(12) United States Patent  
Thomas et al.

(10) Patent No.: US 12,123,014 B2  
(45) Date of Patent: Oct. 22, 2024

(54) CLASS II, TYPE V CRISPR SYSTEMS

(71) Applicant: METAGENOMI, INC., Emeryville, CA (US)

(72) Inventors: Brian Thomas, Emeryville, CA (US); Christopher Brown, Emeryville, CA (US); Audra Devoto, Emeryville, CA (US); Cristina Butterfield, Emeryville, CA (US); Lisa Alexander, Emeryville, CA (US); Daniela S. A. Goltsman, Emeryville, CA (US); Justine Albers, Emeryville, CA (US); Alan Brooks, Emeryville, CA (US); Greg Cost, Emeryville, CA (US); Morayma Temoche-Diaz, Emeryville, CA (US); Cindy Castelle, Emeryville, CA (US); Rebecca Lamothe, Emeryville, CA (US)

(73) Assignee: Metagenomi, Inc., Emeryville, CA (US)

( * ) Notice: Subject to any disclaimer, the term of this patent is extended or adjusted under 35 U.S.C. 154(b) by 0 days.

(21) Appl. No.: 18/302,387

(22) Filed: Apr. 18, 2023

(65) Prior Publication Data

US 2024/0093239 A1 Mar. 21, 2024

Related U.S. Application Data

(63) Continuation of application No. 17/706,466, filed on Mar. 28, 2022, now Pat. No. 11,713,471, which is a continuation of application No. PCT/US2021/021259, filed on Mar. 6, 2021.

(60) Provisional application No. 62/986,477, filed on Mar. 6, 2020, provisional application No. 63/022,276, filed on May 8, 2020, provisional application No. 63/045,815, filed on Jun. 29, 2020, provisional application No. 63/068,316, filed on Aug. 20, 2020, provisional application No. 63/069,699, filed on Aug. 24, 2020, provisional application No. 63/116,157, filed on Nov. 19, 2020.

(51) Int. Cl.
| | |
|---|---|
| *C12N 15/90* | (2006.01) |
| *C12N 9/22* | (2006.01) |
| *C12N 15/10* | (2006.01) |
| *C12N 15/11* | (2006.01) |

(52) U.S. Cl.
CPC ............ *C12N 15/90* (2013.01); *C12N 9/22* (2013.01); *C12N 15/1068* (2013.01); *C12N 15/11* (2013.01); *C12N 15/111* (2013.01); *C12N 15/902* (2013.01); *C12N 15/907* (2013.01); *C12N 2310/20* (2017.05); *C12N 2800/80* (2013.01)

(58) Field of Classification Search
CPC ...... C12N 15/90; C12N 9/22; C12N 15/1068; C12N 15/11; C12N 15/111; C12N 2310/20; C12N 2800/80
See application file for complete search history.

(56) References Cited

U.S. PATENT DOCUMENTS

| | | | |
|---|---|---|---|
| 10,913,941 B2 | 2/2021 | Thomas et al. | |
| 10,982,200 B2 | 4/2021 | Thomas et al. | |
| 11,713,471 B2 | 8/2023 | Thomas et al. | |
| 2018/0371498 A1 | 12/2018 | Gill et al. | |
| 2019/0241954 A1 | 8/2019 | Doudna et al. | |
| 2019/0264186 A1 | 8/2019 | Yamano et al. | |
| 2020/0332273 A1 | 10/2020 | Thomas et al. | |
| 2020/0332274 A1 | 10/2020 | Thomas et al. | |
| 2021/0087555 A1 | 3/2021 | Li et al. | |
| 2022/0033791 A1 | 2/2022 | Thomas et al. | |
| 2023/0227857 A1 | 7/2023 | Thomas et al. | |
| 2023/0416710 A1 | 12/2023 | Thomas et al. | |

FOREIGN PATENT DOCUMENTS

| | | |
|---|---|---|
| CN | 110684823 A | 1/2020 |
| CN | 110904239 A | 3/2020 |
| EP | 3617311 A1 | 3/2020 |
| WO | WO-2012135805 A2 | 10/2012 |
| WO | WO-2015103153 A1 | 7/2015 |
| WO | WO-2016094867 A1 | 6/2016 |
| WO | WO-2016205711 A1 | 12/2016 |
| WO | WO-2017127807 A1 | 7/2017 |
| WO | WO-2017189308 A1 | 11/2017 |
| WO | WO-2017196768 A1 | 11/2017 |
| WO | WO-2018195545 A2 | 10/2018 |
| WO | WO-2018226762 A1 | 12/2018 |
| WO | WO-2019051278 A1 | 3/2019 |
| WO | WO-2019079527 A1 | 4/2019 |
| WO | WO-2019191495 A1 | 10/2019 |
| WO | WO-2020030984 A2 | 2/2020 |
| WO | WO-2020123887 A2 | 6/2020 |
| WO | WO-2020142754 A2 | 7/2020 |
| WO | WO-2020168291 A1 | 8/2020 |
| WO | WO-2021178933 A2 | 9/2021 |
| WO | WO-2021178934 A1 | 9/2021 |

(Continued)

OTHER PUBLICATIONS

Akinc et al. Targeted Delivery of RNAi Therapeutics With Endogenous and Exogenous Ligand-Based Mechanisms. Mol Ther 18(7):1357-1364 (2010).

(Continued)

*Primary Examiner* — Paul J Holland  
(74) *Attorney, Agent, or Firm* — Wilson Sonsini Goodrich & Rosati

(57) ABSTRACT

Described herein are methods, compositions, and systems derived from uncultivated microorganisms useful for gene editing.

28 Claims, 75 Drawing Sheets

Specification includes a Sequence Listing.

(56) References Cited

FOREIGN PATENT DOCUMENTS

| WO | WO-2021226363 A1 | 11/2021 |
|---|---|---|
| WO | WO-2022056324 A1 | 3/2022 |
| WO | WO-2022159742 A1 | 7/2022 |
| WO | WO-2022159758 A1 | 7/2022 |
| WO | WO-2022159892 A1 | 7/2022 |
| WO | WO-2022198080 A1 | 9/2022 |
| WO | WO-2022256462 A1 | 12/2022 |
| WO | WO-2023039377 A1 | 3/2023 |
| WO | WO-2023039378 A1 | 3/2023 |

OTHER PUBLICATIONS

Bale et al.: Isolation and co-culture of rat parenchymal and non-parenchymal liver cells to evaluate cellular interactions and response. Sci Rep. 6:25329, pp. 1-10 doi:10.1038/srep25329 (2016).
Baratta et al.: Cellular organization of normal mouse liver: a histological, quantitative immunocytochemical, and fine structural analysis. Histochemistry and Cell Biology 131:713-726 URL: https://doi.org/10.1007/s00418-009-0577-1 (2009).
Bramsen et al. Development of Therapeutic-Grade Small Interfering RNAs by Chemical Engineering. Front Genet. 3:154 (2012).
Brinkman et al.: Easy quantitative assessment of genome editing by sequence trace decomposition. Nucleic Acids Research 42(22):e168, pp. 1-8 doi:10.1093/nar/gku936 (2014).
Brogna et al.: Nonsense-mediated mRNA decay (NMD) mechanisms. Nat Struct Mol Biol. 16(2):107-113 doi:10.1038/nsmb.1550 (2009).
Bu et al.: CD38 knockout suppresses tumorigenesis in mice and clonogenic growth of human lung cancer cells. Carcinogenesis 39(2):242-251 doi:10.1093/carcin/bgx137 (2018).
Chen at al .: Systematic evaluation of 2'-Fluoro modified chimeric antisense oligonucleotide-mediated exon skipping in vitro. Sci Rep. 9(1):6078 doi:10.1038/s41598-019-42523-0 [1-10](2019).
Chen et al.: Candidate Phyla Radiation Roizmanbacteria From Hot Springs Have Novel and Unexpectedly Abundant CRISPR-Cas Systems. Front Microbiol. 10:928. doi:10.3389/fmicb.2019.00928 [1-14](2019).
Corey. Chemical modification: the key to clinical application of RNA interference? J Clin Invest 117(12):3615-3622 (2007).
CtSkennerton: Mining CRISPRs in Environmental Datasets: Minced. GitHub URL:www.github.com/ctSkennerton/minced [1-4](2019).
Frishberg et al.: Phase 1/2 Study of Lumasiran for Treatment of Primary Hyperoxaluria Type 1: A Placebo-Controlled Randomized Clinical Trial. Clin J Am Soc Nephrol. 16(7):1025-1036 doi:10.2215/CJN.14730920 (2021).
Gasinuas et al.: A catalogue of biochemically diverse CRISPR-Cas9 orthologs. Nat Commun. 11(1):5512:1-10 doi:10.1038/s41467-020-19344-1 (2020).
Geneious Prime nucleic acid analysis software https://www.geneious.com/prime/ (14 pages, retrieved online Apr. 13, 2022).
Goltsman et al.: Novel Type V-A CRISPR Effectors Are Active Nucleases with Expanded Targeting Capabilities. CRISPR J. 3(6):454-461 doi: 10.1089/crispr.2020.0043 (2020).
Hendel, et al. Chemically modified guide RNAs enhance CRISPR-Cas genome editing in human primary cells. Nat Biotechnol. Sep. 2015;33(9):985-9. doi: 10.1038/nbt.3290. Epub Jun. 29, 2015.
Hsiau et al.: Inference of CRISPR Edits from Sanger Trace Data. bioRxiv URL:www.biorxiv.org/content/10.1101/251082v1 [1-14](2018).
Huber et al. Orchestrating High-Throughput Genomic Analysis With Bioconductor. Nat Methods 12(2):115-21 (2015).
Jinek et al. A programmable dual-RNA-guided DNA endonuclease in adaptive bacterial immunity. Science 337(6096):816-821 (2012).
Kararoudi et al.: CD38 deletion of human primary NK cells eliminates daratumumab-induced fratricide and boosts their effector activity. Blood 136(21):2416-2427 doi:10.1182/blood.2020006200 (2020).

Kauffman, et al., "Optimization of Lipid Nanoparticle Formulations for mRNA Delivery in vivo with Fractional Factorial and Definitive Screening Designs," Nano Letters, 15, 2015, pp. 7300-7306.
Kawasaki et al.: Uniformly modified 2'-deoxy-2'-fluoro phosphorothioate oligonucleotides as nuclease-resistant antisense compounds with high affinity and specificity for RNA targets. J Med Chem. 36(7):831-841 (1993).
Kegel et al.: Protocol for Isolation of Primary Human Hepatocytes and Corresponding Major Populations of Non-parenchymal Liver Cells. J Vis Exp. 109(e53069):1-10 doi: 10.3791/53069 (2016).
Kleinstiver et al.: Engineered CRISPR-Cas12a variants with increased activities and improved targeting ranges for gene, epigenetic and base editing. Nature Biotechnology 37(3): 276-282 (2019).
Labun et al.: CHOPCHOP v3: expanding the CRISPR web toolbox beyond genome editing. Nucleic Acids Research 47(W1):W171-W174 doi:10.1093/nar/gkz365 (2019).
Lieber. The mechanism of double-strand DNA break repair by the nonhomologous DNA end-joining pathway. Annu. Rev. Biochem. 79:181-211 (2010).
Liu et al.: C2c1-sgRNA Complex Structure Reveals RNA-Guided DNA Cleavage Mechanism. Mol Cell. 65(2):310-322 doi:10.1016/j.molcel.2016.11.040 (2017).
Liu et al.: Synthetic chimeric nucleases function for efficient genome editing. Nature Communications 10(1): 5524. 11 pages (2019).
Liu, Y. et al., Designer Lipids Advance Systemic siRNA Delivery, Molecular Therapy, 18(4):669-670 (2010).
Love et al., "Lipid-like materials for low-dose in vivo gene silencing", PNAS, Feb. 2, 2010, vol. 107, No. 5, pp. 1864-1869. (Correction included May 25, 2010, vol. 107, No. 21, p. 9915).
Mali et al. RNA-guided human genome engineering via Cas9. Science 339(6121):823-826 (2013).
Martin-Higueras et al.: Glycolate Oxidase Is a Safe and Efficient Target for Substrate Reduction Therapy in a Mouse Model of Primary Hyperoxaluria Type I. Mol Ther. Apr. 2016;24(4):719-725 doi:10.1038/mt.2015.224 (2016).
Mir et al.: Heavily and fully modified RNAs guide efficient SpyCas9-mediated genome editing. Nat Commun. 9(1):2641 doi:10.1038/s41467-018-05073-z [1-9](2018).
Monia et al. Nuclease resistance and antisense activity of modified oligonucleotides targeted to Ha-ras. J Biol Chem 271(24):14533-14540 (1996).
Moon et al.: Recent advances in the CRISPR genome editing tool set. Exp Mol Med. 51(11):1-11 (2019).
NCBI GenBank Accession No. MBI1232615.1: type II CRISPR RNA-guided endonuclease Cas9 [Cytophagales bacterium], 2 pages, published Dec. 18, 2020.
NCBI GenBank Accession No. WP_068647445: Type V CRISPR-associated protein Cas12a/Cpf1 [*Thiomicrospira* sp. XS5], 1 pages, published Oct. 13, 2019.
O'Reilly et al.: Extensive CRISPR RNA modification reveals chemical compatibility and structure-activity relationships for Cas9 biochemical activity. Nucleic Acids Res. 47(2):546-558 (2019).
Pallan et al.: Unexpected origins of the enhanced pairing affinity of 2'-fluoro-modified RNA. Nucleic Acids Res.39(8):3482-3495 (2011).
PCT/US2021/021259 International Search Report and Written Opinion dated Oct. 25, 2021.
PCT/US2021/021260 International Search Report and Written Opinion dated Jun. 24, 2021.
PCT/US2022/013377 International Preliminary Report on Patentability dated Jul. 20, 2023.
PCT/US2022/013377 International Search Report and Written Opinion dated May 11, 2022.
PCT/US2022/013396 International Preliminary Report on Patentability dated Aug. 3, 2023.
PCT/US2022/031849 International Search Report and Written Opinion dated Sep. 5, 2022.
PCT/US2022/075988 International Search Report and Written Opinion dated Feb. 7, 2023.
PCT/US2022/075992 International Search Report and Written Opinion dated Nov. 21, 2022.
ProteinAtlas: Liver Expression Summary, 3 pages, retrieved online Apr. 2022 URL: https://www.proteinatlas.org/ENSG00000130164-LDLR/tissue/liver#imid_2815831 (retrieved online Apr. 2022).

(56) References Cited

OTHER PUBLICATIONS

Raab et al.: The GeneOptimizer Algorithm: using a sliding window approach to cope with the vast sequence space in multiparameter DNA sequence optimization. Syst Synth Biol. 4(3):215-225 (2010).
Ryan et al.: Improving CRISPR-Cas specificity with chemical modifications in single-guide RNAs. Nucleic Acids Res. 46(2):792-803 doi:10.1093/nar/gkx1199 (2018).
Singh et al. Protein Engineering Approaches in the Post-Genomic Era. Curr Protein Pept Sci. 18: 1-11 (2017).
Stella et al.: Class 2 CRISPR-Cas RNA-guided endonucleases: Swiss Army knives of genome editing. Nat Struct Mol Biol. 4(11):882-892 doi:10.1038/nsmb.3486 (2017).
Tang et al.: Class 2 CRISPR/Cas: an expanding biotechnology toolbox for and beyond genome editing. Cell Biosci. 8:59 doi:10.1186/s13578-018-0255-x [1-13](2018).
Taylor et al.: Droplet Digital PCR versus qPCR for gene expression analysis with low abundant targets: from variable nonsense to publication quality data. Sci Rep 2409:1-9 doi:10.1038/s41598-017-02217-x (2017).
Wang et al.: Efficient genome editing by CRISPR-Mb3Cas12a in mice. J Cell Sci. 133(9):jcs240705 [1-8](2020).
Yan et al.: The role of apolipoprotein E in the elimination of liposomes from blood by hepatocytes in the mouse. Biochem Biophys Res Commun. 328(1):57-62 doi:10.1016/j.bbrc.2004.12.137 (2005).
Yang et al.: New CRISPR-Cas systems discovered. Cell Res. 27(3):313-314 doi:10.1038/cr.2017.21 (2017).
Yang et al.: PAM-Dependent Target DNA Recognition and Cleavage by C2c1 CRISPR-Cas Endonuclease. Cell 167(7):1814-1828.e12. doi:10.1016/j.cell.2016.11.053 (2016).
Yin et al., "Structure-guided chemical modification of guide RNA enables potent non-viral in vivo genome editing," Nat. Biotechnol., 35:1179-1187, 2017.
Zetsche et al. Cpf1 is a single RNA-guided endonuclease of a class 2 CRISPR-Cas system. Cell 163:759-771 (2015).
Zetsche et al. Multiplex gene editing by CRISPR-Cpf1 using a single crRNA array. Nature Biotechnology 35:31-34 (2017). Published online Dec. 5, 2016. Corrected after print Jan. 12, 2017.
Zhang et al.: CRISPR-Cpf1 correction of muscular dystrophy mutations in human cardiomyocytes and mice. Sci Adv. 3(4):e1602814:1-10 doi:10.1126/sciadv.1602814 (2017).
Zhang et al.: Propagated Perturbations from a Peripheral Mutation Show Interactions Supporting WW Domain Thermostability. Structure 26(11):1474-1485 doi:10.1016/j.str.2018.07.014 (2018).
Clement, Kendell et al. CRISPResso2 Provides Accurate and Rapid Genome Editing Sequence Analysis. Nature Biotechnology vol. 37,3: 224-226 (2019).
Co-pending U.S. Appl. No. 18/596,189, inventor Thomas; Brian, filed Mar. 5, 2024.
Co-pending U.S. Appl. No. 18/597,260, inventors Brian; C. Thomas et al., filed Mar. 6, 2024.
Friedberg, Iddo, et al., Automated protein function prediction—the genomic challenge. Briefings In Bioinformatics 7 3:225-242 (2006).
Infernal Packages: Infernal: inference of RNA alignments. URL: http://eddylab.org/infernal/ [1-3] [retrieved online May 15, 2024].
Liu, Guanqing, et al., Computational approaches for effective CRISPR guide RNA design and evaluation. Computational and Structural Biotechnology Journal 18:35-44 (2020).
MAFFT: MAFFT version 7: Multiple alignment program for amino acid or nucleotide sequences. URL: https://mafft.cbrc.jp/alignment/software/[1-4][retrieved online May 15, 2024].
Nunez, James K, et al., Genome-wide Programmable Transcriptional Memory By CRISPR-based Epigenome Editing. Cell 184(9):2503-2519.e17 (2021).
Price, Morgan N, et al., FastTree 2—Approximately Maximum-Likelihood Trees for Large Alignments. PLoS One 5(3):e9490, 10 Pages (2010).
Soedinglab: MMseqs2: ultra fast and sensitive search and clustering suite. GitHub URL:https://github.com/soedinglab/MMseqs2 [1-7][retrieved online May 15, 2024].
Thorton, J., et al., From structure to function: Approaches and limitations. Nature structural biology 991-994 (2000).
Uniprotkb/trembl: A1F0PN46 · A0A1F0PN46_9MICC HNH Cas9-type domain-containing protein. *Rothia* sp. HMSC076D04, pp. 1-5 [retrieved online Dec. 1, 2022] URL: https://www.uniprot.org/uniprotkb/A0A1F0PN46/entry (Feb. 15, 2017).
U.S. Appl. No. 18/056,629 Office Action dated Feb. 29, 2024.
Co-pending U.S. Appl. No. 18/524,511, inventors Thomas; Brian et al., filed Nov. 30, 2023.
PCT/US2022/013396 International Search Report and Written Opinion dated Jun. 22, 2022.
U.S. Appl. No. 17/706,466 Non-Final Office Action dated Oct. 31, 2022.
Uniprotkb/trembl: A0A1F0KNW4 · A0A1F0KNW4_9MICC HNHc domain-containing protein. *Rothia* sp. HMSC066H02, pp. 1-5 [retrieved online Dec. 1, 2022] URL: https://www.uniprot.org/uniprotkb/A0A1F0KNW4/entry (Feb. 15, 2017).
Burstein, David et al. New CRISPR-Cas systems from uncultivated microbes. Nature vol. 542,7640: 237-241 (2017).

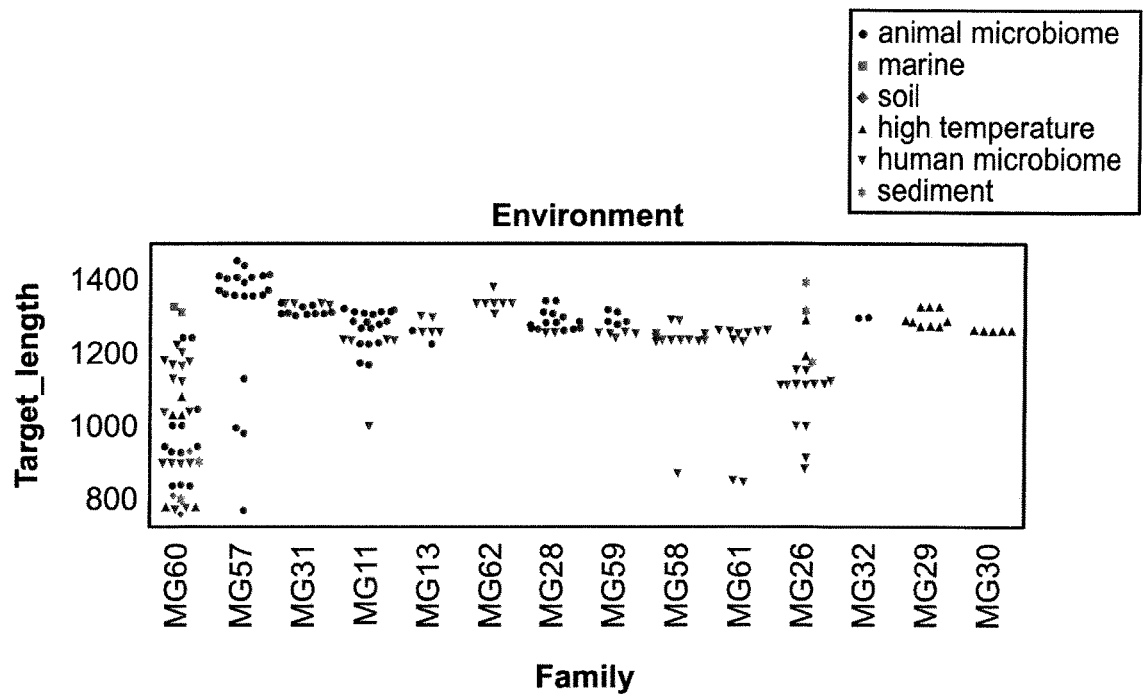
FIG. 5A
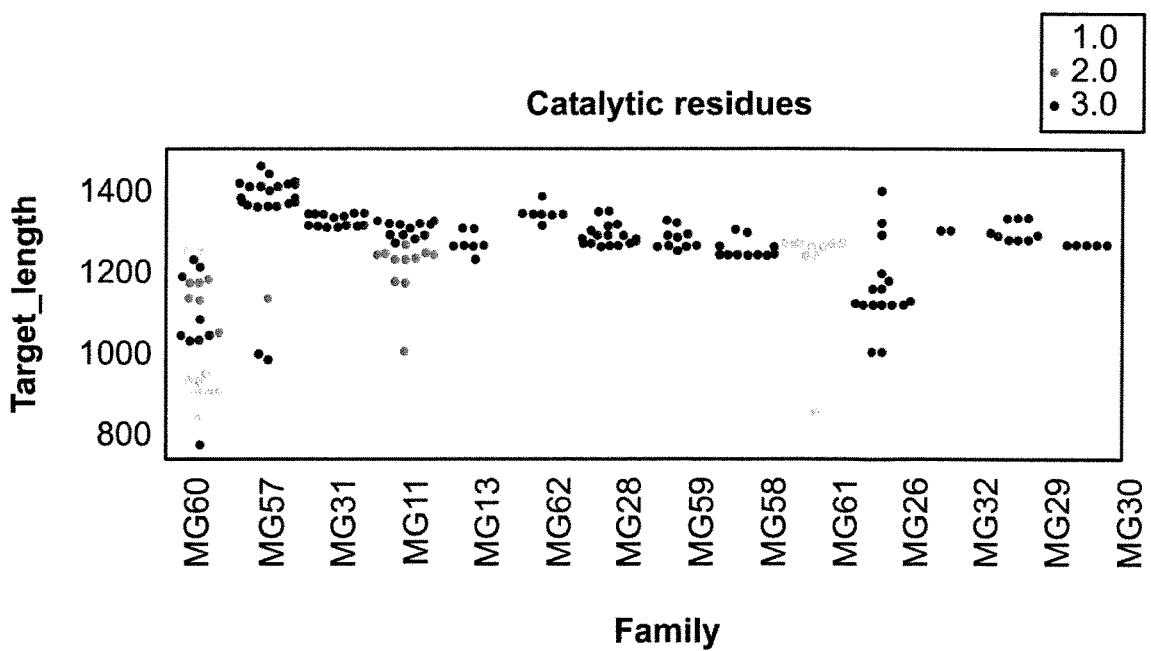
FIG. 5B
FIG. 5

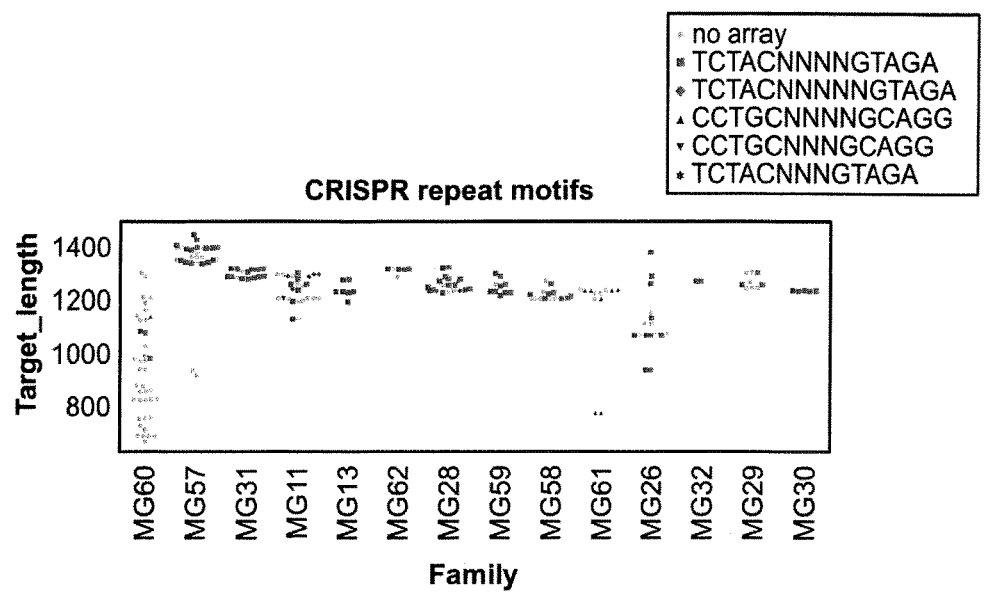
FIG. 5C
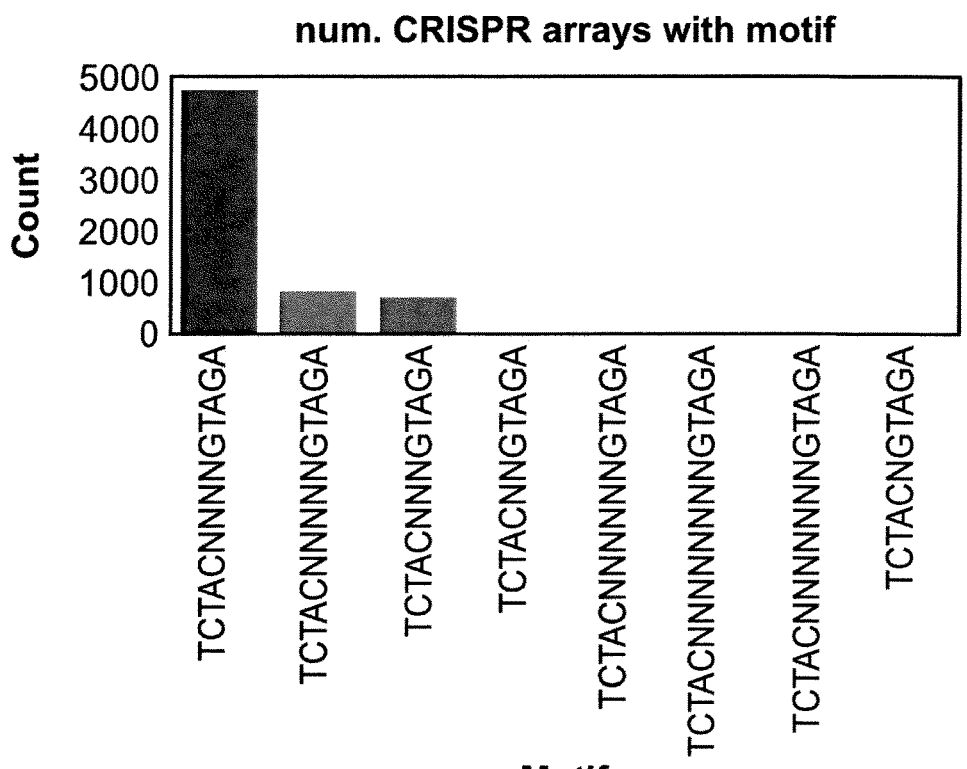
FIG. 5D
FIG. 5 (cont.)

Consensus
Identity

```
                    1,190            1,200            1,210            1,220
                    NNPDVXXIGIDRGERHLLYLTVIBQKGEILEQKSLNEI
```

```
                       912         D917 922          932              942
1 FnCas12a           KANDVHILSIDRGERHLAYYTLVDGKGNIIKQDTFNII
                                            RuvCI
2. CasCas12a         EHPETPIIGIDRGERNLIYITVIDSTGKILEQRSLNTI
3. MbCas12a          QYDEVNVIGIDRGERNHLLYLTVINSKGEILEQCSLNDI
4. LbCas12a          HDDNPYVIGIDRGEKHLLYLYIVVVDGKGNIVEQYSLNEI
5. Cas12a-M26-1      NNPDINIIGVDRGERHLAYYSVINQKSEILRDEKGKLL
6. Cas12a-M29-1      AQDDVHVIGIDRGERHLLYYTVVNGKGEVVEQGSLNQV
7. Cas12a-M30-1      NNPDIKIIGLDRGERHLLYLSLIIDQKGNIIEQYTLNEI
8. Cas12a-M13-1      SAEDTHVIGIDRGERHLLYLYLVVVDSLGHICEQVSLNEI
9. Cas12a-M31-1      NNPDVKIIGIDRGERNLIIYSLINQNGEIELQKTLNIV
10. Cas12a-M28-1     KSDDLHVIGIDRGERHLLYLTVIDMKGNIKKQFSLNEI
11. Cas12a-M32-1     NNPDVNIIGLDRGERNLLYLTLINQKGEILQQKSFNVV
```

```
                    1,280            1,290
                    AZLMIEYNAIVVLEEDLNF
```

```
                       993       E1006 1,003
                    AKLVIEYNAIVVEEDLNF
2.                  VDLMIHYQAVVVLENLNF
3.                  SQLMLKYNAIVVLVVLEDLNF
4.                  CELVEKYDAVIALEDLNS
5.                  ADLAIEHNAIIVLEDLNM
6.                  AQLIVKHNAIVCLEDLNF
7.                  TQMMIEHNAIVVLEDLNF
8.                  AELMIKYRAIVRAIVLENLNG
9.                  AKLMVEQNAIVVMEDLNF
10.                 SELMIEYNAIHIVLEDLNL
11.                 VTLMLEHNAIIVLEDLNS
```

```
                    1,590            1,600            1,610
                    XXLPKDADANGAYHIALKGLWLLQQIKNSD
```

```
                       1,248 1,254 D1255 1,264              1,274
                    KNMPQDADANGAYHIGLKGLMLLGRIKNNQ
                          Nuc
2.                  -EWPMDADANGAYHIALKGQLLNHLKESK
3.                  DTQPQNADANGAYHIALKGLWLLNELKNSD
4.                  AILPKNADANGAYNIARKVLWAIGQFKKAE
5.                  ENLPKNGDDNGAYNIARKGIILLQKIDAWE
6.                  DKQPKNADANGAYHIALKGLWNLQQIRQHD
7.                  PSEPKDADANGAYHIALKGLWALRTINAYD
8.                  HSMPENADANGAYNIARKGLMIIEQLKSTK
9.                  SKFPVDADANGAYNIARKGLYLLQNNFNLN
10.                 KSMPENADANGAYNIARKGLMIIDKIKKSK
11.                 -KLPIDADANGAYHIALKGLWYLKNDFNRD
```

FIG 6A

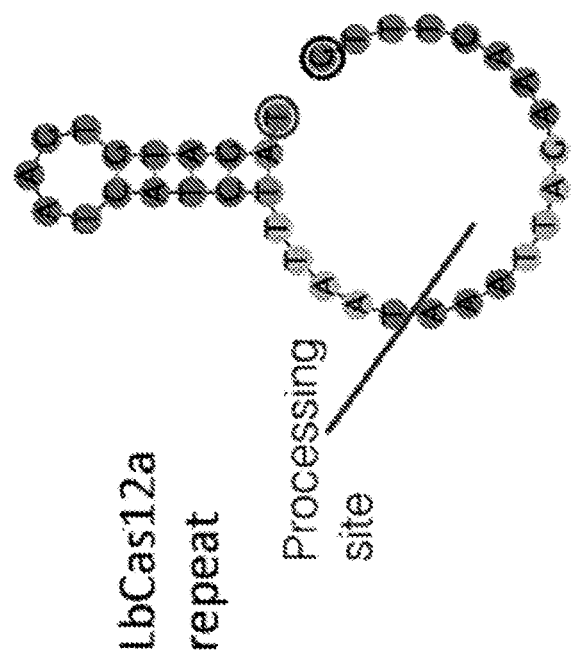
*FIG. 10A*
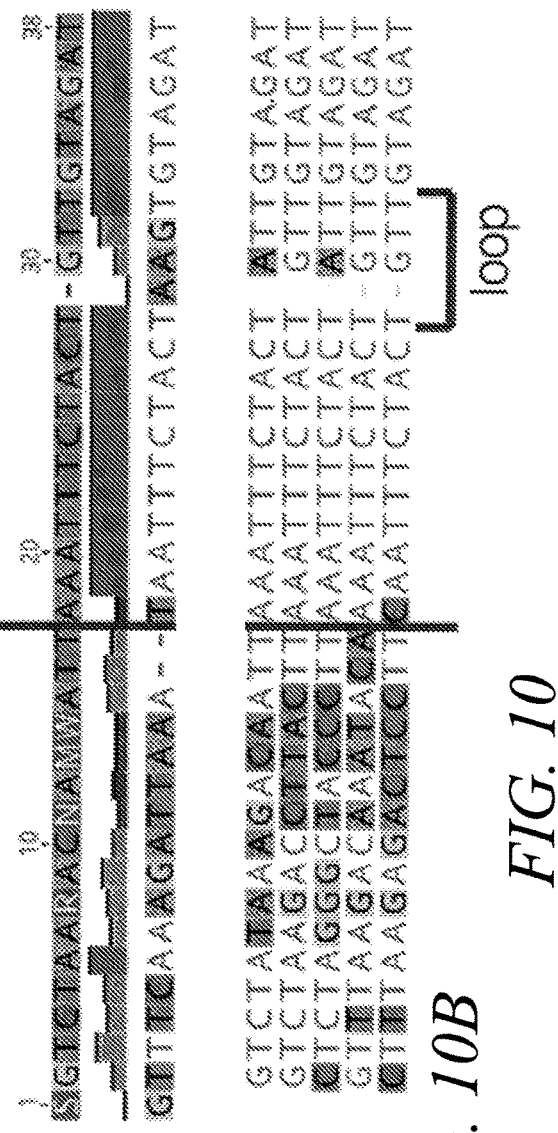
*FIG. 10B*
*FIG. 10*

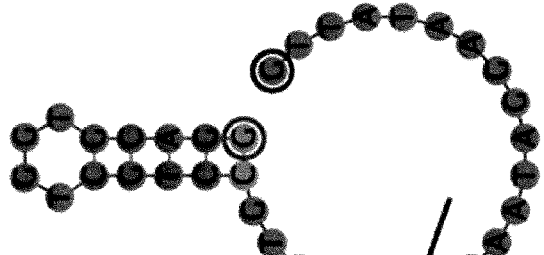
Cas12a-M61-2 repeat
Putative processing site
FIG. 10C
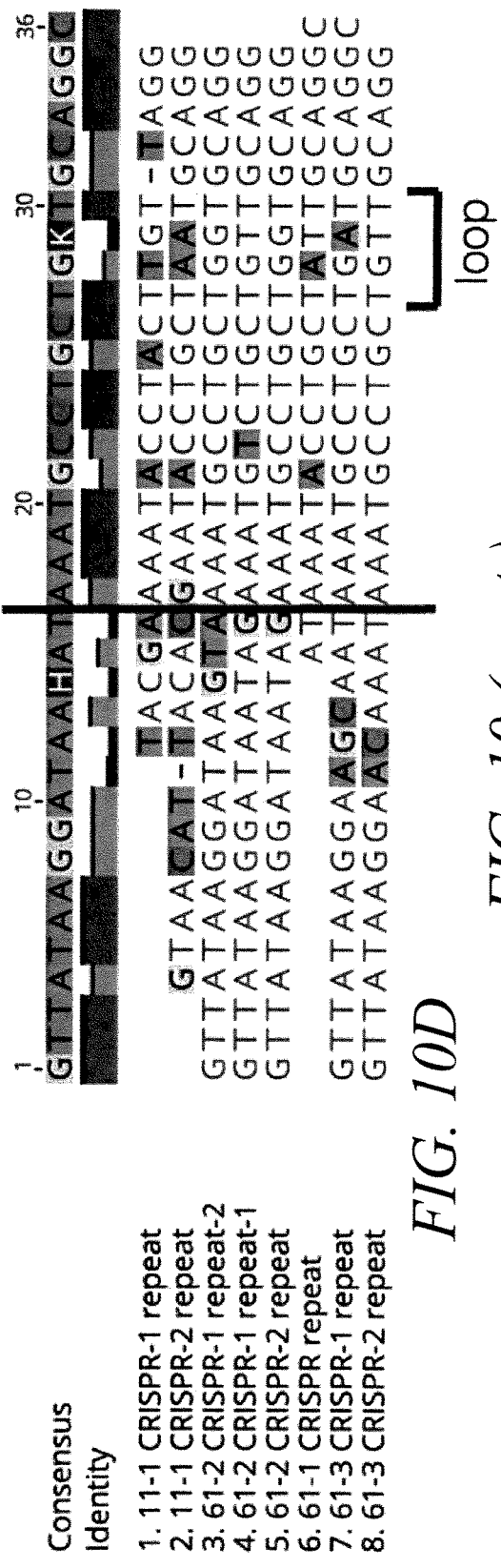
FIG. 10D
FIG. 10 (cont.)

MG53-1 sgRNA3

MG53-1 sgRNA4

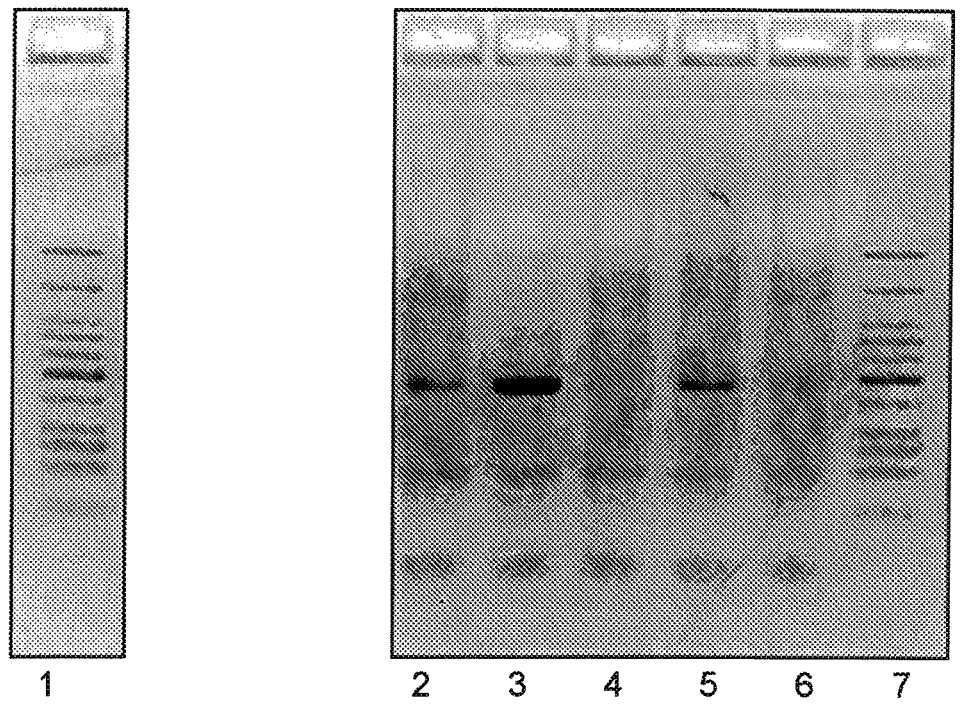
FIG. 17A
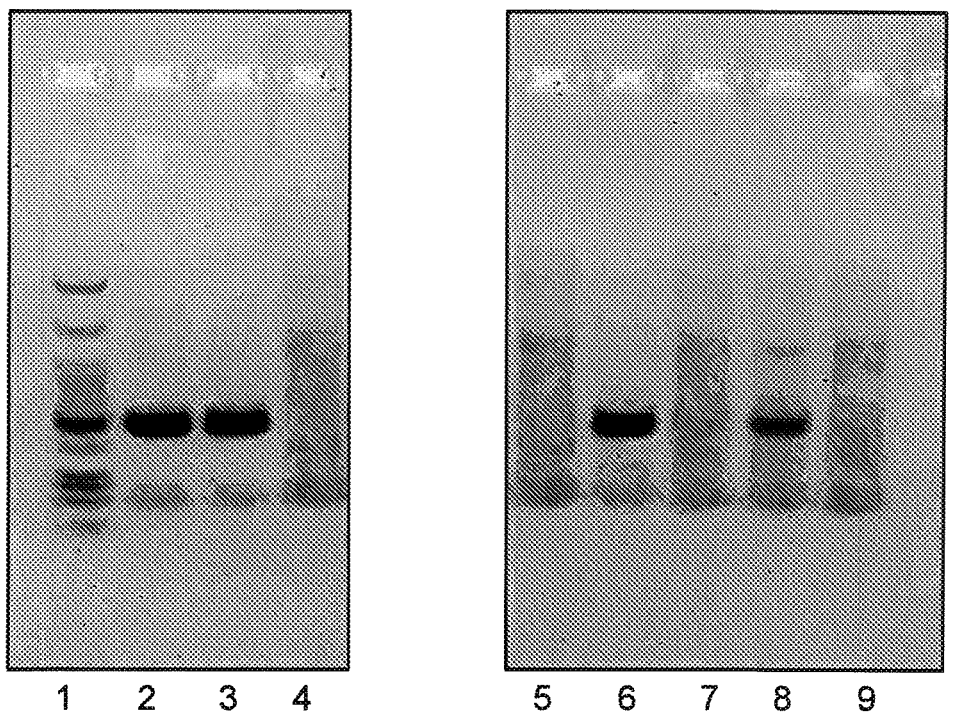
FIG. 17B
FIG. 17

MG31-1 Synthetic PAM

MG32-1 Synthetic PAM

MG29-1 Synthetic PAM

MG28-1 Synthetic PAM

MG57-1 Synthetic PAM

MG57-2 Synthetic PAM

MG59-1 Synthetic PAM

MG77-1 Synthetic PAM

MG77-2 Synthetic PAM

MG78-1 Synthetic PAM

MG59-2 Synthetic PAM

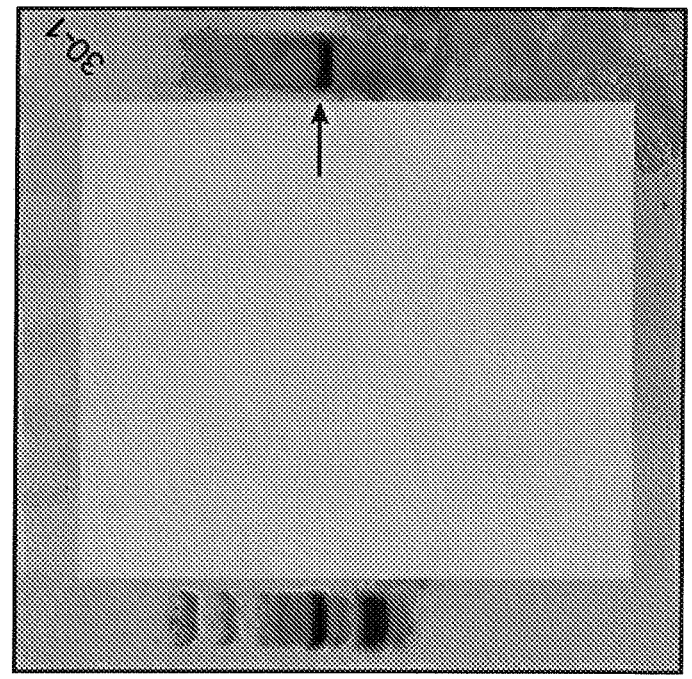
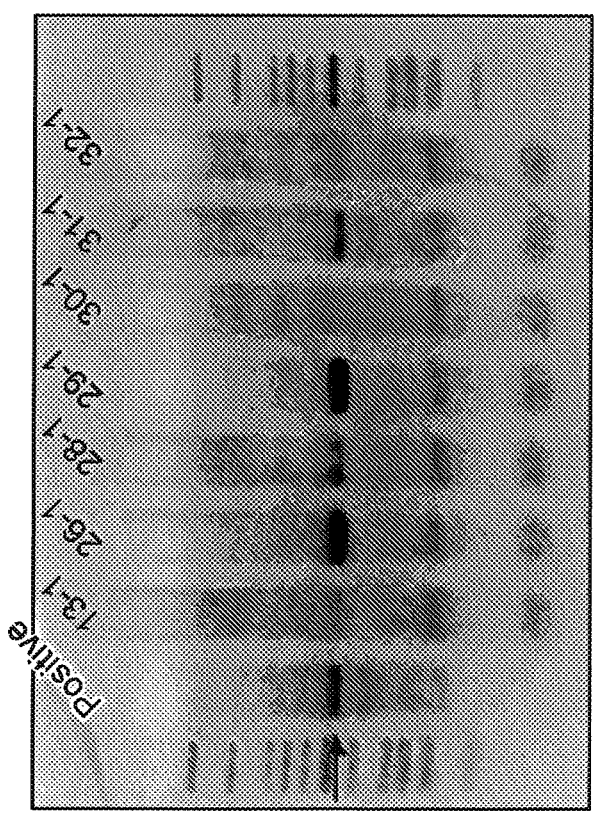
FIG. 26A
FIG. 26B
FIG. 26

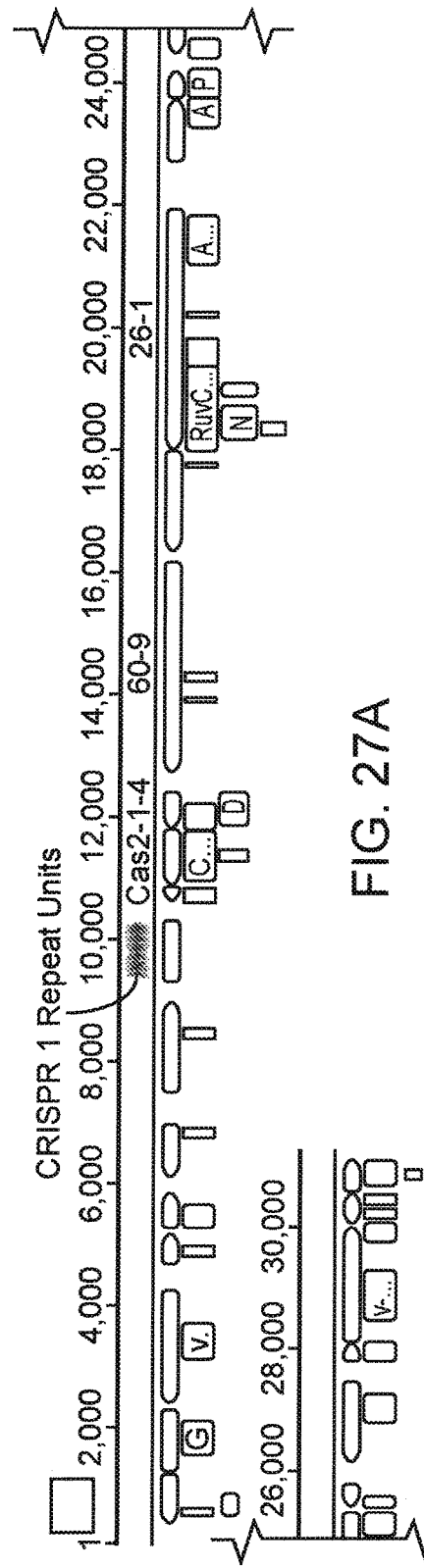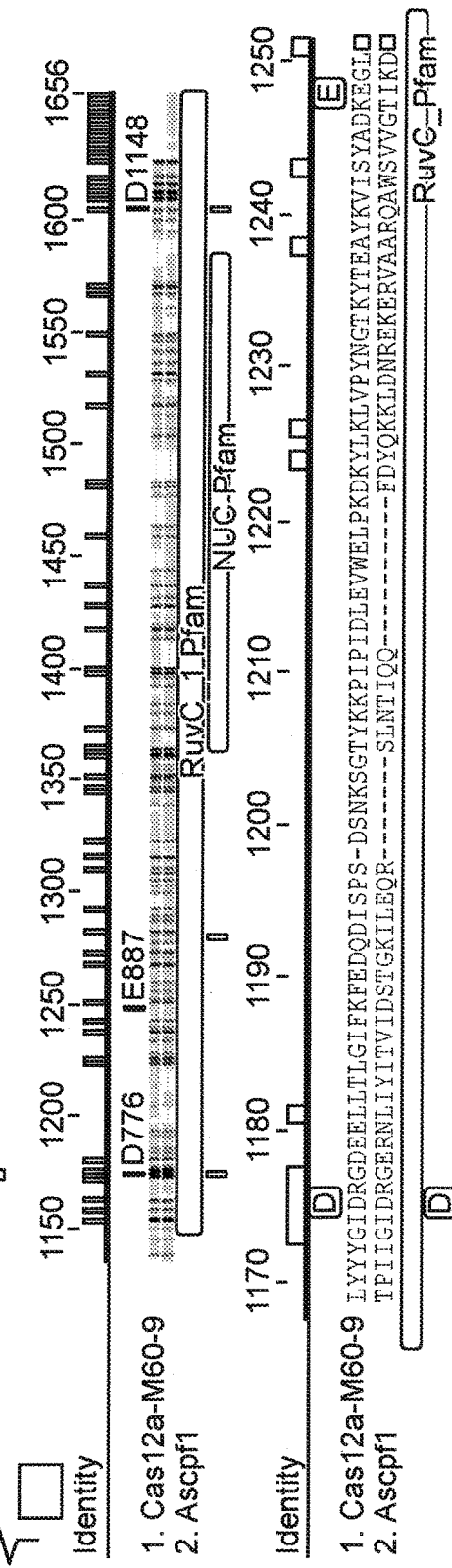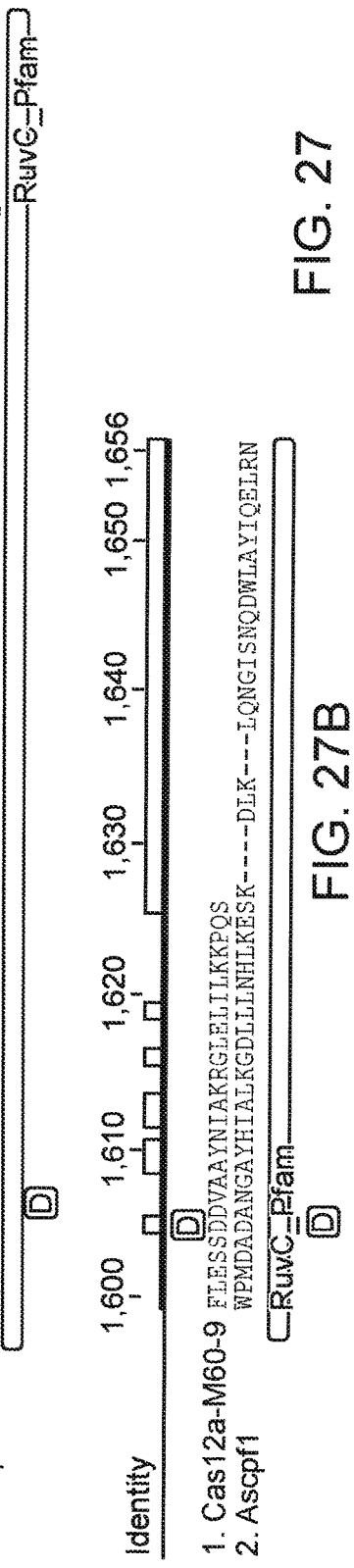
FIG. 27A
FIG. 27B
FIG. 27

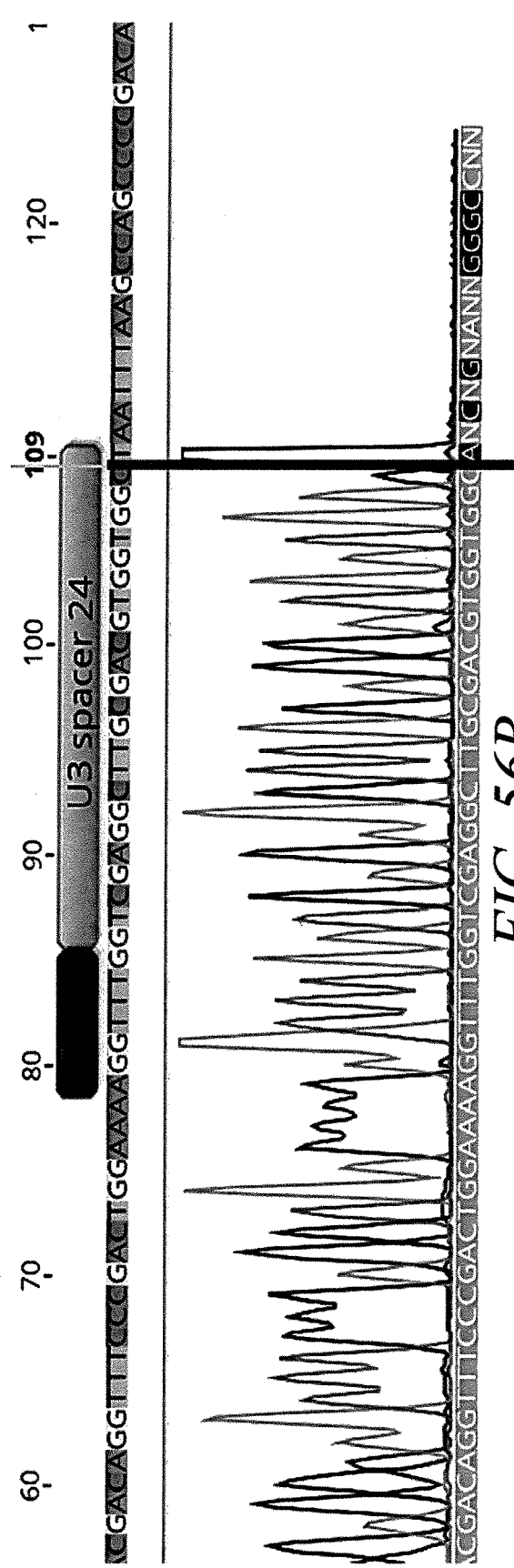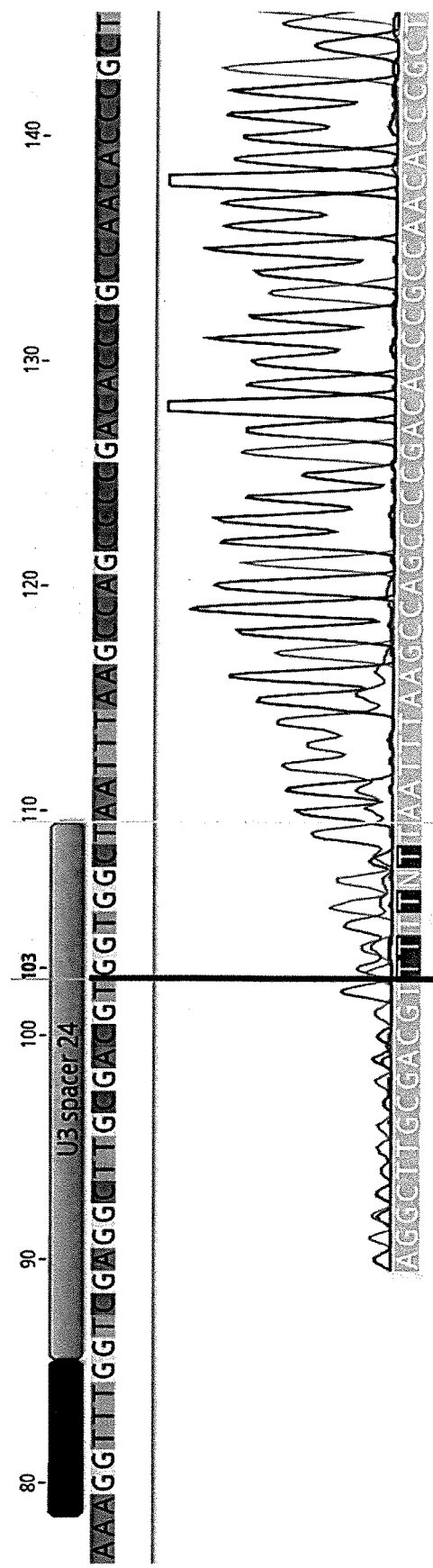
FIG. 56B
FIG. 56C
FIG. 56 (cont.)

CLASS II, TYPE V CRISPR SYSTEMS

CROSS-REFERENCE

This application is a continuation application which claims the benefit of U.S. Non-Provisional application Ser. No. 17/706,466, filed Mar. 28, 2022, now U.S. Pat. No. 11,713,471, entitled "CLASS II, TYPE V CRISPR SYSTEMS", which is a continuation of International Application No. PCT/US2021/021259 filed on Mar. 6, 2021 which claims the benefit of U.S. Provisional Application No. 62/986,477, filed on Mar. 6, 2020, entitled "CLASS II, TYPE V CRISPR SYSTEMS", U.S. Provisional Application No. 63/022,276, filed on May 8, 2020, entitled "CLASS II, TYPE V CRISPR SYSTEMS", U.S. Provisional Application No. 63/045,815, filed on Jun. 29, 2020, entitled "CLASS II, TYPE V CRISPR SYSTEMS", U.S. Provisional Application No. 63/068,316, filed on Aug. 20, 2020, entitled "CLASS II, TYPE V CRISPR SYSTEMS", U.S. Provisional Application No. 63/069,699, filed on Aug. 24, 2020, entitled "CLASS II, TYPE V CRISPR SYSTEMS", U.S. Provisional Application No. 63/116,157, filed on Nov. 19, 2020, entitled "CLASS II, TYPE V CRISPR SYSTEMS", each of which is incorporated by reference herein in its entirety.

BACKGROUND

Cas enzymes along with their associated Clustered Regularly Interspaced Short Palindromic Repeats (CRISPR) guide ribonucleic acids (RNAs) appear to be a pervasive (~45% of bacteria, ~84% of archaea) component of prokaryotic immune systems, serving to protect such microorganisms against non-self nucleic acids, such as infectious viruses and plasmids by CRISPR-RNA guided nucleic acid cleavage. While the deoxyribonucleic acid (DNA) elements encoding CRISPR RNA elements may be relatively conserved in structure and length, their CRISPR-associated (Cas) proteins are highly diverse, containing a wide variety of nucleic acid-interacting domains. While CRISPR DNA elements have been observed as early as 1987, the programmable endonuclease cleavage ability of CRISPR/Cas complexes has only been recognized relatively recently, leading to the use of recombinant CRISPR/Cas systems in diverse DNA manipulation and gene editing applications.

SEQUENCE LISTING

The instant application contains a Sequence Listing which has been submitted electronically in XML format and is hereby incorporated by reference in its entirety. Said XML copy, created on Oct. 16, 2023, is named 55921-710-303_Replacement_SL_2.xml and is 11,621,051 bytes in size, and is incorporated by references as if written herein in its entirety.

SUMMARY

In some aspects, the present disclosure provides for an engineered nuclease system comprising: (a) an endonuclease comprising a RuvC domain, wherein the endonuclease is derived from an uncultivated microorganism, and wherein the endonuclease is a Cas12a endonuclease; and (b) an engineered guide RNA, wherein the engineered guide RNA is configured to form a complex with the endonuclease and the engineered guide RNA comprises a spacer sequence configured to hybridize to a target nucleic acid sequence. In some embodiments, the Cas12a endonuclease comprises the sequence GWxxxK. In some embodiments, the engineered guide RNA comprises UCUAC[$N_{3-5}$]GUAGAU ($N_4$). In some embodiments, the engineered guide RNA comprises CCUGC[$N_4$]GCAGG ($N_{3-4}$). In some aspects, the present disclosure provides for an engineered nuclease system comprising: (a) an endonuclease having at least 75% sequence identity to any one of SEQ ID NOs: 1-3470 or a variant thereof; and (b) an engineered guide RNA, wherein the engineered guide RNA is configured to form a complex with the endonuclease and the engineered guide RNA comprises a spacer sequence configured to hybridize to a target nucleic acid sequence. In some embodiments, the endonuclease comprises a RuvCI, II, or III domain. In some embodiments, the endonuclease has at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, at least about 99% identity to a RuvCI, II, or III domain of any one of SEQ ID NOs: 1-3470 or a variant thereof. In some embodiments, the RuvCI domain comprises a D catalytic residue. In some embodiments the RuvCII domain comprises an E catalytic residue. In some embodiments the RuvCIII domain comprises a D catalytic residue. In some embodiments, said RuvC domain does not have nuclease activity. In some embodiments, said endonuclease further comprises a WED II domain having at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, at least about 99% identity to a WED II domain of any one of SEQ ID NOs: 1-3470 or a variant thereof. In some aspects, the present disclosure provides for an engineered nuclease system comprising: (a) an endonuclease configured to bind to a protospacer adjacent motif (PAM) sequence comprising any one of SEQ ID NOs: 3862-3913, wherein the endonuclease is a class 2, type V Cas endonuclease; and (b) an engineered guide RNA, wherein the engineered guide RNA is configured to form a complex with the endonuclease and the engineered guide RNA comprises a spacer sequence configured to hybridize to a target nucleic acid sequence. In some embodiments, the endonuclease further comprises a zinc finger-like domain. In some embodiments, the guide RNA comprises a sequence with at least 80% sequence identity to the non-degenerate nucleotides of any one of SEQ ID NOs: 3471, 3551-3559, 3608-3609, 3612, 3636-3637, 3640-3641, 3644-3645, 3648-3649, 3652-3653, 3656-3657, 3660-3661, 3664-3667, 3671-3672, -3678, 3695-3696, 3729-3730, 3734-3735, and 3851-3857. In some aspects, the present disclosure provides for an engineered nuclease system comprising: (a) an engineered guide RNA comprising a sequence with at least 80% sequence identity to the non-degenerate nucleotides of any one of SEQ ID NOs: 3471, 3539, 3551-3559, 3608-3609, 3612, 3636-3637, 3640-3641, 3644-3645, 3648-3649, 3652-3653, 3656-3657, 3660-3661, 3664-3667, 3671-3672, 3677-3678, 3695-3696, 3729-3730, 3734-3735, or 3851-3857, and (b) a class 2, type V Cas endonuclease configured to bind to the engineered guide RNA. In some embodiments, the endonuclease is configured to bind to a protospacer adjacent motif (PAM) sequence comprising any one of SEQ ID NOs: 3863-3913. In some embodiments, the guide RNA comprises a sequence complementary to a eukaryotic, fungal, plant, mammalian, or human genomic polynucleotide sequence. In some embodiments, the guide RNA is 30-250 nucleotides in length. In some embodiments, the endonuclease comprises one or more nuclear localization sequences (NLSs) proximal to an N- or C-terminus of the endonuclease. In some embodiments, the NLS comprises a sequence at least 80% identical to a sequence from the group consisting of SEQ ID NO: 3938-3953. In some embodiments, the endonuclease comprises at least one of the following mutations: S168R, E172R, N577R, or Y170R when a sequence of the endonuclease is optimally aligned to SEQ ID NO: 215. In some embodiments, the endonuclease comprises the mutations S168R and E172R when a sequence of the endonuclease is optimally aligned to SEQ ID NO: 215. In some embodiments, the endonuclease comprises the mutations N577R or Y170R when a sequence of the endonuclease is optimally aligned to SEQ ID NO: 215. In some embodiments, the endonuclease comprises the mutation S168R when a sequence of the endonuclease is optimally aligned to SEQ ID NO: 215. In some embodiments, the endonuclease does not comprise a mutation of E172, N577, or Y170. In some embodiments, the engineered nuclease system further comprises
a single- or double-stranded DNA repair template comprising from 5' to 3': a first homology arm comprising a sequence of at least 20 nucleotides 5' to the target deoxyribonucleic acid sequence, a synthetic DNA sequence of at least 10 nucleotides, and a second homology arm comprising a sequence of at least 20 nucleotides 3' to the target sequence. In some embodiments, the first or second homology arm comprises a sequence of at least 40, 80, 120, 150, 200, 300, 500, or 1,000 nucleotides. In some embodiments, the first and second homology arms are homologous to a genomic sequence of a prokaryote, bacteria, fungus, or eukaryote. In some embodiments, the single- or double-stranded DNA repair template comprises a transgene donor. In some embodiments, the engineered nuclease system further comprises a DNA repair template comprising a double-stranded DNA segment flanked by one or two single-stranded DNA segments. In some embodiments, single-stranded DNA segments are conjugated to the 5' ends of the double-stranded DNA segment. In some embodiments, the single stranded DNA segments are conjugated to the 3' ends of the double-stranded DNA segment. In some embodiments, the single-stranded DNA segments have a length from 4 to 10 nucleotide bases. In some embodiments, the single-stranded DNA segments have a nucleotide sequence complementary to a sequence within the spacer sequence. In some embodiments, the double-stranded DNA sequence comprises a barcode, an open reading frame, an enhancer, a promoter, a protein-coding sequence, a miRNA coding sequence, an RNA coding sequence, or a transgene. In some embodiments, the double-stranded DNA sequence is flanked by a nuclease cut site. In some embodiments, the nuclease cut site comprises a spacer and a PAM sequence. In some embodiments, the system further comprises a source of $Mg^{2+}$. In some embodiments, the guide RNA comprises a hairpin comprising at least 8, at least 10, or at least 12 base-paired ribonucleotides. In some embodiments, the hairpin comprises 10 base-paired ribonucleotides. In some embodiments: (a) the endonuclease comprises a sequence at least 75%, 80%, or 90% identical to any one of SEQ ID NOs: 141, 215, 229, 261, or 1711-1721 or a variant thereof; and (b) the guide RNA structure comprises a sequence at least 80%, or 90% identical to the non-degenerate nucleotides of any one of SEQ ID NOs: 3608-3609, 3853, or 3851-3857. In some embodiments, the endonuclease is configured to bind to a PAM comprising any one of SEQ ID NOs: 3863-3913. In some embodiments, the endonuclease is configured to bind to a PAM comprising SEQ ID NO: 3871. In some embodiments, the sequence identity is determined by a BLASTP, CLUSTALW, MUSCLE, MAFFT algorithm, or a CLUSTALW algorithm with the Smith-Waterman homology search algorithm parameters. In some embodiments, the sequence identity is determined by the BLASTP homology search algorithm using parameters of a word-length (W) of 3, an expectation (E) of 10, and a BLOSUM62 scoring matrix setting gap costs at existence of 11, extension of 1, and using a conditional compositional score matrix adjustment.

In some aspects, the present disclosure provides for an engineered guide RNA comprising: (a) a DNA-targeting segment comprising a nucleotide sequence that is complementary to a target sequence in a target DNA molecule; and (b) a protein-binding segment comprising two complementary stretches of nucleotides that hybridize to form a double-stranded RNA (dsRNA) duplex, wherein the two complementary stretches of nucleotides are covalently linked to one another with intervening nucleotides, and wherein the engineered guide ribonucleic acid polynucleotide is capable of forming a complex with an endonuclease having at least 75% sequence identity to any one of SEQ ID NOs: 1-3470, and targeting the complex to the target sequence of the target DNA molecule. In some embodiments, the DNA-targeting segment is positioned 3' of both of the two complementary stretches of nucleotides. In some embodiments, the protein binding segment comprises a sequence having at least 70%, at least 80%, or at least 90% identity to the non-degenerate nucleotides of SEQ ID NO: 3608-3609. In some embodiments, the double-stranded RNA (dsRNA) duplex comprises at least 5, at least 8, at least 10, or at least 12 ribonucleotides.

In some aspects, the present disclosure provides for a deoxyribonucleic acid polynucleotide encoding the engineered guide ribonucleic acid polynucleotide described herein.

In some aspects, the present disclosure provides for a nucleic acid comprising an engineered nucleic acid sequence optimized for expression in an organism, wherein the nucleic acid encodes a class 2, type V Cas endonuclease, and wherein the endonuclease is derived from an uncultivated microorganism, wherein the organism is not the uncultivated organism. In some embodiments, the endonuclease comprises a variant having at least 70% or at least 80% sequence identity to any one of SEQ ID NOs: 1-3470. In some embodiments, the endonuclease comprises a sequence encoding one or more nuclear localization sequences (NLSs) proximal to an N- or C-terminus of the endonuclease. In some embodiments, the NLS comprises a sequence selected from SEQ ID NOs: 3938-3953. In some embodiments, the NLS comprises SEQ ID NO: 3939. In some embodiments, the NLS is proximal to the N-terminus of the endonuclease. In some embodiments, the NLS comprises SEQ ID NO: 3938. In some embodiments, the NLS is proximal to the C-terminus of the endonuclease. In some embodiments, the organism is prokaryotic, bacterial, eukaryotic, fungal, plant, mammalian, rodent, or human.

In some aspects, the present disclosure provides for an engineered vector comprising a nucleic acid sequence encoding a class 2, type V Cas endonuclease or a Cas12a endonuclease, wherein the endonuclease is derived from an uncultivated microorganism.

In some aspects, the present disclosure provides for an engineered vector comprising a nucleic acid described herein.

In some aspects, the present disclosure provides for an engineered vector comprising a deoxyribonucleic acid polynucleotide described herein. In some embodiments, the vector is a plasmid, a minicircle, a CELiD, an adeno-associated virus (AAV) derived virion, a lentivirus, or an adenovirus.

In some aspects, the present disclosure provides for a cell comprising a vector described herein.

In some aspects, the present disclosure provides for a method of manufacturing an endonuclease, comprising cultivating any of the host cells described herein.

In some aspects, the present disclosure provides for a method for binding, cleaving, marking, or modifying a double-stranded deoxyribonucleic acid polynucleotide, comprising: (a) contacting the double-stranded deoxyribonucleic acid polynucleotide with a class 2, type V Cas endonuclease in complex with an engineered guide RNA configured to bind to the endonuclease and the double-stranded deoxyribonucleic acid polynucleotide; (b) wherein the double-stranded deoxyribonucleic acid polynucleotide comprises a protospacer adjacent motif (PAM); and (c) wherein the PAM comprises a sequence comprising any one of SEQ ID NOs: 3863-3913. In some embodiments, the double-stranded deoxyribonucleic acid polynucleotide comprises a first strand comprising a sequence complementary to a sequence of the engineered guide RNA and a second strand comprising the PAM. In some embodiments, the PAM is directly adjacent to the 5' end of the sequence complementary to the sequence of the engineered guide RNA. In some embodiments, the PAM comprises SEQ ID NO: 3871. In some embodiments, the class 2, type V Cas endonuclease is derived from an uncultivated microorganism. In some embodiments, the double-stranded deoxyribonucleic acid polynucleotide is a eukaryotic, plant, fungal, mammalian, rodent, or human double-stranded deoxyribonucleic acid polynucleotide. In some embodiments, the method comprising delivering to the target nucleic acid locus the engineered nuclease system of any one of claims [0004]-26, wherein the endonuclease is configured to form a complex with the engineered guide ribonucleic acid structure, and wherein the complex is configured such that upon binding of the complex to the target nucleic acid locus, the complex modifies the target nucleic acid locus. In some embodiments, modifying the target nucleic acid locus comprises binding, nicking, cleaving, or marking the target nucleic acid locus. In some embodiments, the target nucleic acid locus comprises deoxyribonucleic acid (DNA) or ribonucleic acid (RNA). In some embodiments, the target nucleic acid comprises genomic DNA, viral DNA, viral RNA, or bacterial DNA. In some embodiments, the target nucleic acid locus is in vitro. In some embodiments, the target nucleic acid locus is within a cell. In some embodiments, the cell is a prokaryotic cell, a bacterial cell, a eukaryotic cell, a fungal cell, a plant cell, an animal cell, a mammalian cell, a rodent cell, a primate cell, a human cell, or a primary cell. In some embodiments, the cell is a primary cell. In some embodiments, the primary cell is a T cell. In some embodiments, the primary cell is a hematopoietic stem cell (HSC). In some embodiments, delivering the engineered nuclease system to the target nucleic acid locus comprises delivering the nucleic acid of any of claims [0007]-[0008] or the vector of any of claims [0008]-[0011]. In some embodiments, delivering the engineered nuclease system to the target nucleic acid locus comprises delivering a nucleic acid comprising an open reading frame encoding the endonuclease. In some embodiments, the nucleic acid comprises a promoter to which the open reading frame encoding the endonuclease is operably linked. In some embodiments, delivering the engineered nuclease system to the target nucleic acid locus comprises delivering a capped mRNA containing the open reading frame encoding the endonuclease. In some embodiments, delivering the engineered nuclease system to the target nucleic acid locus comprises delivering a translated polypeptide. In some embodiments, delivering the engineered nuclease system to the target nucleic acid locus comprises delivering a deoxyribonucleic acid (DNA) encoding the engineered guide RNA operably linked to a ribonucleic acid (RNA) pol III promoter. In some embodiments, the endonuclease induces a single-stranded break or a double-stranded break at or proximal to the target locus. In some embodiments, the endonuclease induces a staggered single stranded break within or 3' to the target locus.

In some aspects, the present disclosure provides for a method of editing a TRAC locus in a cell, comprising contacting to the cell (a) an RNA-guided endonuclease; and (b) an engineered guide RNA, wherein the engineered guide RNA is configured to form a complex with the endonuclease and the engineered guide RNA comprises a spacer sequence configured to hybridize to a region of the TRAC locus, wherein the engineered guide RNA comprises a targeting sequence having at least 85% identity at least 18 consecutive nucleotides of any one of SEQ ID NOs: 4316-4369. In some embodiments, the RNA-guided nuclease is a Cas endonuclease. In some embodiments, the Cas endonuclease is a class 2, type V Cas endonuclease. In some embodiments, the class 2, type V Cas endonuclease comprises a RuvC domain comprising a RuvCI subdomain, a RuvCII subdomain, and a RuvCIII subdomain. In some embodiments, the class 2, type V Cas endonuclease comprises an endonuclease having at least 75% sequence identity to any one of SEQ ID NOs: 1-3470 or a variant thereof. In some embodiments, the engineered guide RNA further comprises a sequence with at least 80% sequence identity to at least 19 of the non-degenerate nucleotides of any one of SEQ ID NOs: 3471, 3539, 3551-3559, 3608-3609, 3612, 3636-3637, 3640-3641, 3644-3645, 3648-3649, 3652-3653, 3656-3657, 3660-3661, 3664-3667, 3671-3672, 3677-3678, 3695-3696, 3729-3730, 3734-3735, and 3851-3857. In some embodiments, the endonuclease comprises a sequence at least 75%, 80%, or 90% identical to any one of SEQ ID NOs: 141, 215, 229, 261, or 1711-1721 or a variant thereof. In some embodiments, the guide RNA structure comprises a sequence at least 80%, or at least 90% identical to at least 19 of the non-degenerate nucleotides of any one of SEQ ID NOs: 3608-3609, 3853, or 3851-3857. In some embodiments, the method further comprises contacting to the cell or introducing to the cell a donor nucleic acid comprising a cargo sequence flanked on a 3' or 5' end by sequence having at least 80% identity to any one of SEQ ID NOs: 4424 or 4425. In some embodiments, the cell is a peripheral blood mononuclear cell (PBMC). In some embodiments, the cell is a T-cell or a precursor thereof or a hematopoietic stem cell (HSC). In some embodiments, the cargo sequence comprises a sequence encoding a T-cell receptor polypeptide, a CAR-T polypeptide, or a fragment or derivative thereof. In some embodiments, the engineered guide RNA comprises a sequence having at least 80% identity to any one of SEQ ID NOs:4370-4423. In some embodiments, the engineered guide RNA comprises the nucleotide sequence of sgRNAs 1-54 from Table 5A comprising the corresponding chemical modifications listed in Table 5A. In some embodiments, the engineered guide RNA comprises a targeting sequence having at least 80% sequence identity to any one of SEQ ID NOs: 4334, 4350, or 4324. In some embodiments, the engineered guide RNA comprises a sequence having at least 80% sequence identity to any one of SEQ ID NOs: 4388, 4404, or 4378. In some embodiments, the engineered guide RNA comprises the nucleotide sequence of sgRNAs 9, 35, or 19 from Table 5A.

In some aspects, the present disclosure provides for an engineered nuclease system comprising: (a) an RNA-guided endonuclease; and (b) an engineered guide RNA, wherein the engineered guide RNA is configured to form a complex with the endonuclease and the engineered guide RNA comprises a spacer sequence configured to hybridize to a target nucleic acid sequence, wherein the engineered guide RNA comprises at least one of the following modifications: (i) a 2'-O methyl or a 2'-fluoro base modification of at least one nucleotide within the first 4 bases of the 5' end of the engineered guide RNA or the last 4 bases of a 3' end of the engineered guide RNA; (ii) a thiophosphate (PS) linkage between at least 2 of the first five bases of a 5' end of the engineered guide RNA, or a thiophosphate linkage between at least two of the last five bases of a 3' end of the engineered guide RNA; (iii) a thiophosphate linkage within a 3' stem or a 5' stem of the engineered guide RNA; (iv) a 2'-O methyl or 2'base modification within a 3' stem or a 5' stem of the engineered guide RNA; (v) a 2'-fluoro base modification of at least 7 bases of a spacer region of the engineered guide RNA; and (vi) a thiophosphate linkage within a loop region of the engineered guide RNA. In some embodiments, the engineered guide RNA comprises a 2'-O methyl or a 2'-fluoro base modification of at least one nucleotide within the first 5 bases of a 5' end of the engineered guide RNA or the last 5 bases of a 3' end of the engineered guide RNA. In some embodiments, the engineered guide RNA comprises a 2'-O methyl or a 2'-fluoro base modification at a 5' end of the engineered guide RNA or a 3' end of the engineered guide RNA. In some embodiments, the engineered guide RNA comprises a thiophosphate (PS) linkage between at least 2 of the first five bases of a 5' end of the engineered guide RNA, or a thiophosphate linkage between at least two of the last five bases of a 3' end of the engineered guide RNA. In some embodiments, the engineered guide RNA comprises a thiophosphate linkage within a 3' stem or a 5' stem of the engineered guide RNA. In some embodiments, the engineered guide RNA comprises a 2'-O methyl base modification within a 3' stem or a 5' stem of the engineered guide RNA. In some embodiments, the engineered guide RNA comprises a 2'-fluoro base modification of at least 7 bases of a spacer region of the engineered guide RNA. In some embodiments, the engineered guide RNA comprises a thiophosphate linkage within a loop region of the engineered guide RNA. In some embodiments, the engineered guide RNA comprises at least three 2'-O methyl or 2'-fluoro bases at the 5' end of the engineered guide RNA, two thiophosphate linkages between the first 3 bases of the 5' end of the engineered guide RNA, at least 4 2'-O methyl or 2'-fluoro bases at the 4' end of the engineered guide RNA, and three thiophosphate linkages between the last three bases of the 3' end of the engineered guide RNA. In some embodiments, the engineered guide RNA comprises at least two 2'-O-methyl bases and at least two thiophosphate linkages at a 5' end of the engineered guide RNA and at least one 2'-O-methyl bases and at least one thiophosphate linkage at a 3' end of the engineered guide RNA. In some embodiments, the engineered guide RNA comprises at least one 2'-O-methyl base in both the 3' stem or the 5' stem region of the engineered guide RNA. In some embodiments, the engineered guide RNA comprises at least one to at least fourteen 2'-fluoro bases in the spacer region excluding a seed region of the engineered guide RNA. In some embodiments, the engineered guide RNA comprises at least one 2'-O-methyl base in the 5' stem region of the engineered guide RNA and at least one to at least fourteen 2'-fluoro bases in the spacer region excluding a seed region of the guide RNA. In some embodiments, the guide RNA comprises a spacer sequence targeting a VEGF-A gene. In some embodiments, the guide RNA comprises a spacer sequence having at least 80% identity to SEQ ID NO: 3985. In some embodiments, the guide RNA comprises the nucleotides of guide RNAs 1-7 from Table 7 comprising the chemical modifications listed in Table 7. In some embodiments, the RNA-guided nuclease is a Cas endonuclease. In some embodiments, the Cas endonuclease is a class 2, type V Cas endonuclease In some embodiments, the class 2, type V Cas endonuclease comprises a RuvC domain comprising a RuvCI subdomain, a RuvCII subdomain, and a RuvCIII subdomain. In some embodiments, the class 2, type V Cas endonuclease comprises an endonuclease having at least 75% sequence identity to any one of SEQ ID NOs: 1-3470 or a variant thereof. In some embodiments, the class 2, type V Cas endonuclease comprises an endonuclease having at least 75% sequence identity to any one of SEQ ID NOs: 141, 215, 229, 261, or 1711-1721 or a variant thereof. In some embodiments, the engineered guide RNA comprises a sequence with at least 80% sequence identity to the non-degenerate nucleotides of any one of SEQ ID NOs: 3471, 3539, 3551-3559, 3608-3609, 3612, 3636-3637, 3640-3641, 3644-3645, 3648-3649, 3652-3653, 3656-3657, 3660-3661, 3664-3667, 3671-3672, 3677-3678, 3695-3696, 3729-3730, 3734-3735, and 3851-3857. In some embodiments, the engineered guide RNA comprises a sequence with at least 80% sequence identity to the non-degenerate nucleotides of any one of SEQ ID NOs: 3608-3609, 3853, or 3851-3857.

In some aspects, the present disclosure provides for a host cell comprising an open reading frame encoding a heterologous endonuclease having at least 75% sequence identity to any one of SEQ ID NOs: 1-3470 or a variant thereof. In some embodiments, the endonuclease has at least 75% sequence identity to any one of SEQ ID NOs: 141, 215, 229, 261, or 1711-1721, or a variant thereof. In some embodiments, the host cell is an *E. coli* cell or a mammalian cell. In some embodiments, the host cell is an *E. coli* cell, wherein the *E. coli* cell is a λDE3 lysogen or the *E. coli* cell is a BL21(DE3) strain. In some embodiments, the *E. coli* cell has an ompT lon genotype. In some embodiments, the open reading frame is operably linked to a T7 promoter sequence, a T7-lac promoter sequence, a lac promoter sequence, a tac promoter sequence, a trc promoter sequence, a ParaBAD promoter sequence, a PrhaBAD promoter sequence, a T5 promoter sequence, a cspA promoter sequence, an araP$_{BAD}$ promoter, a strong leftward promoter from phage lambda (pL promoter), or any combination thereof. In some embodiments, the open reading frame comprises a sequence encoding an affinity tag linked in-frame to a sequence encoding the endonuclease. In some embodiments, the affinity tag is an immobilized metal affinity chromatography (IMAC) tag. In some embodiments, the IMAC tag is a polyhistidine tag. In some embodiments, the affinity tag is a myc tag, a human influenza hemagglutinin (HA) tag, a maltose binding protein (MBP) tag, a glutathione S-transferase (GST) tag, a streptavidin tag, a FLAG tag, or any combination thereof. In some embodiments, the affinity tag is linked in-frame to the sequence encoding the endonuclease via a linker sequence encoding a protease cleavage site. In some embodiments, the protease cleavage site is a tobacco etch virus (TEV) protease cleavage site, a PreScission® protease cleavage site, a Thrombin cleavage site, a Factor Xa cleavage site, an enterokinase cleavage site, or any combination thereof. In some embodiments, the open reading frame is codon-optimized for expression in the host cell. In some embodiments, the open reading frame is provided on a vector. In some embodiments, the open reading frame is integrated into a genome of the host cell.

In some aspects, the present disclosure provides for a culture comprising any of the host cells described herein in compatible liquid medium.

In some aspects, the present disclosure provides for a method of producing an endonuclease, comprising cultivating any of the host cells described herein in compatible growth medium. In some embodiments, the method further comprises inducing expression of the endonuclease In some embodiments, the inducing expression of the nuclease is by addition of an additional chemical agent or an increased amount of a nutrient, or by temperature increase or decrease. In some embodiments, an additional chemical agent or an increased amount of a nutrient comprises Isopropyl β-D-1-thiogalactopyranoside (IPTG) or additional amounts of lactose In some embodiments, the method further comprises isolating the host cell after the cultivation and lysing the host cell to produce a protein extract. In some embodiments, the method further comprises isolating the endonuclease. In some embodiments, the isolating comprises subjecting the protein extract to IMAC, ion-exchange chromatography, anion exchange chromatography, or cation exchange chromatography. In some embodiments, the open reading frame comprises a sequence encoding an affinity tag linked in-frame to a sequence encoding the endonuclease. In some embodiments, the affinity tag is linked in-frame to the sequence encoding the endonuclease via a linker sequence encoding protease cleavage site. In some embodiments, the protease cleavage site comprises a tobacco etch virus (TEV) protease cleavage site, a PreScission® protease cleavage site, a Thrombin cleavage site, a Factor Xa cleavage site, an enterokinase cleavage site, or any combination thereof. In some embodiments, the method further comprises cleaving the affinity tag by contacting a protease corresponding to the protease cleavage site to the endonuclease. In some embodiments, the affinity tag is an IMAC affinity tag. In some embodiments, the method further comprises performing subtractive IMAC affinity chromatography to remove the affinity tag from a composition comprising the endonuclease.

In some aspects, the present disclosure provides for a system comprising (a) a class 2, Type V-A Cas endonuclease configured to bind a 3- or 4-nucleotide PAM sequence, wherein the endonuclease has increased cleavage activity relative to sMbCas12a; and (b) an engineered guide RNA, wherein the engineered guide RNA is configured to form a complex with the class 2, Type V-A Cas endonuclease and the engineered guide RNA comprises a spacer sequence configured to hybridize to a target nucleic acid comprising a target nucleic acid sequence. In some embodiments, the cleavage activity is measured in vitro by introducing the endonucleases alongside compatible guide RNAs to cells comprising the target nucleic acid and detecting cleavage of the target nucleic acid sequence in the cells. In some embodiments, the class 2, Type V-A Cas endonuclease comprises a sequence having at least 75% identity to any one of 215-225 or a variant thereof. In some embodiments, the engineered guide RNA comprises a sequence having at least 80% identity to the non-degenerate nucleotides of SEQ ID NO: 3609. In some embodiments, the target nucleic acid further comprises a YYN PAM sequence proximal to the target nucleic acid sequence. In some embodiments, the class 2, Type V-A Cas endonuclease has at least about 5%, 10%, 20%, 30%, 40%, 50%, 60%, 70%, 80%, 90%, 100%, or 200%, or more increased activity relative to sMbCas12a.

In some aspects, the present disclosure provides for a system comprising: (a) a class 2, Type V-A' Cas endonuclease; and (b) an engineered guide RNA, wherein the engineered guide RNA comprises a sequence having at least 80% identity to about 19 to about 25 or about 19 to about 31 consecutive nucleotides of a natural effector repeat sequence of a class 2, Type V Cas endonuclease. In some embodiments, the natural effector repeat sequence is any one of SEQ ID NOs: 3560-3572. In some embodiments, the class 2, Type V-A' Cas endonuclease has at least 75% identity to SEQ ID NO: 126.

In some aspects, the present disclosure provides for a system comprising: (a) a class 2, Type V-L endonuclease, and (b) an engineered guide RNA, wherein the engineered guide RNA comprises a sequence having at least 80% identity to about 19 to about 25 or about 19 to about 31 consecutive nucleotides of a natural effector repeat sequence of a class 2, Type V Cas endonuclease. In some embodiments, the class 2, Type V-L endonuclease has at least 75% sequence identity to any one of SEQ ID NOs: 793-1163.

In some aspects, the present disclosure provides for a method of disrupting the VEGF-A locus in a cell, comprising introducing to the cell: (a) a class 2, type V Cas endonuclease; and (b) an engineered guide RNA, wherein the engineered guide RNA is configured to form a complex with the endonuclease and the engineered guide RNA comprises a spacer sequence configured to hybridize to a region of the VEGF-A locus, wherein the engineered guide RNA comprises a targeting sequence having at least 80% identity to SEQ ID NO: 3985; or wherein the engineered guide RNA comprises the nucleotide sequence of any one of guide RNAs 1-7 from Table 7 In some embodiments, the class 2, type V Cas endonuclease comprises an endonuclease having at least 75% sequence identity to any one of SEQ ID NOs: 1-3470 or a variant thereof. In some embodiments, the class 2, type V Cas endonuclease comprises an endonuclease having at least 75% sequence identity to any one of SEQ ID NOs: 141, 215, 229, 261, or 1711-1721 or a variant thereof. In some embodiments, the engineered guide RNA comprises a sequence with at least 80% sequence identity to the non-degenerate nucleotides of any one of SEQ ID NOs: 3471, 3539, 3551-3559, 3608-3609, 3612, 3636-3637, 3640-3641, 3644-3645, 3648-3649, 3652-3653, 3656-3657, 3660-3661, 3664-3667, 3671-3672, 3677-3678, 3695-3696, 3729-3730, 3734-3735, and 3851-3857. In some embodiments, the engineered guide RNA comprises a sequence with at least 80% sequence identity to the non-degenerate nucleotides of any one of SEQ ID NOs: 3608-3609, 3853, or 3851-3857.

In some aspects, the present disclosure provides for a method of disrupting a locus in a cell, comprising contacting to the cell a composition comprising: (a) a class 2, type V Cas endonuclease having at least 75% identity to any one of SEQ ID NOs: 215-225 or a variant thereof; and (b) an engineered guide RNA, wherein the engineered guide RNA is configured to form a complex with the endonuclease and the engineered guide RNA comprises a spacer sequence configured to hybridize to a region of the locus, wherein the class 2, type V Cas endonuclease has at least equivalent cleavage activity to spCas9 in the cell. In some embodiments, the cleavage activity is measured in vitro by introducing the endonucleases alongside compatible guide RNAs to cells comprising the target nucleic acid and detecting cleavage of the target nucleic acid sequence in the cells. In some embodiments, the composition comprises 20 pmoles or less of the class 2, type V Cas endonuclease. In some embodiments, the composition comprises 1 pmol or less of the class 2, type V Cas endonuclease.

Additional aspects and advantages of the present disclosure will become readily apparent to those skilled in this art from the following detailed description, wherein only illustrative embodiments of the present disclosure are shown and described. As will be realized, the present disclosure is capable of other and different embodiments, and its several details are capable of modifications in various obvious respects, all without departing from the disclosure. Accordingly, the drawings and description are to be regarded as illustrative in nature, and not as restrictive.

INCORPORATION BY REFERENCE

All publications, patents, and patent applications mentioned in this specification are herein incorporated by reference to the same extent as if each individual publication, patent, or patent application was specifically and individually indicated to be incorporated by reference.

BRIEF DESCRIPTION OF THE DRAWINGS

The novel features of the invention are set forth with particularity in the appended claims. A better understanding of the features and advantages of the present invention will be obtained by reference to the following detailed description that sets forth illustrative embodiments, in which the principles of the invention are utilized, and the accompanying drawings of which:

FIG. 2). Protein length is shown for representatives of the MG29 protein family. The number of catalytic residues that were predicted for each protein are indicated in the figure legend (3.0 residues). The first, second and third catalytic residues are located in the RuvCI domain, the RuvCII domain and the RuvCIII domain, respectively.

FIG. 5 provides various characteristic information about nucleases described herein. FIG. 5A depicts the per family distribution of effector protein length and the type of sample; FIG. 5B shows the presence of RuvC catalytic residues. FIG. 5C shows the number of CRISPR arrays having various repeat motifs (repeat motifs in order of appearance from top to bottom are SEQ ID NOs: 4426-4430). FIG. 5D depicts the per family distribution of repeat motifs (repeat motifs in order of appearance from left to right are SEQ ID NOs: 4426, 4427, 4429, 4431, 4432, 4433, 4434, and 4435).

FIG. 6A shows blocks of conservation around the DED catalytic residues in RuvC-I (left), RuvC-II (middle), and RuvC-III (right) regions (sequences from top to bottom in order of appearance are SEQ ID NO: 215, residues 876-913, 963-980, 1222-1251; SEQ ID NO: 226, residues 850-887, 940-957, 1202-1231; SEQ ID NO: 229, residues 891-928, 983-1000, 1254-1283; SEQ ID NO: 141 896-933, 986-1003, 1238-1267, SEQ ID NO: 261, residues 885-922, 976-993, 1242-1270).

FIG. 7A shows Type V-A (MG26-1) and V-A' (MG26-2) indicated by arrows pointing in the direction of transcription. The CRISPR array is indicated by a gray bar. Predicted domains for each protein in the contig are indicated by boxes. FIG. 7B shows sequence alignments of Type V-A' MG26-2 (SEQ ID NOs: 4456-4457) and AsCas12a reference sequence (SEQ ID NOs: 4458-4459). Top: RuvC-I domain. Middle: region containing the RuvC-I and RuvC-II catalytic residues. Bottom: region containing the RuvC-III catalytic residue. Catalytic residues are indicated by squares.

FIG. 10 depicts the CRISPR RNA (crRNA) structure is conserved among Type V-A systems. FIG. 10A shows the fold structure of the reference crRNA sequence in the LbCpf1 system (SEQ ID NO: 4460, shown in the figure with T in place of U). FIG. 10B shows multiple sequence alignment of CRISPR repeats associated with novel Type V-A systems (consensus sequence shown is SEQ ID NO: 4461, others are SEQ ID NOs: 4542-4546 from top to bottom in order of appearance, shown in the figure with T in place of U). The LbCpf1 processing site is indicated with a black bar. FIG. 10C shows the fold structure of MG61-2 putative crRNA with an alternative stem-loop motif CCUGC $[N_{3-4}]$GCAGG (SEQ ID NO: 4463, shown in the figure with T in place of U). FIG. 10D shows multiple sequence alignment of CRISPR repeats with the alternative repeat motif sequence (SEQ ID NOs: 4462 and 4463-4467 from top to bottom in order of appearance, shown in the figure with T in place of U). The processing sites and loop are indicated.

FIG. 17 depicts an agarose gel showing the results of PAM vector library cleavage in the presence of TXTL extracts containing various MG family nucleases and their corresponding tracrRNA or sgRNAs (as described in Example 12).

FIG. 17A shows lane 1: ladder. The bands are, from top to bottom, 766, 500, 350, 300, 350, 200, 150, 100, 75, 50; lane 2: 28-1+MGcrRNA spacer1 (SEQ ID NOs: 141+3860); lane 3: 29-1+MGcrRNA spacer1 (SEQ ID NOs: 215+3860); lane 4: 30-1+MGcrRNA spacer1 (SEQ ID NOs: 226+3860); lane 5: 31-1+MGcrRNA spacer1 (SEQ ID NOs: 229+3860); lane 6: 32-1+MGcrRNA spacer1 (SEQ ID NOs: 261+3860); lane 7: ladder. FIG. 17B shows lane 1: ladder; lane 2: LbaCas12a+LbaCas12a crRNA spacer2; lane 3: LbaCas12a+MGcrRNA spacer2; lane 4: Apo 13-1; lane 5: 28-1+MGcrRNA spacer2 (SEQ ID NOs: 141+3861); lane 6: 29-1+MGcrRNA spacer2 (SEQ ID NOs: 215+3861); lane 7: 30-1+MGcrRNA spacer2 (SEQ ID NOs: 226+3861); lane 8: 31-1+MGcrRNA spacer2 (SEQ ID NOs: 229+3861); lane 9: 32-1+MGcrRNA spacer2 (SEQ ID NOs: 261+3861).

FIG. 18C and FIG. 18D show mean editing frequency with one standard deviation error bar.

FIG. 26A shows PCR of cleavage products with adaptors ligated to their ends shows activity of nucleases described herein and Cpf1 (positive control) when bound to a universal crRNA. Expected cleavage product band labeled with an arrow. FIG. 26B shows PCR of cleavage products with adaptors ligated to their ends show activity of nucleases described herein when bound to their native crRNA. Cleavage product band indicated with an arrow.

FIGS. 27A and 27B depict multiple sequence alignments of Type V-L nucleases described herein, showing (FIG. 27A) an example locus organization for a Type V-L nuclease, and (FIG. 27B) a multiple sequence alignment (MG60-9 effector RuvC domain is SEQ ID NOs: 4468-4469; 4471, AsCpf1 RuvC domain is SEQ ID NOs: 4470-4471). Regions containing putative RuvC-III domains are shown as light grey rectangles. Putative RuvC catalytic residues are shown as small dark grey rectangles above each sequence. Putative single-guide RNA binding sequences are small white rectangles, putative scissile phosphate binding sites are indicated by black rectangles above sequences, and residues predicted to disrupt base stacking near the scissile phosphate in the target sequence are indicated by small medium-grey rectangles above sequences.

Figure 35:
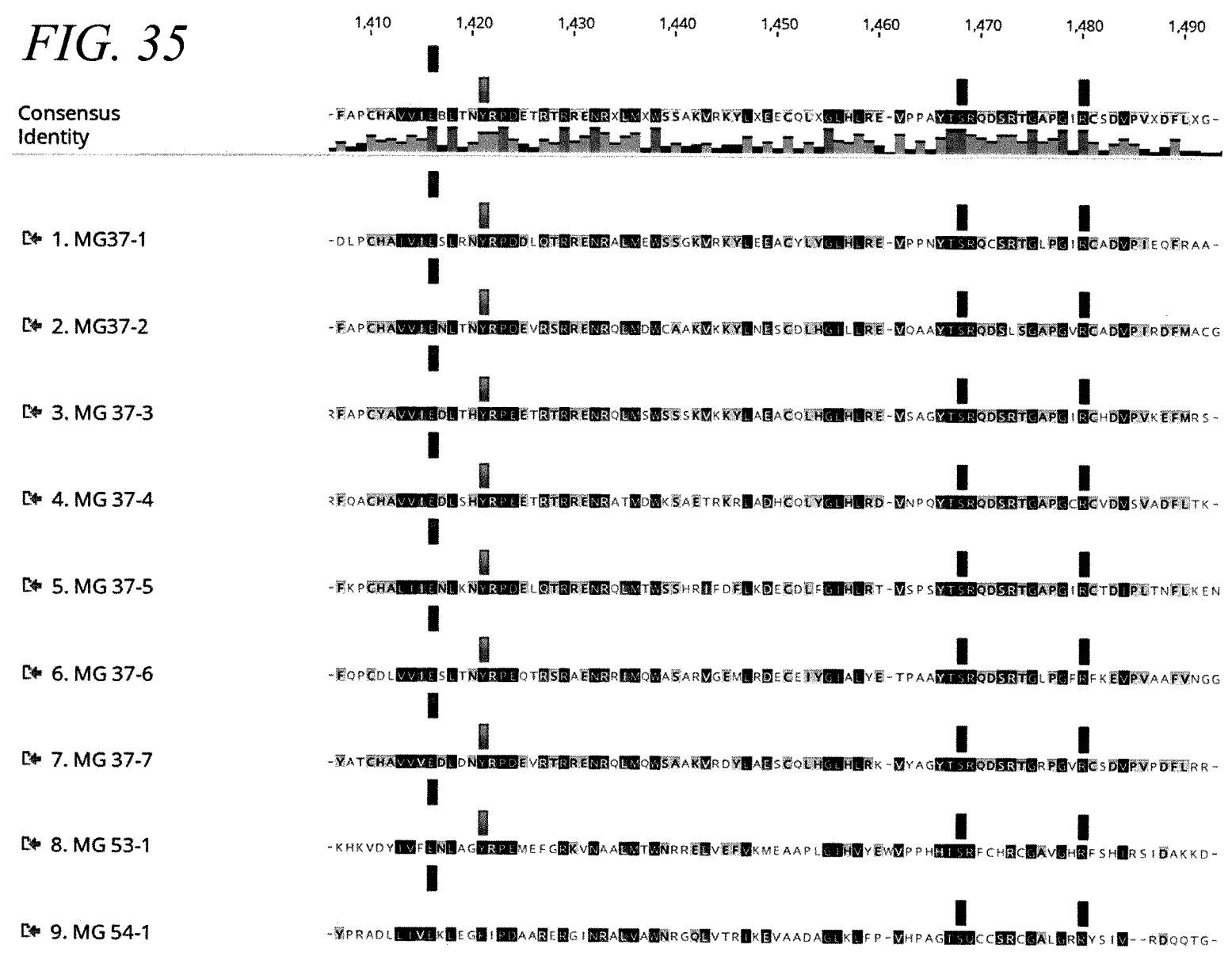

FIG. 34 and FIG. 35 depicts an enlarged version of multiple sequence alignments in FIG. 33 of regions of the MG nucleases described herein containing putative RuvC catalytic residues (dark-grey rectangles), scissile phosphate-binding residues (black rectangles), and residues predicted to disrupt base stacking adjacent to the scissile phosphate (light-grey rectangles) (sequences from top to bottom in order of appearance are SEQ ID NO: 262, residues 735-784; SEQ ID NO: 263, residues 143-190; SEQ ID NO: 264, residues 719-766; SEQ ID NO: 265, residues 785-832; SEQ ID NO: 266, residues 749-796; SEQ ID NO: 267, residues 670-719; SEQ ID NO: 268, residues 726-773; SEQ ID NO: 427, residues 516-547; SEQ ID NO: 430, residues 321-3351; SEQ ID NOs: 4472-4482; SEQ ID NOs: 4473-4482).

Figure 38:
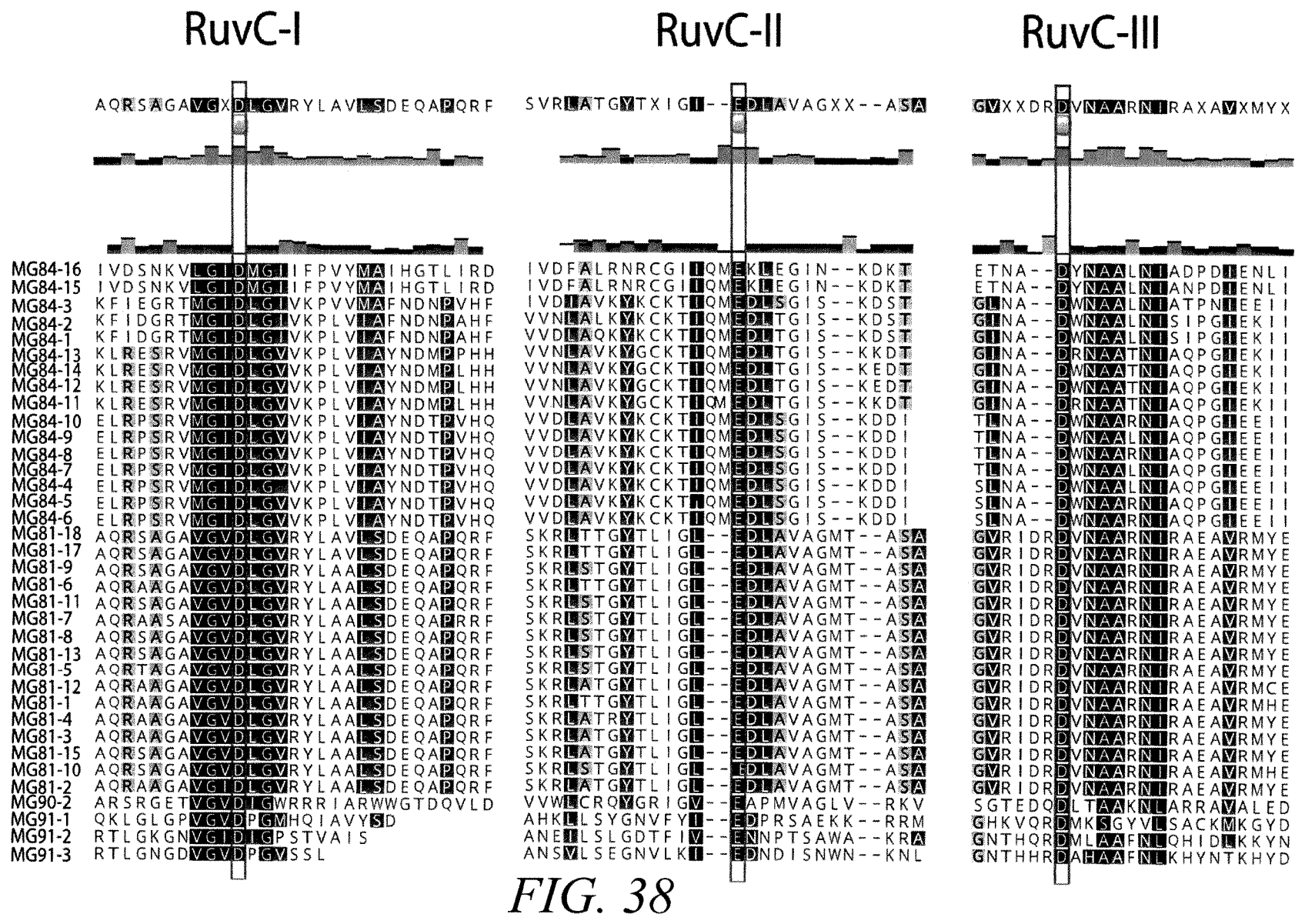

FIG. 38 depicts multiple protein sequence alignment of representatives from several MG type V Families. Shown are conserved regions containing portions of the RuvC domain predicted to be involved in nuclease activity. Predicted catalytic residues are highlighted (sequences from top to bottom in order of appearance are SEQ ID NOs: 4503-4539).

FIG. 51 is a representative indel profile of MG29-1 with a guide targeting mouse albumin intron 1 determined by next generation sequencing (approximately 15,000 total reads analyzed) as in Example 29 (SEQ ID NO: 4540, showing variability depicted in the figure).

FIG. 53A depicts editing efficiency in Hepa 1-6 cells transfected with plasmids codifying for MG29-1 WT or mutant versions.

FIG. 53B depicts Editing efficiency in Hepa 1-6 cells transfected with mRNA encoding WT or S168R at various concentrations. FIG. 53C depicts the editing efficiency in Hepa 1-6 cells transfected with mRNA codifying versions of MG29-1 with single or double amino acid substitutions.

FIG. 56B shows the use of Sanger Sequencing to define the MG29-1 cut site on the target strand. FIG. 56C shows the use of Sanger Sequencing to define the MG29-1 cut site on the non-target strand (SEQ ID NO: 4541 is the top sequence in FIGS. 56B and 56C; SEQ ID NO: 4547 is the bottom sequence in FIGS. 56B and 56C). Run-off Sanger sequencing was performed on in vitro reactions containing MG29-1, a guide and an appropriate template to evaluate the cleavage of both strands. The cleavage site on the target strand is position 23 which is consistent with the NGS data in FIG. 56A which shows cleavage at 21-23 bases. The "A" peak at the end of the sequence is due to polymerase run off and is expected. The cleavage site on the non-target strand can be seen in the reverse read in which the expected terminating base is "T". The marked spot (line) shows cleavage at position 17 from the PAM and then the terminal T. However, there is a mixed T signal at positions 18, 19, and 20 from the PAM suggesting variable cleavage on this strand at positions 17, 18, and 19.

BRIEF DESCRIPTION OF THE SEQUENCE LISTING

Figure 1:
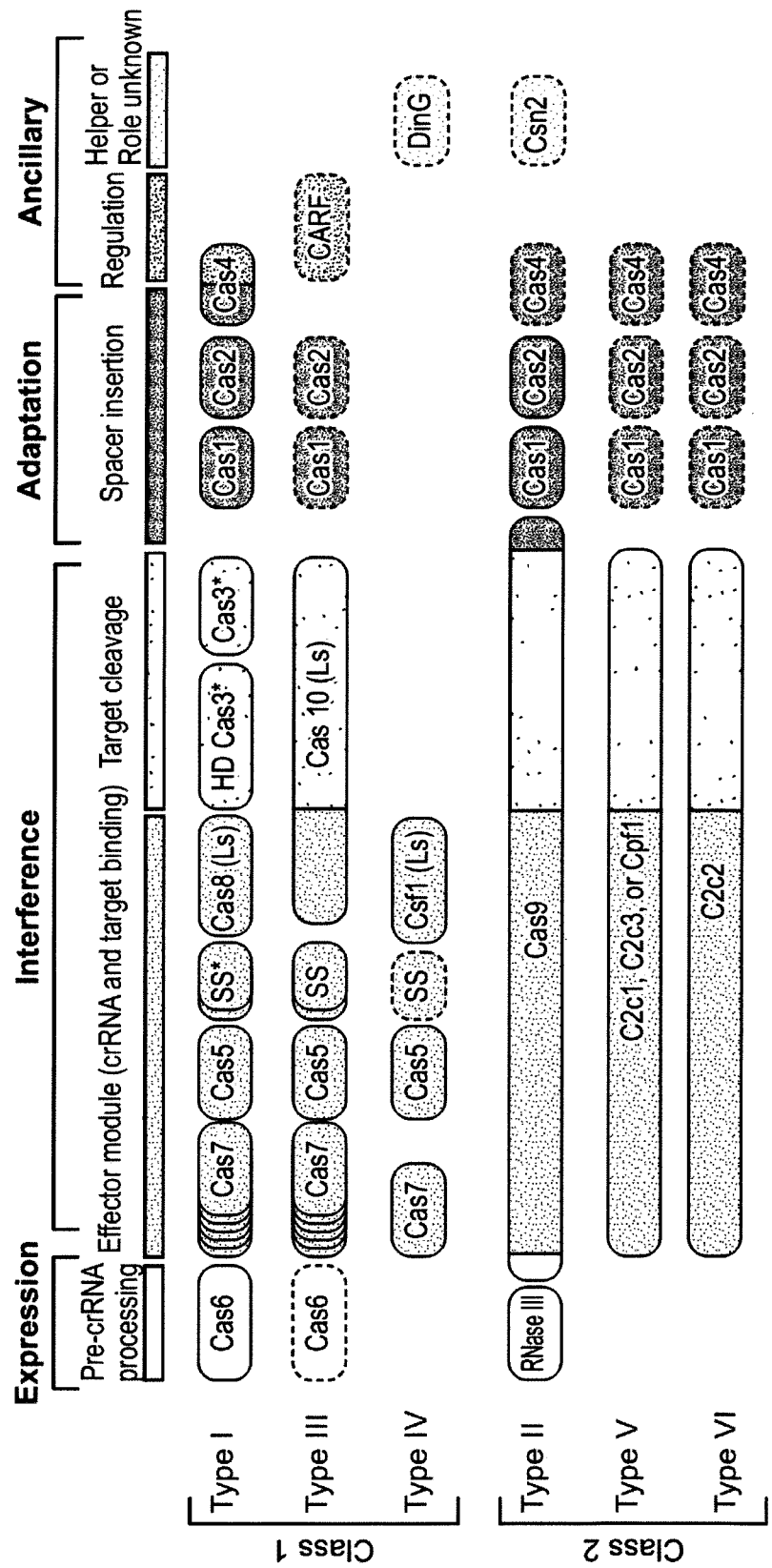
FIG. 1 depicts typical organizations of CRISPR/Cas loci of different classes and types that were previously described before this disclosure.

The Sequence Listing filed herewith provides exemplary polynucleotide and polypeptide sequences for use in methods, compositions and systems according to the disclosure. Below are exemplary descriptions of sequences therein.

MG11
SEQ ID NOs: 1-37 show the full-length peptide sequences of MG11 nucleases.
SEQ ID NO: 3471 shows a crRNA 5' direct repeats designed to function with an MG11 nuclease.
SEQ ID NOs: 3472-3538 show effector repeat motifs of MG11 nucleases.
SEQ ID NOs: 38-118 show the full-length peptide sequences of MG13 nucleases.
SEQ ID NOs: 3540-3550 show effector repeat motifs of MG13 nucleases.

MG19
SEQ ID NOs: 119-124 show the full-length peptide sequences of MG19 nucleases.
SEQ ID NOs: 3551-3558 show the nucleotide sequences of sgRNAs engineered to function with a MG19 nuclease.
SEQ ID NOs: 3863-3866 show PAM sequences compatible with MG19 nucleases.

MG20
SEQ ID NO: 125 shows the full-length peptide sequence of a MG20 nuclease.
SEQ ID NO: 3559 shows the nucleotide sequence of a sgRNA engineered to function with a MG20 nuclease.
SEQ ID NO: 3867 shows a PAM sequence compatible with an MG20 nuclease.

MG26
SEQ ID NOs: 126-140 show the full-length peptide sequences of MG26 nucleases.
SEQ ID NOs: 3560-3572 show effector repeat motifs of MG26 nucleases.

MG28
SEQ ID NOs: 141-214 show the full-length peptide sequences of MG28 nucleases.
SEQ ID NOs: 3573-3607 show effector repeat motifs of MG28 nucleases.
SEQ ID NOs: 3608-3609 show crRNA 5' direct repeats designed to function with an MG28 nuclease.
SEQ ID NOs: 3868-3869 shows a PAM sequence compatible with an MG28 nuclease.

MG29
SEQ ID NOs: 215-225 show the full-length peptide sequences of MG29 nucleases.
SEQ ID NOs: 3610-3611 show effector repeat motifs of MG29 nucleases.
SEQ ID NO: 3612 shows the nucleotide sequence of a sgRNA engineered to function with a MG29 nuclease.
SEQ ID NOs: 3870-3872 show PAM sequences compatible with an MG29 nuclease.

MG30
SEQ ID NOs: 226-228 show the full-length peptide sequences of MG30 nucleases.
SEQ ID NOs: 3613-3615 show effector repeat motifs of MG30 nucleases.
SEQ ID NO: 3873 shows a PAM sequence compatible with an MG30 nuclease.

MG31
SEQ ID NOs: 229-260 show the full-length peptide sequences of MG31 nucleases.
SEQ ID NOs: 3616-3632 show effector repeat motifs of MG31 nucleases.
SEQ ID NOs: 3874-3876 show PAM sequences compatible with a MG31 nuclease.

MG32
SEQ ID NO: 261 shows the full-length peptide sequence of a MG32 nuclease.
SEQ ID NO: 3633-3634 show effector repeat motifs of MG32 nucleases.

SEQ ID NO: 3876 shows a PAM sequence compatible with a MG32 nuclease.

MG37

SEQ ID NOs: 262-426 show the full-length peptide sequences of MG37 nucleases.

SEQ ID NO: 3635 shows an effector repeat motif of MG37 nucleases.

SEQ ID NOs: 3636-3637, 3640-3641, 3644-3645, 3648-3649, 3652-3653, 3656-3657, and 3660-3661 show the nucleotide sequence of sgRNA engineered to function with an MG37 nuclease.

SEQ ID NOs: 3638, 3642, 3646, 3650, 3654, 3658, and 3662 show the nucleotide sequences of MG37 tracrRNAs derived from the same loci as MG37 nucleases above.

SEQ ID NO: 3639, 3643, 3647, 3651, 3655, and 3659 show 5' direct repeat sequences derived from native MG37 loci that serve as crRNAs when placed 5' to a 3' targeting or spacer sequence.

MG53

SEQ ID NOs: 427-428 show the full-length peptide sequences of MG53 nucleases.

SEQ ID NO: 3663 shows a 5' direct repeat sequence derived from native MG53 loci that serve as a crRNA when placed 5' to a 3' targeting or spacer sequence.

SEQ ID NOs: 3664-3667 show the nucleotide sequence of sgRNAs engineered to function with an MG53 nuclease.

SEQ ID NOs: 3668-3669 show the nucleotide sequences of MG53 tracrRNAs derived from the same loci as MG53 nucleases above.

MG54

SEQ ID NOs: 429-430 show the full-length peptide sequences of MG54 nucleases.

SEQ ID NO: 3670 shows a 5' direct repeat sequence derived from native MG54 loci that serve as a crRNA when placed 5' to a 3' targeting or spacer sequence.

SEQ ID NOs: 3671-3672 show the nucleotide sequence of sgRNA engineered to function with an MG54 nuclease.

SEQ ID NOs: 3673-3676 show the nucleotide sequences of MG54 tracrRNAs derived from the same loci as MG54 nucleases above.

MG55

SEQ ID NOs: 431-688 show the full-length peptide sequences of MG55 nucleases.

MG56

SEQ ID NOs: 689-690 show the full-length peptide sequences of MG56 nucleases.

SEQ ID NO: 3678 shows a crRNA 5' direct repeats designed to function with an MG56 nuclease.

SEQ ID NOs: 3679-3680 show effector repeat motifs of MG56 nucleases.

MG57

SEQ ID NOs: 691-721 show the full-length peptide sequences of MG57 nucleases.

SEQ ID NOs: 3681-3694 show effector repeat motifs of MG57 nucleases.

SEQ ID NOs: 3695-3696 show the nucleotide sequences of sgRNAs engineered to function with an MG57 nuclease.

SEQ ID NOs: 3879-3880 shows PAM sequences compatible with MG57 nucleases.

MG58

SEQ ID NOs: 722-779 show the full-length peptide sequences of MG58 nucleases.

SEQ ID NOs: 3697-3711 show effector repeat motifs of MG58 nucleases.

MG59

SEQ ID NOs: 780-792 show the full-length peptide sequences of MG59 nucleases.

SEQ ID NOs: 3712-3728 show effector repeat motifs of MG59 nucleases.

SEQ ID NOs: 3729-3730 show the nucleotide sequences of sgRNAs engineered to function with an MG59 nuclease.

SEQ ID NOs: 3881-3882 shows PAM sequences compatible with MG59 nucleases.

MG60

SEQ ID NOs: 793-1163 show the full-length peptide sequences of MG60 nucleases.

SEQ ID NOs: 3731-3733 show effector repeat motifs of MG60 nucleases.

MG61

SEQ ID NOs: 1164-1469 show the full-length peptide sequences of MG61 nucleases.

SEQ ID NOs: 3734-3735 show crRNA 5' direct repeats designed to function with MG61 nucleases.

SEQ ID NOs: 3736-3847 show effector repeat motifs of MG61 nucleases.

MG62

SEQ ID NOs: 1470-1472 show the full-length peptide sequences of MG62 nucleases.

SEQ ID NOs: 3848-3850 show effector repeat motifs of MG62 nucleases.

MG70

SEQ ID NOs: 1473-1514 show the full-length peptide sequences of MG70 nucleases.

MG75

SEQ ID NOs: 1515-1710 show the full-length peptide sequences of MG75 nucleases.

MG77

SEQ ID NOs: 1711-1712 show the full-length peptide sequences of MG77 nucleases.

SEQ ID NOs: 3851-3852 show the nucleotide sequences of sgRNAs engineered to function with an MG77 nuclease.

SEQ ID NOs: 3883-3884 show PAM sequences compatible with MG77 nucleases.

MG78

SEQ ID NOs: 1713-1717 show the full-length peptide sequences of MG78 nucleases.

SEQ ID NO: 3853 shows the nucleotide sequence of a sgRNA engineered to function with an MG78 nuclease.

SEQ ID NO: 3885 shows a PAM sequence compatible with a MG78 nuclease.

MG79

SEQ ID NOs: 1718-1722 show the full-length peptide sequences of MG79 nucleases.

SEQ ID NOs: 3854-3857 shows the nucleotide sequences of sgRNAs engineered to function with an MG79 nuclease.

SEQ ID NOs: 3886-3889 show the PAM sequences compatible with MG79 nucleases.

MG80

SEQ ID NO: 1723 shows the full-length peptide sequence of a MG80 nuclease.

MG81

SEQ ID NOs: 1724-2654 show the full-length peptide sequences of MG81 nucleases.

MG82

SEQ ID NOs: 2655-2657 show the full-length peptide sequences of MG82 nucleases.

MG83

SEQ ID NOs: 2658-2659 show the full-length peptide sequences of MG83 nucleases.

MG84

SEQ ID NOs: 2660-2677 show the full-length peptide sequences of MG84 nucleases.

MG85
SEQ ID NOs: 2678-2680 show the full-length peptide sequences of MG85 nucleases.
MG90
SEQ ID NOs: 2681-2809 show the full-length peptide sequences of MG90 nucleases.
MG91
SEQ ID NOs: 2810-3470 show the full-length peptide sequences of MG91 nucleases.
Spacer Segments
SEQ ID NOs: 3858-3861 show the nucleotide sequences of spacer segments.
NLS
SEQ ID NOs: 3938-3953 show the sequences of example nuclear localization sequences (NLSs) that can be appended to nucleases according to the disclosure.

DETAILED DESCRIPTION

While various embodiments of the invention have been shown and described herein, it will be obvious to those skilled in the art that such embodiments are provided by way of example only. Numerous variations, changes, and substitutions may occur to those skilled in the art without departing from the invention. It should be understood that various alternatives to the embodiments of the invention described herein may be employed.

The practice of some methods disclosed herein employ, unless otherwise indicated, techniques of immunology, biochemistry, chemistry, molecular biology, microbiology, cell biology, genomics and recombinant DNA. See for example Sambrook and Green, Molecular Cloning: A Laboratory Manual, 4th Edition (2012); the series Current Protocols in Molecular Biology (F. M. Ausubel, et al. eds.); the series Methods In Enzymology (Academic Press, Inc.), PCR 2: A Practical Approach (M. J. MacPherson, B. D. Hames and G. R. Taylor eds. (1995)), Harlow and Lane, eds. (1988) Antibodies, A Laboratory Manual, and Culture of Animal Cells: A Manual of Basic Technique and Specialized Applications, 6th Edition (R. I. Freshney, ed. (2010)) (which is entirely incorporated by reference herein).

As used herein, the singular forms "a", "an" and "the" are intended to include the plural forms as well, unless the context clearly indicates otherwise. Furthermore, to the extent that the terms "including", "includes", "having", "has", "with", or variants thereof are used in either the detailed description and/or the claims, such terms are intended to be inclusive in a manner similar to the term "comprising".

The term "about" or "approximately" means within an acceptable error range for the particular value as determined by one of ordinary skill in the art, which will depend in part on how the value is measured or determined, i.e., the limitations of the measurement system. For example, "about" can mean within one or more than one standard deviation, per the practice in the art. Alternatively, "about" can mean a range of up to 20%, up to 15%, up to 10%, up to 5%, or up to 1% of a given value.

As used herein, a "cell" generally refers to a biological cell. A cell may be the basic structural, functional and/or biological unit of a living organism. A cell may originate from any organism having one or more cells. Some non-limiting examples include: a prokaryotic cell, eukaryotic cell, a bacterial cell, an archaeal cell, a cell of a single-cell eukaryotic organism, a protozoa cell, a cell from a plant (e.g., cells from plant crops, fruits, vegetables, grains, soy bean, corn, maize, wheat, seeds, tomatoes, rice, cassava, sugarcane, pumpkin, hay, potatoes, cotton, *cannabis*, tobacco, flowering plants, conifers, gymnosperms, ferns, clubmosses, hornworts, liverworts, mosses), an algal cell, (e.g., *Botryococcus braunii, Chlamydomonas reinhardtii, Nannochloropsis gaditana, Chlorella pyrenoidosa, Sargassum patens C. Agardh*, and the like), seaweeds (e.g., kelp), a fungal cell (e.g., a yeast cell, a cell from a mushroom), an animal cell, a cell from an invertebrate animal (e.g., fruit fly, cnidarian, echinoderm, nematode, etc.), a cell from a vertebrate animal (e.g., fish, amphibian, reptile, bird, mammal), a cell from a mammal (e.g., a pig, a cow, a goat, a sheep, a rodent, a rat, a mouse, a non-human primate, a human, etc.), and etcetera. Sometimes a cell is not originating from a natural organism (e.g., a cell can be a synthetically made, sometimes termed an artificial cell).

The term "nucleotide," as used herein, generally refers to a base-sugar-phosphate combination. A nucleotide may comprise a synthetic nucleotide. A nucleotide may comprise a synthetic nucleotide analog. Nucleotides may be monomeric units of a nucleic acid sequence (e.g., deoxyribonucleic acid (DNA) and ribonucleic acid (RNA)). The term nucleotide may include ribonucleoside triphosphates adenosine triphosphate (ATP), uridine triphosphate (UTP), cytosine triphosphate (CTP), guanosine triphosphate (GTP) and deoxyribonucleoside triphosphates such as dATP, dCTP, dITP, dUTP, dGTP, dTTP, or derivatives thereof. Such derivatives may include, for example, [αS]dATP, 7-deaza-dGTP and 7-deaza-dATP, and nucleotide derivatives that confer nuclease resistance on the nucleic acid molecule containing them. The term nucleotide as used herein may refer to dideoxyribonucleoside triphosphates (ddNTPs) and their derivatives. Illustrative examples of dideoxyribonucleoside triphosphates may include, but are not limited to, ddATP, ddCTP, ddGTP, ddITP, and ddTTP. A nucleotide may be unlabeled or detectably labeled, such as using moieties comprising optically detectable moieties (e.g., fluorophores). Labeling may also be carried out with quantum dots. Detectable labels may include, for example, radioactive isotopes, fluorescent labels, chemiluminescent labels, bioluminescent labels and enzyme labels. Fluorescent labels of nucleotides may include but are not limited fluorescein, 5-carboxyfluorescein (FAM), 2'7'-dimethoxy-4'5-dichloro-6-carboxyfluorescein (JOE), rhodamine, 6-carboxyrhodamine (R6G), N,N,N',N'-tetramethyl-6-carboxyrhodamine (TAMRA), 6-carboxy-X-rhodamine (ROX), 4-(4'dimethylaminophenylazo) benzoic acid (DABCYL), Cascade Blue, Oregon Green, Texas Red, Cyanine and 5-(2'-aminoethyl) aminonaphthalene-1-sulfonic acid (EDANS). Specific examples of fluorescently labeled nucleotides can include [R6G]dUTP, [TAMRA]dUTP, [R110]dCTP, [R6G]dCTP, [TAMRA]dCTP, [JOE]ddATP, [R6G]ddATP, [FAM]ddCTP, [R110]ddCTP, [TAMRA]ddGTP, [ROX]ddTTP, [dR6G] ddATP, [dR110]ddCTP, [dTAMRA]ddGTP, and [dROX] ddTTP available from Perkin Elmer, Foster City, Calif; FluoroLink DeoxyNucleotides, FluoroLink Cy3-dCTP, FluoroLink Cy5-dCTP, FluoroLink Fluor X-dCTP, FluoroLink Cy3-dUTP, and FluoroLink Cy5-dUTP available from Amersham, Arlington Heights, Il.; Fluorescein-15-dATP, Fluorescein-12-dUTP, Tetramethyl-rodamine-6-dUTP, IR770-9-dATP, Fluorescein-12-ddUTP, Fluorescein-12-UTP, and Fluorescein-15-2'-dATP available from Boehringer Mannheim, Indianapolis, Ind.; and Chromosome Labeled Nucleotides, BODIPY-FL-14-UTP, BODIPY-FL-4-UTP, BODIPY-TMR-14-UTP, BODIPY-TMR-14-dUTP, BODIPY-TR-14-UTP, BODIPY-TR-14-dUTP, Cascade Blue-7-UTP, Cascade Blue-7-dUTP, fluorescein-12-UTP, fluorescein-12-dUTP, Oregon Green 488-5-dUTP, Rhodamine Green-5-UTP, Rhodamine Green-5-dUTP, tetramethylrhodamine-6-UTP, tetramethylrhodamine-6-dUTP, Texas Red-5-UTP, Texas Red-5-dUTP, and Texas Red-12-dUTP available from Molecular Probes, Eugene, Oreg. Nucleotides can also be labeled or marked by chemical modification. A chemically-modified single nucleotide can be biotin-dNTP. Some non-limiting examples of biotinylated dNTPs can include, biotin-dATP (e.g., bio-N6-ddATP, biotin-14-dATP), biotin-dCTP (e.g., biotin-11-dCTP, biotin-14-dCTP), and biotin-dUTP (e.g., biotin-11-dUTP, biotin-16-dUTP, biotin-20-dUTP).

The terms "polynucleotide," "oligonucleotide," and "nucleic acid" are used interchangeably to generally refer to a polymeric form of nucleotides of any length, either deoxyribonucleotides or ribonucleotides, or analogs thereof, either in single-, double-, or multi-stranded form. A polynucleotide may be exogenous or endogenous to a cell. A polynucleotide may exist in a cell-free environment. A polynucleotide may be a gene or fragment thereof. A polynucleotide may be DNA. A polynucleotide may be RNA. A polynucleotide may have any three-dimensional structure and may perform any function. A polynucleotide may comprise one or more analogs (e.g., altered backbone, sugar, or nucleobase). If present, modifications to the nucleotide structure may be imparted before or after assembly of the polymer. Some non-limiting examples of analogs include: 5-bromouracil, peptide nucleic acid, xeno nucleic acid, morpholinos, locked nucleic acids, glycol nucleic acids, threose nucleic acids, dideoxynucleotides, cordycepin, 7-deaza-GTP, fluorophores (e.g., rhodamine or fluorescein linked to the sugar), thiol-containing nucleotides, biotin-linked nucleotides, fluorescent base analogs, CpG islands, methyl-7-guanosine, methylated nucleotides, inosine, thiouridine, pseudouridine, dihydrouridine, queuosine, and wyosine. Non-limiting examples of polynucleotides include coding or non-coding regions of a gene or gene fragment, loci (locus) defined from linkage analysis, exons, introns, messenger RNA (mRNA), transfer RNA (tRNA), ribosomal RNA (rRNA), short interfering RNA (siRNA), short-hairpin RNA (shRNA), micro-RNA (miRNA), ribozymes, cDNA, recombinant polynucleotides, branched polynucleotides, plasmids, vectors, isolated DNA of any sequence, isolated RNA of any sequence, cell-free polynucleotides including cell-free DNA (cfDNA) and cell-free RNA (cfRNA), nucleic acid probes, and primers. The sequence of nucleotides may be interrupted by non-nucleotide components.

The terms "transfection" or "transfected" generally refer to introduction of a nucleic acid into a cell by non-viral or viral-based methods. The nucleic acid molecules may be gene sequences encoding complete proteins or functional portions thereof. See, e.g., Sambrook et al., 1989, Molecular Cloning: A Laboratory Manual, 18.1-18.88 (which is entirely incorporated by reference herein).

The terms "peptide," "polypeptide," and "protein" are used interchangeably herein to generally refer to a polymer of at least two amino acid residues joined by peptide bond(s). This term does not connote a specific length of polymer, nor is it intended to imply or distinguish whether the peptide is produced using recombinant techniques, chemical or enzymatic synthesis, or is naturally occurring. The terms apply to naturally occurring amino acid polymers as well as amino acid polymers comprising at least one modified amino acid. In some cases, the polymer may be interrupted by non-amino acids. The terms include amino acid chains of any length, including full length proteins, and proteins with or without secondary and/or tertiary structure (e.g., domains). The terms also encompass an amino acid polymer that has been modified, for example, by disulfide bond formation, glycosylation, lipidation, acetylation, phosphorylation, oxidation, and any other manipulation such as conjugation with a labeling component. The terms "amino acid" and "amino acids," as used herein, generally refer to natural and non-natural amino acids, including, but not limited to, modified amino acids and amino acid analogues. Modified amino acids may include natural amino acids and non-natural amino acids, which have been chemically modified to include a group or a chemical moiety not naturally present on the amino acid. Amino acid analogues may refer to amino acid derivatives. The term "amino acid" includes both D-amino acids and L-amino acids.

As used herein, the "non-native" can generally refer to a nucleic acid or polypeptide sequence that is not found in a native nucleic acid or protein. Non-native may refer to affinity tags. Non-native may refer to fusions. Non-native may refer to a naturally occurring nucleic acid or polypeptide sequence that comprises mutations, insertions and/or deletions. A non-native sequence may exhibit and/or encode for an activity (e.g., enzymatic activity, methyltransferase activity, acetyltransferase activity, kinase activity, ubiquitinating activity, etc.) that may also be exhibited by the nucleic acid and/or polypeptide sequence to which the non-native sequence is fused. A non-native nucleic acid or polypeptide sequence may be linked to a naturally-occurring nucleic acid or polypeptide sequence (or a variant thereof) by genetic engineering to generate a chimeric nucleic acid and/or polypeptide sequence encoding a chimeric nucleic acid and/or polypeptide.

The term "promoter", as used herein, generally refers to the regulatory DNA region which controls transcription or expression of a gene and which may be located adjacent to or overlapping a nucleotide or region of nucleotides at which RNA transcription is initiated. A promoter may contain specific DNA sequences which bind protein factors, often referred to as transcription factors, which facilitate binding of RNA polymerase to the DNA leading to gene transcription. A 'basal promoter', also referred to as a 'core promoter', may generally refer to a promoter that contains all the basic necessary elements to promote transcriptional expression of an operably linked polynucleotide. Eukaryotic basal promoters typically, though not necessarily, contain a TATA-box and/or a CAAT box.

The term "expression", as used herein, generally refers to the process by which a nucleic acid sequence or a polynucleotide is transcribed from a DNA template (such as into mRNA or other RNA transcript) and/or the process by which a transcribed mRNA is subsequently translated into peptides, polypeptides, or proteins. Transcripts and encoded polypeptides may be collectively referred to as "gene product." If the polynucleotide is derived from genomic DNA, expression may include splicing of the mRNA in a eukaryotic cell.

As used herein, "operably linked", "operable linkage", "operatively linked", or grammatical equivalents thereof generally refer to juxtaposition of genetic elements, e.g., a promoter, an enhancer, a polyadenylation sequence, etc., wherein the elements are in a relationship permitting them to operate in the expected manner. For instance, a regulatory element, which may comprise promoter and/or enhancer sequences, is operatively linked to a coding region if the regulatory element helps initiate transcription of the coding sequence. There may be intervening residues between the regulatory element and coding region so long as this functional relationship is maintained.

A "vector" as used herein, generally refers to a macromolecule or association of macromolecules that comprises or associates with a polynucleotide and which may be used to mediate delivery of the polynucleotide to a cell. Examples of vectors include plasmids, viral vectors, liposomes, and other gene delivery vehicles. The vector generally comprises genetic elements, e.g., regulatory elements, operatively linked to a gene to facilitate expression of the gene in a target.

As used herein, "an expression cassette" and "a nucleic acid cassette" are used interchangeably generally to refer to a combination of nucleic acid sequences or elements that are expressed together or are operably linked for expression. In some cases, an expression cassette refers to the combination of regulatory elements and a gene or genes to which they are operably linked for expression.

A "functional fragment" of a DNA or protein sequence generally refers to a fragment that retains a biological activity (either functional or structural) that is substantially similar to a biological activity of the full-length DNA or protein sequence. A biological activity of a DNA sequence may be its ability to influence expression in a manner known to be attributed to the full-length sequence.

As used herein, an "engineered" object generally indicates that the object has been modified by human intervention. According to non-limiting examples: a nucleic acid may be modified by changing its sequence to a sequence that does not occur in nature; a nucleic acid may be modified by ligating it to a nucleic acid that it does not associate with in nature such that the ligated product possesses a function not present in the original nucleic acid; an engineered nucleic acid may synthesized in vitro with a sequence that does not exist in nature; a protein may be modified by changing its amino acid sequence to a sequence that does not exist in nature; an engineered protein may acquire a new function or property. An "engineered" system comprises at least one engineered component.

As used herein, "synthetic" and "artificial" can generally be used interchangeably to refer to a protein or a domain thereof that has low sequence identity (e.g., less than 50% sequence identity, less than 25% sequence identity, less than 10% sequence identity, less than 5% sequence identity, less than 1% sequence identity) to a naturally occurring human protein. For example, VPR and VP64 domains are synthetic transactivation domains.

As used herein, the term "Cas12a" generally refers to a family of Cas endonucleases that are class 2, Type V-A Cas endonucleases and that (a) use a relatively small guide RNA (about 42-44 nucleotides) that is processed by the nuclease itself following transcription from the CRISPR array, and (b) cleave DNA to leave staggered cut sites. Further features of this family of enzymes can be found, e.g. in Zetsche B, Heidenreich M, Mohanraju P, et al. Nat Biotechnol 2017; 35:31-34, and Zetsche B, Gootenberg J S, Abudayyeh O O, et al. Cell 2015; 163:759-771, which are incorporated by reference herein.

As used herein, a "guide nucleic acid" can generally refer to a nucleic acid that may hybridize to another nucleic acid. A guide nucleic acid may be RNA. A guide nucleic acid may be DNA. The guide nucleic acid may be programmed to bind to a sequence of nucleic acid site-specifically. The nucleic acid to be targeted, or the target nucleic acid, may comprise nucleotides. The guide nucleic acid may comprise nucleotides. A portion of the target nucleic acid may be complementary to a portion of the guide nucleic acid. The strand of a double-stranded target polynucleotide that is complementary to and hybridizes with the guide nucleic acid may be called the complementary strand. The strand of the double-stranded target polynucleotide that is complementary to the complementary strand, and therefore may not be complementary to the guide nucleic acid may be called noncomplementary strand. A guide nucleic acid may comprise a polynucleotide chain and can be called a "single guide nucleic acid." A guide nucleic acid may comprise two polynucleotide chains and may be called a "double guide nucleic acid." If not otherwise specified, the term "guide nucleic acid" may be inclusive, referring to both single guide nucleic acids and double guide nucleic acids. A guide nucleic acid may comprise a segment that can be referred to as a "nucleic acid-targeting segment" or a "nucleic acid-targeting sequence" or "spacer sequence." A nucleic acid-targeting segment may comprise a sub-segment that may be referred to as a "protein binding segment" or "protein binding sequence" or "Cas protein binding segment".

The term "sequence identity" or "percent identity" in the context of two or more nucleic acids or polypeptide sequences, generally refers to two (e.g., in a pairwise alignment) or more (e.g., in a multiple sequence alignment) sequences that are the same or have a specified percentage of amino acid residues or nucleotides that are the same, when compared and aligned for maximum correspondence over a local or global comparison window, as measured using a sequence comparison algorithm. Suitable sequence comparison algorithms for polypeptide sequences include, e.g., BLASTP using parameters of a wordlength (W) of 3, an expectation (E) of 10, and the BLOSUM62 scoring matrix setting gap costs at existence of 11, extension of 1, and using a conditional compositional score matrix adjustment for polypeptide sequences longer than 30 residues; BLASTP using parameters of a wordlength (W) of 2, an expectation (E) of 1000000, and the PAM30 scoring matrix setting gap costs at 9 to open gaps and 1 to extend gaps for sequences of less than 30 residues (these are the default parameters for BLASTP in the BLAST suite available at blast.ncbi.nlm-.nih.gov); CLUSTALW with the Smith-Waterman homology search algorithm parameters with a match of 2, a mismatch of −1, and a gap of −1; MUSCLE with default parameters; MAFFT with parameters of a retree of 2 and max iterations of 1000; Novafold with default parameters; HMMER hmmalign with default parameters.

The term "optimally aligned" in the context of two or more nucleic acids or polypeptide sequences, generally refers to two (e.g., in a pairwise alignment) or more (e.g., in a multiple sequence alignment) sequences that have been aligned to maximal correspondence of amino acids residues or nucleotides, for example, as determined by the alignment producing a highest or "optimized" percent identity score.

Included in the current disclosure are variants of any of the enzymes described herein with one or more conservative amino acid substitutions. Such conservative substitutions can be made in the amino acid sequence of a polypeptide without disrupting the three-dimensional structure or function of the polypeptide. Conservative substitutions can be accomplished by substituting amino acids with similar hydrophobicity, polarity, and R chain length for one another. Additionally, or alternatively, by comparing aligned sequences of homologous proteins from different species, conservative substitutions can be identified by locating amino acid residues that have been mutated between species (e.g., non-conserved residues) without altering the basic functions of the encoded proteins. Such conservatively substituted variants may include variants with at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, at least about 99% identity to any one of the endonuclease protein sequences described herein (e.g. MG11, MG13, MG26, MG28, MG29, MG30, MG31, MG32, MG37, MG53, MG54, MG55, MG56, MG57, MG58, MG59, MG60, MG61, MG62, MG70, MG82, MG83, MG84 or MG85 family endonucleases described herein, or any other family nuclease described herein). In some embodiments, such conservatively substituted variants are functional variants. Such functional variants can encompass sequences with substitutions such that the activity of one or more critical active site residues or guide RNA binding residues of the endonuclease are not disrupted. In some embodiments, a functional variant of any of the proteins described herein lacks substitution of at least one of the conserved or functional residues called out in FIG. 17, 18, 10, 20, or 25 or a residue described in Table 1B. In some embodiments, a functional variant of any of the proteins described herein lacks substitution of all of the conserved or functional residues called out in FIG. 17, 18, 10, 20, or 25 or a residue described in Table 1B.

Also included in the current disclosure are variants of any of the enzymes described herein with substitution of one or more catalytic residues to decrease or eliminate activity of the enzyme (e.g. decreased-activity variants). In some embodiments, a decreased activity variant as a protein described herein comprises a disrupting substitution of at least one, at least two, or all three catalytic residues identified in Table 1B.

Conservative substitution tables providing functionally similar amino acids are available from a variety of references (see, for e.g., Creighton, Proteins: Structures and Molecular Properties (W H Freeman & Co.; 2nd edition (December 1993)). The following eight groups each contain amino acids that are conservative substitutions for one another:

1) Alanine (A), Glycine (G);
2) Aspartic acid (D), Glutamic acid (E);
3) Asparagine (N), Glutamine (Q);
4) Arginine (R), Lysine (K);
5) Isoleucine (I), Leucine (L), Methionine (M), Valine (V);
6) Phenylalanine (F), Tyrosine (Y), Tryptophan (W);
7) Serine (S), Threonine (T); and
8) Cysteine (C), Methionine (M)

Overview

The discovery of new Cas enzymes with unique functionality and structure may offer the potential to further disrupt deoxyribonucleic acid (DNA) editing technologies, improving speed, specificity, functionality, and ease of use. Relative to the predicted prevalence of Clustered Regularly Interspaced Short Palindromic Repeats (CRISPR) systems in microbes and the sheer diversity of microbial species, relatively few functionally characterized CRISPR/Cas enzymes exist in the literature. This is partly because a huge number of microbial species may not be readily cultivated in laboratory conditions. Metagenomic sequencing from natural environmental niches containing large numbers of microbial species may offer the potential to drastically increase the number of new CRISPR/Cas systems known and speed the discovery of new oligonucleotide editing functionalities. A recent example of the fruitfulness of such an approach is demonstrated by the 2016 discovery of CasX/CasY CRISPR systems from metagenomic analysis of natural microbial communities.

CRISPR/Cas systems are RNA-directed nuclease complexes that have been described to function as an adaptive immune system in microbes. In their natural context, CRISPR/Cas systems occur in CRISPR (clustered regularly interspaced short palindromic repeats) operons or loci, which generally comprise two parts: (i) an array of short repetitive sequences (30-40 bp) separated by equally short spacer sequences, which encode the RNA-based targeting element; and (ii) ORFs encoding the Cas encoding the nuclease polypeptide directed by the RNA-based targeting element alongside accessory proteins/enzymes. Efficient nuclease targeting of a particular target nucleic acid sequence generally requires both (i) complementary hybridization between the first 6-8 nucleic acids of the target (the target seed) and the crRNA guide; and (ii) the presence of a protospacer-adjacent motif (PAM) sequence within a defined vicinity of the target seed (the PAM usually being a sequence not commonly represented within the host genome). Depending on the exact function and organization of the system, CRISPR-Cas systems are commonly organized into 2 classes, 5 types and 16 subtypes based on shared functional characteristics and evolutionary similarity (see FIG. 1).

Class I CRISPR-Cas systems have large, multi-subunit effector complexes, and comprise Types I, III, and IV. Class II CRISPR-Cas systems generally have single-polypeptide multidomain nuclease effectors, and comprise Types II, V and VI.

Type II CRISPR-Cas systems are considered the simplest in terms of components. In Type II CRISPR-Cas systems, the processing of the CRISPR array into mature crRNAs does not require the presence of a special endonuclease subunit, but rather a small trans-encoded crRNA (tracrRNA) with a region complementary to the array repeat sequence; the tracrRNA interacts with both its corresponding effector nuclease (e.g. Cas9) and the repeat sequence to form a precursor dsRNA structure, which is cleaved by endogenous RNAse III to generate a mature effector enzyme loaded with both tracrRNA and crRNA. Cas II nucleases are known as DNA nucleases. Type 2 effectors generally exhibit a structure consisting of a RuvC-like endonuclease domain that adopts the RNase H fold with an unrelated HNH nuclease domain inserted within the folds of the RuvC-like nuclease domain. The RuvC-like domain is responsible for the cleavage of the target (e.g., crRNA complementary) DNA strand, while the HNH domain is responsible for cleavage of the displaced DNA strand.

Type V CRISPR-Cas systems are characterized by a nuclease effector (e.g. Cas12) structure similar to that of Type II effectors, comprising a RuvC-like domain. Similar to Type II, most (but not all) Type V CRISPR systems use a tracrRNA to process pre-crRNAs into mature crRNAs; however, unlike Type II systems which requires RNAse III to cleave the pre-crRNA into multiple crRNAs, type V systems are capable of using the effector nuclease itself to cleave pre-crRNAs. Like Type-II CRISPR-Cas systems, Type V CRISPR-Cas systems are again known as DNA nucleases. Unlike Type II CRISPR-Cas systems, some Type V enzymes (e.g., Cas12a) appear to have a robust single-stranded nonspecific deoxyribonuclease activity that is activated by the first crRNA directed cleavage of a double-stranded target sequence.

CRISPR-Cas systems have emerged in recent years as the gene editing technology of choice due to their targetability and ease of use. The most commonly used systems are the Class 2 Type II SpCas9 and the Class 2 Type V-A Cas12a (previously Cpf1). The Type V-A systems in particular are becoming more widely used since their reported specificity in cells is higher than other nucleases, with fewer or no off-target effects. The V-A systems are also advantageous in that the guide RNA is small (42-44 nucleotides compared with approximately 100 nt for SpCas9) and is processed by the nuclease itself following transcription from the CRISPR array, simplifying multiplexed applications with multiple gene edits. Furthermore, the V-A systems have staggered cut sites, which may facilitate directed repair pathways, such as microhomology-dependent targeted integration (MITI).

The most commonly used Type V-A enzymes require a 5' protospacer adjacent motif (PAM) next to the chosen target site: 5'-TTTV-3' for Lachnospiraceae bacterium ND2006 LbCas12a and *Acidaminococcus* sp. AsCas12a; and 5'-TTV-3' for *Francisella novicida* FnCas12a. Recent exploration of orthologs has revealed proteins with less restrictive PAM sequences that are also active in mammalian cell culture, for example YTV, YYN or TTN. However, these enzymes do not fully encompass V-A biodiversity and targetability, and may not represent all possible activities and PAM sequence requirements. Here, thousands of genomic fragments were mined from numerous metagenomes for Type V-A nucleases. The known diversity of V-A enzymes may have been expanded and novel systems may have been developed into highly targetable, compact, and precise gene editing agents.

MG Enzymes

Type V-A CRISPR systems are quickly being adopted for use in a variety of genome editing applications. These programmable nucleases are part of adaptive microbial immune systems, the natural diversity of which has been largely unexplored. Novel families of Type V-A CRISPR enzymes were identified through a large-scale analysis of metagenomes collected from a variety of complex environments, and developed representatives of these systems into gene-editing platforms. The nucleases are phylogenetically diverse (see FIG. 4A) and recognize a single guide RNA with specific motifs. The majority of these systems come from uncultivated organisms, some of which encode a divergent Type V effector within the same CRISPR operon. Biochemical analysis uncovered unexpected PAM diversity (see FIG. 4B), indicating that these systems will facilitate a variety of genome engineering applications. The simplicity of guide sequences and activity in human cell lines suggest utility in gene and cell therapies.

Figure 28:
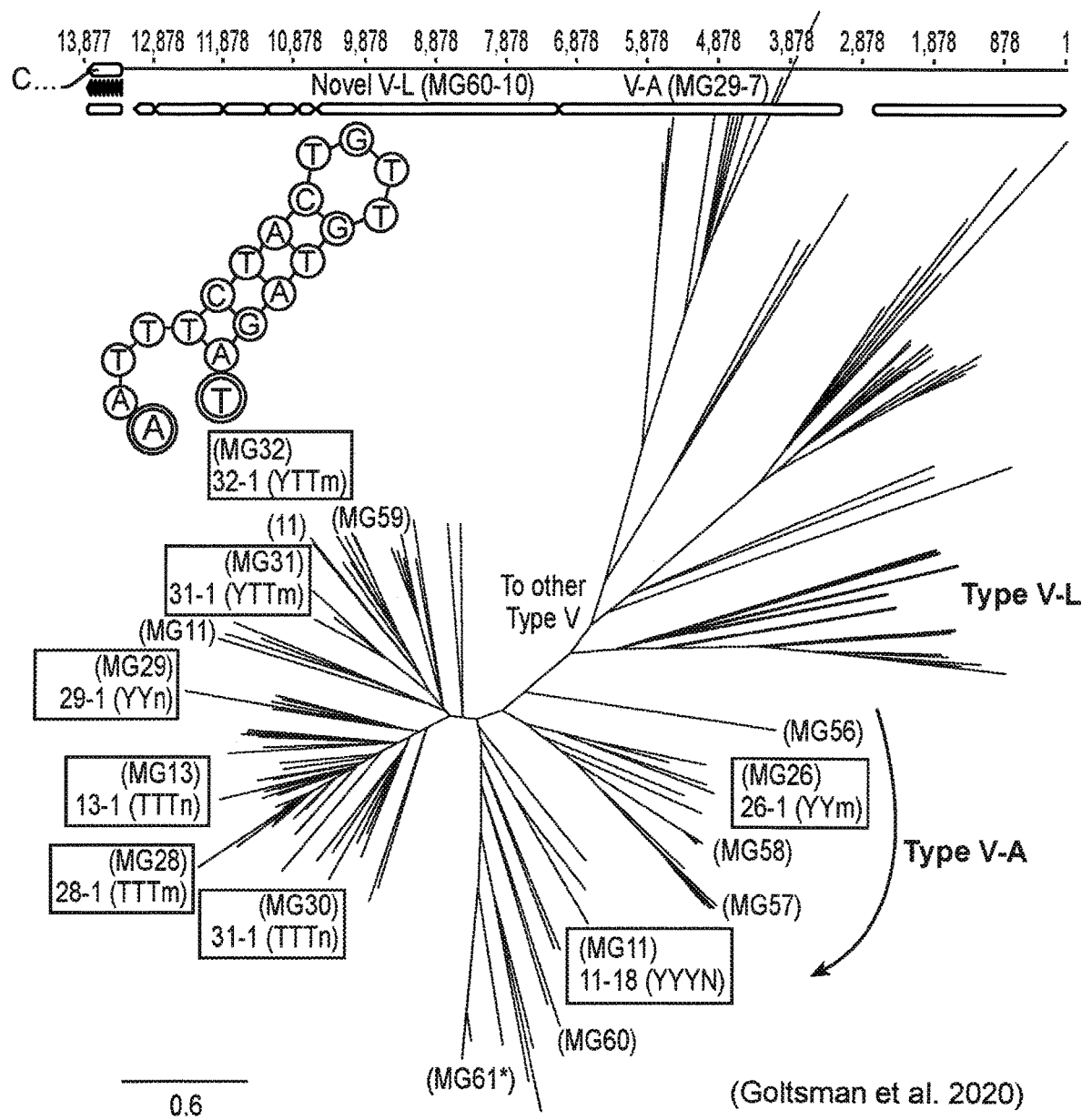
FIG. 28 shows a Type V-L candidate labeled MG60 as an example locus organization alongside an effector repeat structure and a phylogenetic tree showing the location of the enzyme in the Type V families.
Figure 32:
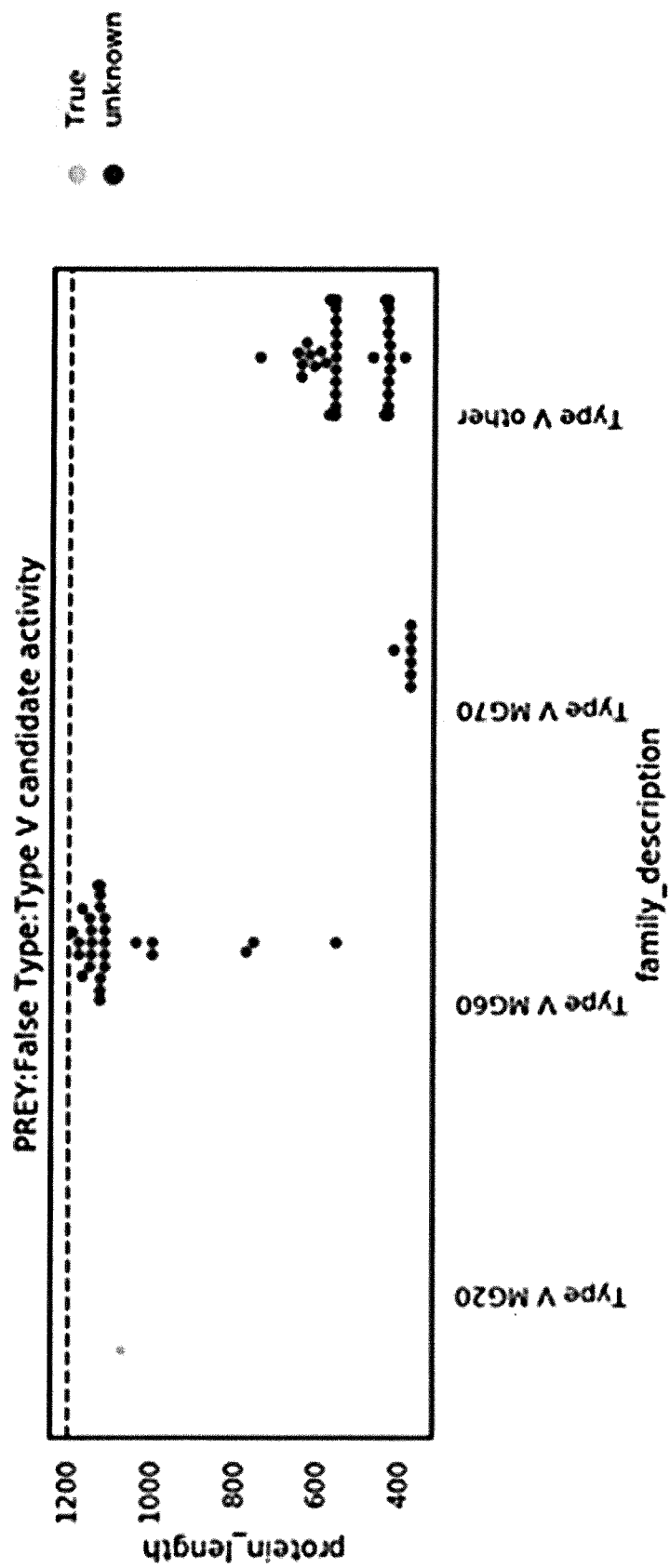
FIG. 32 shows that the activity individual enzymes of Type V effector families identified herein (e.g. MG20, MG60, MG70, other) is maintained over a variety of different enzyme lengths (e.g. 400-1200 AA). Light dots (True) indicate active enzymes while dark dots (unknown) indicate untested enzymes.
Figure 33:
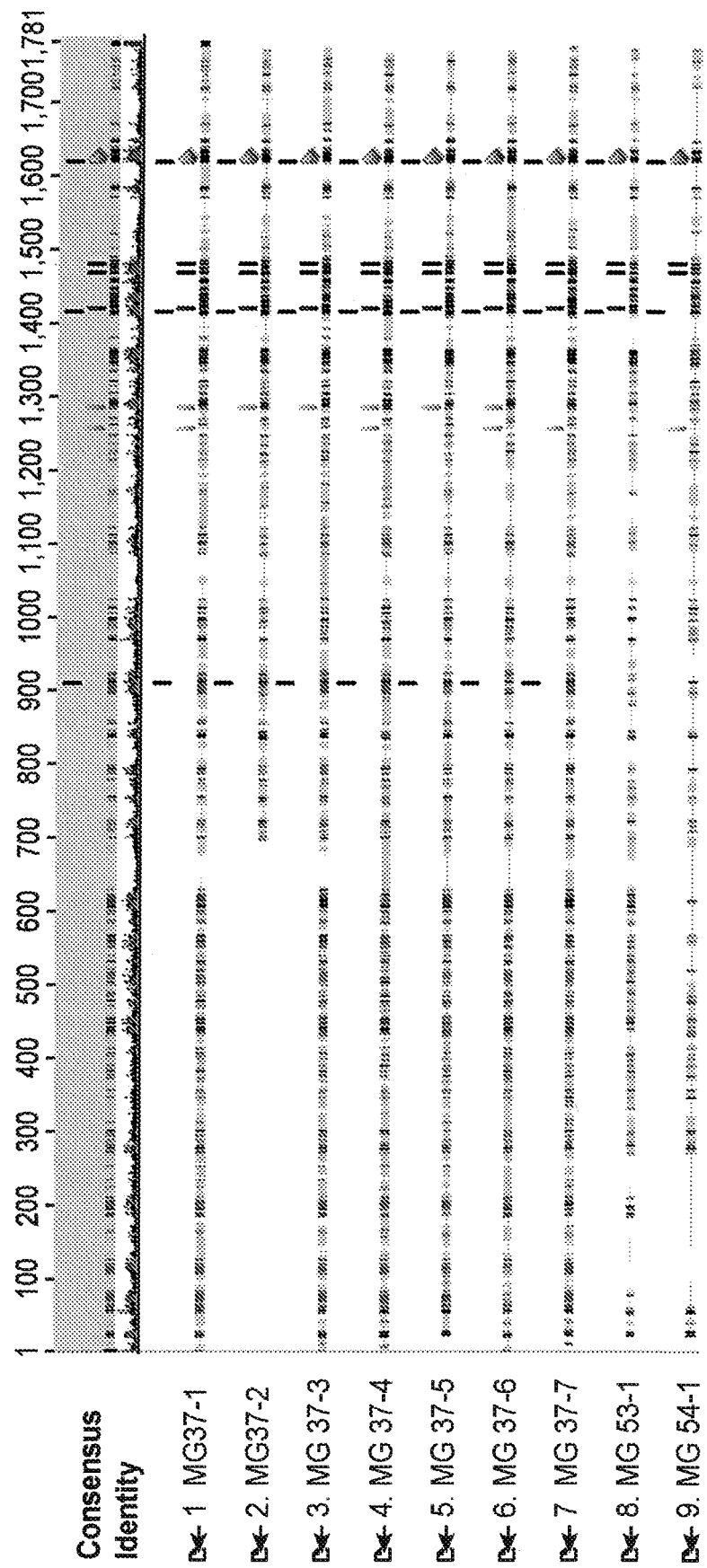
FIG. 33 depicts sequence conservation of MG nucleases described herein. The black bars indicate putative RuvC catalytic residues.
Figure 34:
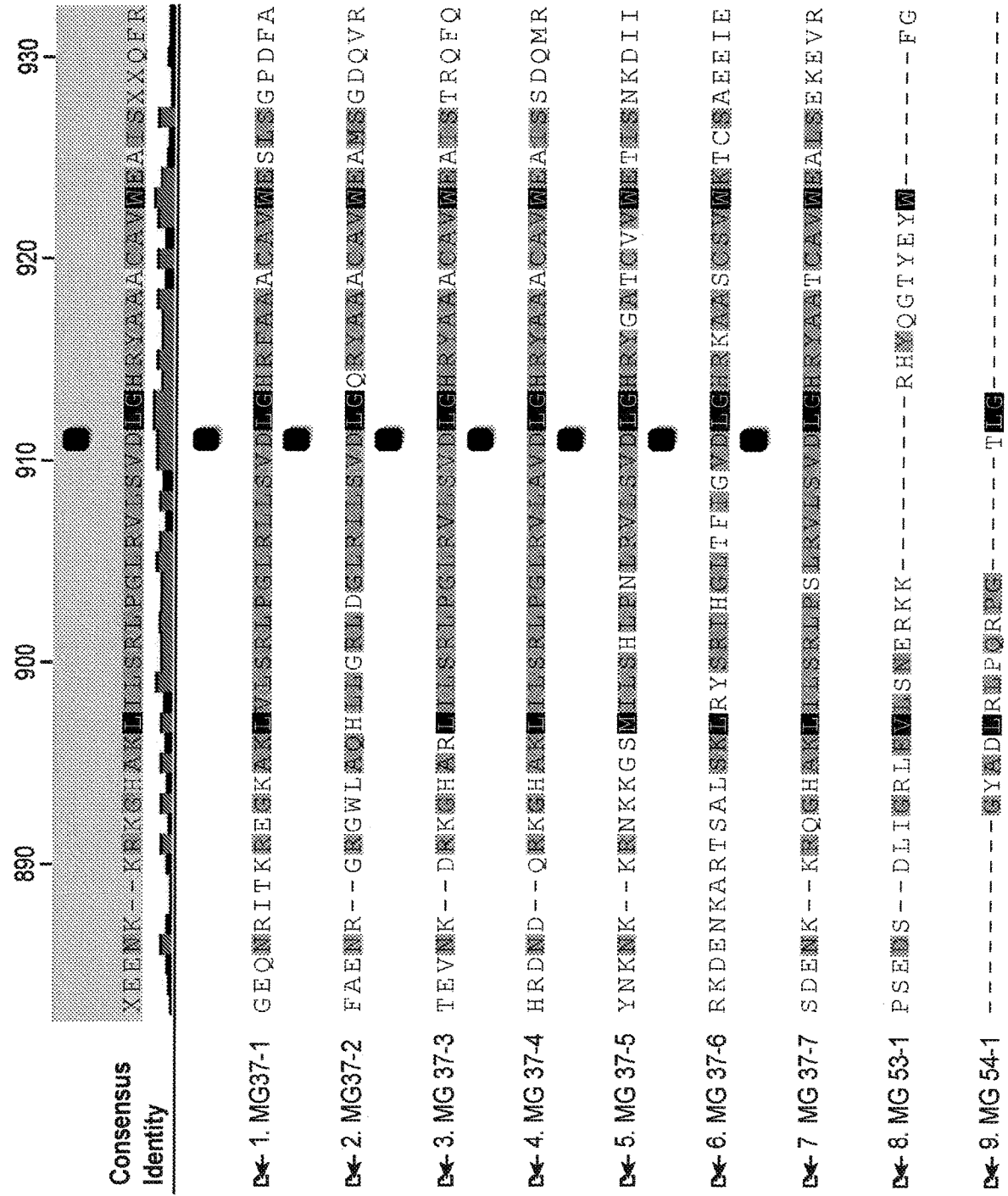
Figure 36:
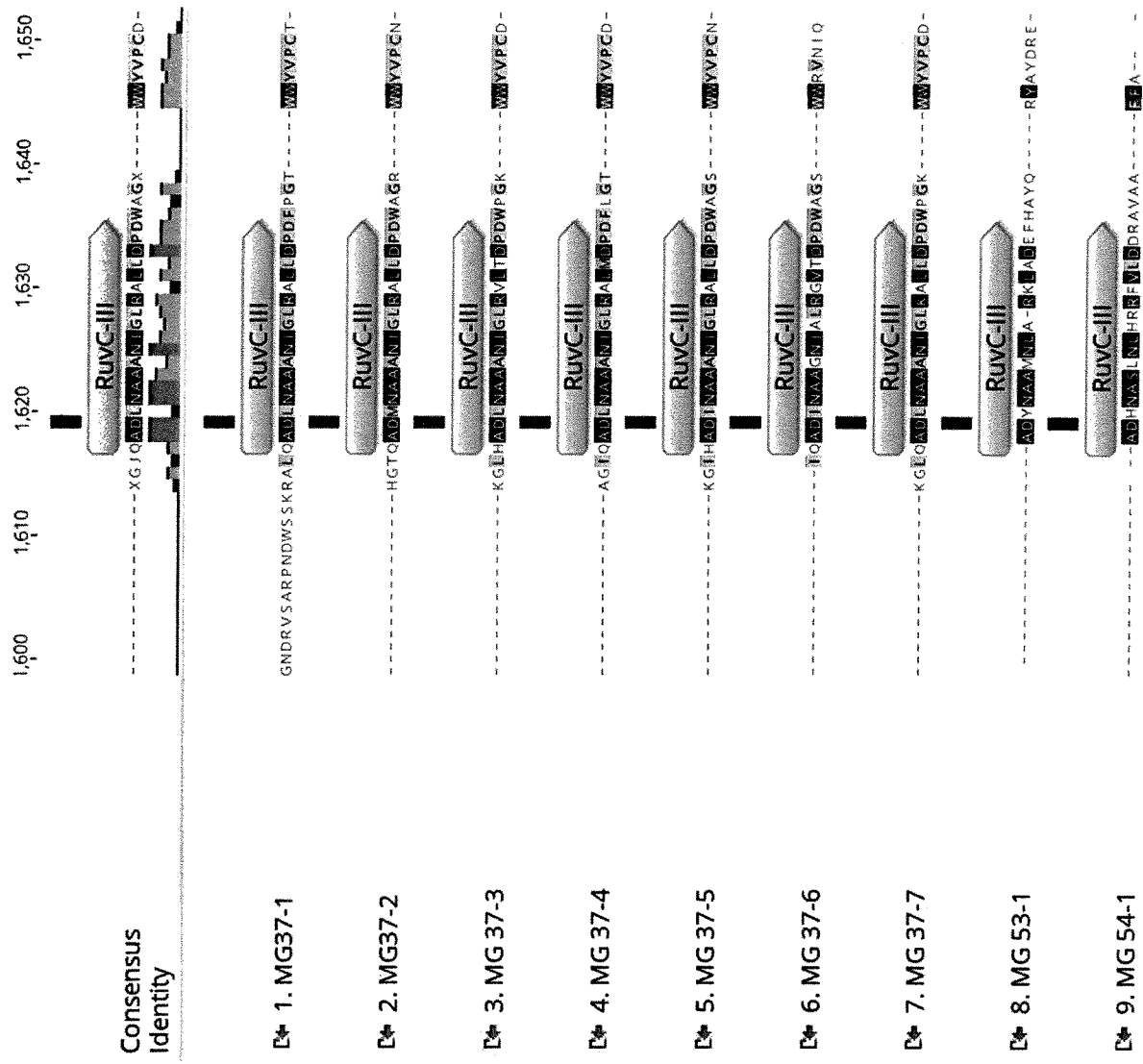
FIG. 36 depicts the regions of the MG nucleases described herein containing putative RuvC-III domain & catalytic residues (sequences from top to bottom in order of appearance are SEQ ID NOs: 4483-4492).
Figure 37:
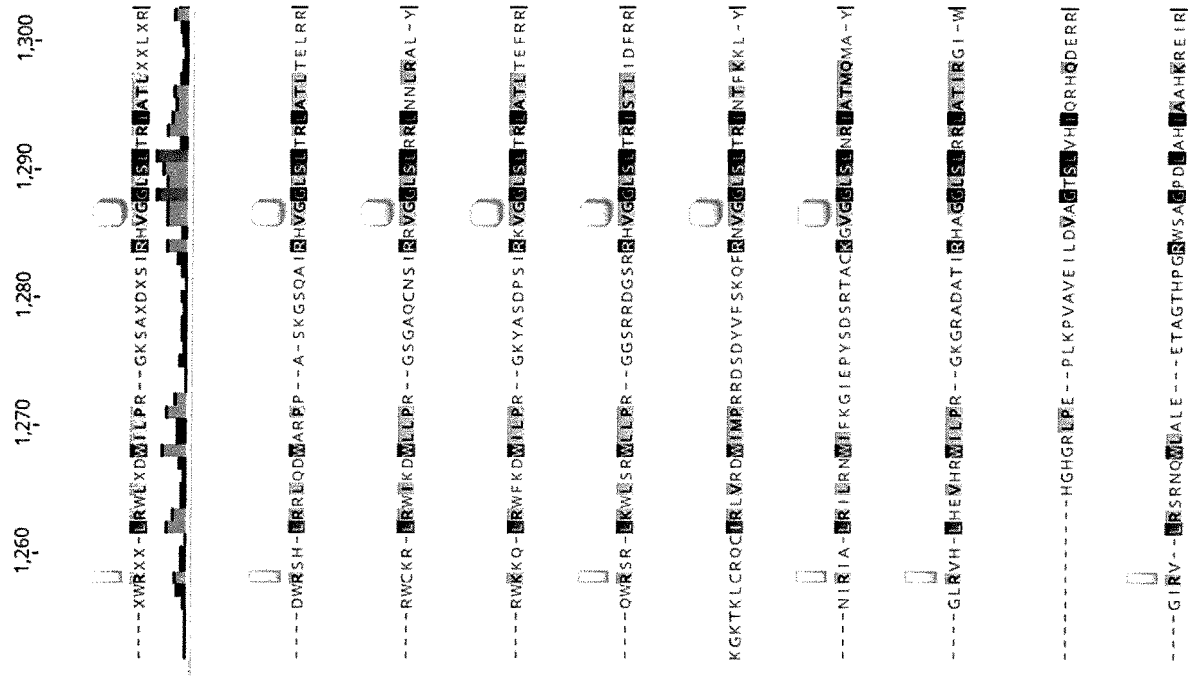
FIG. 37 depicts regions of the MG nucleases containing putative single-guide RNA-binding residues (white rectangles above sequences) (sequences from top to bottom in order of appearance are SEQ ID NOs: 4493-4502).

In some aspects, the present disclosure provides for novel Type V-L candidates (see FIG. 27). Type V-L may be a novel subtype and some sub-families may have been identified. These nucleases are about 1000-1100 amino acids in length. Type V-L may be found in the same CRISPR locus as Type V-A effectors. RuvC catalytic residues may have been identified for Type V-L candidates and these Type V-L candidates may not require tracrRNA. One example of a Type V-L are the MG60 nucleases described herein (see FIG. 28 and FIG. 32).

Figure 30:
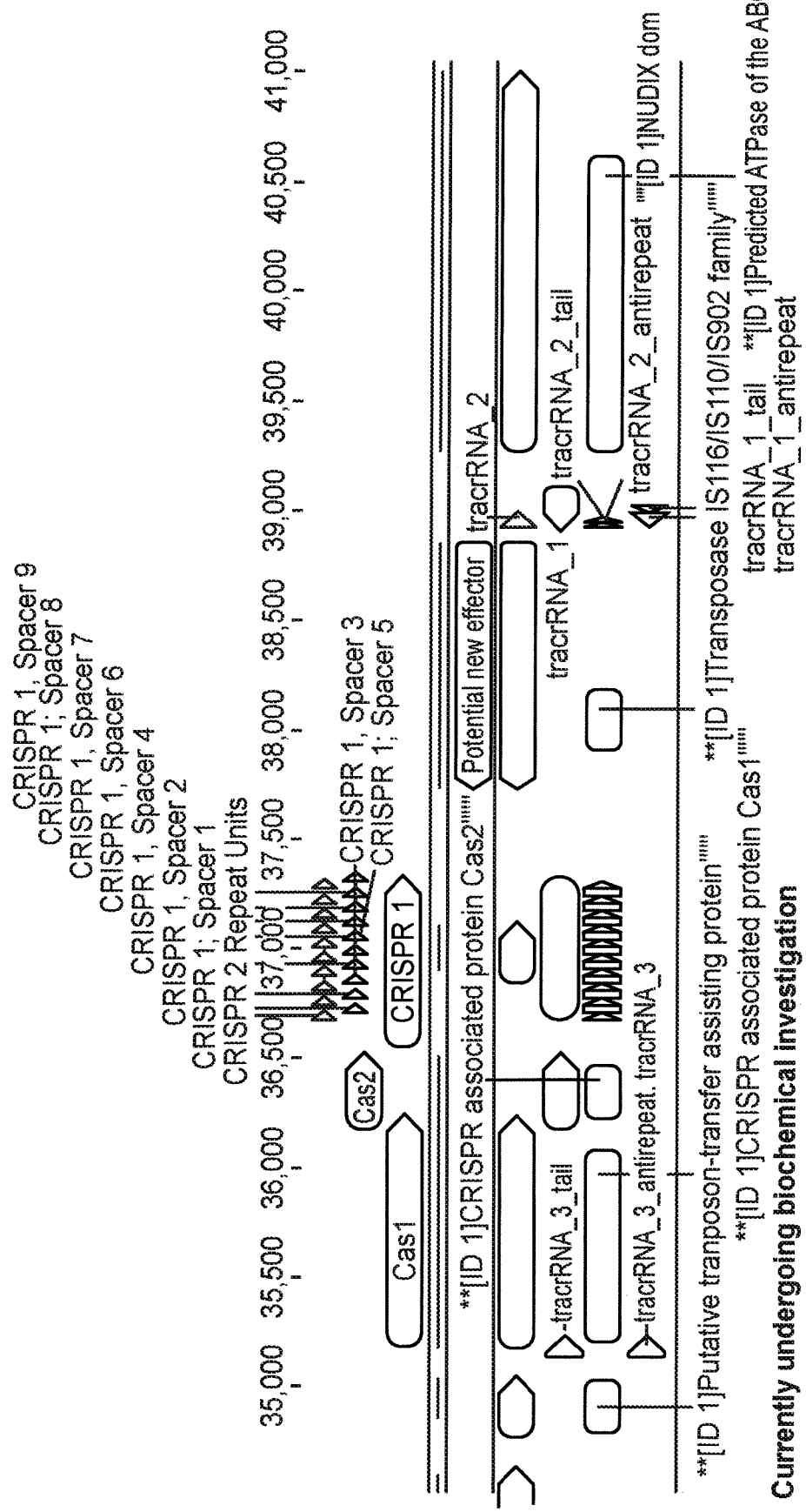
FIG. 30 shows characteristic information of MG70 as described herein. Depicted is an example locus organization alongside a phylogenetic tree illustrating the location of these enzymes in the Type V family.
Figure 30:
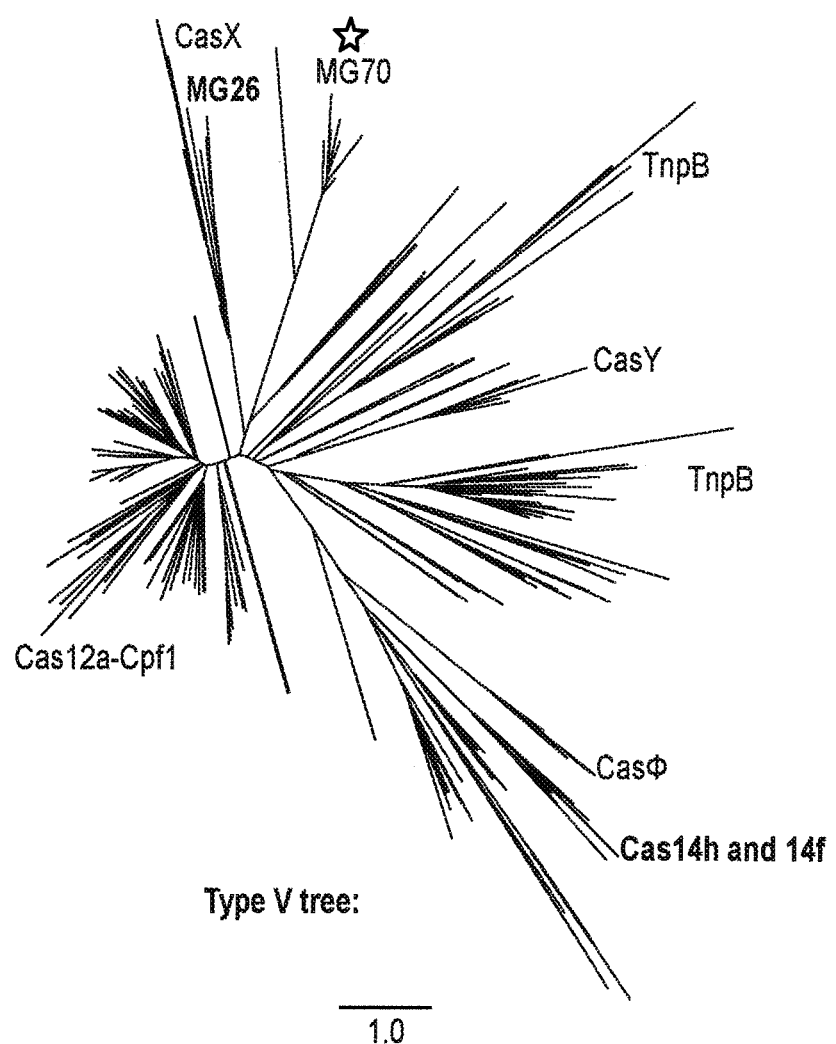
Figure 30:

In some aspects, the present disclosure provides for smaller Type V effectors (see FIG. 30). Such effectors may be small putative effectors. These effectors may simplify delivery and may extend therapeutic applications.

Figure 29:
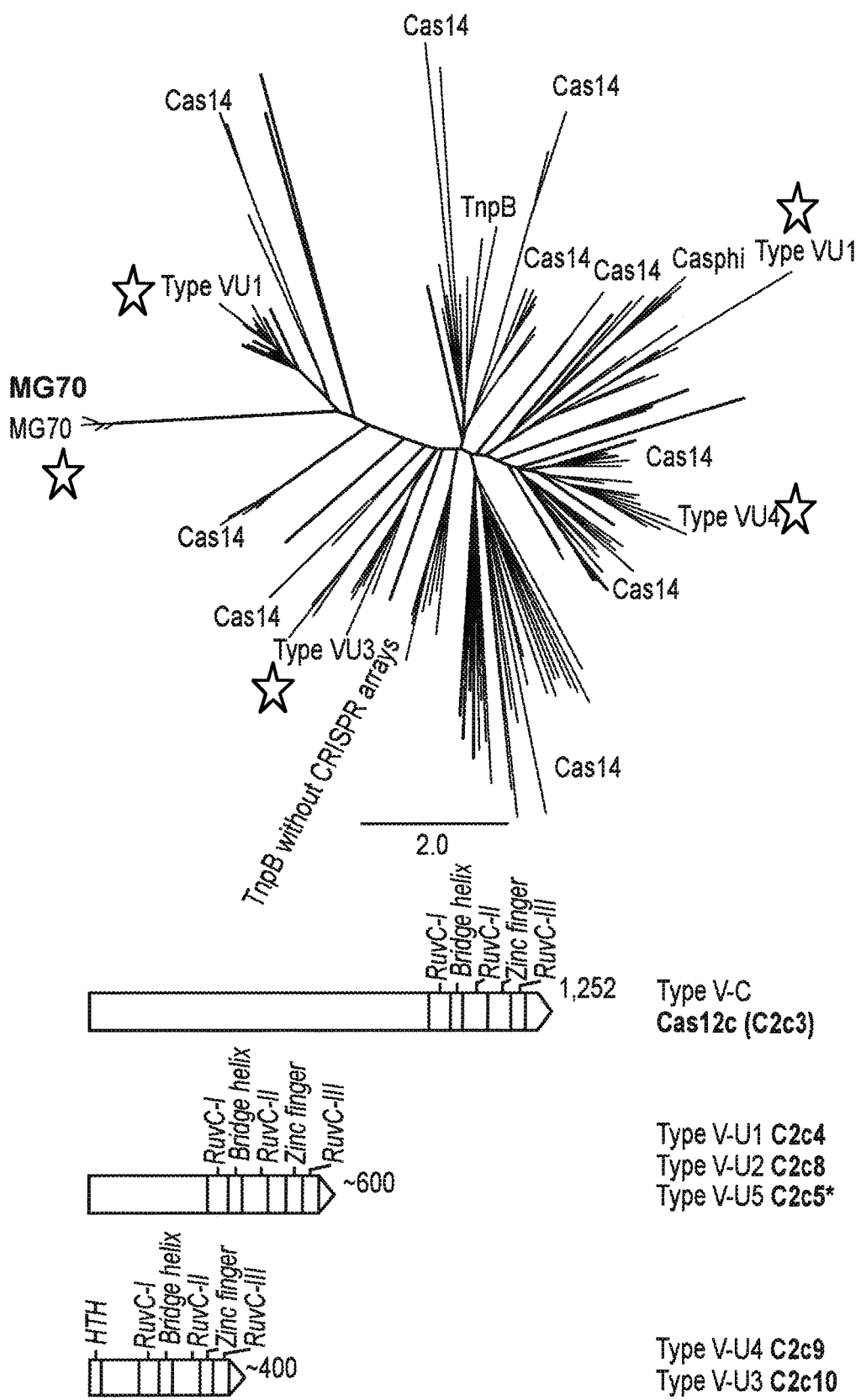
FIG. 29 shows examples of smaller Type V effectors one of which may be labeled as MG70.

In some aspects, the present disclosure provides for novel type V effector. Such an effector may be MG70 as described herein (see FIG. 29). MG70 may be an ultra-small enzyme of about 373 amino acids in length. MG 70 may have a single transposase domain at the N-terminus and may have a predicted tracrRNA (see FIG. 30 and FIG. 32).

Figure 31:
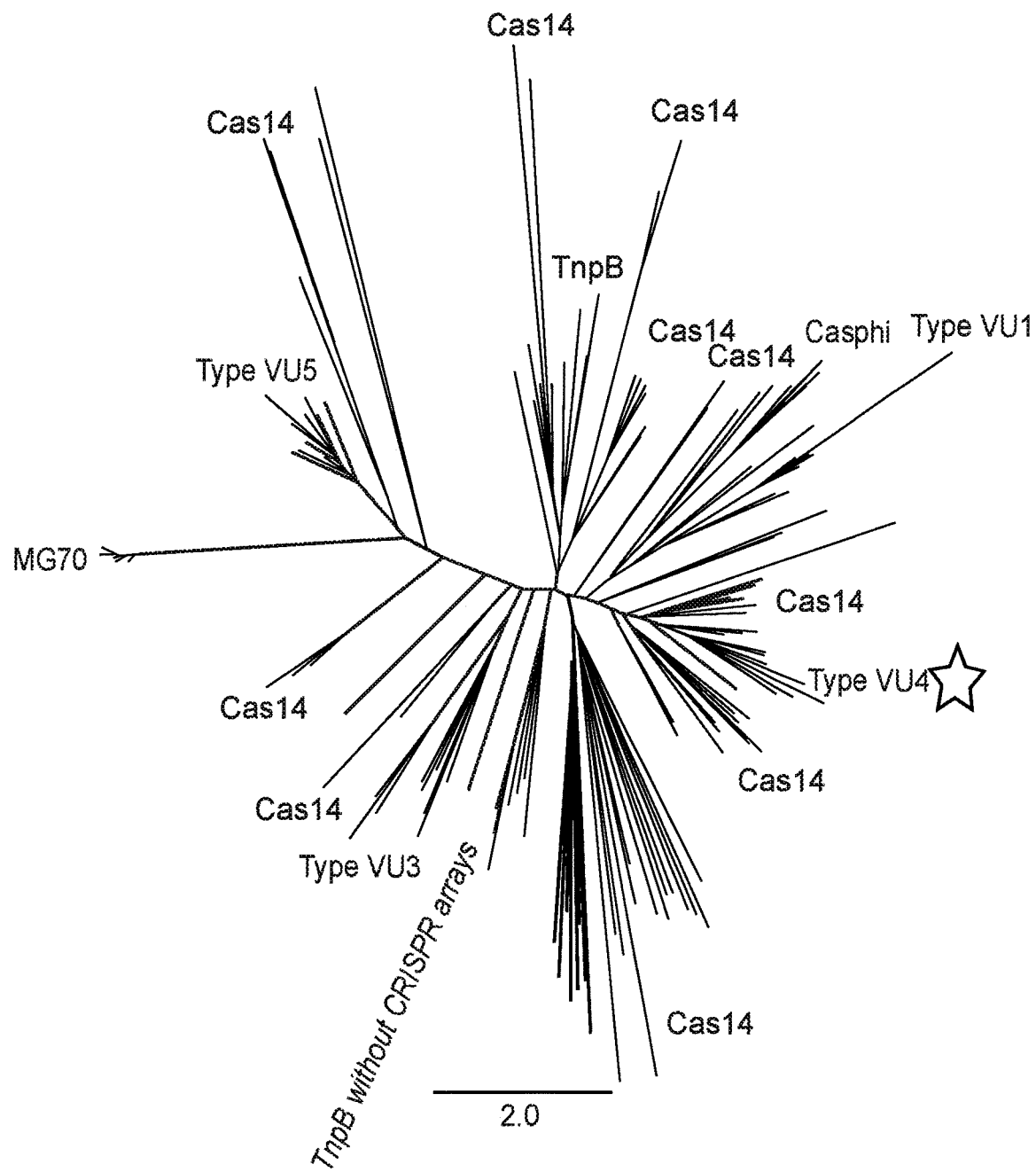
FIG. 31 shows another example of a small Type V effector MG81 as described herein. Depicted is an example locus organization alongside a phylogenetic tree illustrating the location of these enzymes in the Type V family.
Figure 31:
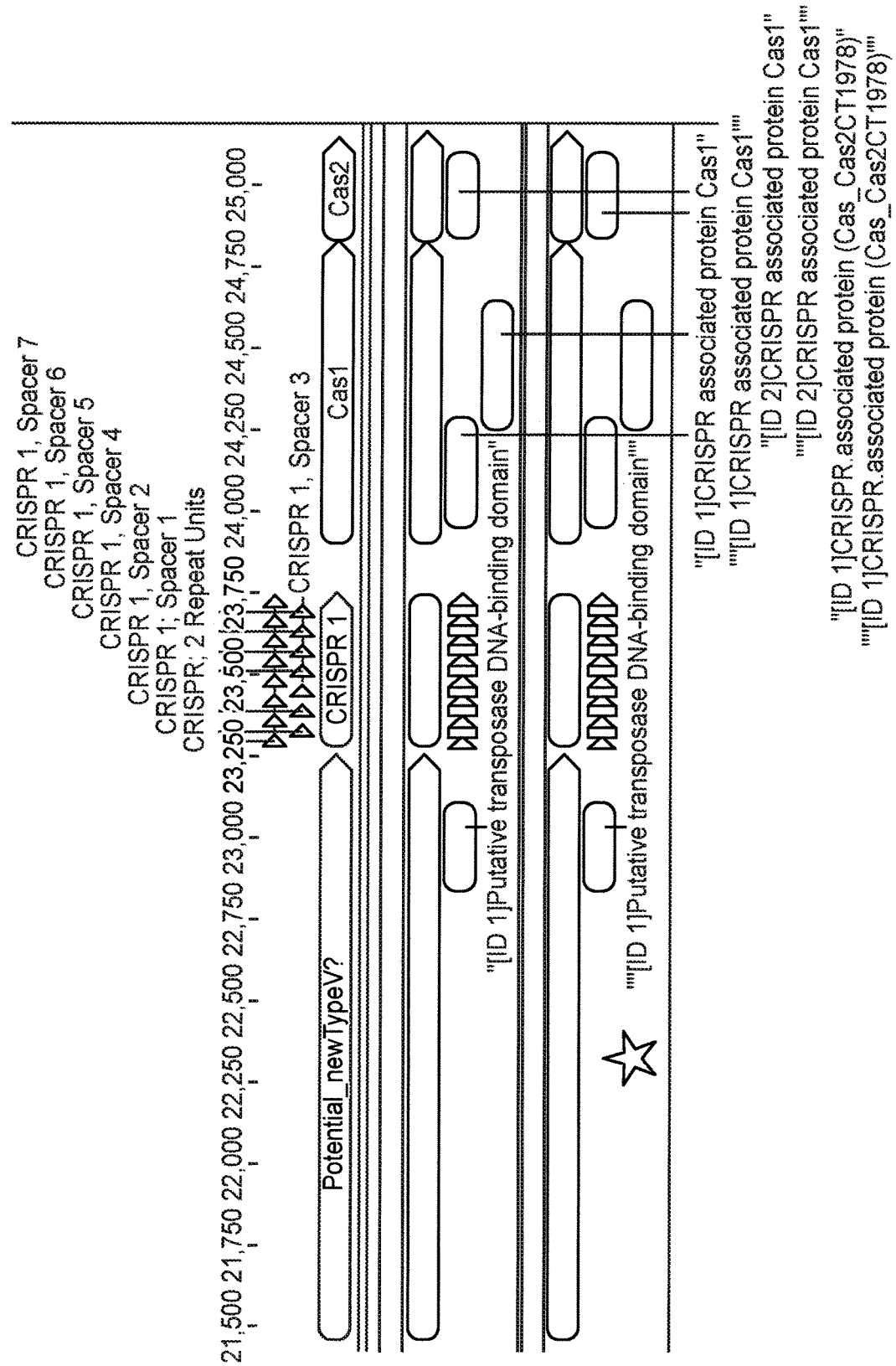

In some aspects, the present disclosure provides for a smaller Type V effector (see FIG. 31). Such an effector may be MG81 described herein. MG81 may be about 500-700 amino acids in length and may contain RuvC, and HTH DNA binding domains.

Figure 2:
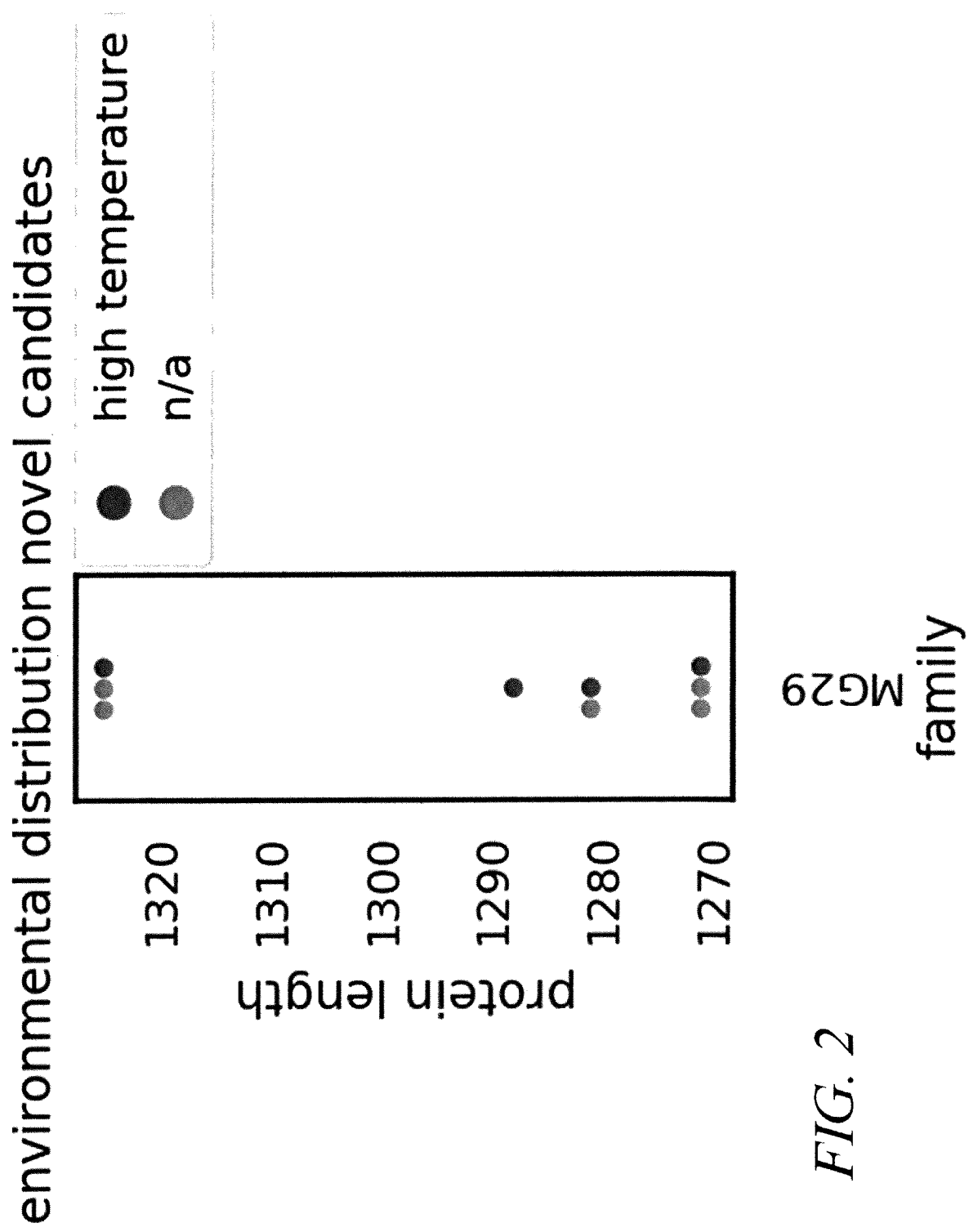
FIG. 2 depicts environmental distribution of MG nucleases described herein. Protein length is shown for representatives of the MG29 protein family. Shades of circle indicates the environment or environment type from which each protein was identified (dark gray circle indicates high temperature environment source; light gray circle indicates non-high temperature environment source). N/A denotes the type of environment the sample was collected from is unknown.

In one aspect, the present disclosure provides for an engineered nuclease system discovered through metagenomic sequencing. In some cases, the metagenomic sequencing is conducted on samples. In some cases, the samples may be collected from a variety of environments. Such environments may be a human microbiome, an animal microbiome, environments with high temperatures, environments with low temperatures. Such environments may include sediment. An example of the types of such environments of the engineered nuclease systems described herein may be found in FIG. 2.

In one aspect, the present disclosure provides for an engineered nuclease system comprising (a) an endonuclease. In some cases, the endonuclease is a Cas endonuclease. In some cases, the endonuclease is a class 2, type V Cas endonuclease. In some cases, the endonuclease is a class 2, type V-A Cas endonuclease. In some cases, the endonuclease is derived from an uncultivated microorganism. The endonuclease may comprise a RuvC domain. In some cases, the engineered nuclease system comprises (b) an engineered guide RNA. In some cases, the engineered guide RNA is configured to form a complex with the endonuclease. In some cases, the engineered guide RNA comprises a spacer sequence. In some cases, the spacer sequence is configured to hybridize to a target nucleic acid sequence.

In one aspect, the present disclosure provides for an engineered nuclease system comprising (a) an endonuclease. In some cases, the endonuclease has at least about 70% sequence identity to any one of SEQ ID NOs: 1-3470. In some cases, the endonuclease has at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, or at least about 99% identity to any one of SEQ ID NOs: 1-3470.

In some cases, the endonuclease comprises a variant having at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, or at least about 99% identity to any one of SEQ ID NOs: 1-3470. In some cases, the endonuclease may be substantially identical to any one of SEQ ID NOs: 1-3470.

In some cases, the engineered nuclease system comprises an engineered guide RNA. In some cases, the engineered guide RNA is configured to form a complex with the endonuclease. In some cases, the engineered guide RNA comprises a spacer sequence. In some cases, the spacer sequence is configured to hybridize to a target nucleic acid sequence.

In one aspect, the present disclosure provides an engineered nuclease system comprising (a) an endonuclease. In some cases, the endonuclease is configured to bind to a protospacer adjacent motif (PAM) sequence. In some cases, the PAM sequence is substantially identical to any one of SEQ ID NOs: 3863-3913. In some cases, the PAM sequence any one of SEQ ID NOs: 3863-3913. In some cases, the endonuclease is a Cas endonuclease. In some cases, the endonuclease is a class 2 Cas endonuclease. In some cases, the endonuclease is a class 2, type V Cas endonuclease. In some cases, the endonuclease is a class 2, type V-A Cas endonuclease. In some cases, the engineered nuclease system comprises (b) an engineered guide RNA. In some cases, the engineered guide RNA is configured to form a complex with the endonuclease. In some cases, the engineered guide RNA comprises a spacer sequence. In some cases, the spacer sequence is configured to hybridize to a target nucleic acid sequence.

In some cases, the endonuclease is not a Cpf1 or Cms1 endonuclease. In some cases, the endonuclease further comprises a zinc finger-like domain.

In some cases, the guide RNA comprises a sequence with at least 80% sequence identity to the first 19 nucleotides or the non-degenerate nucleotides of SEQ ID NO: 3471, 3539, 3551-3559, 3608-3609, 3612, 3636-3637, 3640-3641, 3644-3645, 3648-3649, 3652-3653, 3656-3657, 3660-3661, 3664-3667, 3671-3672, 3677-3678, 3695-3696, 3729-3730, 3734-3735, or 3851-3857. In some cases, the guide RNA comprises a sequence with at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, or at least about 99% identity to the first 19 nucleotides or the non-degenerate nucleotides of SEQ ID NO: 3471, 3539, 3551-3559, 3608-3609, 3612, 3636-3637, 3640-3641, 3644-3645, 3648-3649, 3652-3653, 3656-3657, 3660-3661, 3664-3667, 3671-3672, 3677-3678, 3695-3696, 3729-3730, 3734-3735, or 3851-3857. In some cases, the guide RNA comprises a variant having at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, or at least about 99% identity to the first 19 nucleotides or the non-degenerate nucleotides of SEQ ID NO: 3471, 3539, 3551-3559, 3608-3609, 3612, 3636-3637, 3640-3641, 3644-3645, 3648-3649, 3652-3653, 3656-3657, 3660-3661, 3664-3667, 3671-3672, 3677-3678, 3695-3696, 3729-3730, 3734-3735, or 3851-3857. In some cases, the guide RNA comprises a sequence which is substantially identical to the first 19 nucleotides or the non-degenerate nucleotides of SEQ ID NO: 3471, 3539, 3551-3559, 3608-3609, 3612, 3636-3637, 3640-3641, 3644-3645, 3648-3649, 3652-3653, 3656-3657, 3660-3661, 3664-3667, 3671-3672, 3677-3678, 3695-3696, 3729-3730, 3734-3735, or 3851-3857.

In some cases, the guide RNA comprises a sequence with at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, or at least about 99% identity to the first 19 nucleotides or the non-degenerate nucleotides of SEQ ID NO: 3471, 3539, 3551-3559, 3608-3609, 3612, 3636-3637, 3640-3641, 3644-3645, 3648-3649, 3652-3653, 3656-3657, 3660-3661, 3664-3667, 3671-3672, 3677-3678, 3695-3696, 3729-3730, 3734-3735, or 3851-3857. In some cases, the endonuclease is configured to bind to the engineered guide RNA. In some cases, the Cas endonuclease is configured to bind to the engineered guide RNA. In some cases, the class 2 Cas endonuclease is configured to bind to the engineered guide RNA. In some cases, the class 2, type V Cas endonuclease is configured to bind to the engineered guide RNA. In some cases, the class 2, type V-A Cas endonuclease is configured to bind to the engineered guide RNA.

In some cases, the endonuclease is configured to bind to a protospacer adjacent motif (PAM) sequence comprising any one of SEQ ID NOs: 3863-3913.

In some cases, the guide RNA comprises a sequence complementary to a eukaryotic, fungal, plant, mammalian, or human genomic polynucleotide sequence. In some cases, the guide RNA comprises a sequence complementary to a eukaryotic genomic polynucleotide sequence. In some cases, the guide RNA comprises a sequence complementary to a fungal genomic polynucleotide sequence. In some cases, the guide RNA comprises a sequence complementary to a plant genomic polynucleotide sequence. In some cases, the guide RNA comprises a sequence complementary to a mammalian genomic polynucleotide sequence. In some cases, the guide RNA comprises a sequence complementary to a human genomic polynucleotide sequence.

In some cases, the guide RNA is 30-250 nucleotides in length. In some cases, the guide RNA is 42-44 nucleotides in length. In some cases, the guide RNA is 42 nucleotides in length. In some cases, the guide RNA is 43 nucleotides in length. In some cases, the guide RNA is 44 nucleotides in length. In some cases, the guide RNA is 85-245 nucleotides in length. In some cases, the guide RNA is more than 90 nucleotides in length. In some cases, the guide RNA is less than 245 nucleotides in length.

In some cases, the endonuclease may comprise a variant having one or more nuclear localization sequences (NLSs). The NLS may be proximal to the N- or C-terminus of the endonuclease. The NLS may be appended N-terminal or C-terminal to any one of SEQ ID NOs: 3938-3953, or to a variant having at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, or at least about 99% identity to any one of SEQ ID NOs: 3938-3953. In some cases, the NLS may comprise a sequence substantially identical to any one of SEQ ID NOs: 3938-3953.

TABLE 1

Example NLS Sequences that may be used with Cas Effectors according to the disclosure.

| Source | NLS amino acid sequence | SEQ ID NO: |
|---|---|---|
| SV40 | PKKKRKV | 3938 |
| nucleoplasmin bipartite NLS | KRPAATKKAGQAKKKK | 3939 |
| c-myc NLS | PAAKRVKLD | 3940 |
| c-myc NLS | RQRRNELKRSP | 3941 |

TABLE 1-continued

Example NLS Sequences that may be used
with Cas Effectors according to the
disclosure.

| Source | NLS amino acid sequence | SEQ ID NO: |
|---|---|---|
| hRNPA1 M9NLS | NQSSNFGPMKGGNF GGRSSGPYGGGGQY FAKPRNQGGY | 3942 |
| Importin-alpha IBB domain | RMRIZFKNKGKDTA ELRRRRVEVSVELR KAKKDEQILKRRNV | 3943 |
| Myoma T protein | VSRKRPRP | 3944 |
| Myoma T protein | PPKKARED | 3945 |
| p53 | PQPKKKPL | 3946 |
| mouse c-abl IV | SALIKKKKKMAP | 3947 |
| influenza virus NS1 | DRLRR | 3948 |
| influenza virus NS1 | PKQKKRK | 3949 |
| Hepatitis virus delta antigen | RKLKKKIKKL | 3950 |
| mouse Mx1 protein | REKKKFLKRR | 3951 |
| human poly(ADP-ribose) polymerase | KRKGDEVDGVDEVA KKKSKK | 3952 |
| steroid hormone receptors (human) glucocorticoid | RKCLQAGMNLEARK TKK | 3953 |

In some cases, the engineered nuclease system further comprises a single- or double stranded DNA repair template. In some cases, the engineered nuclease system further comprises a single-stranded DNA repair template. In some cases, the engineered nuclease system further comprises a double-stranded DNA repair template. In some cases, the single- or double-stranded DNA repair template may comprise from 5' to 3': a first homology arm comprising a sequence of at least 20 nucleotides 5' to said target deoxyribonucleic acid sequence, a synthetic DNA sequence of at least 10 nucleotides, and a second homology arm comprising a sequence of at least 20 nucleotides 3' to said target sequence.

In some cases, the first homology arm comprises a sequence of at least 40, at least 50, at least 60, at least 70, at least 80, at least 90, at least 100, at least 110, at least 120, at least 130, at least 140, at least 150, at least 175, at least 200, at least 250, at least 300, at least 400, at least 500, at least 750, or at least 1000 nucleotides. In some cases, the second homology arm comprises a sequence of at least 40, at least 50, at least 60, at least 70, at least 80, at least 90, at least 100, at least 110, at least 120, at least 130, at least 140, at least 150, at least 175, at least 200, at least 250, at least 300, at least 400, at least 500, at least 750, or at least 1000 nucleotides.

In some cases, the first and second homology arms are homologous to a genomic sequence of a prokaryote. In some cases, the first and second homology arms are homologous to a genomic sequence of a bacteria. In some cases, the first and second homology arms are homologous to a genomic sequence of a fungus. In some cases, the first and second homology arms are homologous to a genomic sequence of a eukaryote.

In some cases, the engineered nuclease system further comprises a DNA repair template. The DNA repair template may comprise a double-stranded DNA segment. The double-stranded DNA segment may be flanked by one single-stranded DNA segment. The double-stranded DNA segment may be flanked by two single-stranded DNA segments. In some cases, the single-stranded DNA segments are conjugated to the 5' ends of the double-stranded DNA segment. In some cases, the single stranded DNA segments are conjugated to the 3' ends of the double-stranded DNA segment.

In some cases, the single-stranded DNA segments have a length from 1 to 15 nucleotide bases. In some cases, the single-stranded DNA segments have a length from 4 to 10 nucleotide bases. In some cases, the single-stranded DNA segments have a length of 4 nucleotide bases. In some cases, the single-stranded DNA segments have a length of 5 nucleotide bases. In some cases, the single-stranded DNA segments have a length of 6 nucleotide bases. In some cases, the single-stranded DNA segments have a length of 7 nucleotide bases. In some cases, the single-stranded DNA segments have a length of 8 nucleotide bases. In some cases, the single-stranded DNA segments have a length of 9 nucleotide bases. In some cases, the single-stranded DNA segments have a length of 10 nucleotide bases.

In some cases, the single-stranded DNA segments have a nucleotide sequence complementary to a sequence within the spacer sequence. In some cases, the double-stranded DNA sequence comprises a barcode, an open reading frame, an enhancer, a promoter, a protein-coding sequence, a miRNA coding sequence, an RNA coding sequence, or a transgene.

In some cases, the engineered nuclease system further comprises a source of $Mg^{2+}$.

In some cases, the guide RNA comprises a hairpin comprising at least 8 base-paired ribonucleotides. In some cases, the guide RNA comprises a hairpin comprising at least 9 base-paired ribonucleotides. In some cases, the guide RNA comprises a hairpin comprising at least 10 base-paired ribonucleotides. In some cases, the guide RNA comprises a hairpin comprising at least 11 base-paired ribonucleotides. In some cases, the guide RNA comprises a hairpin comprising at least 12 base-paired ribonucleotides.

In some cases, the endonuclease comprises a sequence at least 70% identical to a variant of any one of SEQ ID NOs: 141, 215, 229, 261, or 1711-1721 or a variant thereof 141, 215, 229, 261, or 1711-1721 or a variant thereof. In some cases, the endonuclease comprises a sequence at least 75% identical to a variant of any one of SEQ ID NOs: 141, 215, 229, 261, or 1711-1721 or a variant thereof. In some cases, the endonuclease comprises a sequence at least 80% identical to a variant of any one of SEQ ID NOs: 141, 215, 229, 261, or 1711-1721 or a variant thereof. In some cases, the endonuclease comprises a sequence at least 85% identical to a variant of any one of SEQ ID NOs: 141, 215, 229, 261, or 1711-1721 or a variant thereof. In some cases, the endonuclease comprises a sequence at least 90% identical to a variant of any one of SEQ ID NOs: 141, 215, 229, 261, or 1711-1721 or a variant thereof. In some cases, the endonuclease comprises a sequence at least 95% identical to a variant of any one of SEQ ID NOs: 141, 215, 229, 261, or 1711-1721 or a variant thereof.

In some cases, the guide RNA structure comprises a sequence of at least 70% identical to the first 19 nucleotides or the non-degenerate nucleotides of SEQ ID NO: 3608. In some cases, the guide RNA structure comprises a sequence of at least 75% identical to the first 19 nucleotides or the non-degenerate nucleotides of SEQ ID NO: 3608. In some cases, the guide RNA structure comprises a sequence of at least 80% identical to the first 19 nucleotides or the non-degenerate nucleotides of SEQ ID NO: 3608. In some cases, the guide RNA structure comprises a sequence of at least 85% identical to the first 19 nucleotides or the non-degenerate nucleotides of SEQ ID NO: 3608. In some cases, the guide RNA structure comprises a sequence of at least 90% identical to the first 19 nucleotides or the non-degenerate nucleotides of SEQ ID NO: 3608. In some cases, the guide RNA structure comprises a sequence of at least 95% identical to the first 19 nucleotides or the non-degenerate nucleotides of SEQ ID NO: 3608. In some cases, the endonuclease is configured to bind to a PAM comprising any one of SEQ ID NOs: 3863-3913.

In some cases, sequence may be determined by a BLASTP, CLUSTALW, MUSCLE, or MAFFT algorithm, or a CLUSTALW algorithm with the Smith-Waterman homology search algorithm parameters. The sequence identity may be determined by said BLASTP homology search algorithm using parameters of a wordlength (W) of 3, an expectation (E) of 10, and a BLOSUM62 scoring matrix setting gap costs at existence of 11, extension of 1, and using a conditional compositional score matrix adjustment.

In one aspect, the present disclosure provides an engineered guide RNA comprising (a) a DNA-targeting segment. In some cases, the DNA-targeting segment comprises a nucleotide sequence that is complementary to a target sequence. In some cases, the target sequence is in a target DNA molecule. In some cases, the engineered guide RNA comprises (b) a protein-binding segment. In some cases, the protein-binding segment comprises two complementary stretches of nucleotides. In some cases, the two complementary stretches of nucleotides hybridize to form a double-stranded RNA (dsRNA) duplex. In some cases, the two complementary stretches of nucleotides are covalently linked to one another with intervening nucleotides. In some cases, the engineered guide ribonucleic acid polynucleotide is capable of forming a complex with an endonuclease. In some cases, the endonuclease has at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, or at least about 99% identity to any one of SEQ ID NOs: 1-3470. In some cases, the complex targets the target sequence of the target DNA molecule.

In some cases, the DNA-targeting segment is positioned 3' of both of the two complementary stretches of nucleotides. In some cases, the protein binding segment comprising a sequence having at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, or at least about 99% identity to the first 19 nucleotides or the non-degenerate nucleotides of SEQ ID NO: 3608.

In some cases, the double-stranded RNA (dsRNA) duplex comprises at least 8 ribonucleotides. In some cases, the double-stranded RNA (dsRNA) duplex comprises at least 9 ribonucleotides. In some cases, the double-stranded RNA (dsRNA) duplex comprises at least 10 ribonucleotides. In some cases, the double-stranded RNA (dsRNA) duplex comprises at least 11 ribonucleotides. In some cases, the double-stranded RNA (dsRNA) duplex comprises at least 12 ribonucleotides.

In some cases, the deoxyribonucleic acid polynucleotide encodes the engineered guide ribonucleic acid polynucleotide.

In one aspect, the present disclosure provides a nucleic acid comprising an engineered nucleic acid sequence. In some cases, the engineered nucleic acid sequence is optimized for expression in an organism. In some cases, the nucleic acid encodes an endonuclease. In some cases, the endonuclease is a Cas endonuclease. In some cases, the endonuclease is a class 2 endonuclease. In some cases, the endonuclease is a class2, type V Cas endonuclease. In some cases, the endonuclease is a class2, type V-A Cas endonuclease. In some cases, the endonuclease is derived from an uncultivated microorganism. In some cases, the organism is not the uncultivated organism.

In some cases, the endonuclease comprises a variant having at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, or at least about 99% sequence identity to any one of SEQ ID NOs: 1-3470.

In some cases, the endonuclease may comprise a variant having one or more nuclear localization sequences (NLSs). The NLS may be proximal to the N- or C-terminus of the endonuclease. The NLS may be appended N-terminal or C-terminal to any one of SEQ ID NOs: 3938-3953, or to a variant having at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, or at least about 99% sequence identity to any one of SEQ ID NOs: 3938-3953.

In some cases, the organism is prokaryotic. In some cases, the organism is bacterial. In some cases, the organism is eukaryotic. In some cases, the organism is fungal. In some cases, the organism is a plant. In some cases, the organism is mammalian. In some cases, the organism is a rodent. In some cases, the organism is human.

In one aspect, the present disclosure provides an engineered vector. In some cases, the engineered vector comprises a nucleic acid sequence encoding an endonuclease. In some cases, the endonuclease is a Cas endonuclease. In some cases, the endonuclease is a class 2 Cas endonuclease. In some cases, the endonuclease is a class 2, type V Cas endonuclease. In some cases, the endonuclease is a class2, type V-A Cas endonuclease. In some cases, the endonuclease is derived from an uncultivated microorganism.

In some cases, the engineered vector comprises a nucleic acid described herein. In some cases, the nucleic acid described herein is a deoxyribonucleic acid polynucleotide described herein. In some cases, the vector is a plasmid, a minicircle, a CELiD, an adeno-associated virus (AAV) derived virion, or a lentivirus.

In one aspect, the present disclosure provides a cell comprising a vector described herein.

In one aspect, the present disclosure provides a method of manufacturing an endonuclease. In some cases, the method comprises cultivating the cell.

In one aspect, the present disclosure provides a method for binding, cleaving, marking, or modifying a double-stranded deoxyribonucleic acid polynucleotide. The method may comprise contacting the double-stranded deoxyribonucleic acid polynucleotide with an endonuclease. In some cases, the endonuclease is a Cas endonuclease. In some cases, the endonuclease is a class 2 Cas endonuclease. In some cases, the endonuclease is a class 2, type V Cas endonuclease. In some cases, the endonuclease is a class2, type V-A Cas endonuclease. In some cases, the endonuclease is in complex with an engineered guide RNA. In some cases, the engineered guide RNA is configured to bind to the endonuclease. In some cases, the engineered guide RNA is configured to bind to the double-stranded deoxyribonucleic acid polynucleotide. In some cases, the engineered guide RNA is configured to bind to the endonuclease and to the double-stranded deoxyribonucleic acid polynucleotide. In some cases, the double-stranded deoxyribonucleic acid polynucleotide comprises a protospacer adjacent motif (PAM). In some cases, the PAM comprises a sequence comprising any one of SEQ ID NOs: 3863-3913.

In some cases, the double-stranded deoxyribonucleic acid polynucleotide comprises a first strand comprising a sequence complementary to a sequence of the engineered guide RNA and a second strand comprising the PAM. In some cases, the PAM is directly adjacent to the 5' end of the sequence complementary to the sequence of the engineered guide RNA. In some cases, the endonuclease is not a Cpf1 endonuclease or a Cms1 endonuclease. In some cases, the endonuclease is derived from an uncultivated microorganism. In some cases, the double-stranded deoxyribonucleic acid polynucleotide is a eukaryotic, plant, fungal, mammalian, rodent, or human double-stranded deoxyribonucleic acid polynucleotide. In some cases, the PAM comprises any one of SEQ ID NOs: 3863-3913.

In one aspect, the present disclosure provides a method of modifying a target nucleic acid locus. The method may comprise delivering to the target nucleic acid locus the engineered nuclease system described herein. In some cases, the endonuclease is configured to form a complex with the engineered guide ribonucleic acid structure. In some cases, the complex is configured such that upon binding of the complex to the target nucleic acid locus, the complex modifies the target nucleic acid locus.

In some cases, modifying the target nucleic acid locus comprises binding, nicking, cleaving, or marking said target nucleic acid locus. In some cases, the target nucleic acid locus comprises deoxyribonucleic acid (DNA) or ribonucleic acid (RNA). In some cases, the target nucleic acid comprises genomic DNA, viral DNA, viral RNA, or bacterial DNA. In some cases, the target nucleic acid locus is in vitro. In some cases, the target nucleic acid locus is within a cell. In some cases, the cell is a prokaryotic cell, a bacterial cell, a eukaryotic cell, a fungal cell, a plant cell, an animal cell, a mammalian cell, a rodent cell, a primate cell, or a human cell.

In some cases, delivery of the engineered nuclease system to the target nucleic acid locus comprises delivering the nucleic acid described herein or the vector described herein.

In some cases, delivery of engineered nuclease system to the target nucleic acid locus comprises delivering a nucleic acid comprising an open reading frame encoding the endonuclease. In some cases, the nucleic acid comprises a promoter. In some cases, the open reading frame encoding the endonuclease is operably linked to the promoter.

In some cases, delivery of the engineered nuclease system to the target nucleic acid locus comprises delivering a capped mRNA containing the open reading frame encoding the endonuclease. In some cases, delivery of the engineered nuclease system to the target nucleic acid locus comprises delivering a translated polypeptide. In some cases, delivery of the engineered nuclease system to the target nucleic acid locus comprises delivering a deoxyribonucleic acid (DNA) encoding the engineered guide RNA operably linked to a ribonucleic acid (RNA) pol III promoter.

In some cases, the endonuclease induces a single-stranded break or a double-stranded break at or proximal to the target locus. In some cases, the endonuclease induces a staggered single stranded break within or 3' to said target locus.

In some cases, effector repeat motifs are used to inform guide design of MG nucleases. For example, the processed gRNA in Type V-A systems consists of the last 20-22 nucleotides of a CRISPR repeat. This sequence may be synthesized into a crRNA (along with a spacer) and tested in vitro, along with the synthesized nucleases, for cleavage on a library of possible targets. Using this method, the PAM may be determined. In some cases, Type V-A enzymes may use a "universal" gRNA. In some cases, Type V enzymes may need a unique gRNA.

Systems of the present disclosure may be used for various applications, such as, for example, nucleic acid editing (e.g., gene editing), binding to a nucleic acid molecule (e.g., sequence-specific binding). Such systems may be used, for example, for addressing (e.g., removing or replacing) a genetically inherited mutation that may cause a disease in a subject, inactivating a gene in order to ascertain its function in a cell, as a diagnostic tool to detect disease-causing genetic elements (e.g. via cleavage of reverse-transcribed viral RNA or an amplified DNA sequence encoding a disease-causing mutation), as deactivated enzymes in combination with a probe to target and detect a specific nucleotide sequence (e.g. sequence encoding antibiotic resistance int bacteria), to render viruses inactive or incapable of infecting host cells by targeting viral genomes, to add genes or amend metabolic pathways to engineer organisms to produce valuable small molecules, macromolecules, or secondary metabolites, to establish a gene drive element for evolutionary selection, to detect cell perturbations by foreign small molecules and nucleotides as a biosensor.

EXAMPLES

Example 1—A Method of Metagenomic Analysis for New Proteins

Figure 3:
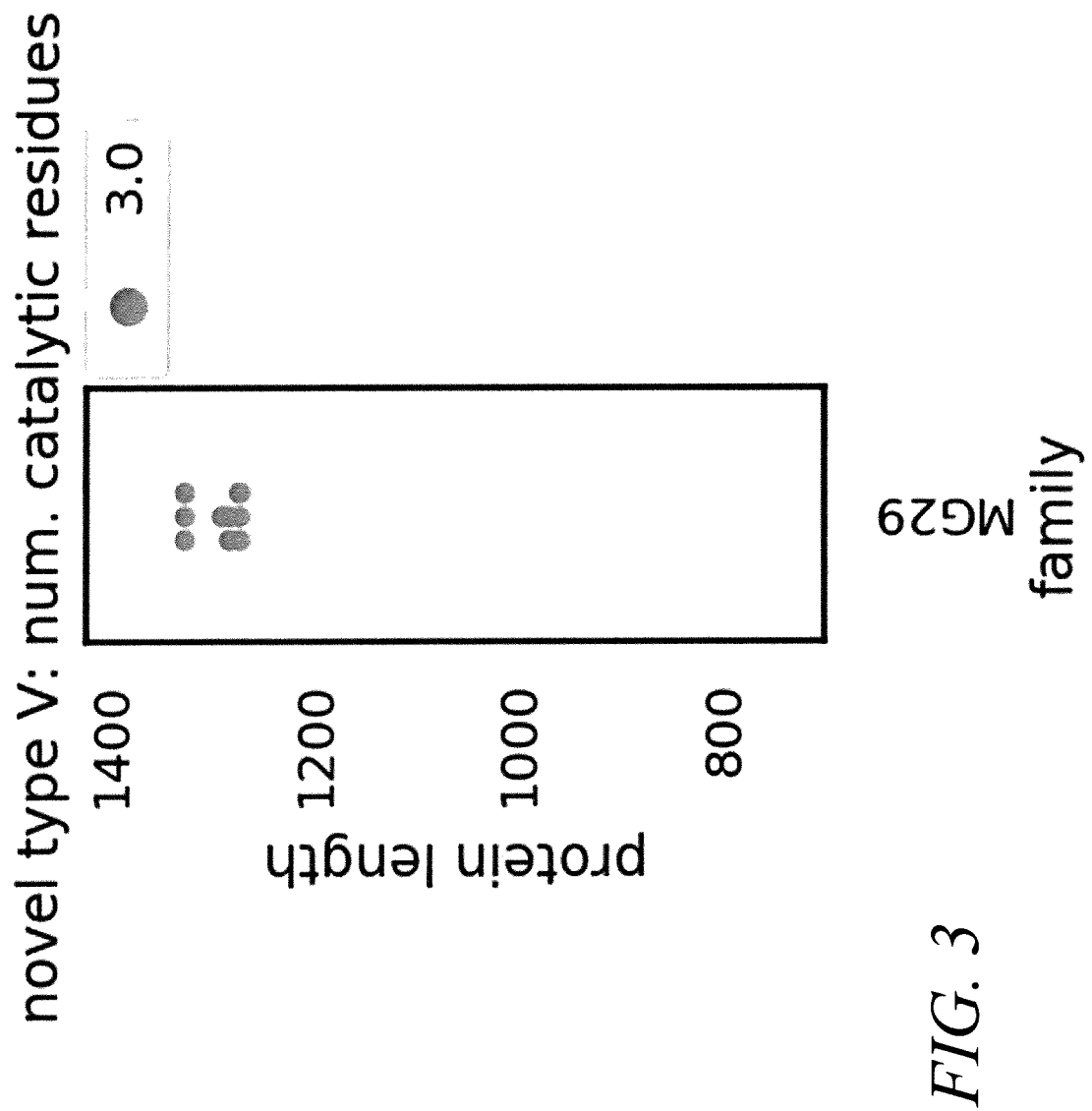
FIG. 3 depicts the number of predicted catalytic residues present in MG nucleases detected from sample types described herein (e.g.

Metagenomic samples were collected from sediment, soil and animals. Deoxyribonucleic acid (DNA) was extracted with a Zymobiomics DNA mini-prep kit and sequenced on an Illumina HiSeq® 2500. Samples were collected with consent of property owners. Metagenomic sequence data was searched using Hidden Markov Models generated based on known Cas protein sequences including class II type V Cas effector proteins to identify new Cas effectors (see FIG. 2, which shows distribution of proteins detected in one family, MG29, identified from sample types such as high-temperature samples). Novel effector proteins identified by the search were aligned to known proteins to identify potential active sites (see e.g. FIG. 3, which shows that all MG29 family effectors identified from various samples have three catalytic residues from RuvCI, RuvCII, and RuvCIII catalytic domains and are predicted to be active). This metagenomic workflow resulted in the delineation of the MG11, MG13, MG19, MG20, MG26, MG28, MG29, MG30, MG31, MG32, MG37, MG53, MG54, MG55, MG56, MG57, MG58, MG59, MG60, MG61, MG62, MG70, MG75, MG77, MG78, MG79, MG80, MG81, MG82, MG83, MG84, MG85, MG90, and MG91 families described herein. Putative spacer sequences were identified by their location adjacent to the genomic loci encoding the effector proteins.

Example 2—A Method of Metagenomic Analysis for New Proteins

Thirteen animal microbiome, high temperature biofilm and sediment samples were collected and stored on ice or in Zymo DNA/RNA Shield after collection. DNA was extracted from samples using either the Qiagen DNeasy PowerSoil Kit or the ZymoBIOMICS DNA Miniprep Kit. DNA sequencing libraries were constructed and sequenced on an Illumina HiSeq 4000 or on a Novaseq machine at the Vincent J. Coates Genomics Sequencing Laboratory at UC Berkeley, with paired 150 bp reads with a 400-800 bp target insert size (10 GB of sequencing was targeted per sample). Publicly available metagenomic sequencing data were downloaded from the NCBI SRA. Sequencing reads were trimmed using BBMap (Bushnell B., sourceforge.net/projects/bbmap/) and assembled with Megahit 11. Open reading frames and protein sequences were predicted with Prodigal. HMM profiles of known Type V-A CRISPR nucleases were built and searched against all predicted proteins using HMMER3 (hmmer.org) to identify potential effectors. CRISPR arrays on assembled contigs were predicted with Minced (github.com/ctSkennerton/minced). Taxonomy was assigned to proteins with Kaiju, and contig taxonomy was determined by finding the consensus of all encoded proteins.

Predicted and reference (e.g., LbCas12a, AsCas12a, FnCas12a) Type V effector proteins were aligned with MAFFT and a phylogenetic tree was inferred using Fas-Tree2. Novel families were delineated by identifying clades composed of sequences recovered from this study. From within families, candidates were selected if they contained the necessary components for laboratory analysis (i.e., they were found on a well-assembled and annotated contig with a CRISPR array) in a manner that sampled as much phylogenetic diversity as possible. Priority was given to small effectors from diverse families (that is, families with representatives sharing a wider range of protein sequences). Selected representative and reference sequences were aligned using MUSCLE and Clustal W to identify catalytic and PAM interacting residues. CRISPR array repeats were searched for a motif associated with Type V-A systems, TCTAC-N-GTAGA (containing between one and eight N residues). From this analysis, families were putatively classified as V-A if representative CRISPR arrays contained one of these motif sequences. This dataset was used to identify HMI profiles associated with V-A families, which were in turn used to classify additional families (see FIG. 33-FIG. 37). Although the convention is to name novel Cas12 nucleases on the basis of the organism that encodes them, it is not possible to do so for the nucleases described herein. Therefore, in order to best adhere to the convention, the systems described herein are named with the prefix MG to indicate they are derived from assembled metagenomic fragments.

Figure 6B:
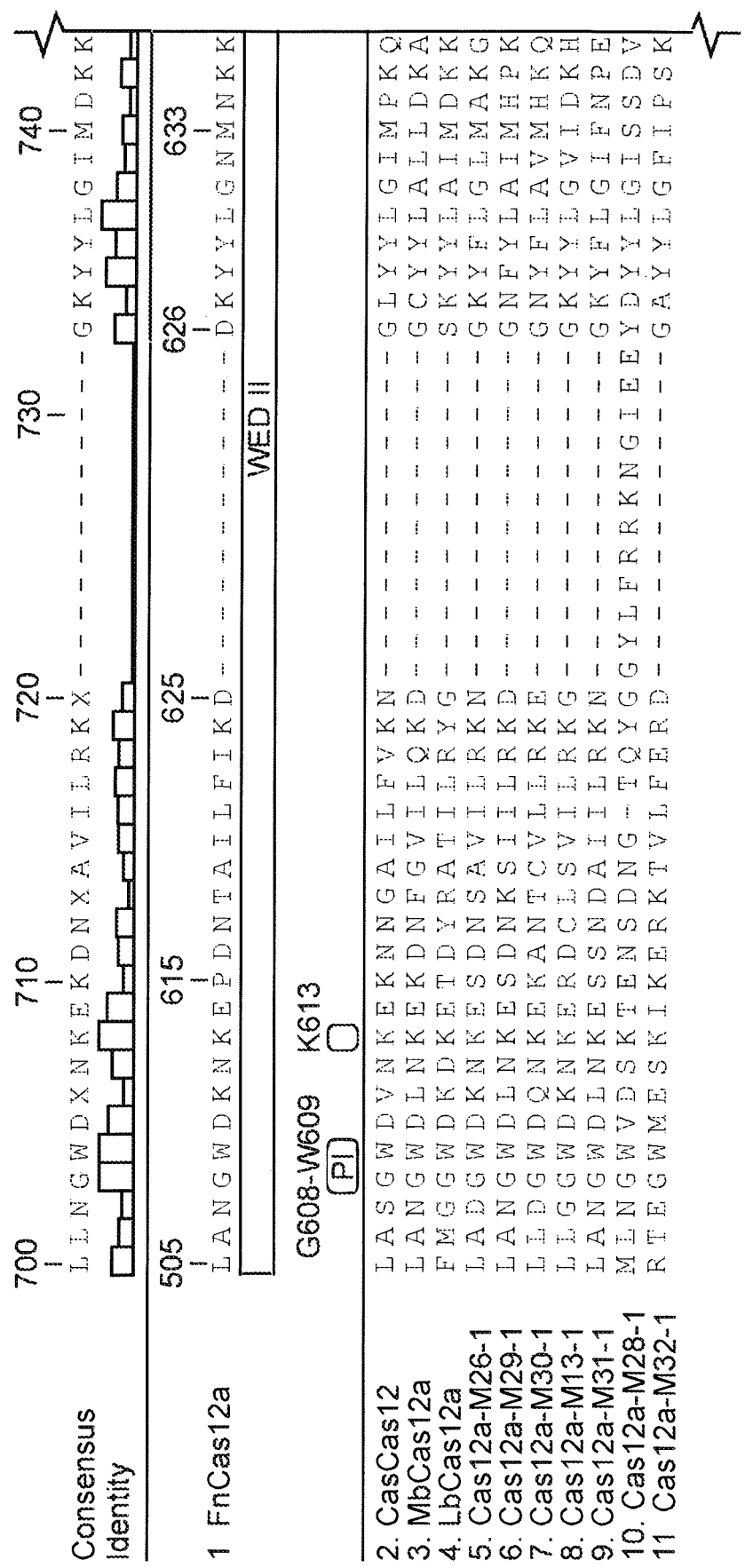
FIG. 6B shows WED-II and PAM interacting regions containing residues involved in PAM recognition and interaction (sequences from top to bottom in order of appearance are SEQ ID NO: 215, residues 575-646; SEQ ID NO: 226, residues 566-635; MG31-1: SEQ ID NO: 229; 557-629; SEQ ID NO: 141, residues 558-631; SEQ ID NO: 261, residues 537-609). The grey boxes underneath the FnCas12a sequence identify the domains. Darker boxes in the alignments indicate increased sequence identity. Black boxes over the FnCas12a sequence indicate catalytic residues (and positions) of the reference sequence. Grey boxes indicate domains in the reference sequence at the top of the alignment (FnCas12a). Black boxes indicate catalytic residues (and positions) of the reference sequence.
Figures 6, 6B:
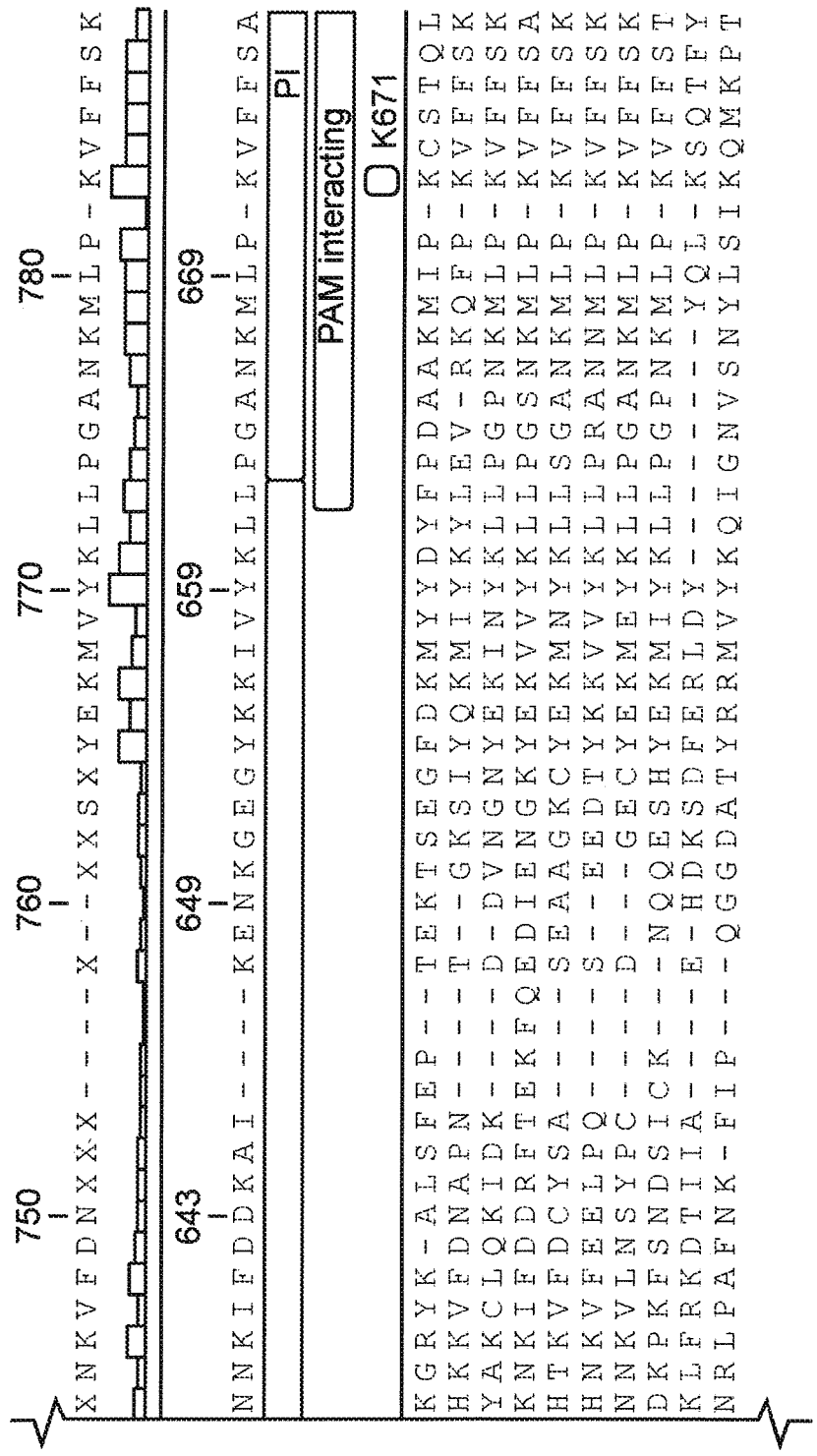
FIG. 6 depicts multiple sequence alignment of catalytic and PAM interacting regions in Type V-A sequences (SEQ ID NOs: 4436-4455). *Francisella novicida* Cas12a (FnCas12) (SEQ ID NOs: 4439-4441, 4452) is a reference sequence. Other reference sequences are *Acidaminococcus* sp. (AsCas12a/CasCas12) (SEQ ID NOs: 4442-4444, 4453), *Moraxella bovoculi* (MbCas12a) (SEQ ID NOs: 4445-4447, 4454), and Lachnospiraceae bacterium ND2006 (LbCas12a) (SEQ ID NOs:4448-4450, 4455).
Figure 7:
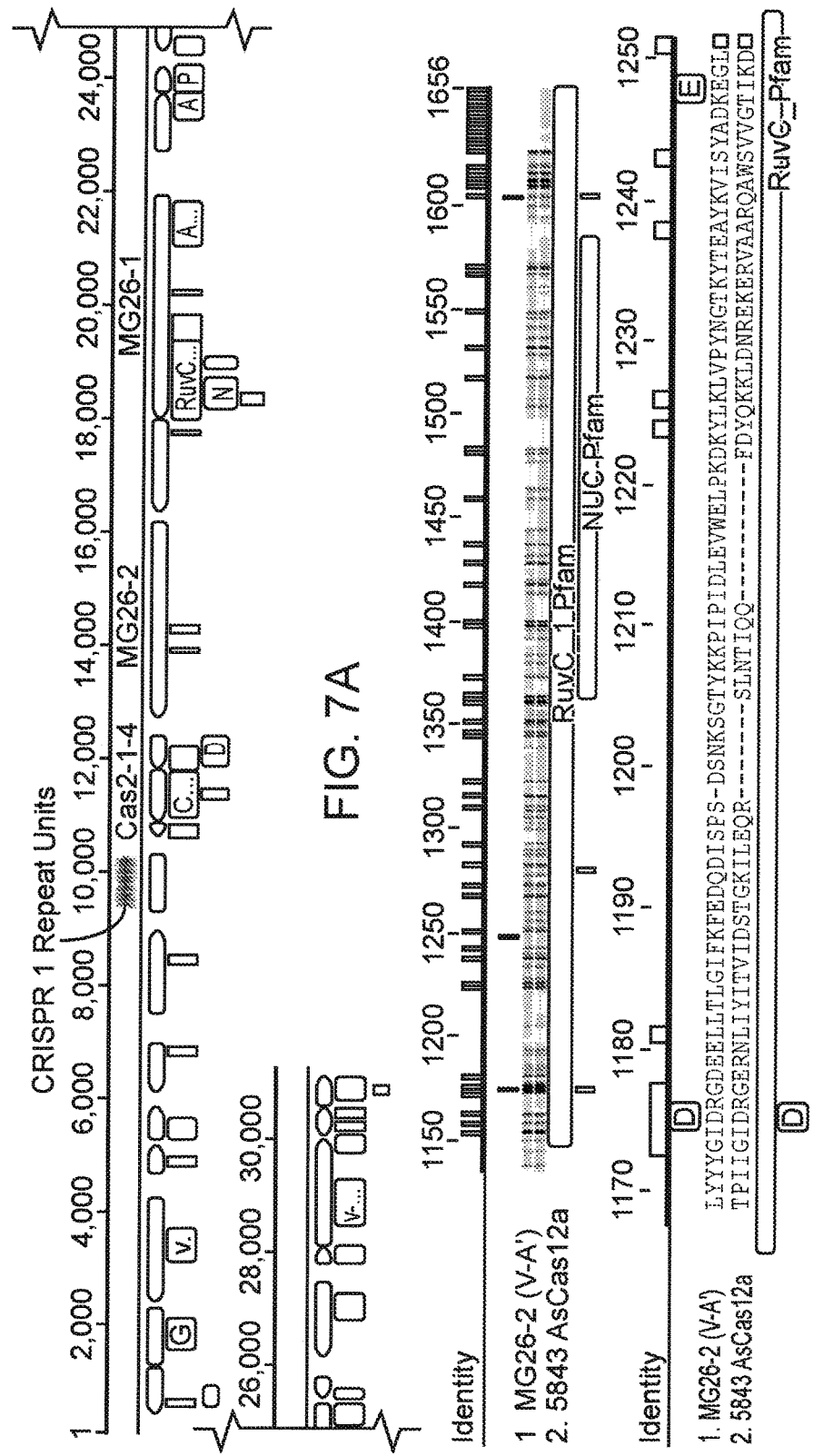
FIG. 7 depicts Type V-A and associated V-A' effectors.
Figure 7:
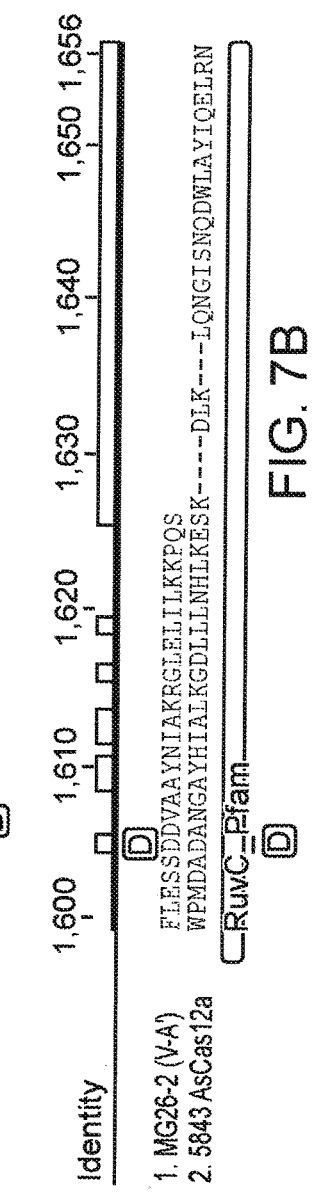

140,867 Mbp of assembled metagenomic sequencing data was mined from diverse environments (soil, thermophilic, sediments, human and non-human microbiomes). In total, 119 genomic fragments encoded CRISPR effectors distantly related to Type V-A nucleases next to a CRISPR array (see FIG. 4B). Type V-A effectors were classified into 14 novel families sharing less than 30% average pairwise amino acid identity between each other, and with reference sequences (e.g., LbCas12a, AsCas12a, FnCas12a). Some effectors contained RuvC and alpha-helical recognition domains, as well as conserved DED nuclease catalytic residues from the RuvCI/CII/CIII domains (identified in multiple sequence alignments, see e.g. Table 1A below), suggesting that these effectors were active nucleases (FIG. 5-FIG. 7). The novel Type V-A nucleases range in size from <800 to 1,400 amino acids in length (see FIG. 5A) and their taxonomic classification spanned a diverse array of phyla (see FIG. 4A) suggesting possible horizontal transfer.

Some genomic fragments carrying a Type V-A CRISPR system also encoded a second effector, referred to here as Type V-A prime (V-A', FIG. 7A). For example, Type V-A' MG26-2, which shared only 16.6% amino acid identity with the Type V-A MG26-1, was encoded in the same CRISPR Cas operon, and may share the same crRNA with MG26-1 (FIG. 7B). Although no nuclease domains were predicted, MG26-2 contained three RuvC catalytic residues identified from multiple sequence alignments (FIG. 7B).

TABLE 1A

Catalytic residues of Enzymes Described Herein Identified by Alignment

| MGID | RuvC-I (D) | RuvC-II (E) | RuvC-III (D) |
|---|---|---|---|
| MG84-16 | 238 | 337 | 413 |
| MG84-15 | 238 | 337 | 413 |
| MG84-3 | 230 | 329 | 405 |
| MG84-2 | 230 | 329 | 405 |
| MG84-1 | 230 | 329 | 405 |
| MG84-13 | 233 | 332 | 408 |
| MG84-14 | 233 | 332 | 408 |
| MG84-12 | 233 | 332 | 408 |
| MG84-11 | 233 | 332 | 408 |
| MG84-10 | 233 | 332 | 408 |
| MG84-9 | 233 | 332 | 408 |
| MG84-8 | 233 | 332 | 408 |
| MG84-7 | 233 | 332 | 408 |
| MG84-4 | 233 | 332 | 408 |
| MG84-5 | 233 | 332 | 408 |
| MG84-6 | 233 | 332 | 408 |
| MG81-18 | 296 | 399 | 497 |
| MG81-17 | 296 | 399 | 497 |
| MG81-9 | 297 | 400 | 498 |
| MG81-6 | 297 | 400 | 498 |
| MG81-11 | 297 | 400 | 498 |
| MG81-7 | 297 | 400 | 498 |
| MG81-8 | 297 | 400 | 498 |
| MG81-13 | 297 | 400 | 498 |
| MG81-5 | 300 | 403 | 501 |
| MG81-12 | 300 | 403 | 501 |
| MG81-1 | 300 | 403 | 502 |
| MG81-4 | 310 | 413 | 501 |
| MG81-3 | 310 | 413 | 511 |
| MG81-15 | 388 | 491 | 589 |
| MG81-10 | 310 | 413 | 511 |
| MG81-2 | 306 | 409 | 507 |
| MG90-2 | 388 | 548 | 661 |
| MG91-1 | 444 | 560 | 653 |
| MG91-2 | 245 | 358 | 453 |
| MG91-3 | 297 | 404 | 499 |

TABLE 1A-continued

Catalytic residues of Enzymes Described Herein Identified by Alignment

| MGID | RuvC-I (D) | RuvC-II (E) | RuvC-III (D) |
|---|---|---|---|
| MG37-1 | 763 | 1167 | 1335 |
| MG37-2 | 169 | 538 | 689 |
| MG37-3 | 745 | 1202 | 1350 |
| MG37-4 | 811 | 1230 | 1377 |
| MG37-5 | 775 | 1173 | 1319 |
| MG37-6 | 698 | 1058 | 1229 |
| MG37-7 | 752 | 1135 | 1273 |
| MG53-1 | — | 775 | 920 |
| MG54-1 | — | 612 | 722 |

Example 3—(General Protocol) PAM Sequence Identification/Confirmation

PAM sequences that could be cleaved in vitro by a CRISPR effector were identified by incubating an effector with a crRNA and a plasmid library having 8 randomized nucleotides located adjacent to the 5' end of a sequence complementary to the spacer of the crRNA. If the 8 randomized nucleotides formed a functional PAM sequence, the plasmid would be cleaved. Functional PAM sequences were then identified by ligating adapters to the ends of cleaved plasmids and then sequencing DNA fragments comprising the adapters. Putative endonucleases were expressed in an E. coli lysate-based expression system (myTXTL, Arbor Biosciences). An E. coli codon optimized nucleotide sequence encoding the putative nuclease was transcribed and translated in vitro from a PCR fragment under control of a T7 promoter. A second PCR fragment with a minimal CRISPR array composed of a T7 promoter followed by a repeat-spacer-repeat sequence was transcribed in the same reaction. Successful expression of the endonuclease and repeat-spacer-repeat sequence followed by CRISPR array processing provided active in vitro CRISPR nuclease complexes.

A library of target plasmids containing a spacer sequence matching that in the minimal array preceded by 8N (degenerate) bases (potential PAM sequences) was incubated with the output of the TXTL reaction. After 1-3 hours, the reaction was stopped and the DNA was recovered via a DNA clean-up kit, e.g., Zymo DCC, AMPure XP beads, QiaQuick etc. Adapter sequences were blunt-end ligated to DNA fragments with active PAM sequences that had been cleaved by the endonuclease, whereas DNA that had not been cleaved was inaccessible for ligation. DNA segments comprising active PAM sequences were then amplified by PCR with primers specific to the library and the adapter sequence. The PCR amplification products were resolved on a gel to identify amplicons that corresponded to cleavage events. The amplified segments of the cleavage reaction were also used as templates for preparation of an NGS library or as a substrate for Sanger sequencing. Sequencing this resulting library, which was a subset of the starting 8N library, revealed sequences with PAM activity compatible with the CRISPR complex. For PAM testing with a processed RNA construct, the same procedure was repeated except that an in vitro transcribed RNA was added along with the plasmid library and the minimal CRISPR array template was omitted. The following sequences were used as targets in these assays: CGTGAGCCACCACGTCGCAAGCCT (SEQ ID NO: 3860); GTCGAGGCTTGCGACGTGGTGGCT (SEQ ID NO: 3861); GTCGAGGCTTGCGACGTGGTGGCT (SEQ ID NO: 3858); and TGGAGATATCTTGAACCTTG-CATC (SEQ ID NO: 3859).

Example 4—PAM Sequence Identification/Confirmation for Endonucleases Described Herein PAM requirements were determined via an E. coli lysate-based expression system (myTXTL, Arbor Biosciences), with modifications. Briefly, the E. coli codon optimized effector protein sequences were expressed under control of a T7 promoter at 29° C. for 16 hours. This crude protein stock was then used in an in vitro digest reaction at a concentration of 20% of the final reaction volume. The reaction was incubated for 3 hours at 37° C. with 5 nM of a plasmid library consisting of a constant target sequence preceded by 8N mixed bases, and 50 nM of in vitro transcribed crRNA derived from the same CRISPR locus as the effector linked to a sequence complementary to the target sequence in NEB buffer 2.1 (New England Biolabs; NEB buffer 2.1 was selected in order to compare candidates with commercially available proteins). Protein concentration was not normalized in PAM discovery assays (PCR amplification signal provides high sensitivity for low expression or activity). The cleavage products from the TXTL reactions were recovered via clean up with AMPure SPRI beads (Beckman Coulter). The DNA was blunted via addition of Klenow fragments and dNTPs (New England Biolabs). Blunt-end products were ligated with a 100-fold excess of double stranded adapter sequences and used as template for the preparation of an NGS library, from which PAM requirements were determined from sequence analysis.

Raw NGS reads were filtered by Phred quality score >20. The 28 bp representing the known DNA sequence from the backbone adjacent to the PAM was used as a reference to find the PAM-proximal region and the 8 bp adjacent were identified as the putative PAM. The distance between the PAM and the ligated adapter was also measured for each read. Reads that did not have an exact match to the reference sequence or adapter sequence were excluded. PAM sequences were filtered by cut site frequency such that only PAMs with the most frequent cut site±2 bp were included in the analysis. This correction removed low levels of background cleavage that may occur at random positions due to the use of crude E. coli lysate. This filtering step can remove between 2% and 40% of the reads depending on the signal to noise ratio of the candidate protein, where less active proteins have more background signal. For reference MG29-1, 2% of reads were filtered out at this step. The filtered list of PAMs was used to generate a sequence logo using Logomaker. These sequence logo depictions of PAMs are presented in FIGS. 20-24.

Example 5—tracrRNA Prediction and Guide Design

Figure 8:
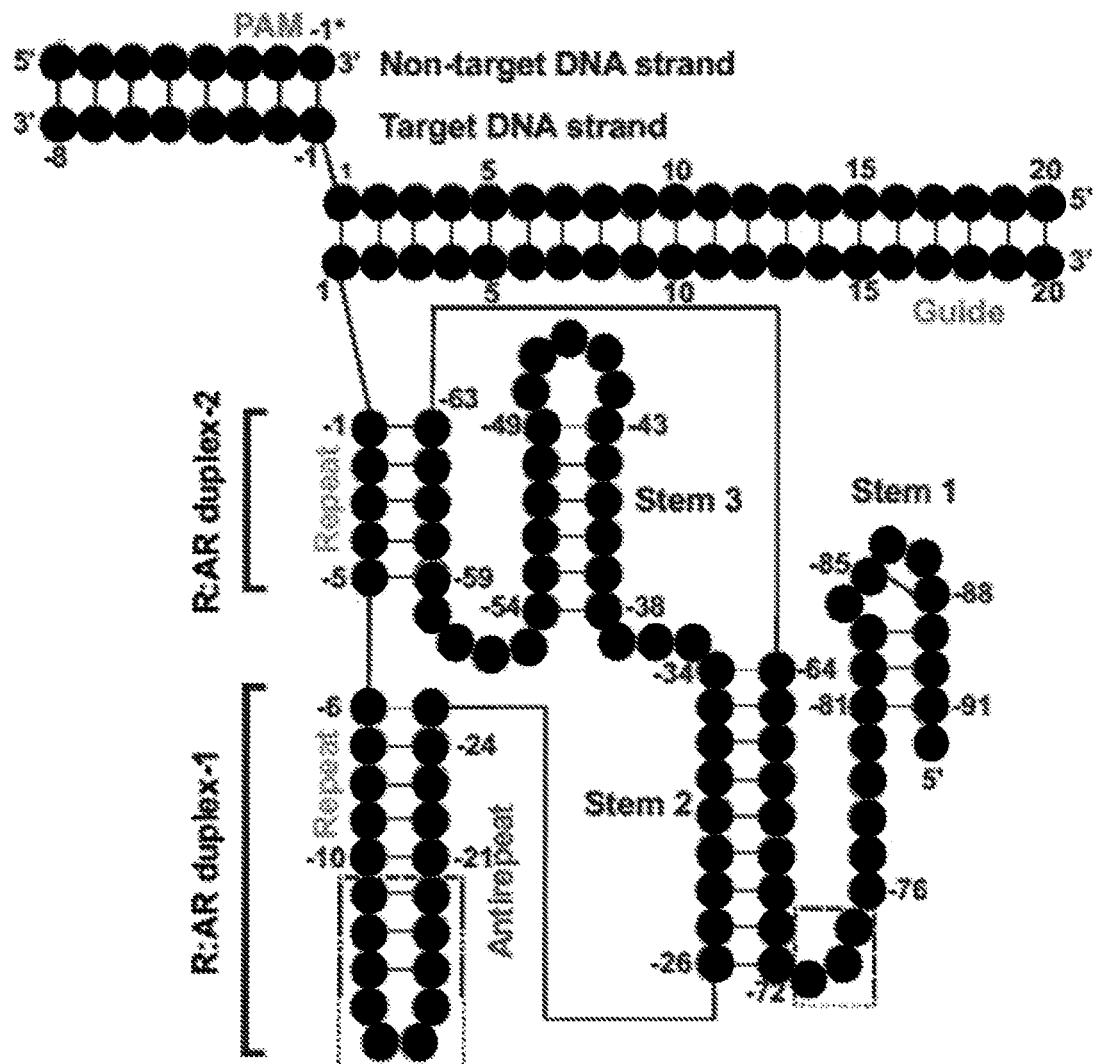
FIG. 8 depicts a schematic representation of the structure of a sgRNA and a target DNA in a ternary complex with AacC2C1 (see Yang, Hui, Pu Gao, Kanagalaghatta R. Raj ashankar, and Dinshaw J. Patel. 2016. "PAM-Dependent Target DNA Recognition and Cleavage by C2c1 CRISPR-Cas Endonuclease." Cell 167 (7): 1814-28.e12 which is incorporated by reference herein in its entirety).
Figure 9:
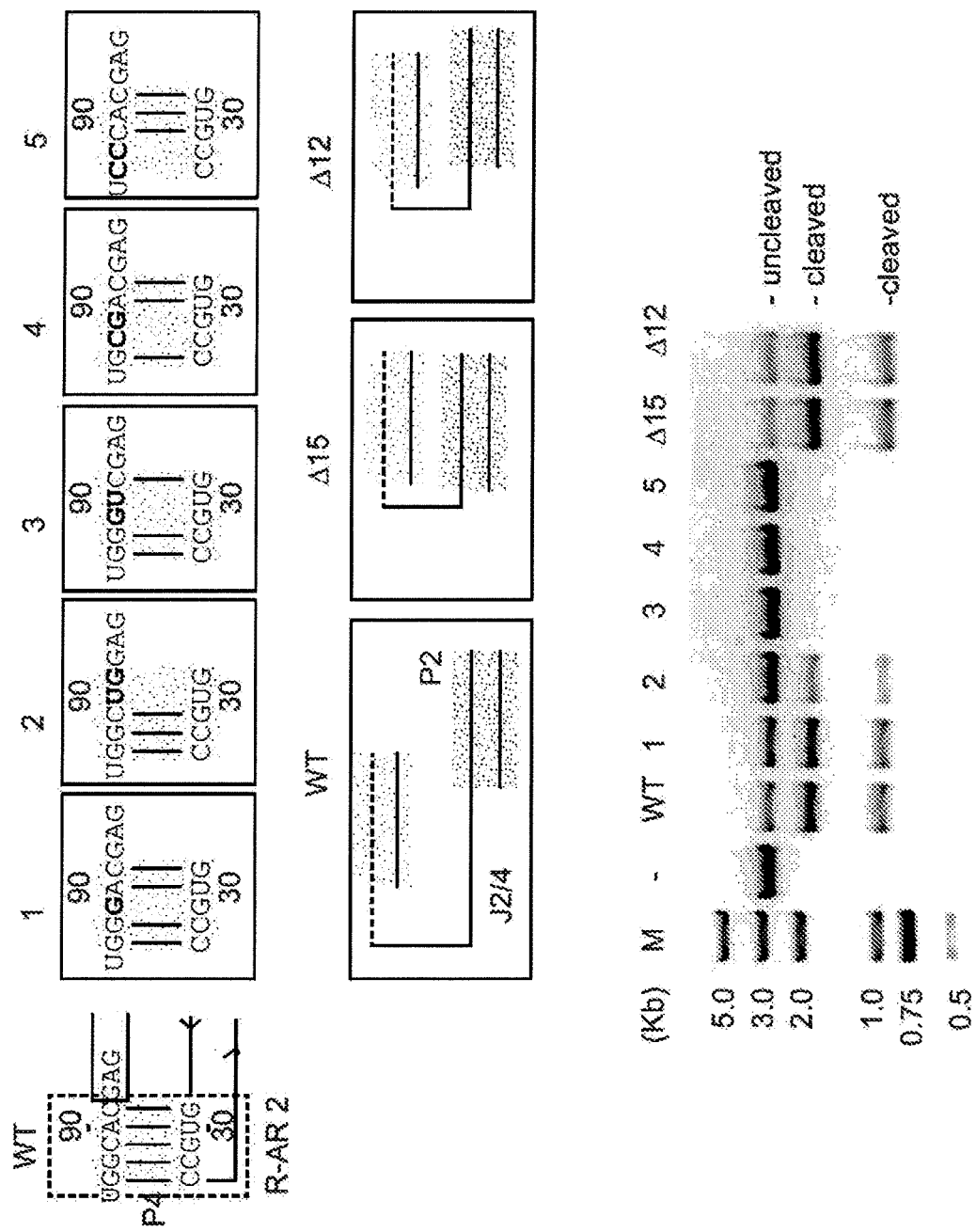
FIG. 9 depicts the effects of mutations or truncations in the R-AR domains of an sgRNA on AacC2c1-mediated cleavage of linear plasmid DNA; WT, wild-type sgRNA. The mutant nucleotides within sgRNA (lanes 1-5) are highlighted in the left panel. Δ15: 15 nt deleted from the sgRNA R-AR 1 region. Δ12: 12 nt have been removed from the sgRNA J2/4 R-AR 1 region (see Liu, Liang, Peng Chen, Min Wang, Xueyan Li, Jiuyu Wang, Maolu Yin, and Yanli Wang. 2017. "C2c1-sgRNA Complex Structure Reveals RNA-Guided DNA Cleavage Mechanism." Molecular Cell 65 (2): 310-22 which is incorporated by reference herein in its entirety).
Figure 11:
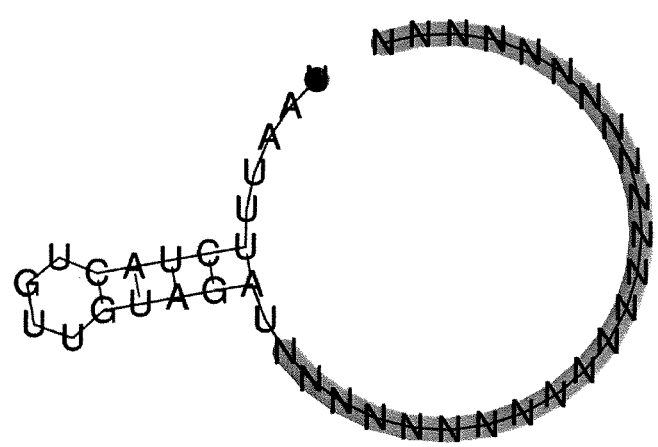
FIG. 11 depicts a predicted structure of a guide RNA utilized herein (SEQ ID NO: 3608).
Figure 12:
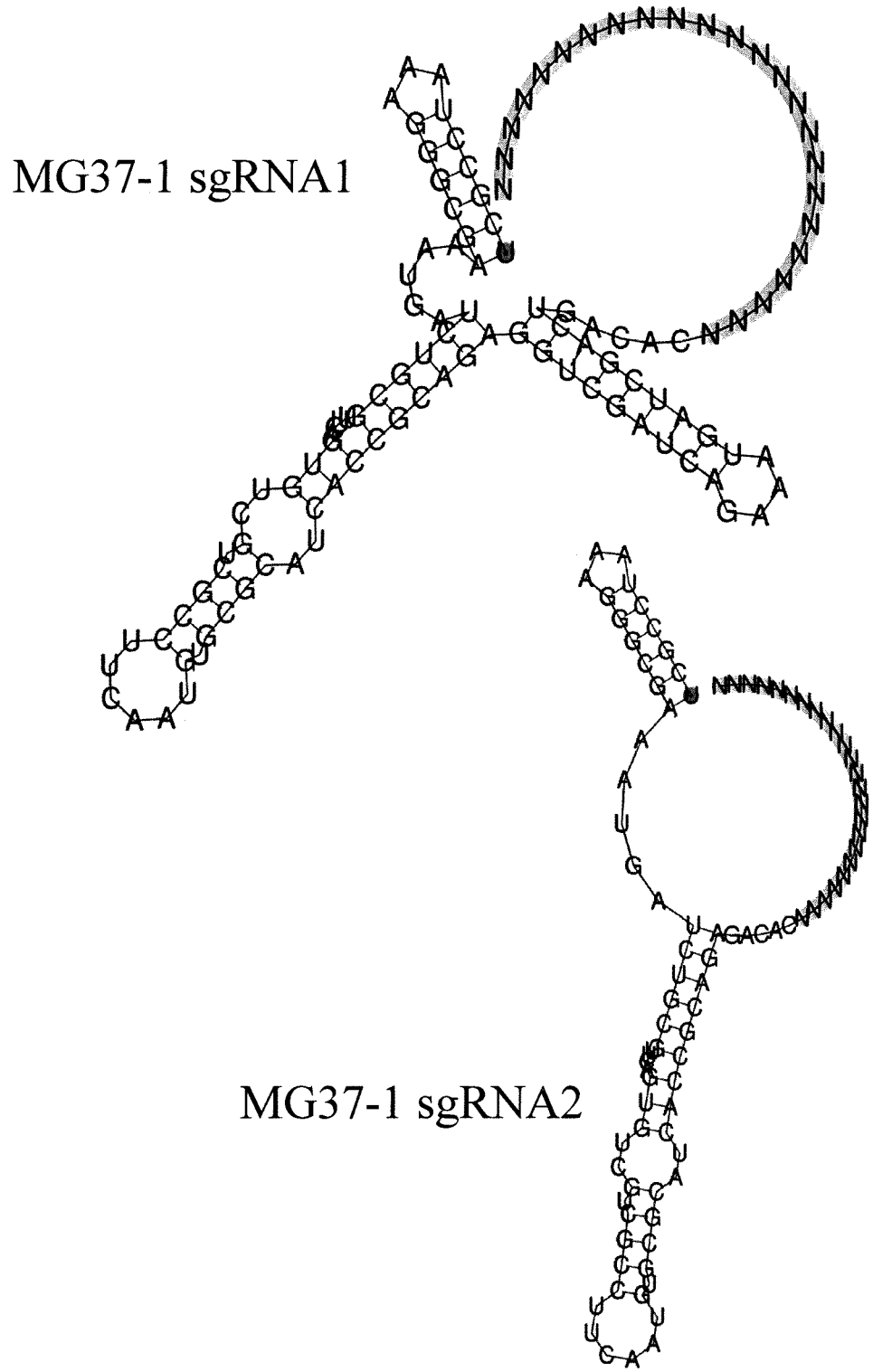
FIG. 12 depicts predicted structures of corresponding sgRNAs of MG enzymes described herein (clockwise, SEQ ID NOs: 3636, 3637, 3641, 3640).
Figure 12:
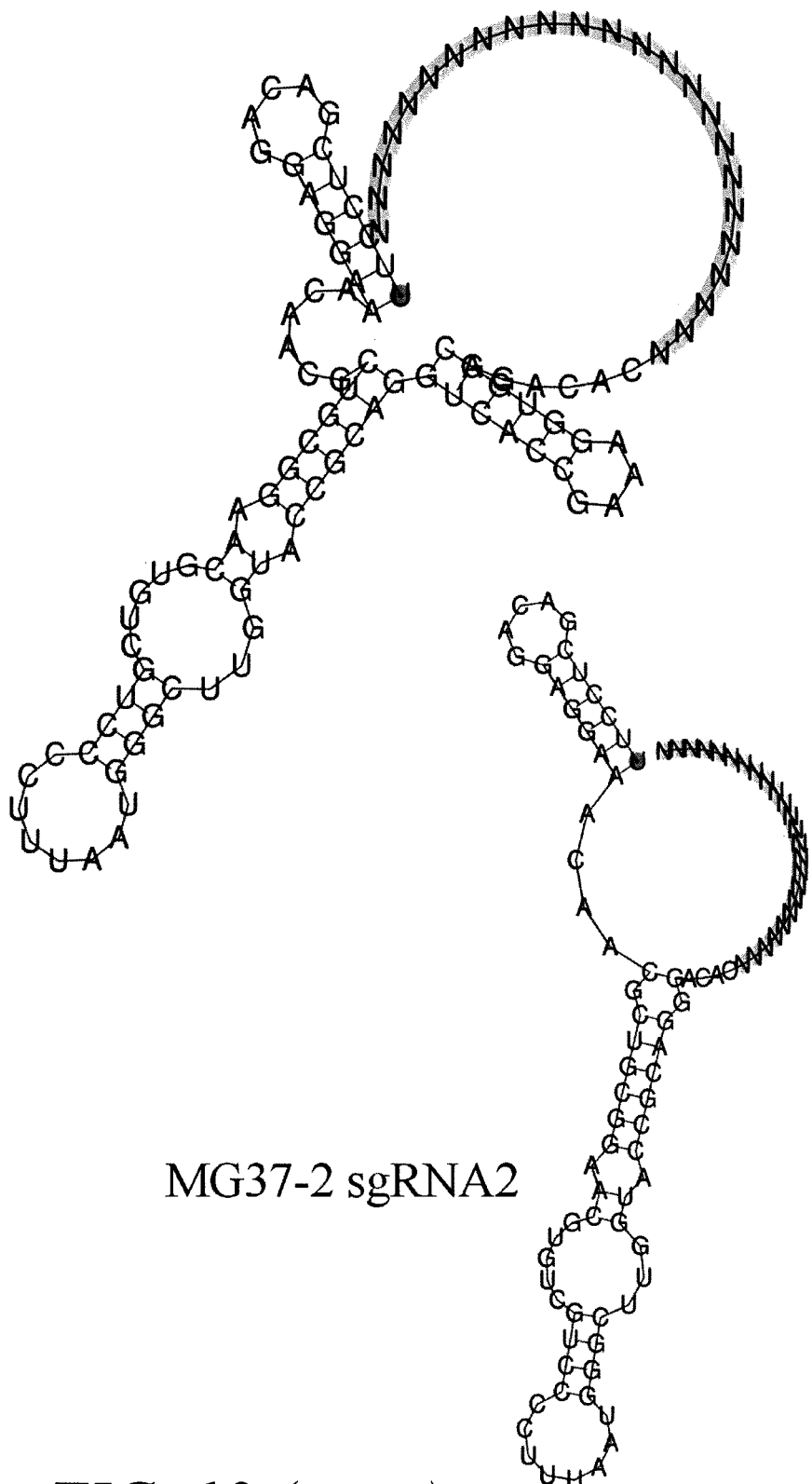
Figure 13:
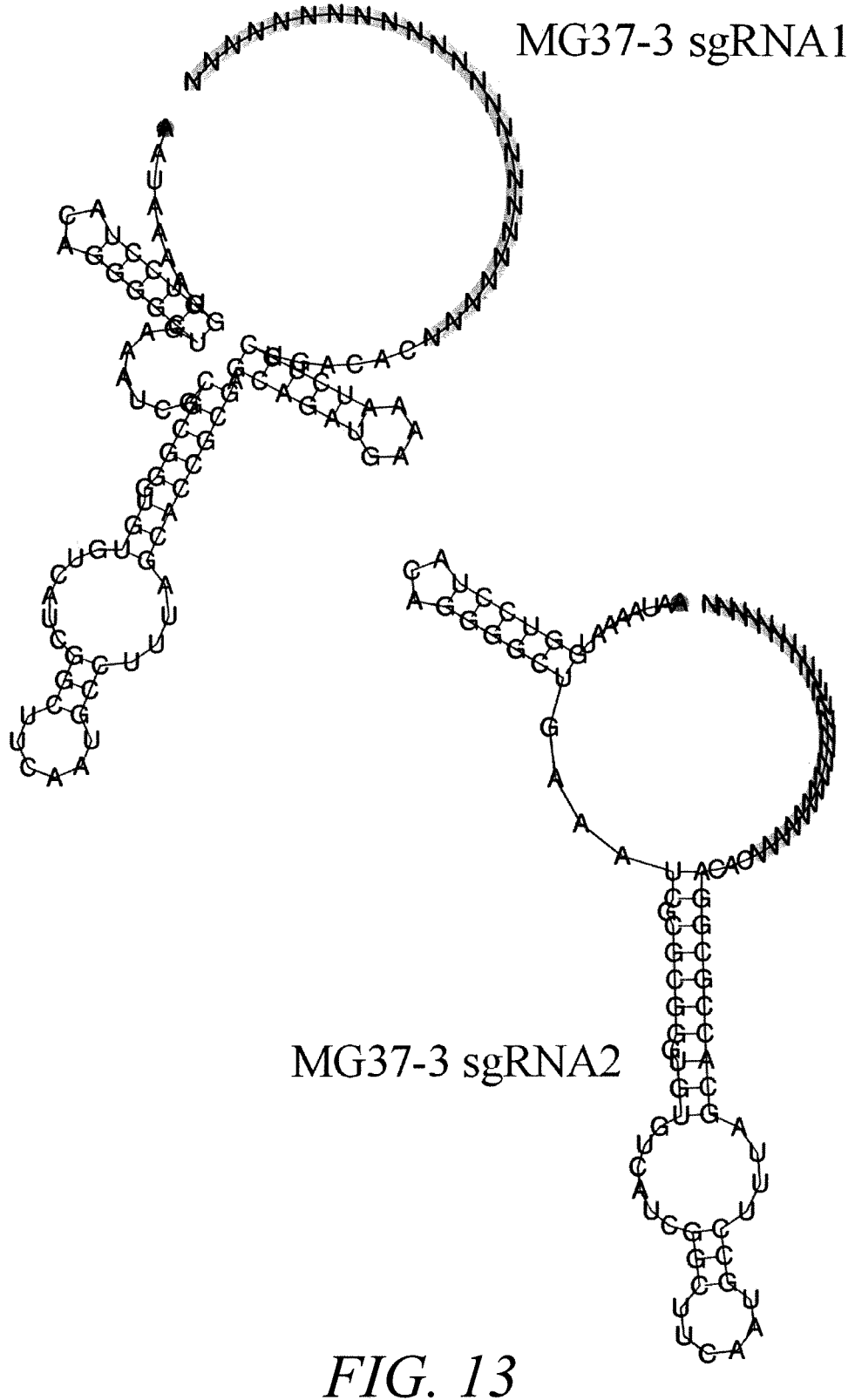
FIG. 13 depicts predicted structures of corresponding sgRNAs of MG enzymes described herein (clockwise, SEQ ID NOs: 3644, 3645, 3649, 3648).
Figure 13:
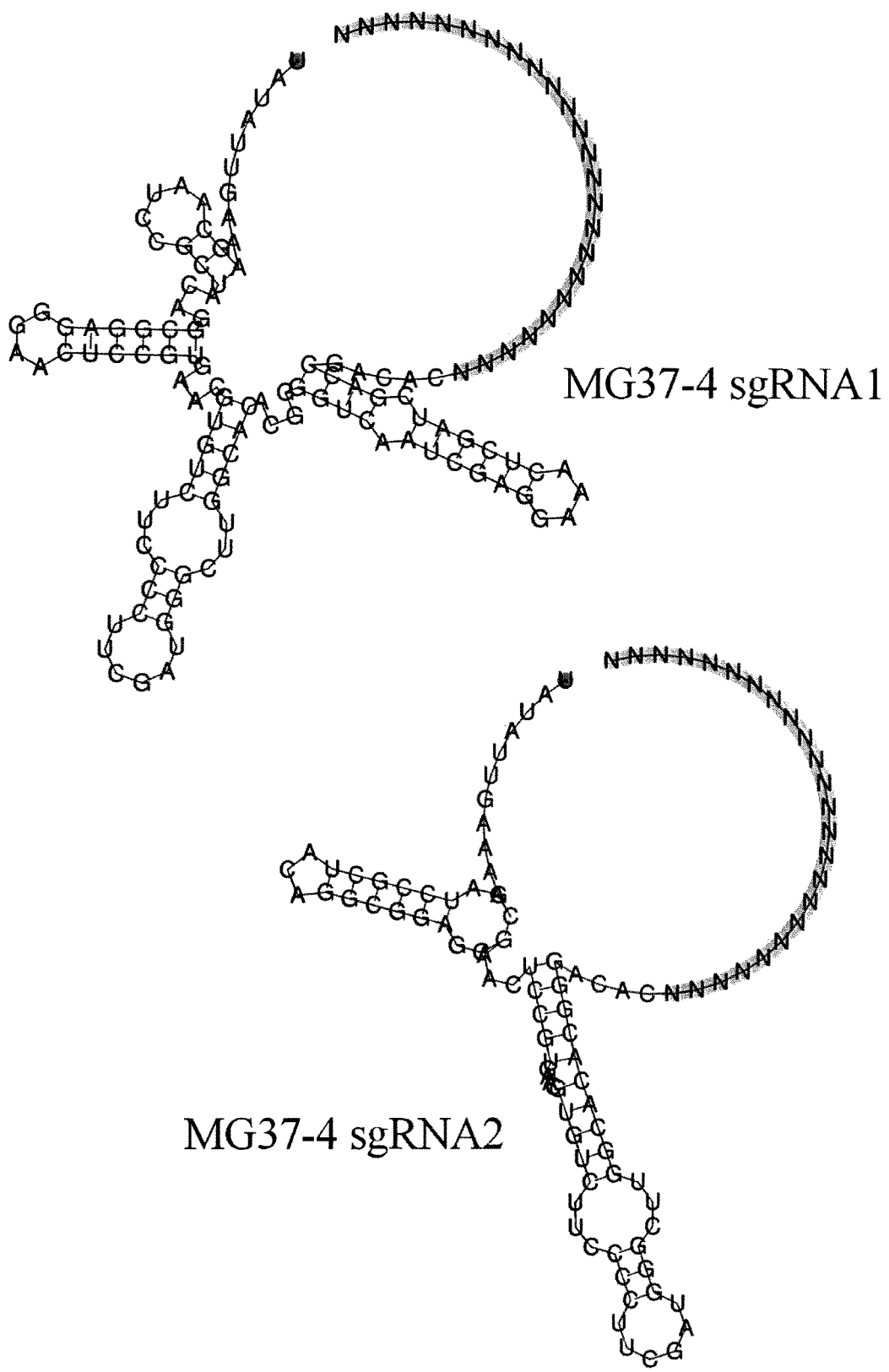
Figure 14:
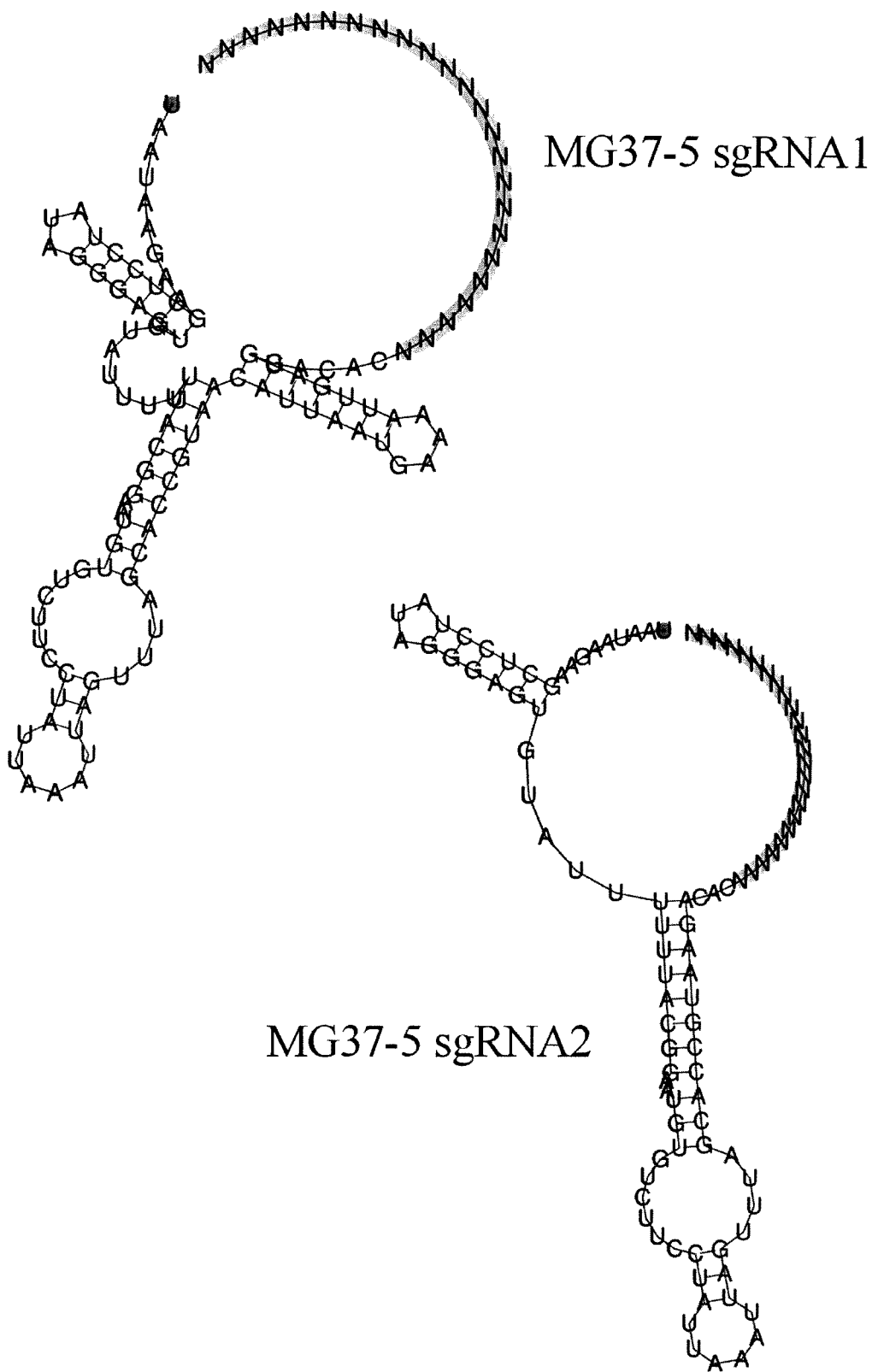
FIG. 14 depicts predicted structures of corresponding sgRNAs of MG enzymes described herein (clockwise, SEQ ID NOs: 3652, 3653, 3657, 3656).
Figure 14:
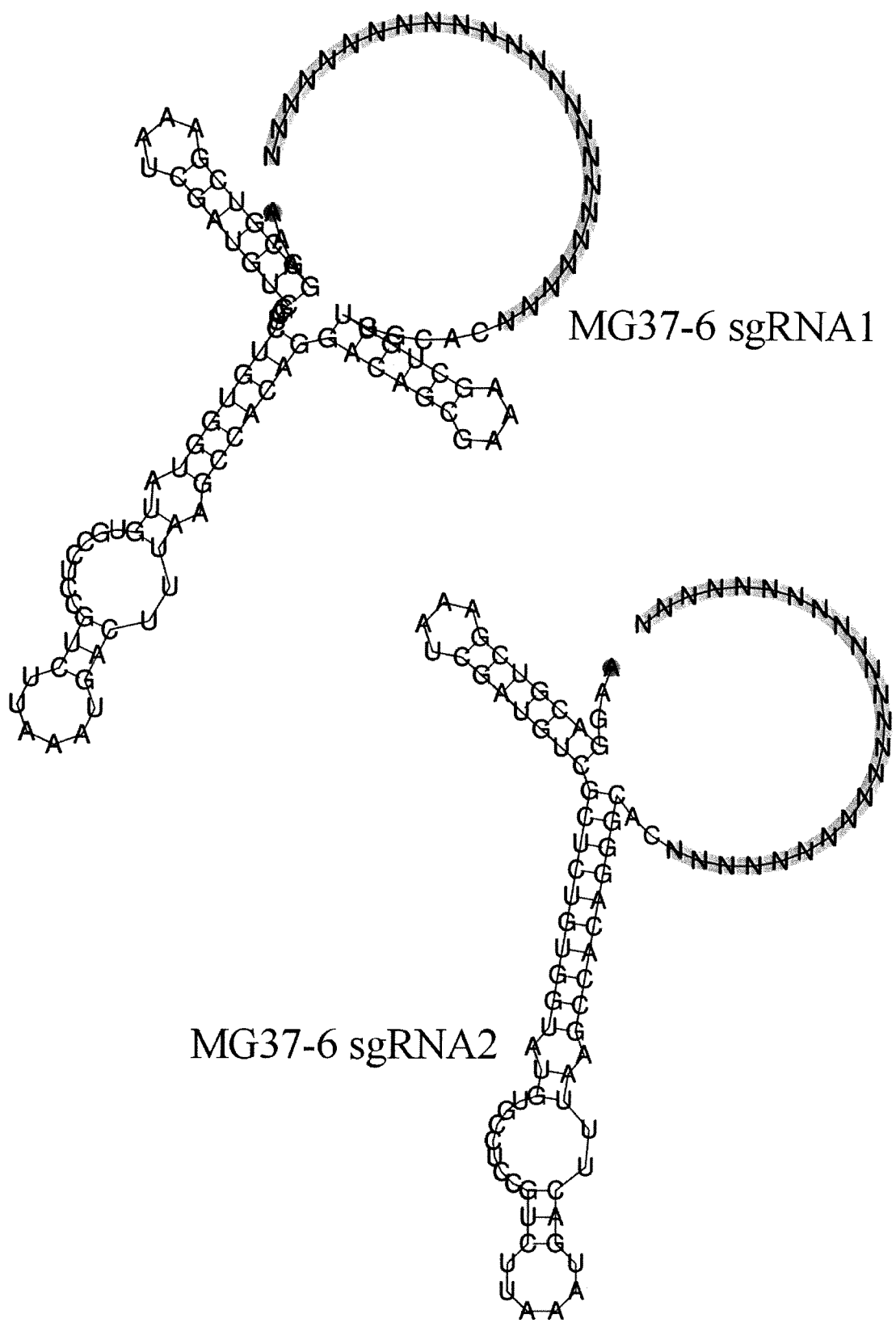
Figure 15:
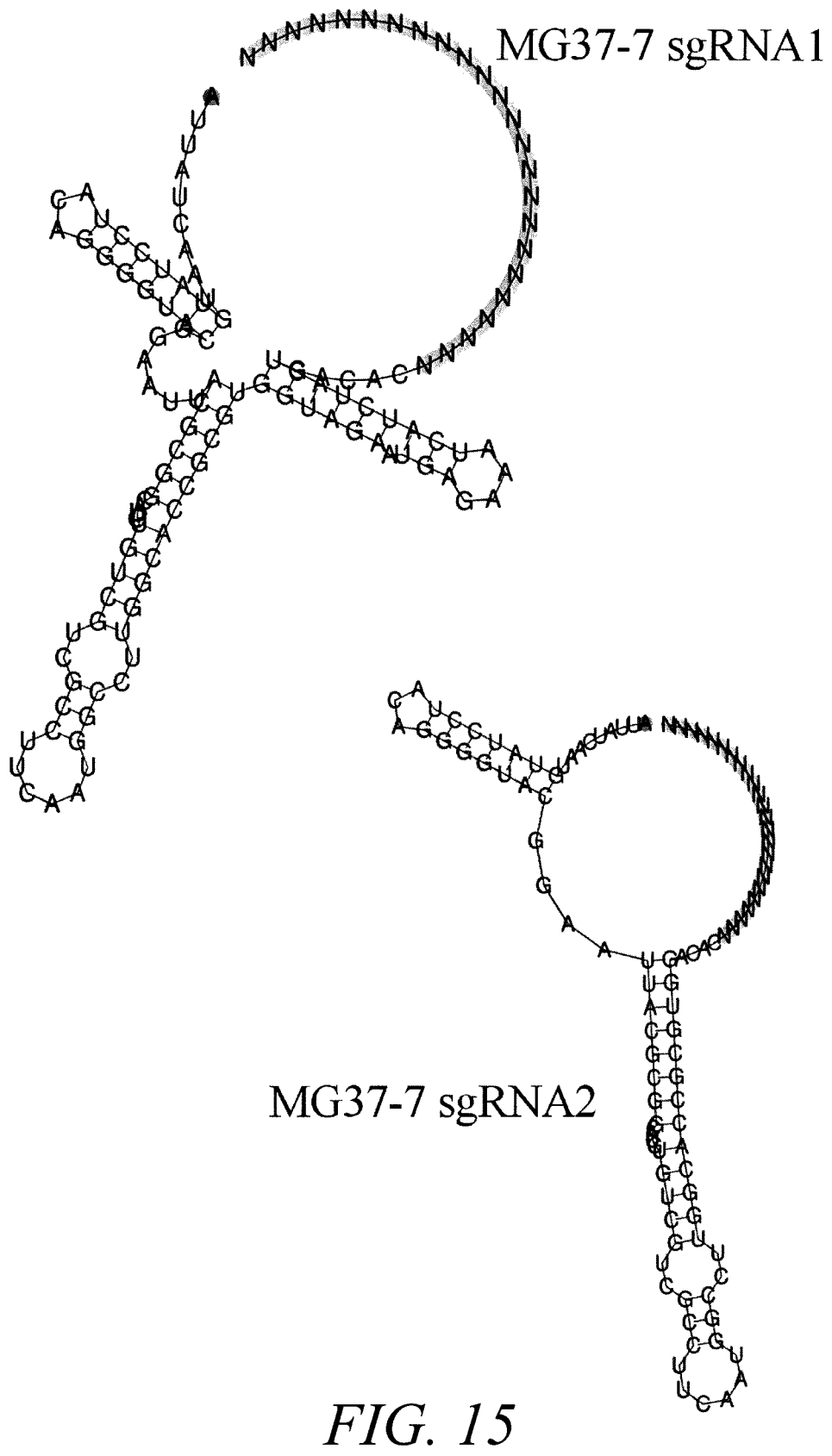
FIG. 15 depicts predicted structures of corresponding sgRNAs of MG enzymes described herein (clockwise, SEQ ID NOs: 3660, 3661, 3665, 3664).
Figure 15:
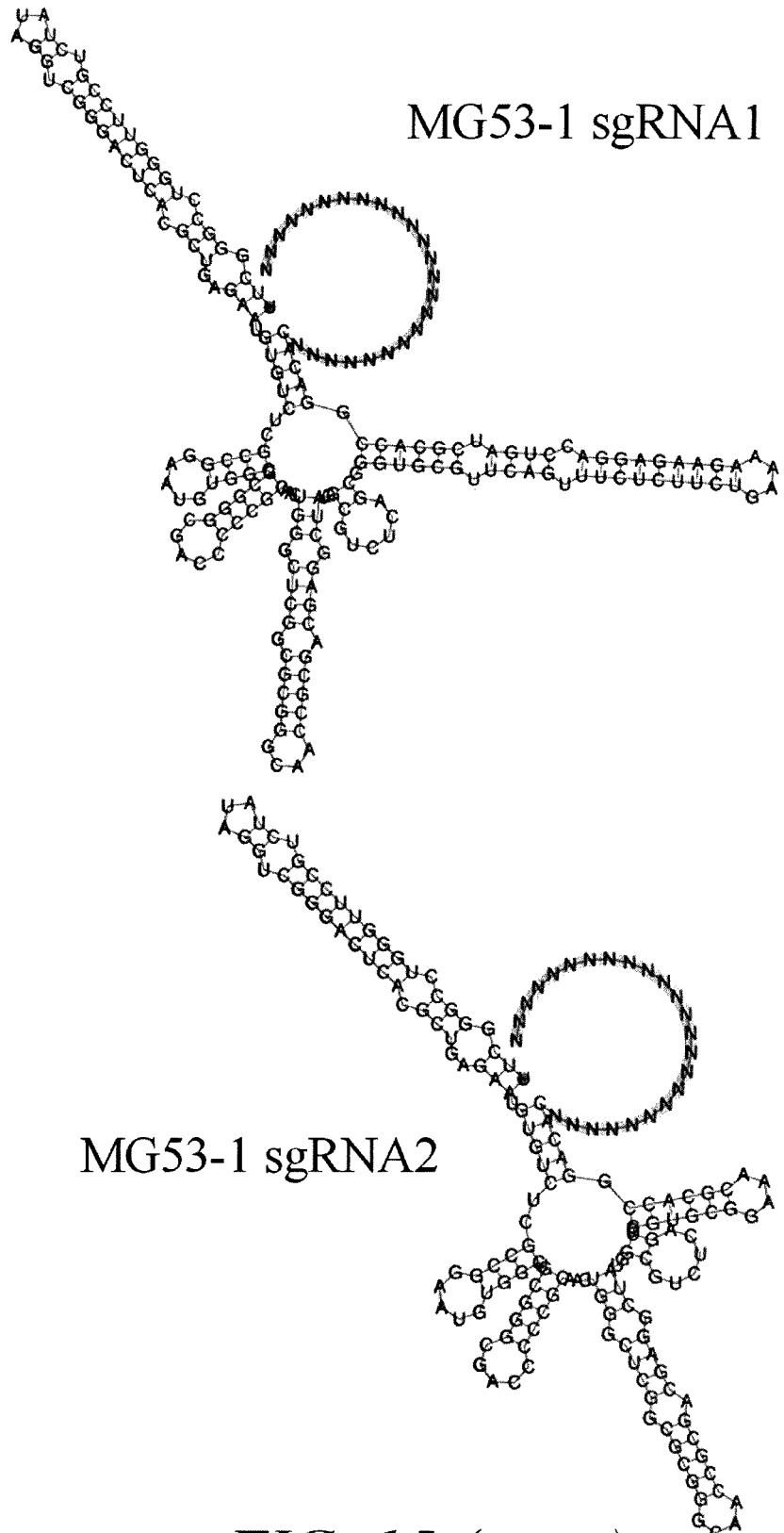
Figure 16:
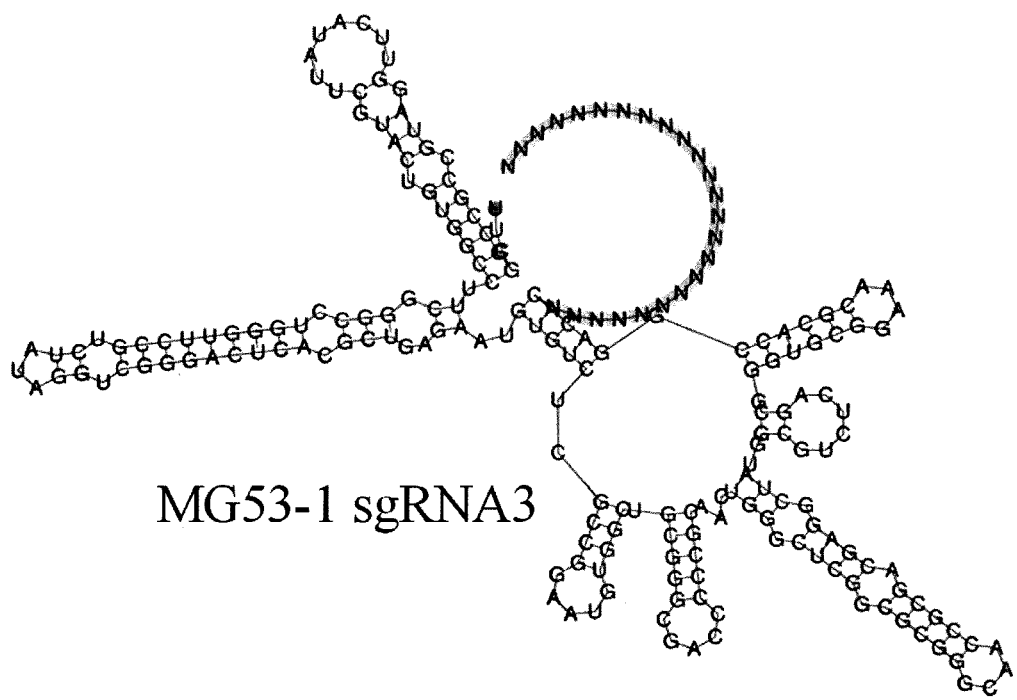
FIG. 16 depicts predicted structures of corresponding sgRNAs of MG enzymes described herein (clockwise, SEQ ID NOs: 3666, 3667, 3672, 3671).
Figure 16:
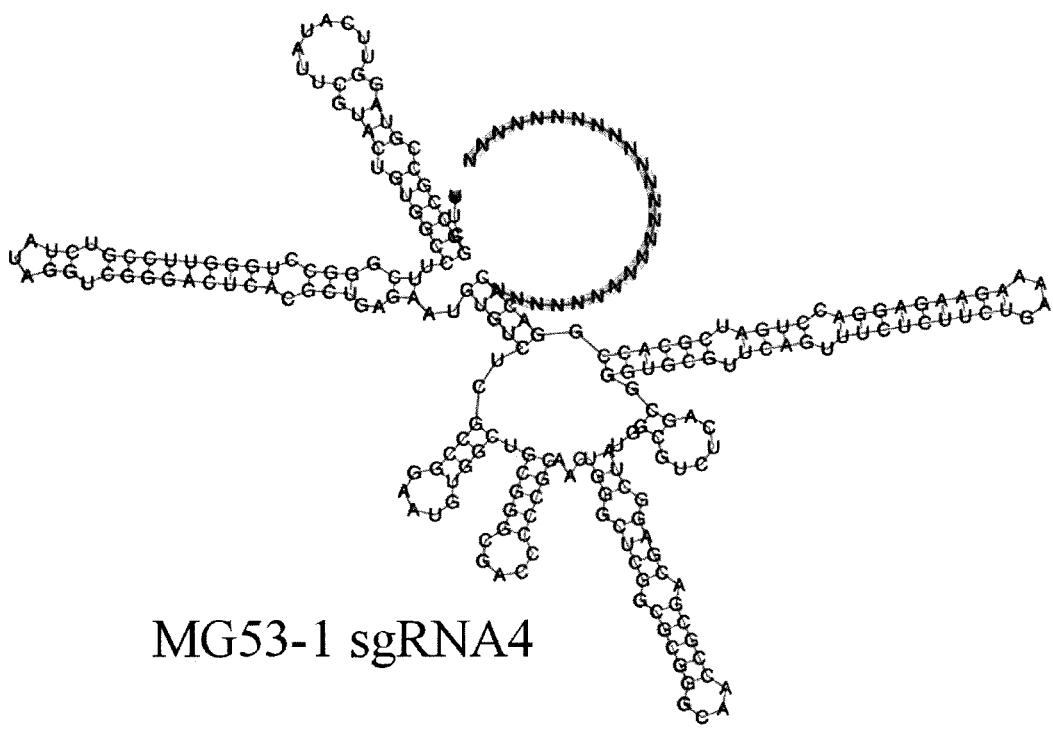
Figure 16:
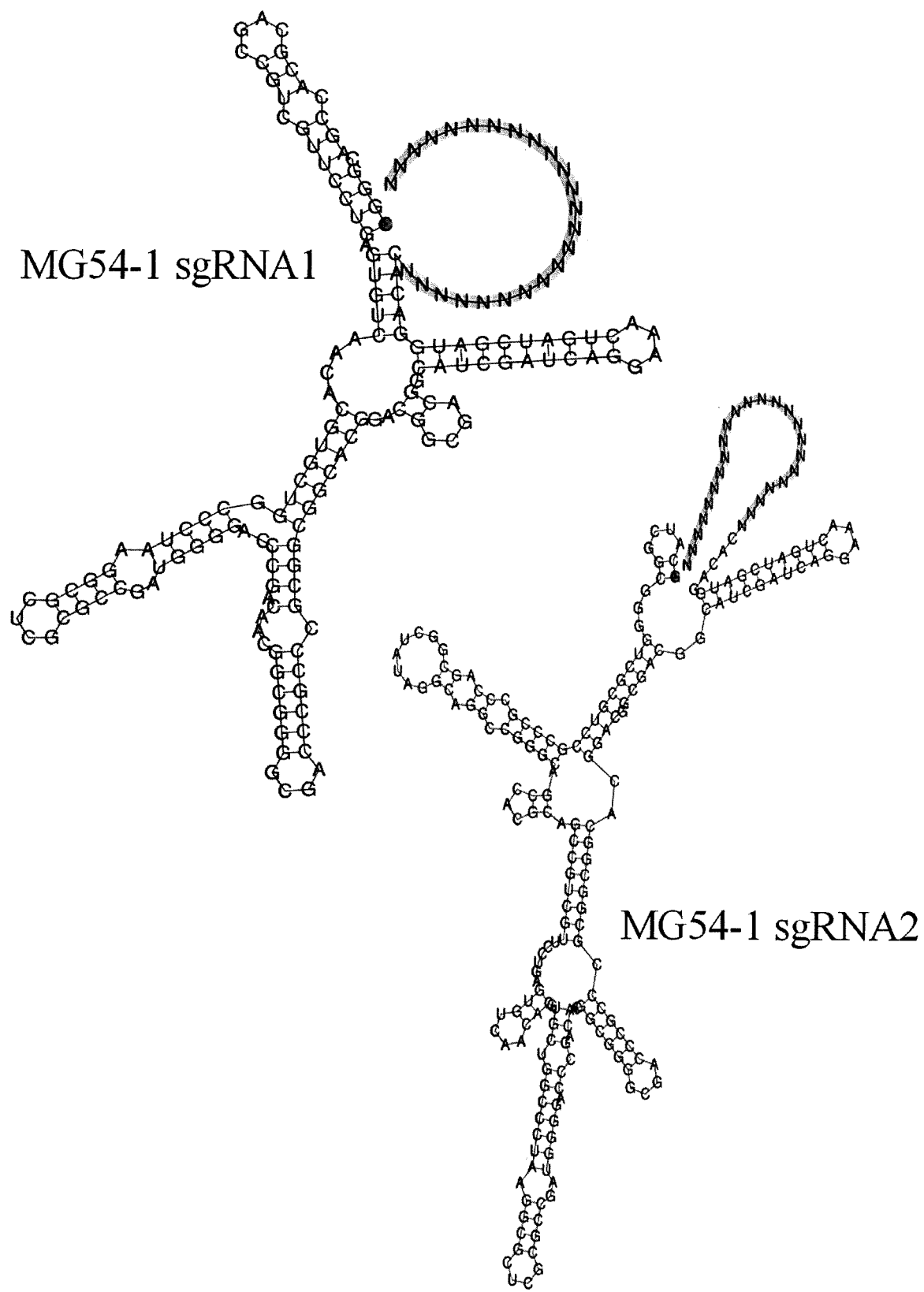

The crystal structure of a ternary complex of AacC2c1 (Cas12b) bound to a sgRNA and a target DNA reveals two separate repeat-anti-repeat (R-AR) motifs in the bound sgRNA, denoted R-AR duplex 1 and R-AR duplex 2 (see FIG. 8 and FIG. 9 herein and Yang, Hui, Pu Gao, Kanagalaghatta R. Rajashankar, and Dinshaw J. Patel. 2016. "PAM-Dependent Target DNA Recognition and Cleavage by C2c1 CRISPR-Cas Endonuclease." Cell 167 (7): 1814-28.e12 and Liu, Liang, Peng Chen, Min Wang, Xueyan Li, Jiuyu Wang, Maolu Yin, and Yanli Wang. 2017. "C2c1-sgRNA Complex Structure Reveals RNA-Guided DNA Cleavage Mechanism." Molecular Cell 65 (2): 310-22, each of which is incorporated by reference herein in its entirety). Putative tracrRNA sequences for the CRISPR effectors disclosed herein were identified by searching for anti-repeat sequences in the surrounding genomic context of native CRISPR arrays, where the R-AR duplex 2 anti-repeat sequence occurs ~20-90 nucleotides upstream of (closer to the 5' end of the tracrRNA than) the R-AR duplex 1 anti-repeat sequence. Following tracrRNA sequence identification, two guide sequences were designed for each enzyme. The first included both R-AR duplexes 1 & 2 (see for example SEQ ID NOs: 3636, 3640, 3644, 3648, 3652, 3656, 3660, 3671, and 3672), and the second was a shorter guide sequence with the R-AR duplex 1 region deleted (see e.g., SEQ ID NOs: 3637, 3641, 3645, 3649, 3653, 3657, and 3661), as this region may not be essential for cleavage.

Example 6—Protocol for Predicted RNA Folding

Predicted RNA folding of RNA sequences at 37° C. was computed using the method of Andronescu 2007 (which is entirely incorporated by reference herein).

Example 7—RNA Guide Identification

For contigs that encoded a Type V-A effector and a CRISPR array, secondary structure folding of repeats indicated that the novel Type V-A systems require a single guide crRNA (sgRNA, FIG. 10). No tracrRNA sequences could be reliably predicted. The sgRNA contained ~19-22 nt from the 3' end of the CRISPR repeat. A multiple sequence alignment of CRISPR repeats from six of the Type V-A candidates that were tested for in-vitro activity shows a highly conserved motif at the 3' end of the repeat, which formed the stem-loop structure of the sgRNA (FIG. 10C). The motif, UCUAC [N3-5]GUAGAU, consisted of short palindromic repeats (the stem) separated by between three and five nucleotides (the loop).

The conservation of the sgRNA motif was used to uncover novel effectors that may not show similarity to classified Type V-A nucleases. Motifs were searched in repeats from 69,117 CRISPR arrays. The most common motif contained a 4-nucleotide loop, while 3- and 5-nucleotide loops were less common (see FIG. 12, FIG. 13, FIG. 14, FIG. 15, and FIG. 16). Inspection of the genomic context surrounding the CRISPR arrays containing the repeat motif revealed numerous effectors of varying lengths. For example, effectors of the family MG57 were the largest of the Type V-A nucleases identified (average 1400 aa), and encoded a repeat with a 4-bp loop. Another family identified from HMM analysis contained a different repeat motif, CCUGC[N$_{3-4}$]GCAGG (see FIGS. 5C,5D). Although differing in sequence, the structure was predicted to fold into a highly similar stem-loop structure.

Example 8—In Vitro Cleavage Efficiency of MG CRISPR Complexes

Endonucleases are expressed as His-tagged fusion proteins from an inducible T7 promoter in a protease deficient E. coli B strain. Cells expressing the His-tagged proteins are lysed by sonication and the His-tagged proteins purified by Ni-NTA affinity chromatography on a HisTrap FF column (GE Lifescience) on an AKTA Avant FPLC (GE Lifescience). The eluate is resolved by SDS-PAGE on acrylamide gels (Bio-Rad) and stained with InstantBlue Ultrafast coomassie (Sigma-Aldrich). Purity is determined using densitometry of the protein band with ImageLab software (Bio-Rad). Purified endonucleases are dialyzed into a storage buffer composed of 50 mM Tris-HCl, 300 mM NaCl, 1 mM TCEP, 5% glycerol; pH 7.5 and stored at −80° C. Target DNAs containing spacer sequences and PAM sequences (determined for example as in either Example 3 or Example 4) are constructed by DNA synthesis. A single representative PAM is chosen for testing when the PAM has degenerate bases. The target DNAs are comprised of 2200 bp of linear DNA derived from a plasmid via PCR amplification with a PAM and spacer located 700 bp from one end. Successful cleavage results in fragments of 700 and 1500 bp. The target DNA, in vitro transcribed single RNA, and purified recombinant protein are combined in cleavage buffer (10 mM Tris, 100 mM NaCl, 10 mM MgCl$_2$) with an excess of protein and RNA and are incubated for 5 minutes to 3 hours, usually 1 hr. The reaction is stopped via addition of RNAse A and incubation at 60 minutes. The reaction is then resolved on a 1.2% TAE agarose gel and the fraction of cleaved target DNA is quantified in ImageLab software.

Example 9—Testing of Genome Cleavage Activity of MG CRISPR Complexes in E. coli

E. coli lacks the capacity to efficiently repair double-stranded DNA breaks. Thus, cleavage of genomic DNA can be a lethal event. Exploiting this phenomenon, endonuclease activity is tested in E. coli by recombinantly expressing an endonuclease and a guide RNA (determined for example as in Example 6) in a target strain with spacer/target and PAM sequences integrated into its genomic DNA (determined for example as in Example 4) integrated into their genomic DNA are transformed with DNA encoding the endonuclease. Transformants are then made chemocompetent and are transformed with 50 ng of guide RNAs (e.g., crRNAs) either specific to the target sequence ("on target"), or non-specific to the target ("non target"). After heat shock, transformations were recovered in SOC for 2 hours at 37° C. Nuclease efficiency is then determined by a 5-fold dilution series grown on induction media. Colonies are quantified from the dilution series in triplicate. A reduction in the number of colonies transformed with an on-target guide RNA compared to the number of colonies transformed with an off-target guide RNA indicates specific genome cleavage by the endonuclease.

Example 10—Generic Procedure: Testing of Genome Cleavage Activity of MG CRISPR Complexes in Mammalian Cells Two types of mammalian expression vectors are used to detected targeting and cleavage activity in mammalian cells. In the first, the MG Cas effector is fused to a C-terminal SV40 NLS and a viral 2A consensus cleavable peptide sequence linked to a GFP tag (the 2A-GFP tag to monitor expression of the protein). In the second, the MG Cas effector is fused to two SV40 NLS sequences, one on the N-terminus and the other on the C-terminus. The NLS sequences comprise any of the NLS sequences described herein (for example SEQ ID NOs: 3938-3953). In some instances, nucleotide sequences encoding the endonucleases are codon-optimized for expression in mammalian cells.

A single guide RNA with a crRNA sequence fused to a sequence complementary to a mammalian target DNA is cloned into a second mammalian expression vector. The two plasmids are co-transfected into HEK293T cells. 72 hours after co-transfection, DNA is extracted from the transformed HEK293T cells and used for the preparation of an NGS-library. Percent NHEJ is measured by quantifying indels at the target site to demonstrate the targeting efficiency of the enzyme in mammalian cells. At least 10 different target sites are chosen to test each protein's activity.

Example 11—Testing of Genome Cleavage Activity of MG CRISPR Complexes in Mammalian Cells To show targeting and cleavage activity in mammalian cells, the MG Cas effector protein sequences were cloned into a mammalian expression vector with flanking N and C-terminal SV40 NLS sequences, a C-terminal His tag, and a 2A-GFP (e.g. a viral 2A consensus cleavable peptide sequence linked to a GFP) tag at the C terminus after the His tag (Backbone 1). In some instances, nucleotide sequences encoding the endonucleases were the native sequence, codon-optimized for expression in *E. coli* cells or codon-optimized for expression in mammalian cells.

The single guide RNA sequence (sgRNA) with a gene target of interest was also cloned into a mammalian expression vector. The two plasmids are co-transfected into HEK293T cells. 72 hours after co-transfection of the expression plasmid and a sgRNA targeting plasmid into HEK293T cells, the DNA was extracted and used for the preparation of an NGS-library. Percent NHEJ was measured via indels in the sequencing of the target site to demonstrate the targeting efficiency of the enzyme in mammalian cells. 7-12 different target sites were chosen for testing each protein's activity. An arbitrary threshold of 5% indels was used to identify active candidates. Genome editing efficiency in human cells was assessed from the NGS reads with CRISPResso using parameters: cleavage offset=−4 and window=10. All post cleavage events from the CRISPResso output were summed for ±1 bp indels/mutations, and >2 bp deletions, insertions, and mutations. All outcomes were normalized to total sequences aligned to the expected amplicon (see FIG. 18)

Example 12—Characterization of MG29 Family PAM Specificity, tracrRNA/sgRNA Validation The targeted endonuclease activity of MG29 family endonuclease systems was confirmed using the myTXTL system described in Example 3 and Example 8. In this assay, PCR amplification of cleaved target plasmids yields a product that migrates at approximately 170 bp in the gel, as shown in FIG. 17. Amplification products were observed for MG29-1 with crRNA corresponding to SEQ ID NO: 3609 (see FIG. 17A, lane 7). Sequencing the PCR products revealed active PAM sequences for these enzymes as shown in Table 2 below.

TABLE 2

Activity of MG29-1 at various target sites

| target ID | target sequence | 5' sequence including PAM | locus | %NHEJ (mean ± std) |
|---|---|---|---|---|
| target1 | TGTCAGAAGC AAATGTAAGC AATA (SEQ ID NO: 3914) | AACACAGTTG (SEQ ID NO: 3890) | HBB | 2.185 ± 0.007 |
| target2 | CTGAAAGGTT ATTGTTGTGT TTGT (SEQ ID NO: 3915) | TACAGTTTTG (SEQ ID NO: 3891) | Fibrinogen | 10.5 ± 8.74 |
| target3 | CTAGTGAACA CAGTTGTGTC AGAA (SEQ ID NO: 3916) | TTTGAGGTTG (SEQ ID NO: 3892) | HBB | 2.14 ± 2.83 |
| target4 | TGAAGTCTTA CAAGGTTATC TTAT (SEQ ID NO: 3917) | TTTGTATTTG (SEQ ID NO: 3893) | Albumin | 13.757 ± 5.46 |
| target5 | CACTTTCCTT AGTGCGCAAA AGAA (SEQ ID NO: 3918) | AGTTACTTTG (SEQ ID NO: 3894) | Albumin | 17.937 ± 8.27 |
| target6 | GTGGTGAGGC CCTGGGCAGG TTGG (SEQ ID NO: 3919) | GATGAAGTTG (SEQ ID NO: 3895) | HBB | 12.545 ± 1.73 |
| target7 | GGAGGTCAGA AATAGGGGGT CCAG (SEQ ID NO: 3920) | TAGCTGTTTG (SEQ ID NO: 3896) | VEGFA | 23.56 ± 7.04 |

TABLE 2-continued

Activity of MG29-1 at various target sites

| target ID | target sequence | 5' sequence including PAM | locus | %NHEJ (mean ± std) |
|---|---|---|---|---|
| target8 | GAAAGGGGT GGGGGGAGTT TGCT (SEQ ID NO: 3921) | ATGGGCTTTG (SEQ ID NO: 3897) | VEGFA | 30.147 ± 10.17 |
| target9 | GTATCAAGGT TACAAGACAG GTTT (SEQ ID NO: 3922) | GGGCAGGTTG (SEQ ID NO: 3898) | HBB | 10.935 ± 1.56 |
| target10 | TGTGAGGGAG CACCGTTCTC TAGA (SEQ ID NO: 3923) | TACATAGTTG (SEQ ID NO: 3899) | Apolipoprotein | 30.43 ± 1.57 |
| target11 | GGTAGTTTTC TGTGGTCCTA TTAT (SEQ ID NO: 3924) | TACGCATTTG (SEQ ID NO: 3900) | Apolipoprotein | 18.173 ± 6.28 |
| target12 | CCAGGAAAGT TGATGTGGTC TGCG (SEQ ID NO: 3925) | CCGCAAGTTG (SEQ ID NO: 3901) | Apolipoprotein | 7.47 ± 10.52 |

Targeted Endonuclease Activity in Mammalian Cells

Figure 19:
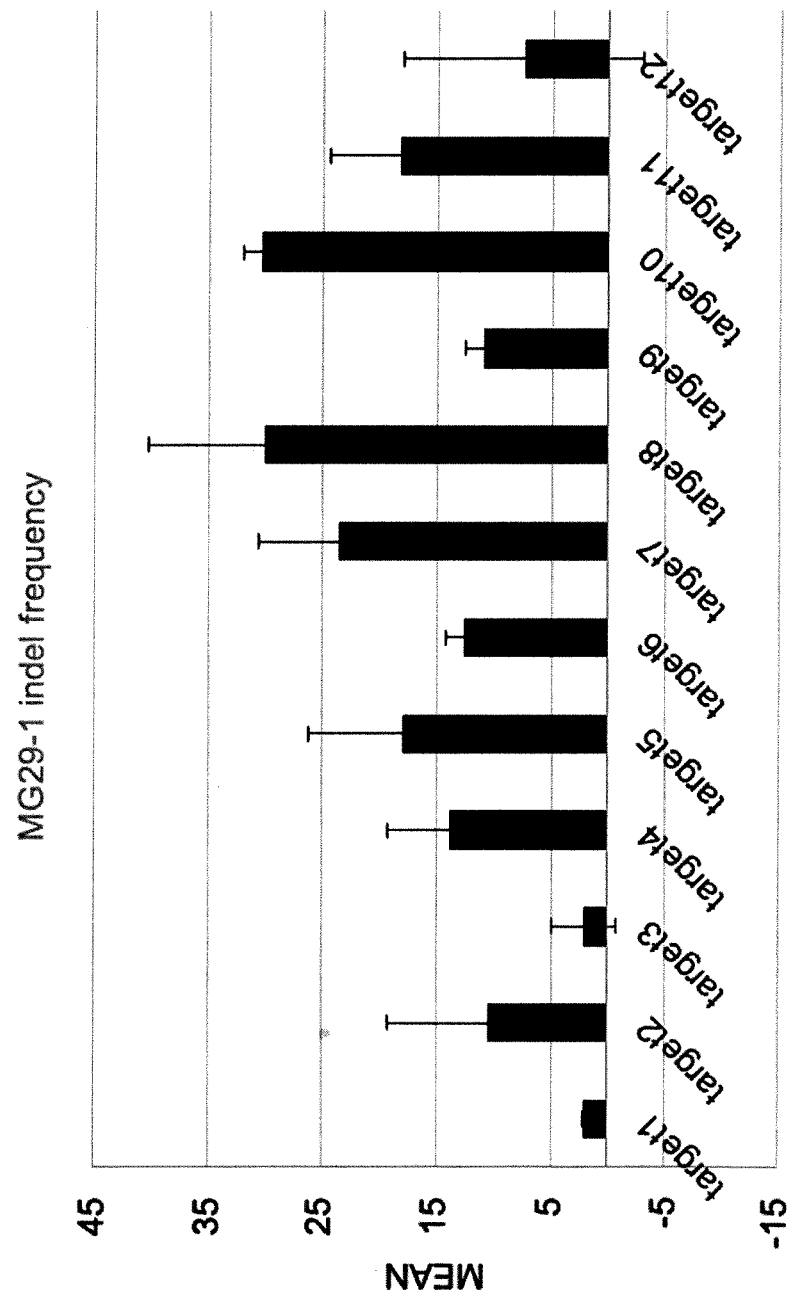
FIG. 19 depicts in cell indel formation generated by transfection of HEK cells with MG29-1 constructs described in Example 12 alongside their corresponding sgRNAs containing various different targeting sequences targeting various locations in the human genome.

MG29-1 target loci were chosen to test locations in the genome with the PAM YYn (SEQ ID NO: 3871). The spacers corresponding to the chosen target sites were cloned into the sgRNA scaffold in the mammalian vector system backbone 1 described in Example 9. The sites are listed in Table 3 below. The activity of MG29-1 at various target sites is shown in Table 2 and FIG. 19.

TABLE 3

5' PAM Sequences and crRNAs for Enzymes Described Herein

| Enzyme | Enzyme SEQ ID NO: | 5' PAM | PAM SEQ ID NO: | crRNA SEQ ID NO: |
|---|---|---|---|---|
| MG29-1 | 215 | KTTG | 3870 | 3608 |

Example 13—High-Replicate PAM Determination Via NGS

Type V endonucleases (e.g. MG28, MG29, MG30, MG31 endonucleases) were tested for cleavage activity using E coli lysate-based expression in the myTXTL kit as described in Example 3 and Example 8. Upon incubation with a crRNA and a plasmid library containing a spacer sequencing matching the crRNA preceded by 8 degenerated ("N") bases (a 5' PAM library), the subset of the plasmid library with a functional PAM was cleaved. Ligation to this cut site and PCR amplification provided evidence of activity, demonstrated by the bands observed in the gel at 170 bp (FIG. 17B). Gel 1 (top panel, A) lanes are as follows: 1 (ladder; darkest band corresponds to 200 bp); 2: positive control (previously verified library); 3 (n/a); 4 (n/a); 5 (MG28-1); 6 (MG29-1); 7 (MG30-1); 8 (MG31-1); 9 (MG32-1); and 10 (Ladder). Gel 2 (bottom panel, B) lanes are as follows: 1 (ladder; darkest band corresponds to 200 bp); 2 (LbCpf1 positive control); 3 (LbCpf1 positive control); 4 (negative control); 5 (n/a); 6 (n/a); 7 (MG28-1); 8 (MG29-1); 9 (MG30-1); 10 (MG31-1); 11 (MG32-1).

Figure 20:
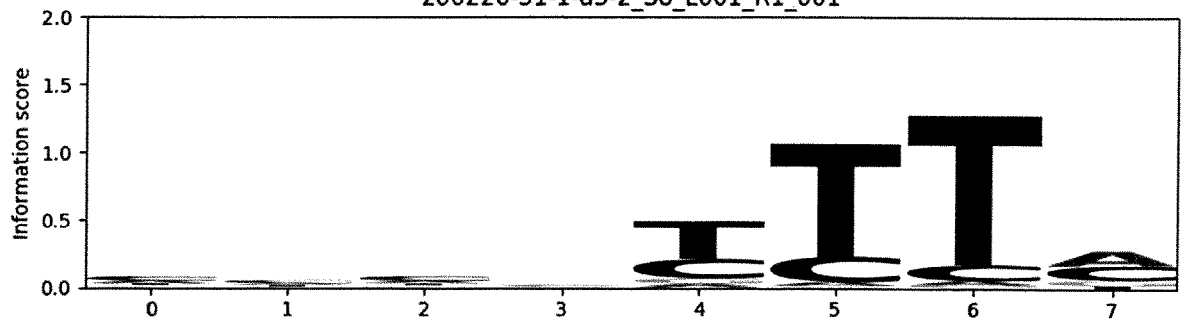
FIG. 20 depicts seqLogo representations of PAM sequences of specific MG family enzymes derived via NGS as described herein (as described in Example 13).
Figure 20:
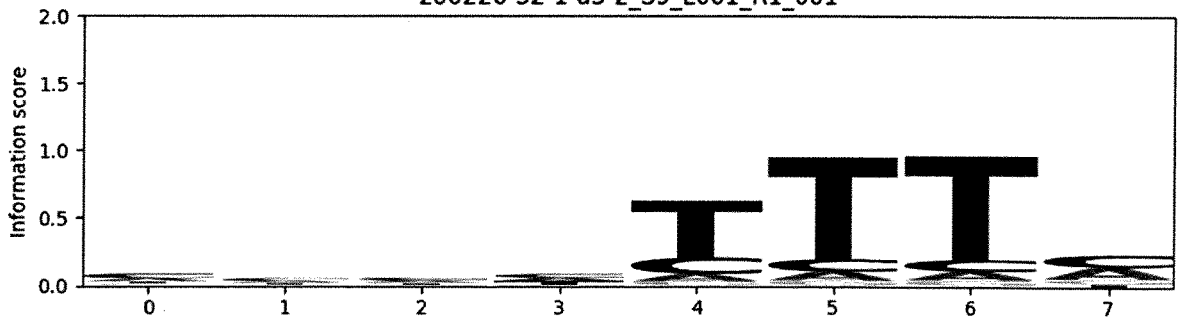
Figure 20:
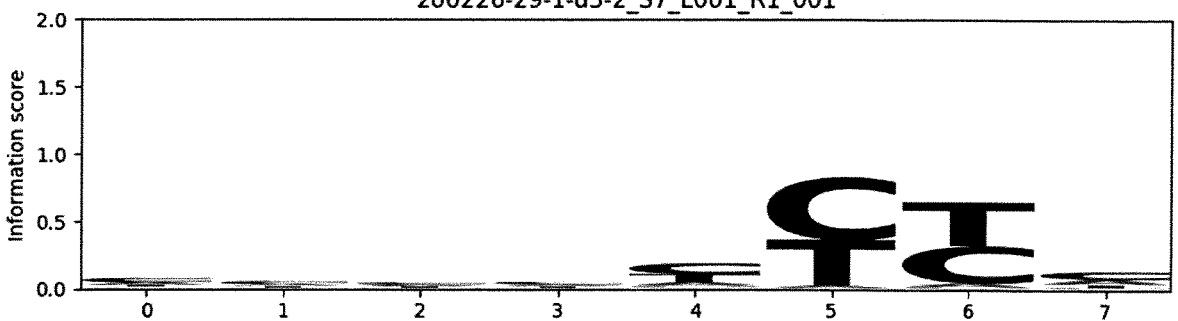
Figure 20:
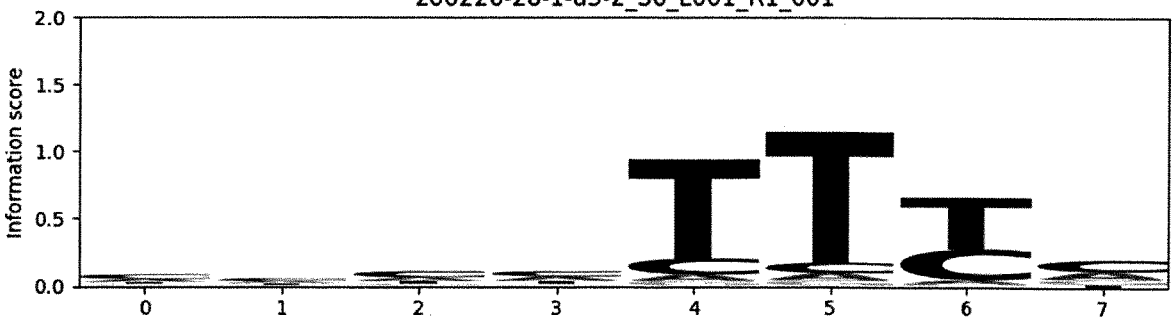
Figure 21:
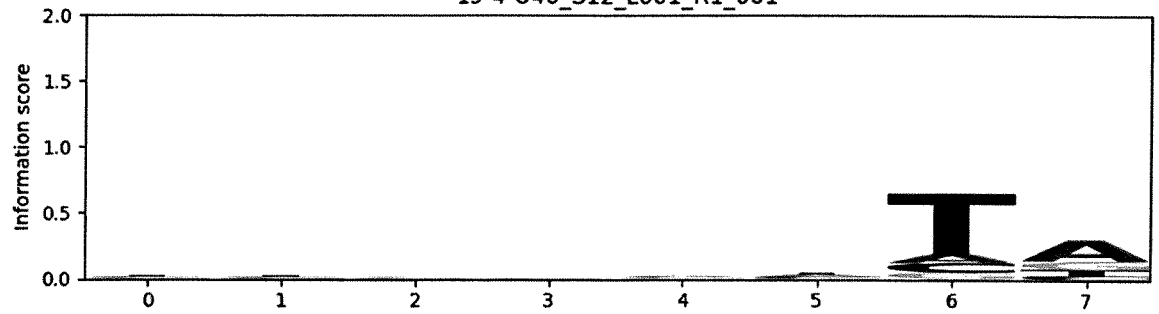
FIG. 21 depict seqLogo representations of PAM sequences of specific MG family enzymes derived via NGS as described herein (top to bottom, SEQ ID NOs: 3865, 3867, 3872).
Figure 21:
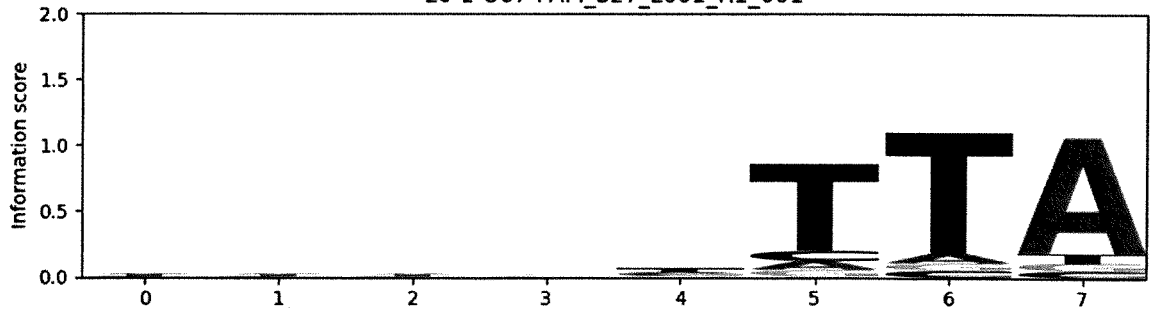
Figure 21:
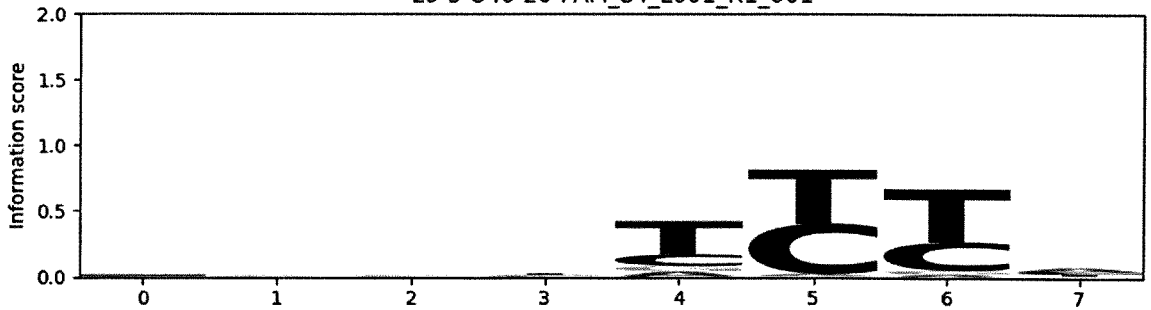
Figure 22:
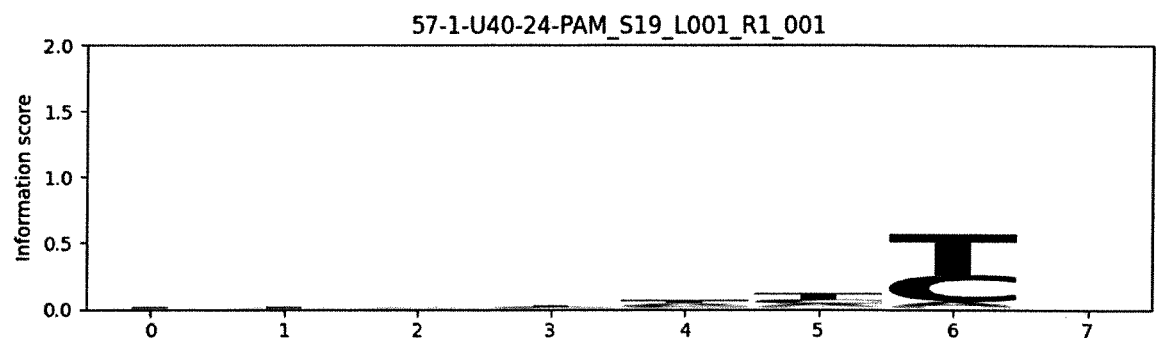
FIG. 22 depict seqLogo representations of PAM sequences derived via NGS as described herein (top to bottom, SEQ ID NOs: 3879, 3880, 3881).
Figure 22:
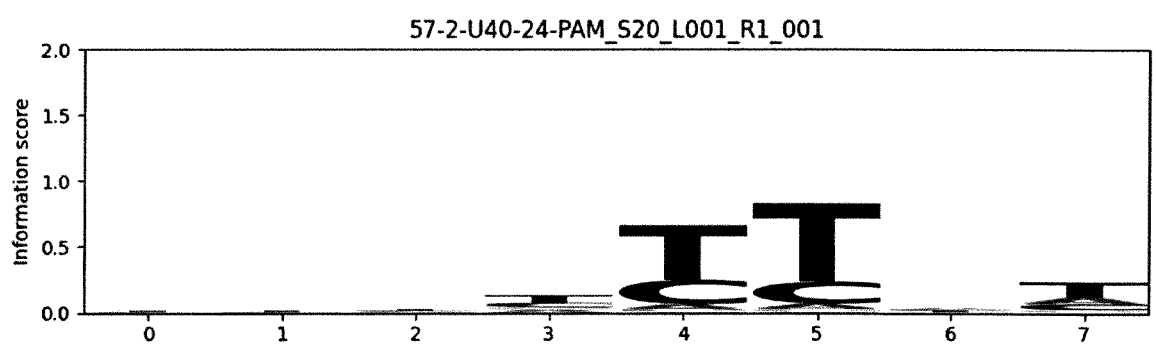
Figure 22:
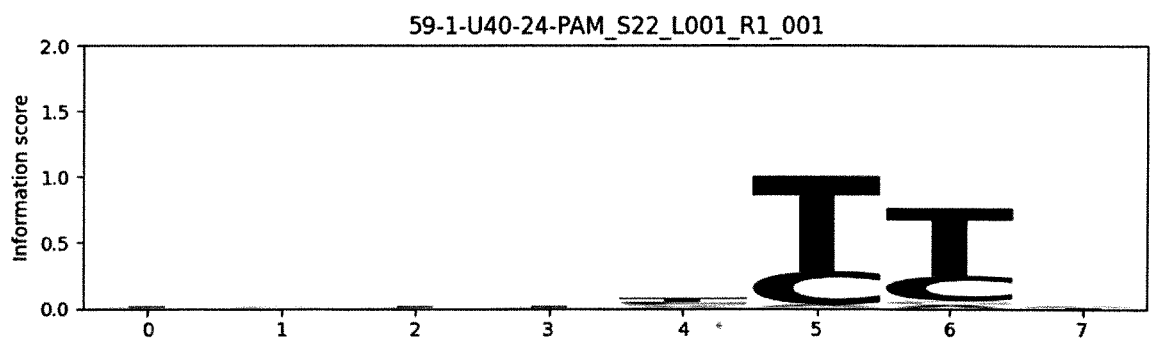
Figure 23:
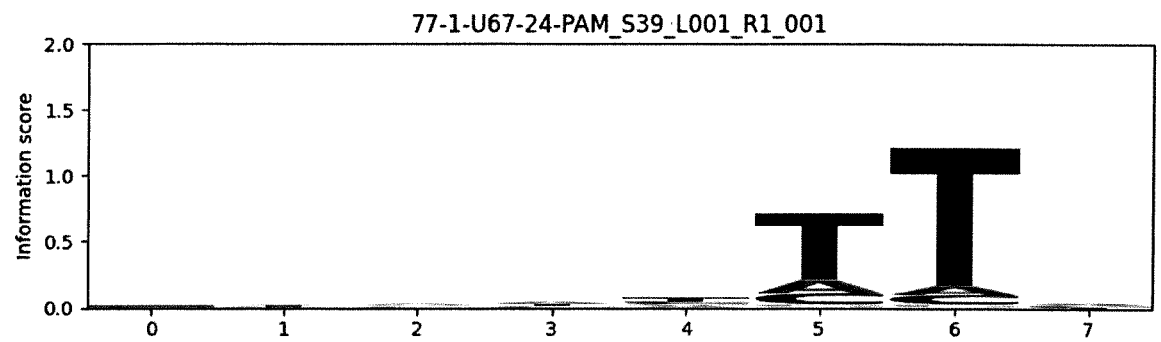
FIG. 23 depict seqLogo representations of PAM sequences derived via NGS as described herein (top to bottom, SEQ ID NOs: 3883, 3884, 3885).
Figure 23:
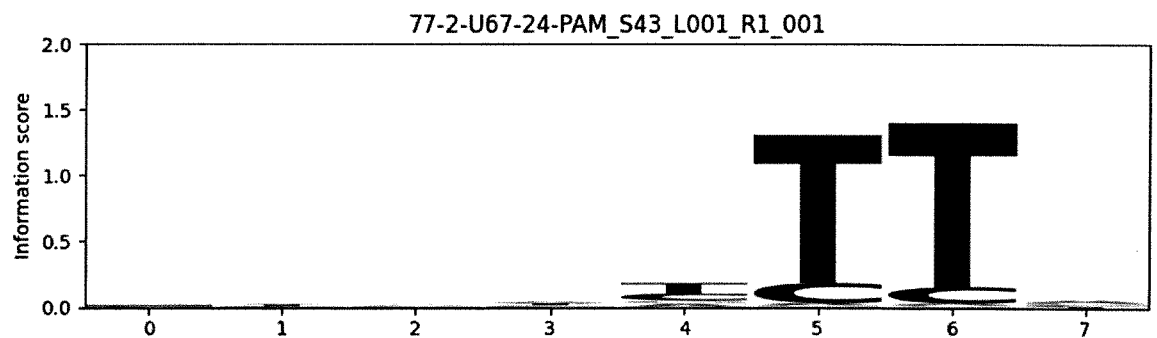
Figure 23:
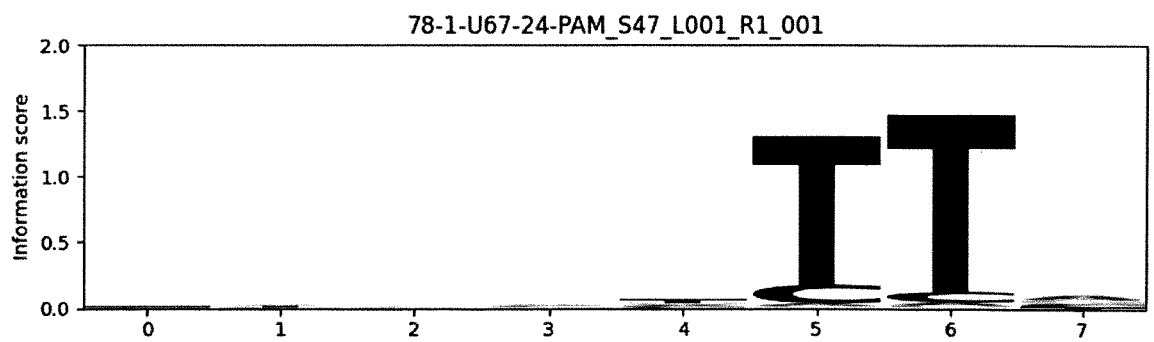
Figure 24:
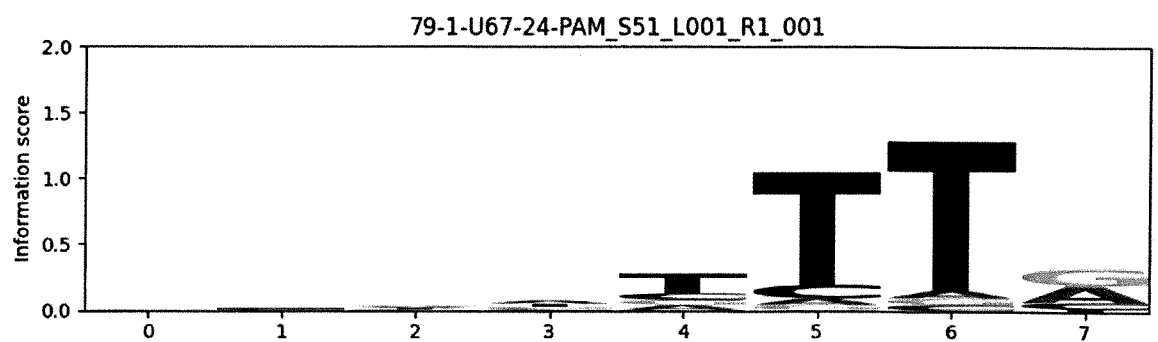
FIG. 24 depict seqLogo representations of PAM sequences derived via NGS as described herein (SEQ ID NO: 3882).
Figure 25:
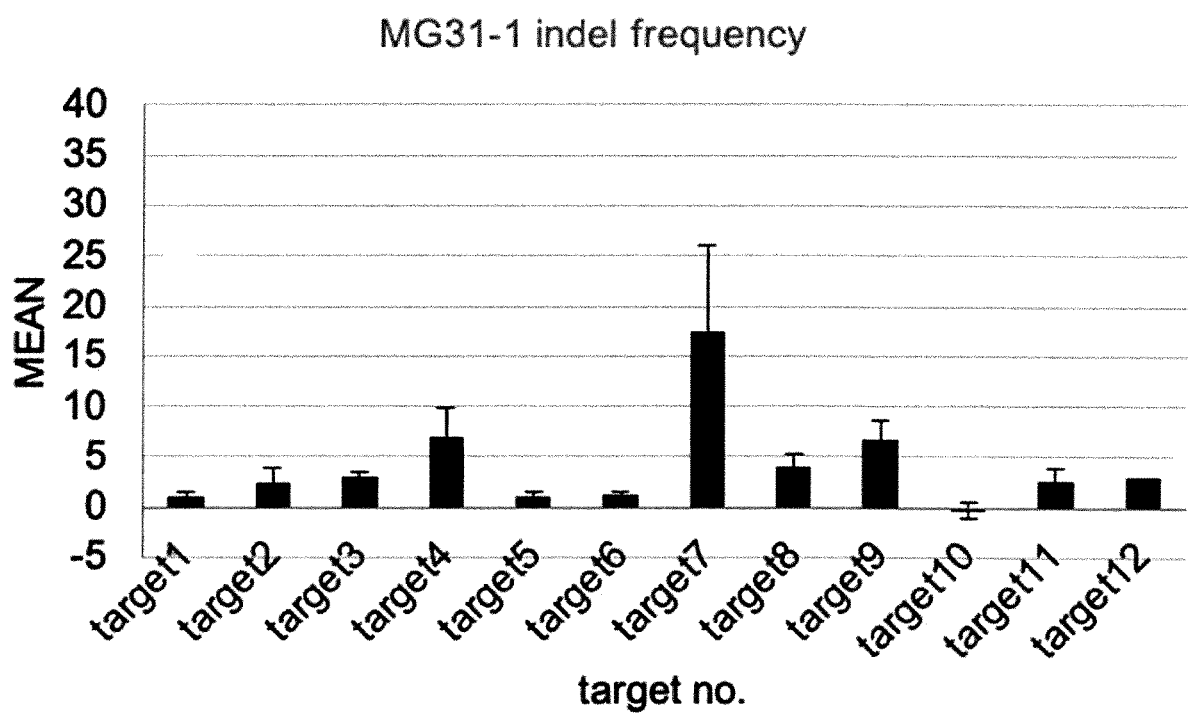
FIG. 25 depicts in cell indel formation generated by transfection of HEK cells with MG31-1 constructs described in Example 14 alongside their corresponding sgRNAs containing various different targeting sequences targeting various locations in the human genome.

The PCR products were further subjected to NGS sequencing and the PAMs were collated into seqLogo (see e.g., Huber et al. Nat Methods. 2015 February; 12(2):115-21) representations (FIG. 20). The seqLogo representation shows the 8 bp which are upstream (5') of the spacer labeled as positions 0-7. As shown in the FIG. 20, the PAMs are pyrimidine rich (C and T), with most sequence requirements 2-4 bp upstream of the spacer (positions 4-6 in the SeqLogo). The PAMs for the MG candidates are shown in Table 4 below.

TABLE 4

5' PAM Sequences and crRNAs for Enzymes Described Herein

| Enzyme | Enzyme SEQ ID NO: | 5' PAM | PAM SEQ ID NO: | crRNA SEQ ID NO: |
|---|---|---|---|---|
| MG28-1 | 141 | TTTn | 3868 | 3609 |
| MG29-1 | 215 | YYn | 3871 | 3609 |
| MG31-1 | 229 | YTTn | 3875 | 3609 |
| MG32-1 | 261 | TTTn | 3877 | 3609 |

In some cases, the position immediately adjacent to the spacer may have a weaker preference, e.g. for "m" or "v" instead of "n".

Example 14—Targeted Endonuclease Activity in Mammalian Cells with MG31 Nucleases Targeted Endonuclease Activity in Mammalian Cells MG31-1 target loci were chosen to test locations in the genome with the PAM TTTR (SEQ ID NO: 3875). The spacers corresponding to the chosen target sites were cloned into the sgRNA scaffold in the mammalian vector system backbone 1 described in Example 11. The sites are listed in Table 5 below. The activity of MG31-1 at various target sites is shown in Table 5 and FIG. 25.

TABLE 5

Activity of MG31-1 at various target sites

| target ID | target sequence | PAM | locus | %NHEJ (mean ± std) |
|---|---|---|---|---|
| target1 | GTTATTAATTTCTTGCTACTTGTC (SEQ ID NO: 3926) | GTTTTCTTTA (SEQ ID NO: 3902) | Fibrinogen | 1.005 ± 0.516 |
| target2 | CTGAAAGGTTATTGTTGTGTTTGT (SEQ ID NO: 3927) | TACAGTTTTG (SEQ ID NO: 3903) | Fibrinogen | 2.417 ± 1.47 |
| target3 | GTGTTAGTACAGTTTTGCTGAAAG (SEQ ID NO: 3928) | AGAACTTTTA (SEQ ID NO: 3904) | Fibrinogen | 2.925 ± 0.516 |
| target4 | TGAAGTCTTACAAGGTTATCTTAT (SEQ ID NO: 3929) | TTTGTATTTG (SEQ ID NO: 3905) | Albumin | 7.053 ± 2.72 |
| target5 | CACTTTCCTTAGTGCGCAAAAGAA (SEQ ID NO: 3930) | AGTTACTTTG (SEQ ID NO: 3906) | Albumin | 0.927 ± 0.50 |
| target6 | CCTAGGATGTTTGAATTTTATTAA (SEQ ID NO: 3931) | TTTTTTTTTA (SEQ ID NO: 3907) | Albumin | 1.125 ± 0.43 |
| target7 | GGAGGTCAGAAATAGGGGGTCCAG (SEQ ID NO: 3932) | TAGCTGTTTG (SEQ ID NO: 3908) | VEGFA | 17.39 ± 8.67 |
| target8 | GAAAGGGGGTGGGGGGAGTTTGCT (SEQ ID NO: 3933) | ATGGGCTTTG (SEQ ID NO: 3909) | VEGFA | 4.01 ± 1.29 |
| target9 | GCCAGAGCCGGGGTGTGCAGA | TCCCTCTTTA (SEQ ID | VEGFA | 6.72 ± 1.92 |

TABLE 5-continued

Activity of MG31-1 at various target sites

| target ID | target sequence | PAM | locus | %NHEJ (mean ± std) |
|---|---|---|---|---|
| | CGG (SEQ ID NO: 3934) | NO: 3910) | | |
| target10 | CTTGGAC CTTGTTT TGCTTAC TGT (SEQ ID NO: 3935) | ACAAATT TTA (SEQ ID NO: 3911) | Apolipoprotein | −0.32 ± 0.75 |
| target11 | GGTAGTT TTCTGTG GTCCTAT TAT (SEQ ID NO: 3936) | TACGCAT TTG (SEQ ID NO: 3912) | Apolipoprotein | 2.593 ± 1.33 |
| target12 | ATCATAA GAAGTTA GCTTGAC GCA (SEQ ID NO: 3937) | GAAAAAT TTA (SEQ ID NO: 3913) | Apolipoprotein | 3.095 |

Example 15—In Vitro Activity

Figures 26, 26C:
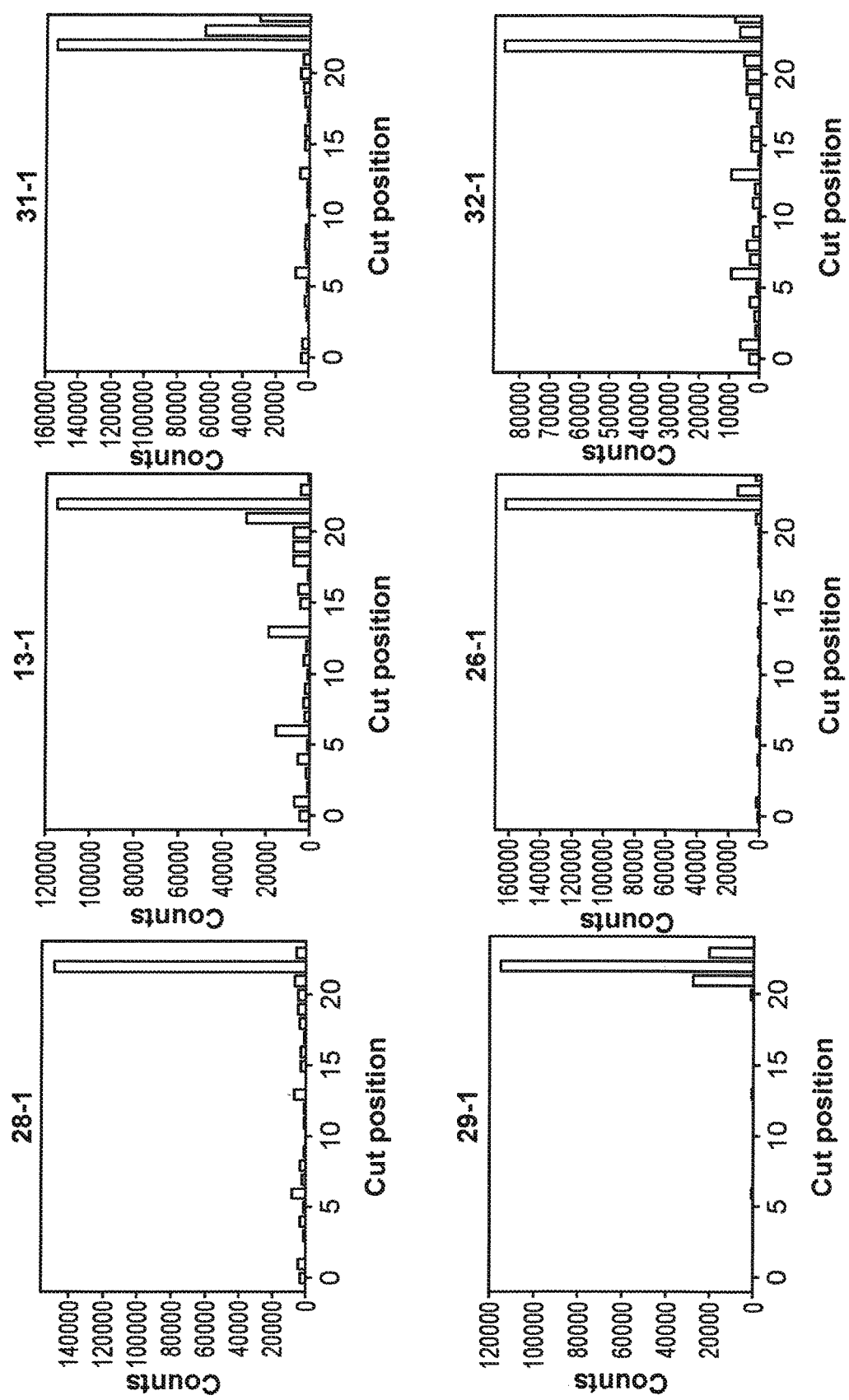
FIG. 26 shows the biochemical characterization of Type V-A nucleases.
FIG. 26C shows analysis of the NGS cut sites shows cleavage on the target strand at position 22, sometimes with less frequent cleavage after 21 or 23 nt.

Promising candidates from the bioinformatic analysis and preliminary screens were selected for further biochemical analysis as described in this example. Using the conserved 3' sgRNA structure, a "universal" sgRNA was designed comprising the 3' 20 nt of the CRISPR repeat and a 24 nt spacer (FIG. 10). Of the seven tested candidates, six showed activity in vitro against the 8N PAM library (FIG. 26A). The remaining inactive candidate (30-1) showed activity when tested with its predicted endogenous trimmed CRISPR repeat (SEQ ID NO: 3608, see FIG. 26B), but was not included in NGS library assays. (FIG. 26C)

Figures 18, 18A:
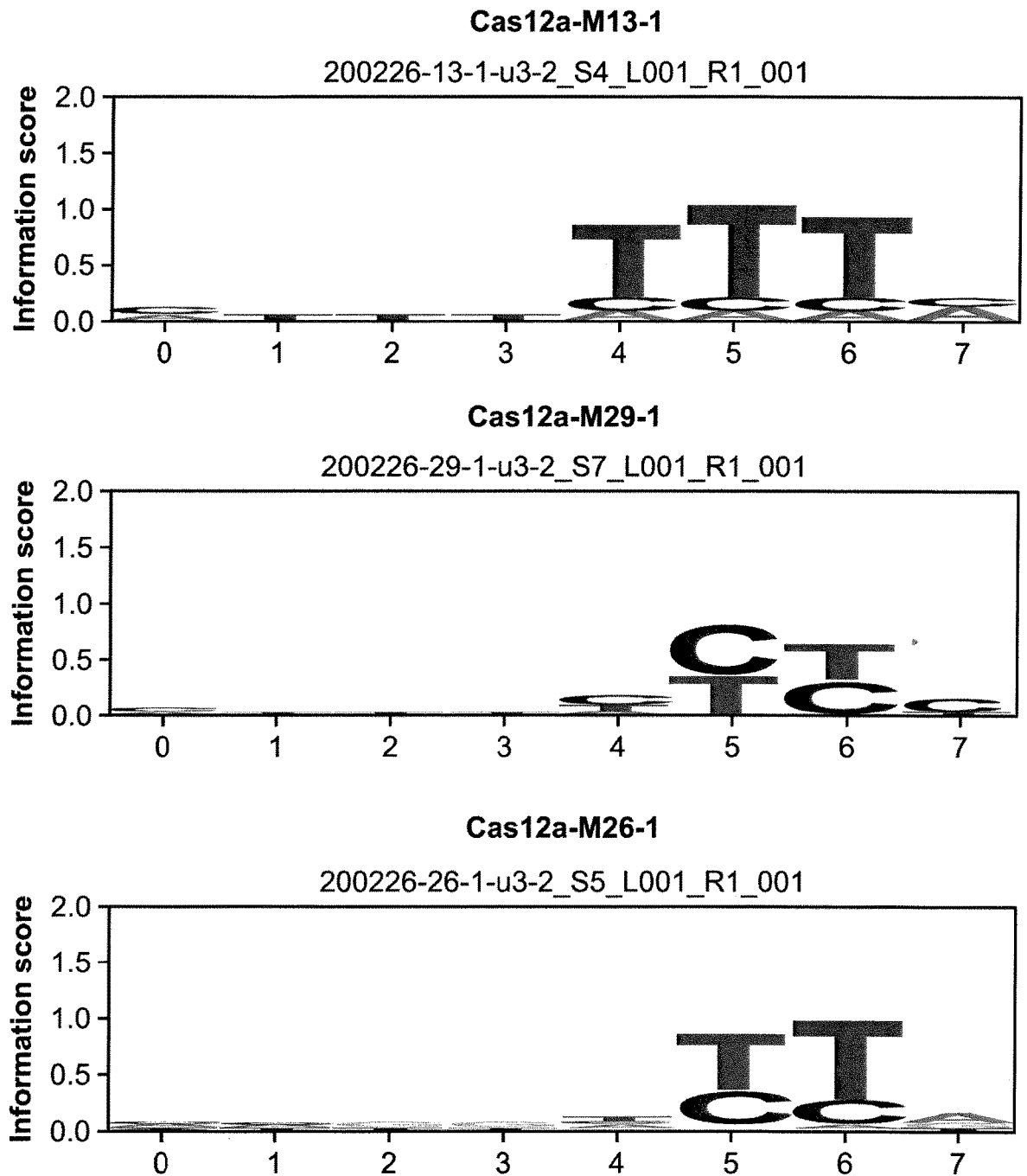
FIG. 18 shows Type V-A effectors described herein are active nucleases.
FIG. 18A depicts seqLogo representations of PAM sequences determined for 6 nucleases described herein.
Figure 18A:
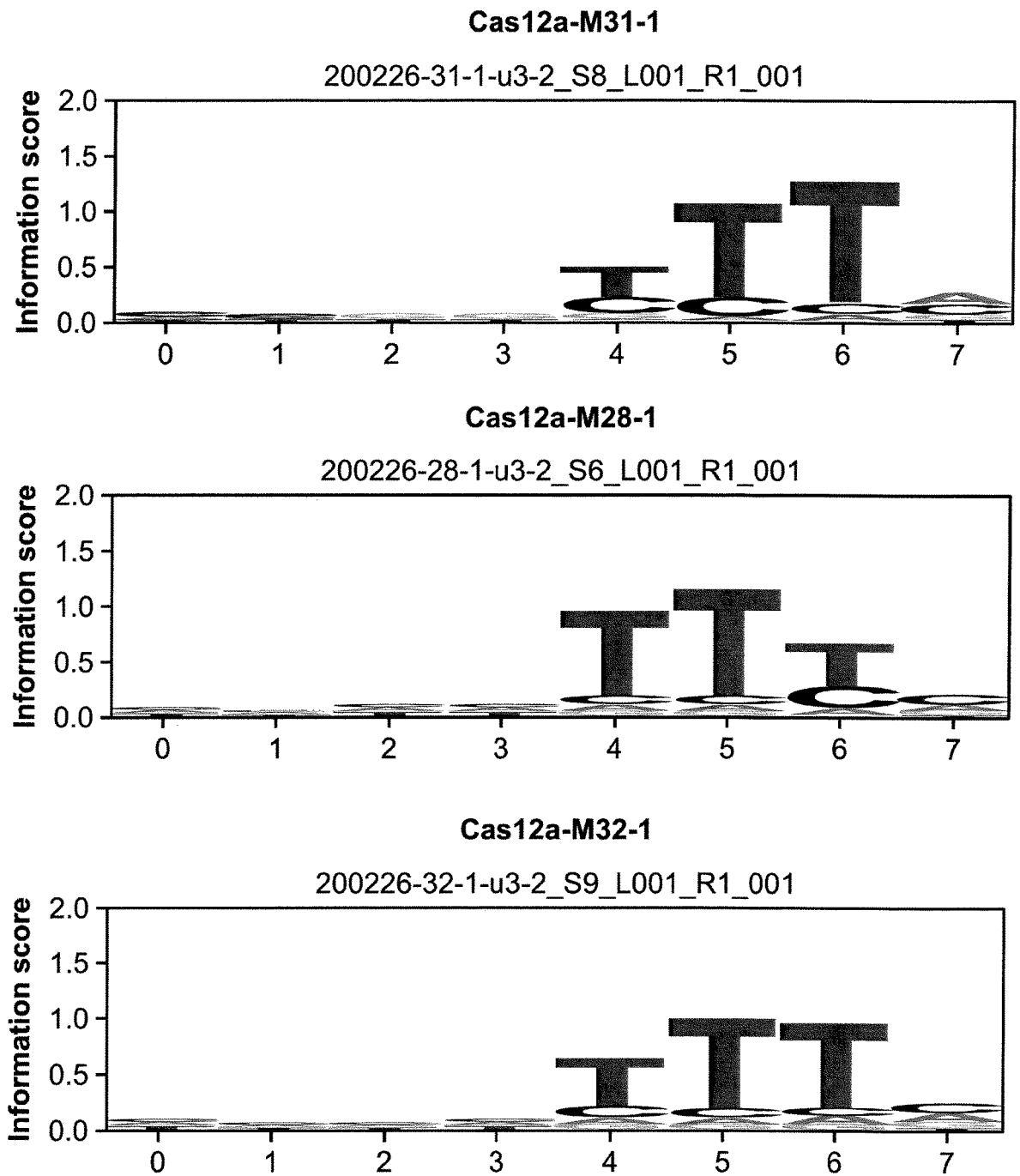

The majority of identified PAMs are thymine-rich sequences of 2-3 bases (FIG. 18A). However, two enzymes, MG26-1 (PAM YYn) and MG29-1 (PAM YYn), had PAM specificity for either pyrimidine base, thymine or cytosine, allowing for broader sequence targeting. Analysis of putative PAM-interacting residues indicated that the active Type V-A nucleases contain a conserved Lysine and a GWxxxK motif, which were shown to be important in recognition and interaction with different PAMs in FnCas12a.

Figure 18B:
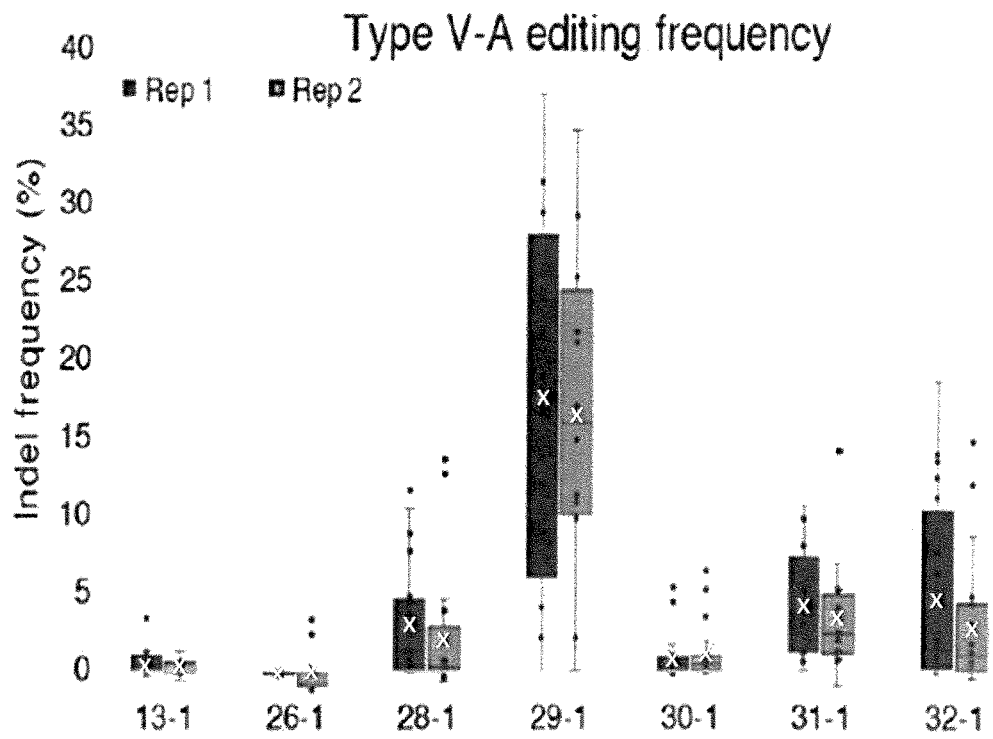
FIG. 18B shows a boxplot of plasmid transfection activity assays inferred from frequency of indel edits for active nucleases. The boundaries of the boxplots indicate first and third quartile values. The mean is indicated with an "x" and the median is represented by the midline within each box.
Figures 56, 56A:
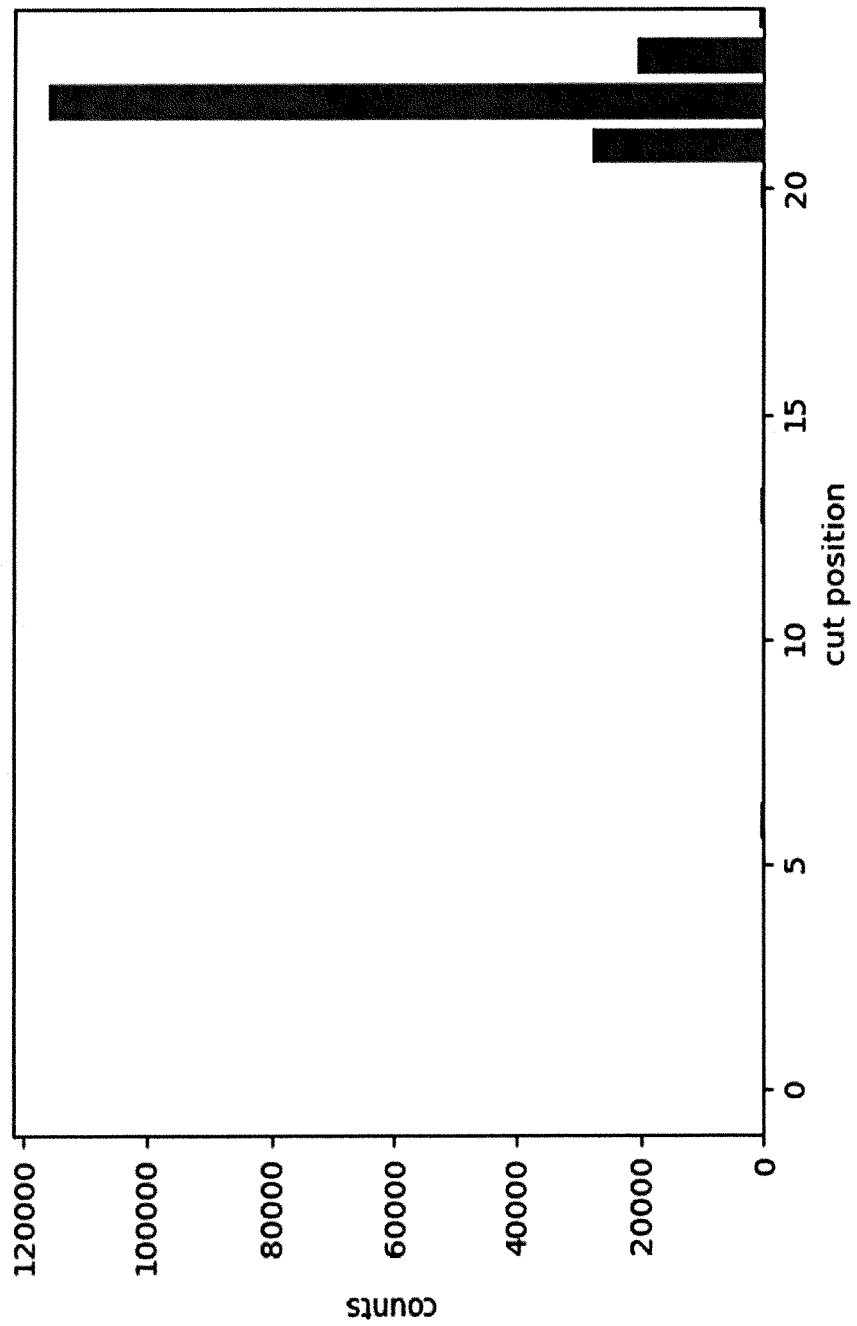
FIG. 56 shows the use of sequencing to identify the cut site on the target strand in an in vitro reaction performed with MG29-1 protein, a guide RNA and an appropriate template (SEQ ID NO: 4541).
FIG. 56A shows the distance of the cut position from the PAM in nucleotides as determined by next generation sequencing.

As our PAM detection assay required ligation to create blunt-end fragments prior to PAM enrichment, this suggested that these enzymes created a staggered double strand DNA break, similar to previously reported Type V-A nucleases. The cut site on the target strand can be identified by analysis of the NGS reads used for indel detection (FIG. 18B) and showed cleavage after the 22nd PAM-distal base in vitro cleavage by MG29-1 was further investigated by sequencing the cleavage products. The cut position on the target strand was 22 nucleotides away from the PAM in most sequences, and 21 or 23 nucleotides less frequently (FIG. 56). The cut position on the non-target strand was 17 to 19 nucleotides from the PAM. In combination, these results indicate a 3-5 bp overhang.

Example 16—Genome Editing

Figure 18C:
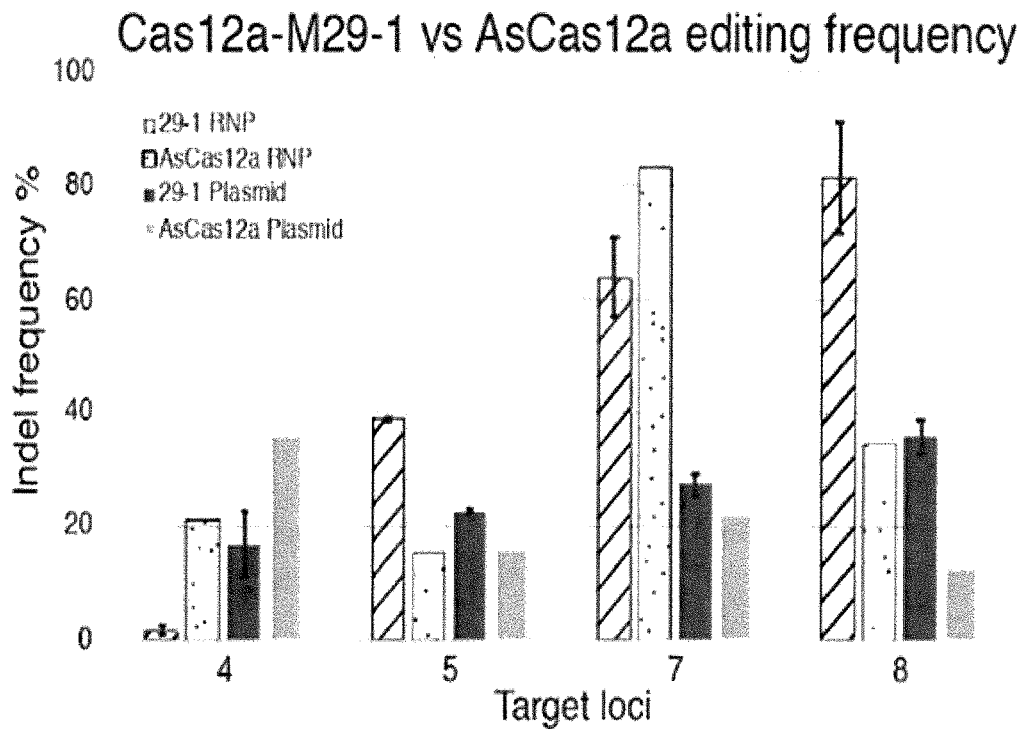
FIG. 18C shows plasmid transfection editing frequencies at four target sites for MG29-1 and AsCas12a. One side-by-side experiment with AsCas12a was done.
Figure 18D:
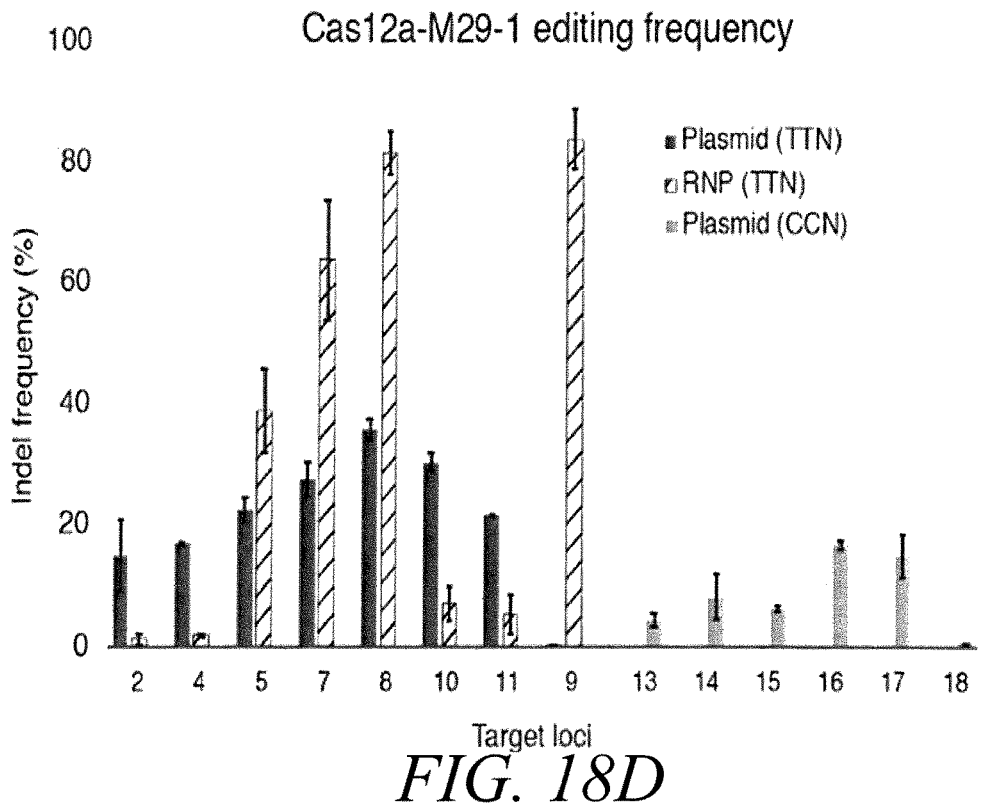
FIG. 18D shows plasmid and RNP editing activity for nuclease MG29-1 at 14 target loci with either TTN or CCN PAMs.
Figure 18E:
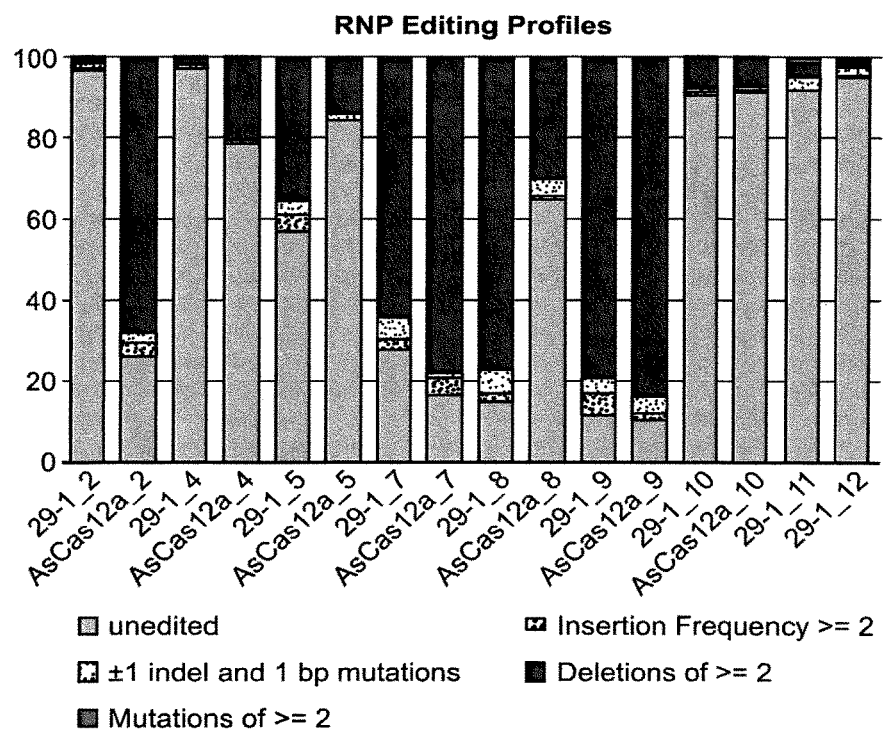
FIG. 18E shows the editing profile of nuclease MG29-1 from RNP transfection assays. One side-by-side experiment with AsCas12a was done. Editing frequency and profile experiments for MG29-1 were done in duplicate. The bar plots

After confirmation of the PAM, novel proteins described herein were tested in HEK293T cells for gene targeting activity. All candidates showed activity of over 5% NHEJ (background corrected) on at least one of ten tested target loci. MG29-1 showed the highest overall activity in NHEJ modification outcomes (FIG. 18B) and was active on the highest number of targets. Thus, this nuclease was selected for purified ribonucleoprotein complex (RNP) testing in HEK293 cells. RNP transfection of MG29-1 holoenzyme showed higher editing levels with RNP than plasmid-based transfection on 4 out of 9 targets, in some cases over 80% editing efficiency (FIG. 18C). Analysis of editing profiles for MG29-1 indicates that this nuclease produces deletions of more than two bp more frequently than other types of edits at their target site (FIG. 18D). At some targets (5 and 8) the indel frequency for MG29-1 was twice that of AsCpf1 (FIG. 18E).

Example 17—Discussion

Type V-A CRISPR were identified from metagenomes collected from a variety of complex environments and arranged into families. These novel Type V-A nucleases had diverse sequences and phylogenetic origins within and across families and cleaved targets with diverse PAM sites. Similar to other Type V-A nucleases (e.g. LbCas12a, AsCas12a, and FnCas12a), the effectors described herein utilized a single guide CRISPR RNA (sgRNA) to target staggered double stranded cleavage of DNA, simplifying guide design and synthesis, which will facilitate multiplexed editing. Analysis of CRISPR repeat motifs that formed the stem-loop structure of the crRNA suggested that the Type V-A effectors described herein have a 4-nt loop guide more frequently than shorter or longer loops. The sgRNA motif of LbCpf1 has a less common 5-nt, although the 4-nt loop was also observed previously for 16 Cpf1 orthologs. An unusual stem-loop CRISPR repeat motif sequence, CCUGC[$N_{3-4}$]GCAGG, was identified for the MG61 family of Type V-A effectors. The high degree of conservation of the sgRNA with variable loop lengths in Type V-A may afford flexible levels of activity, as shown for proteins described herein. Taken together, these effectors are not close homologs to previously studied enzymes, and greatly expand the diversity of Type V-A-like sgRNA nucleases.

Figures 4, 4A:
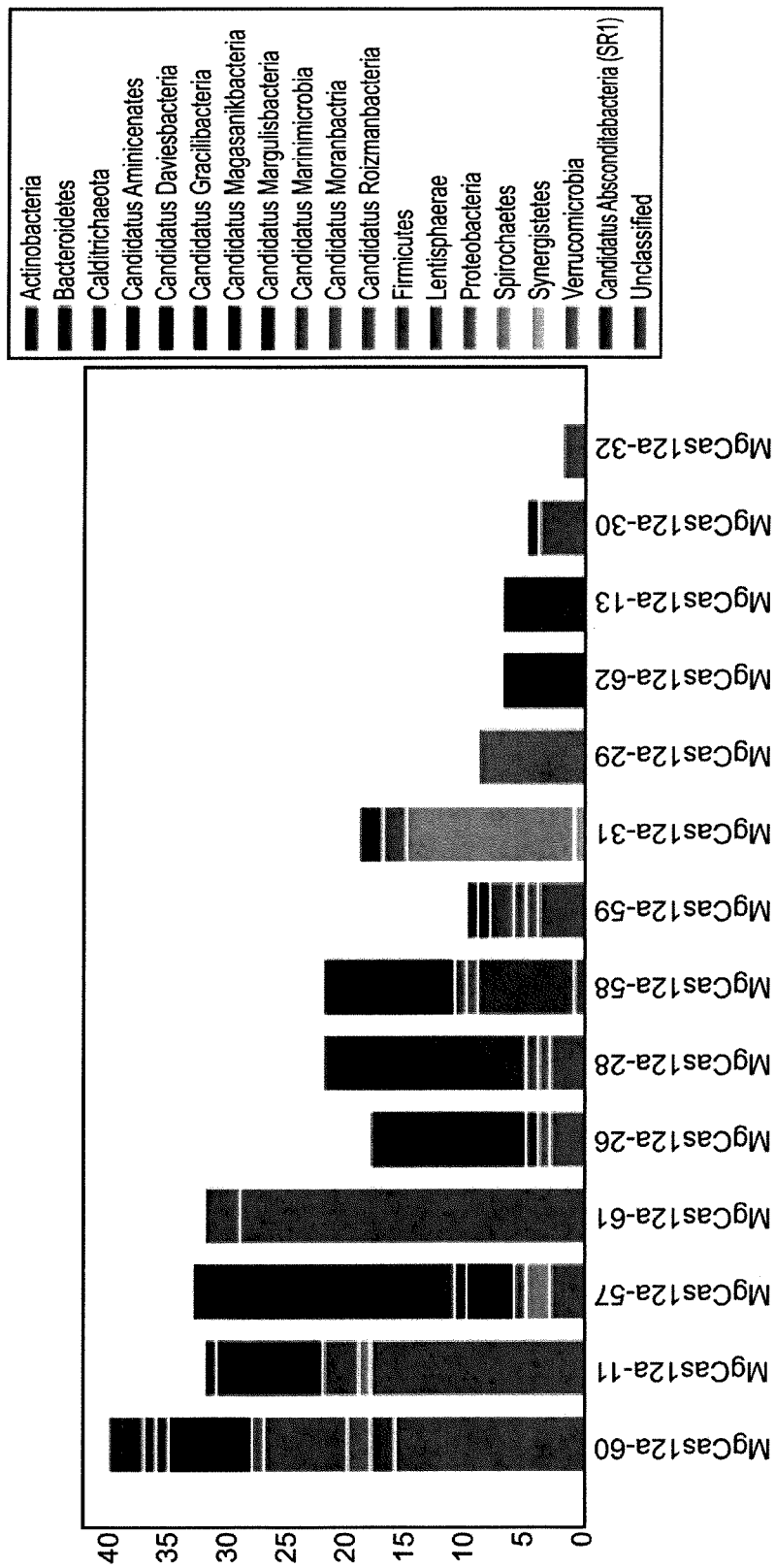
FIG. 4 shows the diversity of CRISPR Type V-A effectors.
FIG. 4A depicts per family distribution of taxonomic classification of contigs encoding the novel Type V-A effectors.
Figures 4, 4B:
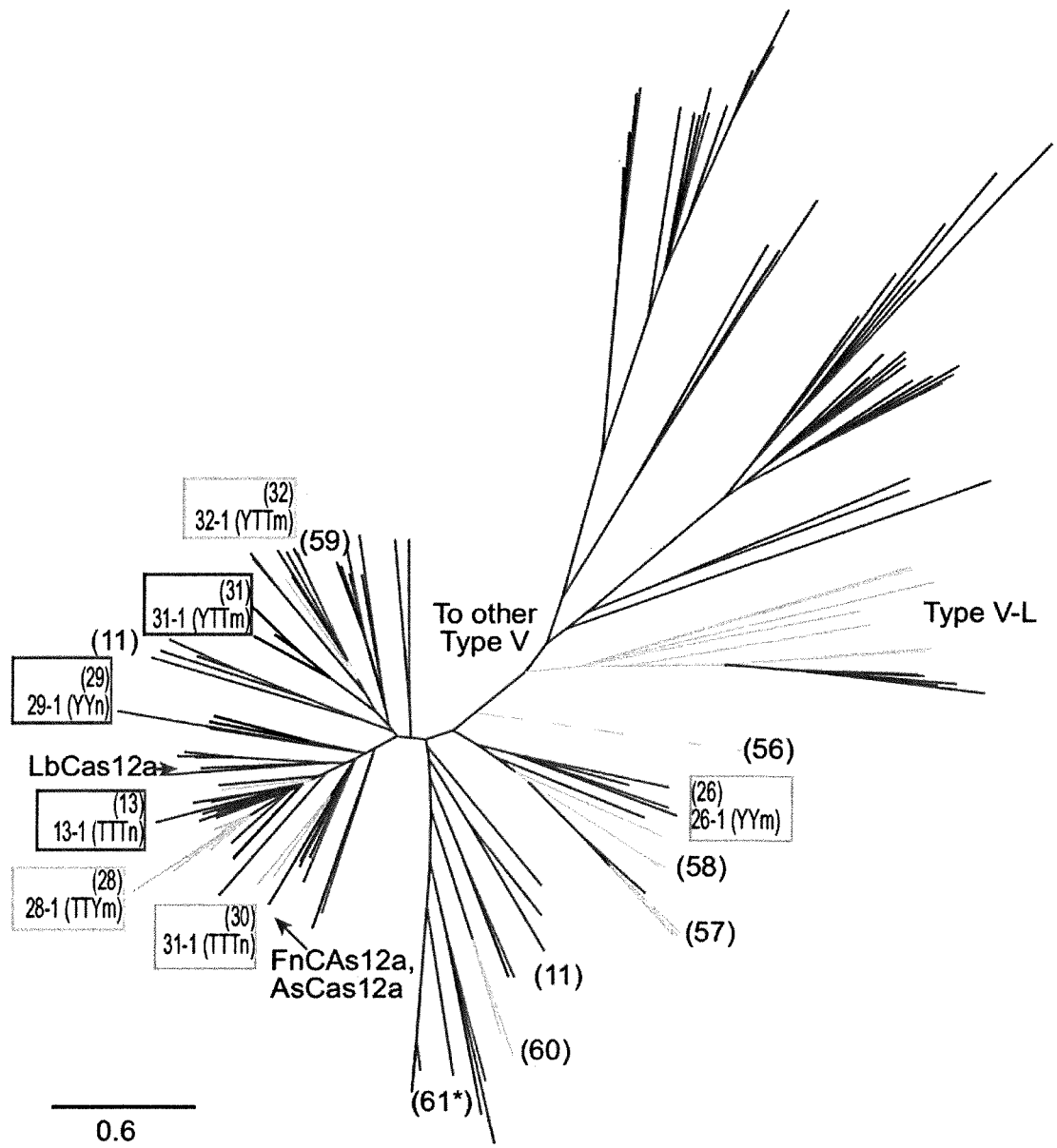
FIG. 4B depicts the phylogenetic gene tree inferred from an alignment of 119 novel and 89 reference Type V effector sequences. MG families are denoted in parentheses. PAM requirements for active nucleases are outlined with boxes associated with the family. Non-Type V-A reference sequences were used to root the tree (*MG61 family requires a crRNA with an alternative stem-loop sequence).

Additional Type V effectors described herein could have evolved from duplications of Type V-A-like nucleases, referred to here as Type V-A prime effectors (V-A') which may be encoded next to Cas12a nucleases. Both Type V-A and these Type V-A' systems may share a CRISPR sgRNA but the Type V-A' systems are divergent from Cas12a (FIG. 4). The CRISPR repeat associated with these prime effectors also folded into single guide crRNA with the UCUAC[$N_{3-5}$]GUAGAU motif. One report identified a Type V cms1 effector encoded next to a Type V-A nuclease, which required a single guide crRNA for cleavage activity in plant cells. Different CRISPR arrays were reported for each effector, while the Type V-A' system described herein suggested that both Type V-A and V-A' may require the same crRNA for DNA targeting and cleavage. As described recently in Roizmanbacterial genomes (see e.g., Chen et al. Front Microbiol. 2019 May 3; 10:928), both Type V-A and V-A' effectors are distantly related based on sequence homology and phylogenetic analysis. Therefore, the prime effectors do not belong within the Type V-A classification, and warrant a separate Type V sub-classification PAMs determined for active Type V-A nucleases were generally thymine-rich, similar to previously described PAMs described for other Type V-A nucleases. In contrast, MG29-1 requires a shorter YYN PAM sequence, which increases target flexibility compared to the four nucleotide TTTV PAM of LbCpf1. Additionally, RNPs containing MG29-1 had higher activity in HEK293 cells compared to sMbCas12a, which has a three-nucleotide PAM.

When testing the novel nucleases for in-vitro editing activity, MG29-1 exhibited comparable or better activity to other reported enzymes of the class. Reports of plasmid transfection editing efficiencies in mammalian cells using Cas12a orthologs indicate between 21% and 26% indel frequencies for guides with T-rich PAMs, and one out of 18 guides with CCN PAMs showed ~10% activity in Mb3Cas12a (*Moraxella bovoculi* AAX11_00205 Cas12a, see e.g. Wang et al. Journal of Cell Science 2020 133: jcs240705). Notably, MG29-1 activity in plasmid transfections appears greater than that reported for Mb3Cas12a for targets with TTN and CCN PAMs (see e.g. FIG. 18). Because the target sites for plasmid transfections have the same TTG PAM on all experiments, the difference in editing efficiency may be attributed to genomic accessibility differences at different target genes. MG29-1 editing as RNP is much more efficient than via plasmid and is more efficient than AsCas12a on two of seven target loci. Therefore, MG29-1 may be a highly active and efficient gene editing nuclease. These findings increase the known diversity of single guide Type V-A CRISPR nucleases, and demonstrate the genome editing potential of novel enzymes from uncultivated microbes. Seven novel nucleases showed in-vitro activity with diverse PAM requirements, and RNP data showed editing efficiency surpassing 80% for therapeutically relevant targets in human cell lines. These novel nucleases expand the toolkit of CRISPR-associated enzymes and enable diverse genome engineering applications.

Example 18—MG29-1 Induced Editing of TRAC Locus in T-Cells

Figure 39:
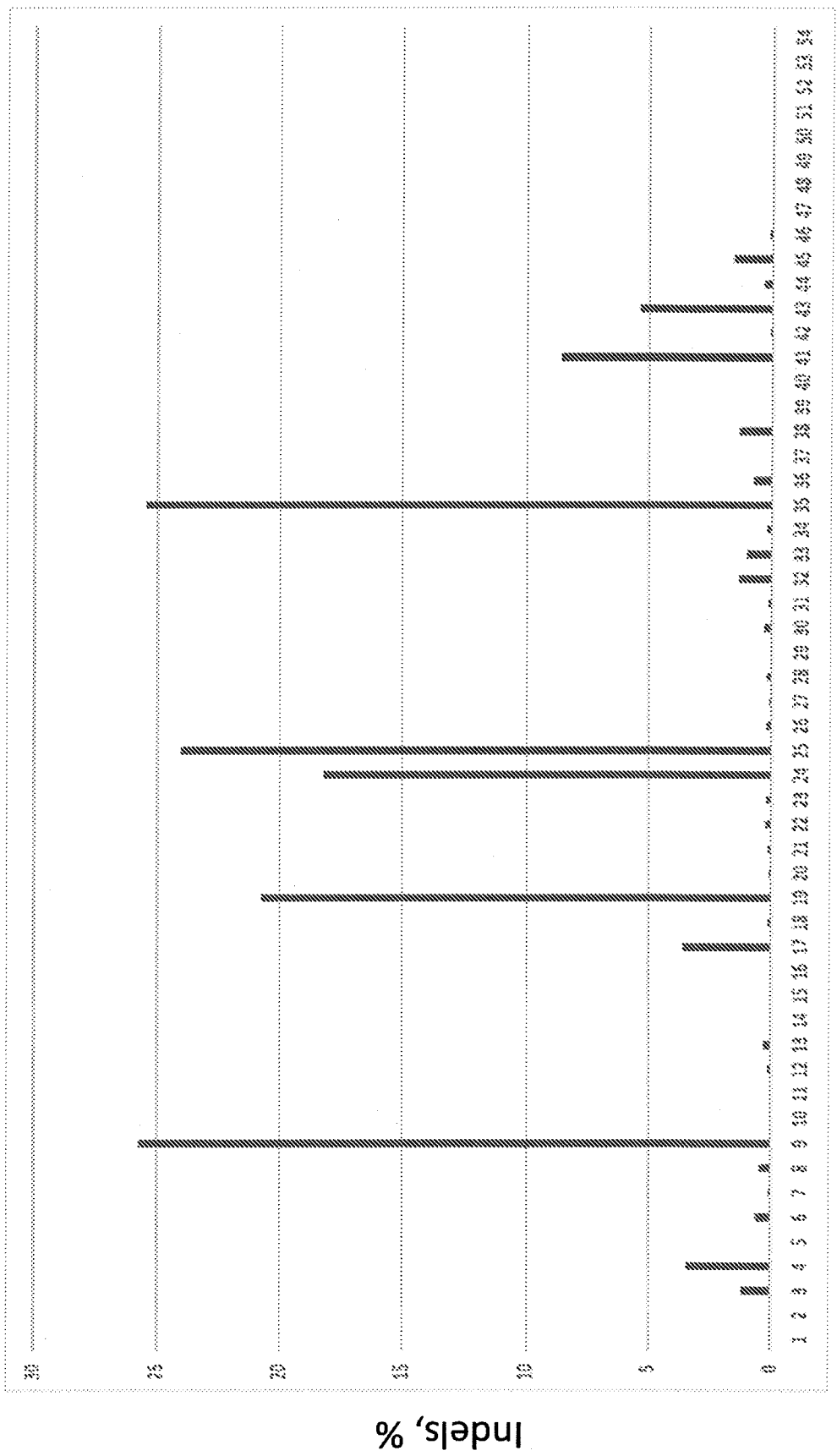
FIG. 39 shows a screen of the TRAC locus for MG29-1 gene editing. A bar graph shows indel creation resulting from transfection of MG29-1 with 54 separate guide RNAs targeting the TRAC locus in primary human T cells. The corresponding guide RNAs depicted in the figure are identified in SEQ ID NOs: 4316-4423.

The three exons of the T cell receptor alpha chain constant region (TRACA) were scanned for sequences matching an initial predicted 5'-TTN-3' PAM preference of MG29-1 and single-guide RNAs with proprietary Alt-R modifications were ordered from IDT. All guide spacer sequences were 22 nt long. Guides (80 pmol) were mixed with purified MG29-1 protein (63 pmol), incubated for 15 minutes at room temperature. T cells were purified from PBMCs by negative selection using (Stemcell Technologies Human T cell Isolation Kit #17951) and activated by CD2/3/28 beads (Miltenyi T cell Activation/Expansion Kit #130-091-441). After four days of cell growth, each MG29-1/guide RNA mixture was electroporated into 200,000 T cells with a Lonza 4-D Nucleofector, using program EO-115 and P3 buffer. The cells were harvested seventy-two hours post-transfection, genomic DNA was isolated, and PCR amplified for analysis using high-throughput DNA sequencing using primers targeting the TRACA locus. The creation of insertions and deletions typical of NHEJ-based gene editing was quantified using a proprietary Python script (see FIG. 39).

TABLE 5A

Guide sequences used in Example 18

| Entity Name | Sequence | SEQ ID NO: |
|---|---|---|
| MG29-1 Guide 1 Target Sequence | ACCGATTTTGATTCTCAAACAA | 4316 |
| MG29-1 Guide 2 Target Sequence | TGATTCTCAAACAAATGTGTCA | 4317 |
| MG29-1 Guide 3 Target Sequence | GATTCTCAAACAAATGTGTCAC | 4318 |
| MG29-1 Guide 4 Target Sequence | ATTCTCAAACAAATGTGTCACA | 4319 |
| MG29-1 Guide 5 Target Sequence | TCAAACAAATGTGTCACAAAGT | 4320 |
| MG29-1 Guide 6 Target Sequence | TGATGTGTATATCACAGACAAA | 4321 |

TABLE 5A-continued

Guide sequences used in Example 18

| Entity Name | Sequence | SEQ ID NO: |
|---|---|---|
| MG29-1 Guide 7 Target Sequence | AAGAGCAACAGTGCTGTGGCCT | 4322 |
| MG29-1 Guide 8 Target Sequence | GCATGTGCAAACGCCTTCAACA | 4323 |
| MG29-1 Guide 9 Target Sequence | CATGTGCAAACGCCTTCAACAA | 4324 |
| MG29-1 Guide 10 Target Sequence | AACAACAGCATTATTCCAGAAG | 4325 |
| MG29-1 Guide 11 Target Sequence | TTCCAGAAGACACCTTCTTCCC | 4326 |
| MG29-1 Guide 12 Target Sequence | CAGAAGACACCTTCTTCCCCAG | 4327 |
| MG29-1 Guide 13 Target Sequence | TGGAATAATGCTGTTGTTGAAG | 4328 |
| MG29-1 Guide 14 Target Sequence | TTGAAGGCGTTTGCACATGCAA | 4329 |
| MG29-1 Guide 15 Target Sequence | AAGGCGTTTGCACATGCAAAGT | 4330 |
| MG29-1 Guide 16 Target Sequence | GCACATGCAAAGTCAGATTTGT | 4331 |
| MG29-1 Guide 17 Target Sequence | CACATGCAAAGTCAGATTTGTT | 4332 |
| MG29-1 Guide 18 Target Sequence | GTTGCTCCAGGCCACAGCACTG | 4333 |
| MG29-1 Guide 19 Target Sequence | TTGCTCCAGGCCACAGCACTGT | 4334 |
| MG29-1 Guide 20 Target Sequence | CTCCAGGCCACAGCACTGTTGC | 4335 |
| MG29-1 Guide 21 Target Sequence | CTCTTGAAGTCCATAGACCTCA | 4336 |
| MG29-1 Guide 22 Target Sequence | AAGTCCATAGACCTCATGTCTA | 4337 |
| MG29-1 Guide 23 Target Sequence | TGTCTGTGATATACACATCAGA | 4338 |
| MG29-1 Guide 24 Target Sequence | GTCTGTGATATACACATCAGAA | 4339 |
| MG29-1 Guide 25 Target Sequence | TCTGTGATATACACATCAGAAT | 4340 |
| MG29-1 Guide 26 Target Sequence | CTTTGTGACACATTTGTTTGAG | 4341 |
| MG29-1 Guide 27 Target Sequence | GTGACACATTTGTTTGAGAATC | 4342 |
| MG29-1 Guide 28 Target Sequence | TGACACATTTGTTTGAGAATCA | 4343 |
| MG29-1 Guide 29 Target Sequence | GTTTGAGAATCAAAATCGGTGA | 4344 |
| MG29-1 Guide 30 Target Sequence | TTTGAGAATCAAAATCGGTGAA | 4345 |

TABLE 5A-continued

Guide sequences used in Example 18

| Entity Name | Sequence | SEQ ID NO: |
|---|---|---|
| MG29-1 Guide 31 Target Sequence | GAGAATCAAAATCGGTGAATAG | 4346 |
| MG29-1 Guide 32 Target Sequence | AGAATCAAAATCGGTGAATAGG | 4347 |
| MG29-1 Guide 33 Target Sequence | TCACTGGATTTAGAGTCTCTCA | 4348 |
| MG29-1 Guide 34 Target Sequence | AGAGTCTCTCAGCTGGTACACG | 4349 |
| MG29-1 Guide 35 Target Sequence | GAGTCTCTCAGCTGGTACACGG | 4350 |
| MG29-1 Guide 36 Target Sequence | CTGTGATGTCAAGCTGGTCGAG | 4351 |
| MG29-1 Guide 37 Target Sequence | CAAAGCTTTTCTCGACCAGCTT | 4352 |
| MG29-1 Guide 38 Target Sequence | AAAGCTTTTCTCGACCAGCTTG | 4353 |
| MG29-1 Guide 39 Target Sequence | TCTCGACCAGCTTGACATCACA | 4354 |
| MG29-1 Guide 40 Target Sequence | CTCGACCAGCTTGACATCACAG | 4355 |
| MG29-1 Guide 41 Target Sequence | TCGACCAGCTTGACATCACAGG | 4356 |
| MG29-1 Guide 42 Target Sequence | CAAAACCTGTCAGTGATTGGGT | 4357 |
| MG29-1 Guide 43 Target Sequence | AAAACCTGTCAGTGATTGGGTT | 4358 |
| MG29-1 Guide 44 Target Sequence | GGTTCCGAATCCTCCTCCTGAA | 4359 |
| MG29-1 Guide 45 Target Sequence | CGAATCCTCCTCCTGAAAGTGG | 4360 |
| MG29-1 Guide 46 Target Sequence | AATCTGCTCATGACGCTGCGGC | 4361 |
| MG29-1 Guide 47 Target Sequence | ATCTGCTCATGACGCTGCGGCT | 4362 |
| MG29-1 Guide 48 Target Sequence | AACCCGGCCACTTTCAGGAGGA | 4363 |
| MG29-1 Guide 49 Target Sequence | CAGGAGGAGGATTCGGAACCCA | 4364 |
| MG29-1 Guide 50 Target Sequence | AGGAGGAGGATTCGGAACCCAA | 4365 |
| MG29-1 Guide 51 Target Sequence | GGAACCCAATCACTGACAGGTT | 4366 |
| MG29-1 Guide 52 Target Sequence | TGAAAGTTTAGGTTCGTATCTG | 4367 |
| MG29-1 Guide 53 Target Sequence | GAAAGTTTAGGTTCGTATCTGT | 4368 |
| MG29-1 Guide 54 Target Sequence | AAAGTTTAGGTTCGTATCTGTA | 4369 |

TABLE 5A-continued

Guide sequences used in Example 18

| Entity Name | Sequence | SEQ ID NO: |
|---|---|---|
| MG29-1 Guide 1 sgRNA synthesized | /AltR1/rUrArArUrUrUrCrUrArCrUrGrUrUrGrUrArGrArUrAr CrCrGrArUrUrUrGrArUrUrCrUrCrArArArCrArA/AltR2/ | 4370 |
| MG29-1 Guide 2 sgRNA synthesized | /AltR1/rUrArArUrUrUrCrUrArCrUrGrUrUrGrUrArGrArUrUr GrArUrUrCrUrCrArArArCrArArArUrGrUrGrUrCrA/AltR2/ | 4371 |
| MG29-1 Guide 3 sgRNA synthesized | /AltR1/rUrArArUrUrUrCrUrArCrUrGrUrUrGrUrArGrArUrGr ArUrCrUrCrArArArCrArArArUrGrUrGrUrCrArC/AltR2/ | 4372 |
| MG29-1 Guide 4 sgRNA synthesized | /AltR1/rUrArArUrUrUrCrUrArCrUrGrUrUrGrUrArGrArUrAr UrUrCrUrCrArArArCrArArArUrGrUrGrUrCrArCrA/AltR2/ | 4373 |
| MG29-1 Guide 5 sgRNA synthesized | /AltR1/rUrArArUrUrUrCrUrArCrUrGrUrUrGrUrArGrArUrUr CrArArArCrArArArUrGrUrGrUrCrArCrArArArGrU/AltR2/ | 4374 |
| MG29-1 Guide 6 sgRNA synthesized | /AltR1/rUrArArUrUrUrCrUrArCrUrGrUrUrGrUrArGrArUrUr GrArUrGrUrGrUrArUrArUrCrArCrArArGrArCrArArA/AltR2/ | 4375 |
| MG29-1 Guide 7 sgRNA synthesized | /AltR1/rUrArArUrUrUrCrUrArCrUrGrUrUrGrUrArGrArUrAr ArGrArGrCrArArCrArGrUrGrCrUrGrUrGrCrCrU/AltR2/ | 4376 |
| MG29-1 Guide 8 sgRNA synthesized | /AltR1/rUrArArUrUrUrCrUrArCrUrGrUrUrGrUrArGrArUrGr CrArUrGrUrGrCrArArArArCrGrCrCrUrUrCrArArCrA/AltR2/ | 4377 |
| MG29-1 Guide 9 sgRNA synthesized | /AltR1/rUrArArUrUrUrCrUrArCrUrGrUrUrGrUrArGrArUrCr ArUrGrUrGrCrArArArCrGrCrCrUrUrCrArArArCrArA/AltR2/ | 4378 |
| MG29-1 Guide 10 sgRNA synthesized | /AltR1/rUrArArUrUrUrCrUrArCrUrGrUrUrGrUrArGrArUrAr ArCrArArCrArGrCrArUrUrArUrUrCrArGrArArG/AltR2/ | 4379 |
| MG29-1 Guide 11 sgRNA synthesized | /AltR1/rUrArArUrUrUrCrUrArCrUrGrUrUrGrUrArGrArUrUr UrCrArGrArArGrArCrArCrCrUrUrCrUrUrCrC/AltR2/ | 4380 |
| MG29-1 Guide 12 sgRNA synthesized | /AltR1/rUrArArUrUrUrCrUrArCrUrGrUrUrGrUrArGrArUrCr ArGrArArGrArCrArCrCrUrUrCrUrUrCrCrCrArG/AllR2/ | 4381 |
| MG29-1 Guide 13 sgRNA synthesized | /AltR1/rUrArArUrUrUrCrUrArCrUrGrUrUrGrUrArGrArUrUr GrGrArArUrArArUrGrCrUrGrUrUrGrUrUrGrArG/AltR2/ | 4382 |
| MG29-1 Guide 14 sgRNA synthesized | /AltR1/rUrArArUrUrUrCrUrArCrUrGrUrUrGrUrArGrArUrUr UrGrArArGrGrCrGrUrUrUrGrCrArCrArUrGrCrArA/AltR2/ | 4383 |
| MG29-1 Guide 15 sgRNA synthesized | /AltR1/rUrArArUrUrUrCrUrArCrUrGrUrUrGrUrArGrArUrAr ArGrGrCrGrUrUrUrGrCrArCrArUrGrCrArArArGrU/AltR2/ | 4384 |
| MG29-1 Guide 16 sgRNA synthesized | /AltR1/rUrArArUrUrUrCrUrArCrUrGrUrUrGrUrArGrArUrGr CrArCrArUrGrCrArArArArGrUrCrArGrrArUrUrUrGrU/AllR2/ | 4385 |
| MG29-1 Guide 17 sgRNA synthesized | /AltR1/rUrArArUrUrUrCrUrArCrUrGrUrUrGrUrArGrArUrCr ArCrArUrGrCrArArArArGrUrCrArGrrArUrUrUrGrUrU/AHR2/ | 4386 |
| MG29-1 Guide 18 sgRNA synthesized | /AltR1/rUrArArUrUrUrCrUrArCrUrGrUrUrGrUrArGrArUrGr UrUrGrCrUrCrArGrGrCrCrArCrArGrCrArCrUrG/AltR2/ | 4387 |
| MG29-1 Guide 19 sgRNA synthesized | /AltR1/rUrArArUrUrUrCrUrArCrUrGrUrUrGrUrArGrArUrUr UrGrCrUrCrCrArGrGrCrCrArCrArGrCrArCrUrGrU/AltR2/ | 4388 |
| MG29-1 Guide 20 sgRNA synthesized | /AltR1/rUrArArUrUrUrCrUrArCrUrGrUrUrGrUrArGrArUrCr UrCrCrArGrGrCrCrArCrArGrCrArCrUrGrUrUrGrC/AltR2/ | 4389 |
| MG29-1 Guide 21 sgRNA synthesized | /AltR1/rUrArArUrUrUrCrUrArCrUrGrUrUrGrUrArGrArUrCr UrCrUrUrGrArArGrUrCrCrArUrArGrArCrCrUrCrA/AltR2/ | 4390 |
| MG29-1 Guide 22 sgRNA synthesized | /AltR1/rUrArArUrUrUrCrUrArCrUrGrUrUrGrUrArGrArUrAr ArGrUrCrCrArUrArGrArCrCrUrCrArUrGrUrCrUrA/AltR2/ | 4391 |
| MG29-1 Guide 23 sgRNA synthesized | /AltR1/rUrArArUrUrUrCrUrArCrUrGrUrUrGrUrArGrArUrUr GrUrCrUrGrUrGrArUrArUrArCrArCrArUrCrArGrA/AltR2/ | 4392 |
| MG29-1 Guide 24 sgRNA synthesized | /AltR1/rUrArArUrUrUrCrUrArCrUrGrUrUrGrUrArGrArUrGr UrCrUrGrUrGrArUrArUrArCrArCrArUrCrArGrArA/AltR2/ | 4393 |

TABLE 5A-continued

Guide sequences used in Example 18

| Entity Name | Sequence | SEQ ID NO: |
|---|---|---|
| MG29-1 Guide 25 sgRNA synthesized | /AltR1/rUrArArUrUrUrCrUrArCrUrGrUrUrGrUrArGrArUrUr CrUrGrUrGrArUrArUrArCrArCrArUrCrArGrArArU/AltR2/ | 4394 |
| MG29-1 Guide 26 sgRNA synthesized | /AltR1/rUrArArUrUrUrCrUrArCrUrGrUrUrGrUrArGrArUrCr UrUrGrUrGrArCrArCrArUrUrUrGrUrUrUrGrArG/AltR2/ | 4395 |
| MG29-1 Guide 27 sgRNA synthesized | /AltR1/rUrArArUrUrUrCrUrArCrUrGrUrUrGrUrArGrArUrGr UrGrArCrArCrArUrUrGrUrUrUrGrArGrArArUrC/AltR2/ | 4396 |
| MG29-1 Guide 28 sgRNA synthesized | /AltR1/rUrArArUrUrUrCrUrArCrUrGrUrUrGrUrArGrArUrUr GrArCrArCrArUrUrUrGrUrUrGrArGrArArUrCrA/AltR2/ | 4397 |
| MG29-1 Guide 29 sgRNA synthesized | /AltR1/rUrArArUrUrUrCrUrArCrUrGrUrUrGrUrArGrArUrGr UrUrGrArGrArArUrCrArArArArUrCrGrGrUrGrA/AltR2/ | 4398 |
| MG29-1 Guide 30 sgRNA synthesized | /AltR1/rUrArArUrUrUrCrUrArCrUrGrUrUrGrUrArGrArUrUr UrUrGrArGrArArUrCrArArArArUrCrGrGrUrGrA/AltR2/ | 4399 |
| MG29-1 Guide 31 sgRNA synthesized | /AltR1/rUrArArUrUrUrCrUrArCrUrGrUrUrGrUrArGrArUrGr ArGrArArUrCrArArArArUrCrGrGrUrGrArArUrArG/AltR2/ | 4400 |
| MG29-1 Guide 32 sgRNA synthesized | /AltR1/rUrArArUrUrUrCrUrArCrUrGrUrUrGrUrArGrArUrAr GrArArUrCrArArArArUrCrGrGrUrGrArArUrArGrG/AltR2/ | 4401 |
| MG29-1 Guide 33 sgRNA synthesized | /AltR1/rUrArArUrUrUrCrUrArCrUrGrUrUrGrUrArGrArUrUr CrArCrUrGrGrArUrUrUrArGrArGrUrCrUrCrUrCrA/AltR2/ | 4402 |
| MG29-1 Guide 34 sgRNA synthesized | /AltR1/rUrArArUrUrUrCrUrArCrUrGrUrUrGrUrArGrArUrAr GrArGrUrCrUrCrUrCrArGrCrUrGrGrUrArCrArCrG/AltR2/ | 4403 |
| MG29-1 Guide 35 sgRNA synthesized | /AltR1/rUrArArUrUrUrCrUrArCrUrGrUrUrGrUrArGrArUrGr ArGrUrCrUrCrUrCrArGrCrUrGrGrUrArCrArCrGrG/AltR2/ | 4404 |
| MG29-1 Guide 36 sgRNA synthesized | /AltR1/rUrArArUrUrUrCrUrArCrUrGrUrUrGrUrArGrArUrCr UrGrUrGrArUrGrUrCrArArGrCrUrGrGrUrCrGrArG/AltR2/ | 4405 |
| MG29-1 Guide 37 sgRNA synthesized | /AltR1/rUrArArUrUrUrCrUrArCrUrGrUrUrGrUrArGrArUrCr ArArArGrCrUrUrUrUrCrUrCrGrArCrrCrArGrCrUrU/AltR2/ | 4406 |
| MG29-1 Guide 38 sgRNA synthesized | /AltR1/rUrArArUrUrUrCrUrArCrUrGrUrUrGrUrArGrArUrAr ArArGrCrUrUrUrUrCrUrCrGrArCrCrArGrCrUrUrG/AltR2/ | 4407 |
| MG29-1 Guide 39 sgRNA synthesized | /AltR1/rUrArArUrUrUrCrUrArCrUrGrUrUrGrUrArGrArUrUr CrUrCrGrArCrArGrCrUrUrGrArCrArUrCrArCrArA/AltR2/ | 4408 |
| MG29-1 Guide 40 sgRNA synthesized | /AltR1/rUrArArUrUrUrCrUrArCrUrGrUrUrGrUrArGrArUrCr UrCrGrArCrCrArGrCrUrUrGrArCrArUrCrArCrArG/AltR2/ | 4409 |
| MG29-1 Guide 41 sgRNA synthesized | /AltR1/rUrArArUrUrUrCrUrArCrUrGrUrUrGrUrArGrArUrUr CrGrArCrCrArGrCrUrUrGrArCrArUrCrArCrArGrG/AltR2/ | 4410 |
| MG29-1 Guide 42 sgRNA synthesized | /AltR1/rUrArArUrUrUrCrUrArCrUrGrUrUrGrUrArGrArUrCr ArArArArCrCrUrGrUrUrCrArGrUrGrGrArUrUrGrGrU/AltR2/ | 4411 |
| MG29-1 Guide 43 sgRNA synthesized | /AltR1/rUrArArUrUrUrCrUrArCrUrGrUrUrGrUrArGrArUrAr ArArArCrCrUrGrUrUrCrArGrUrGrGrArUrUrGrGrU/AltR2/ | 4412 |
| MG29-1 Guide 44 sgRNA synthesized | /AltR1/rUrArArUrUrUrCrUrArCrUrGrUrUrGrUrArGrArUrGr UrUrCrCrGrArArUrCrCrUrCrrCrUrCrCrUrGrArA/AltR2/ | 4413 |
| MG29-1 Guide 45 sgRNA synthesized | /AltR1/rUrArArUrUrUrCrUrArCrUrGrUrUrGrUrArGrArUrCr GrArArUrCrCrUrCrrCrUrCrUrGrArArArArGrUrGrG/AltR2/ | 4414 |
| MG29-1 Guide 46 sgRNA synthesized | /AltR1/rUrArArUrUrUrCrUrArCrUrGrUrUrGrUrArGrArUrAr ArUrCrUrGrCrUrCrArUrGrArCrGrCrUrGrCrGrGrC/AltR2/ | 4415 |
| MG29-1 Guide 47 sgRNA synthesized | /AltR1/rUrArArUrUrUrCrUrArCrUrGrUrUrGrUrArGrArUrAr UrCrUrGrCrUrCrArUrGrArCrGrCrUrGrCrGrGrCrU/AltR2/ | 4416 |
| MG29-1 Guide 48 sgRNA synthesized | /AltR1/rUrArArUrUrUrCrUrArCrUrGrUrUrGrUrArGrArUrAr ArCrCrCrGrGrCrCrrCrArCrUrUrUrCrArGrGrArGrGrA/AltR2/ | 4417 |

TABLE 5A-continued

Guide sequences used in Example 18

| Entity Name | Sequence | SEQ ID NO: |
|---|---|---|
| MG29-1 Guide 49 sgRNA synthesized | /AltR1/rUrArArUrUrUrCrUrArCrUrGrUrUrGrUrArGrArUrCr ArGrGrArGrArGrGrArUrUrCrGrGrArArCrCrCrA/AltR2/ | 4418 |
| MG29-1 Guide 50 sgRNA synthesized | /AltR1/rUrArArUrUrUrCrUrArCrUrGrUrUrGrUrArGrArUrAr GrGrArGrGrArGrGrArUrUrCrGrGrArArCrCrCrArA/AltR2/ | 4419 |
| MG29-1 Guide 51 sgRNA synthesized | /AltR1/rUrArArUrUrUrCrUrArCrUrGrUrUrGrUrArGrArUrGr GrArArCrCrCrArArUrCrArCrUrGrGrArCrArGrGrUrU/AltR2/ | 4420 |
| MG29-1 Guide 52 sgRNA synthesized | GrArArArGrUrUrUrArGrGrUrUrCrGrUrArUrCrUrG/AltR2/ | 4421 |
| MG29-1 Guide 53 sgRNA synthesized | /AltR1/rUrArArUrUrUrCrUrArCrUrGrUrUrGrUrArGrArUrGr ArArArGrUrUrUrArGrGrUrUrCrGrUrArUrCrUrGrU/AltR2/ | 4422 |
| MG29-1 Guide 54 sgRNA synthesized | /AltR1/rUrArArUrUrUrCrUrArCrUrGrUrUrGrUrArGrArUrAr ArArGrUrUrUrArGrGrUrUrCrGrUrArUrCrUrGrUrA/AltR2/ | 4423 |

Example 19—Re-Testing of Lead Guides of MG29-1

Figure 40:
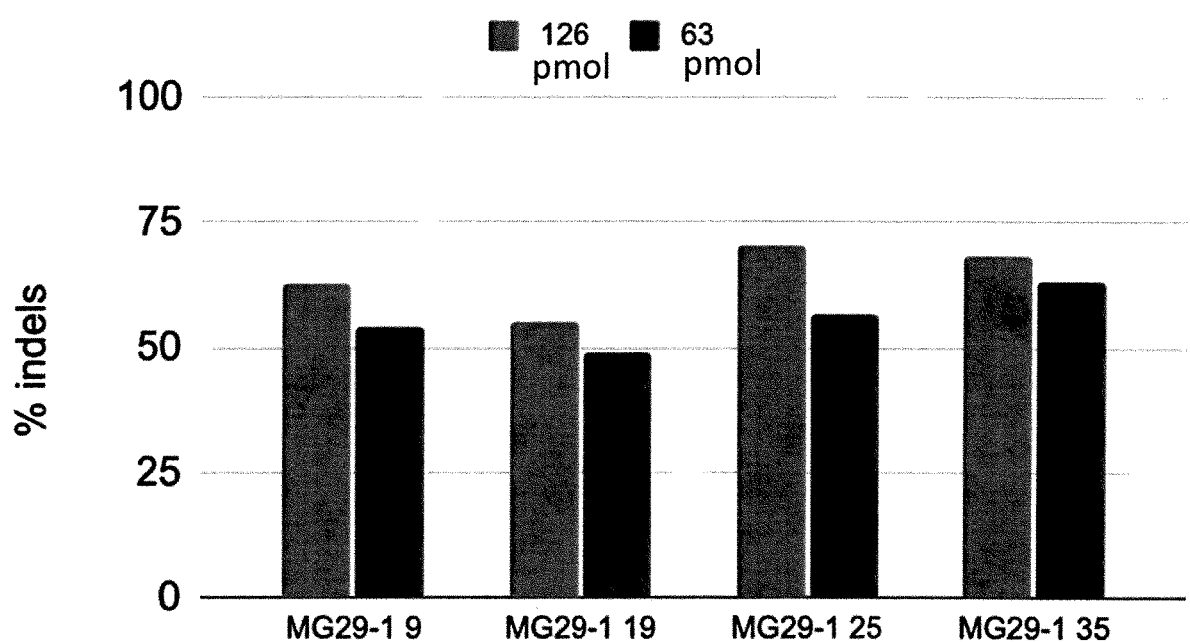
FIG. 40 depicts the optimization of MG29-1 editing at TRAC. A bar graph shows indel creation resulting from transfection of MG29-1 (at the indicated concentrations) with the four best 22 nt guide RNAs from the experiment shown in the figure above (9, 19, 25, and 35), Legend: MG29-1 9 is MG29-1 effector (SEQ ID NO: 215) and Guide 9 (SEQ ID NO: 4378), MG29-1 19 is MG29-1 effector (SEQ ID NO: 215) and Guide 19 (SEQ ID NO: 4388), MG29-1 25 is MG29-1 effector (SEQ ID NO: 215) and Guide 25 (SEQ ID NO: 4394), and MG29-1 35 is MG29-1 effector (SEQ ID NO: 215) and Guide 35 (SEQ ID NO: 4404).

An experiment retesting the lead guides for MG29-1 was performed. The three exons of the T cell receptor alpha chain constant region were scanned for sequences matching 5'-TTN-3' and single-guide RNAs ordered from IDT using Alt-R modifications. All guide spacer sequences 22 nt long. Guides were mixed with purified MG29-1 protein (80 pmol gRNA+63 pmol MG29-1; or 160 pmol gRNA with 126 pmol MG29-1), incubated for 15 minutes at room temperature. T cells were purified from PBMCs by negative selection using (Stemcell Technologies Human T cell Isolation Kit #17951) and activated by CD2/3/28 beads (Miltenyi T cell Activation/Expansion Kit #130-091-441). After four days of cell growth, each MG29-1/guide RNA mixture was electroporated into 200,000 T cells with a Lonza 4-D Nucleofector, using program EO-115 and P3 buffer. Seventy-two hours post-transfection, genomic DNA was harvested, and PCR amplified for analysis using high-throughput DNA sequencing. The creation of insertions and deletions typical of NHEJ-based gene editing was quantified using a proprietary Python script (see FIG. 40).

Example 20—Testing Length of Guide Spacer for MG29-1

An experiment was performed to determine the optimal guide spacer length. The three exons of the T cell receptor alpha chain constant region were scanned for sequences matching 5'-TTN-3' and single-guide RNAs ordered from IDT using Alt-R modifications. Guides were mixed with purified MG29-1 protein (80 pmol gRNA+60 pmol effector; 160 pmol gRNA+120 pmol effector; or 320 pmol gRNA+ 240 pmol effector), incubated for 15 minutes at room temperature. T cells were purified from PBMCs by negative selection using (Stemcell Technologies Human T cell Isolation Kit #17951) and activated by CD2/3/28 beads (Miltenyi T cell Activation/Expansion Kit #130-091-441). After four days of cell growth, each MG29-1/guide RNA mixture was electroporated into 200,000 T cells with a Lonza 4-D Nucleofector, using program EO-115 and P3 buffer. Seventy-two hours post-transfection, genomic DNA was harvested, and PCR amplified for analysis using high-throughput DNA sequencing. The creation of insertions and deletions typical of NHEJ-based gene editing was quantified using a proprietary Python script. The results are shown in FIG. 41, which demonstrates that guide spacer lengths of 20-24 nt work well, with a dropoff at 19 nt.

Example 21—Determination of MG29-1 Indel Generation Versus TCR Expression

Figure 41:
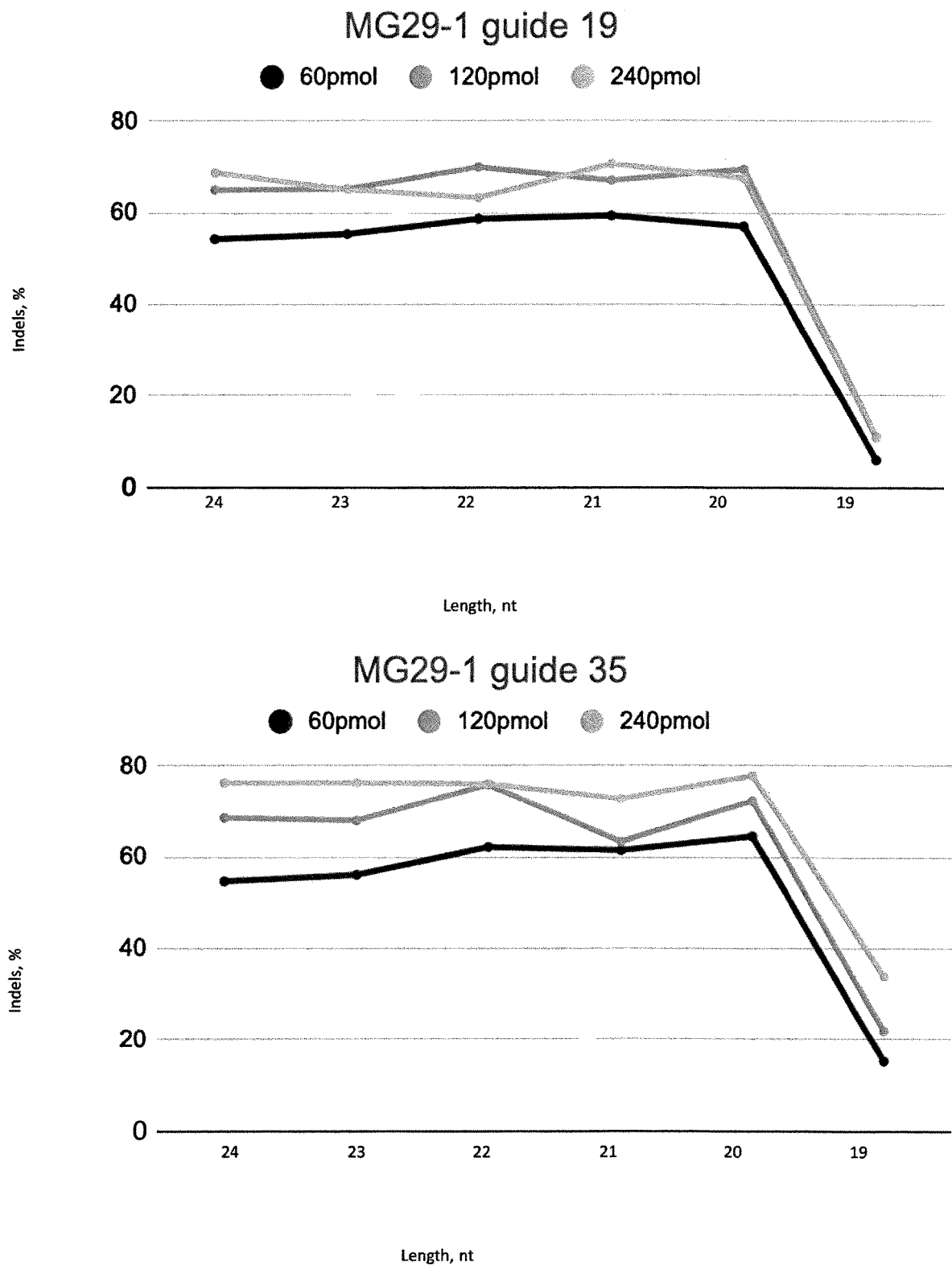
FIG. 41 depicts the optimization of dose and guide length for MG29-1 editing at TRAC. Line graphs show the indel creation resulting from transfection of MG29-1 and either guide RNA #19 (SEQ ID NO: 4388) or guide RNA #35 (SEQ ID NO: 4404). Three different doses of nuclease/guide RNA were used. For each dose, six different guide lengths were tested, successive one-nucleotide 3' truncations of SEQ ID NOs: 4388 and 4404. The guides used in FIG. 39 and FIG. 40 are the 22nt-long spacer-containing guides in this case.

Cells from FIG. 41 were analyzed for TCR expression by flow cytometry using the APC-labeled anti-human TCRα/β Ab (Biolegend #306718, clone IP26) and an Attune NxT flow cytometer (Thermo Fisher). Indel data are taken from FIG. 41.

Example 22—Targeted CAR Integration with MG29-1

Figure 42:
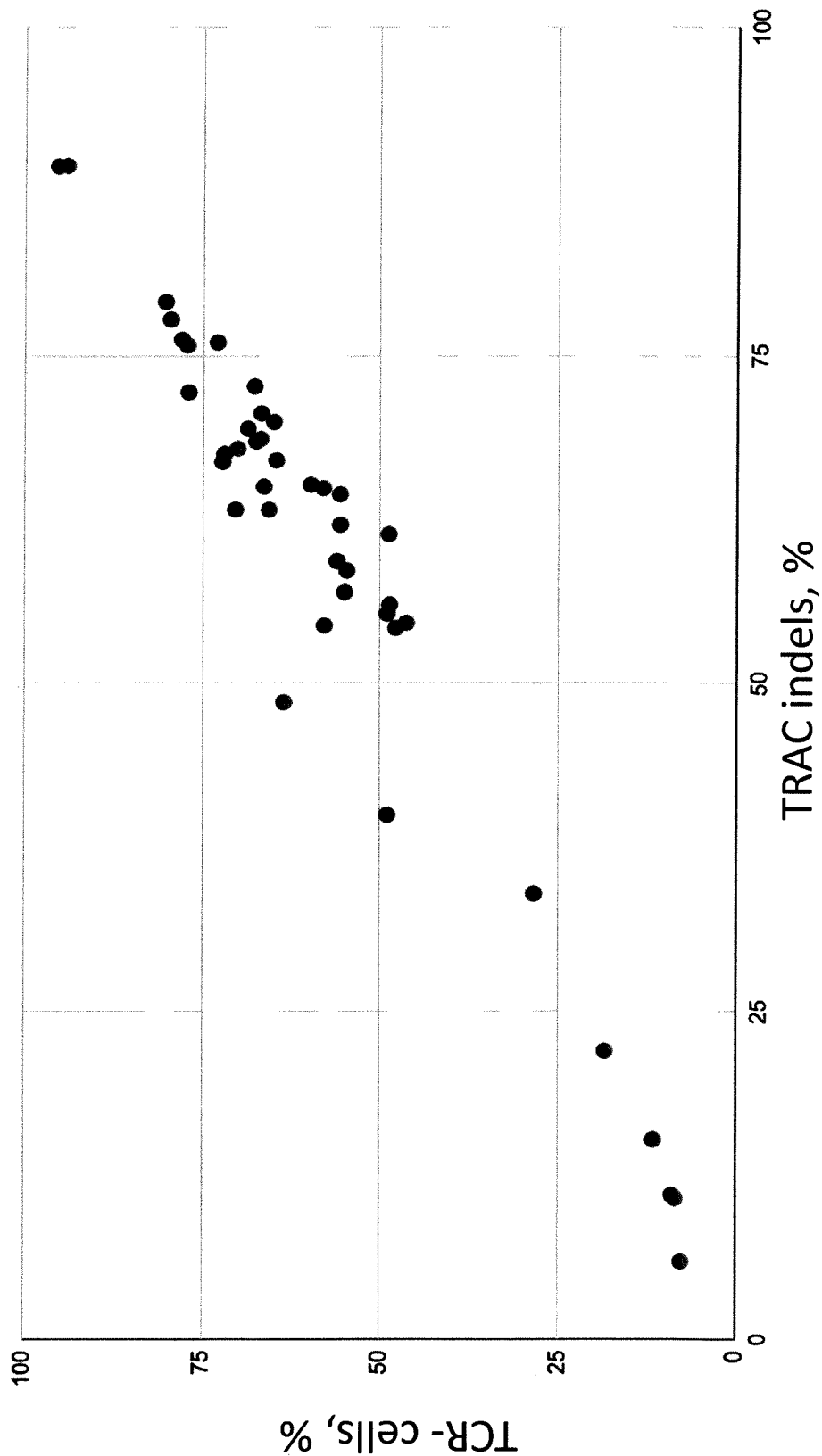
FIG. 42 shows a correlation of indel generation at TRAC and loss of the T cell receptor expression in the Experiment of Example 22.
Figure 43:
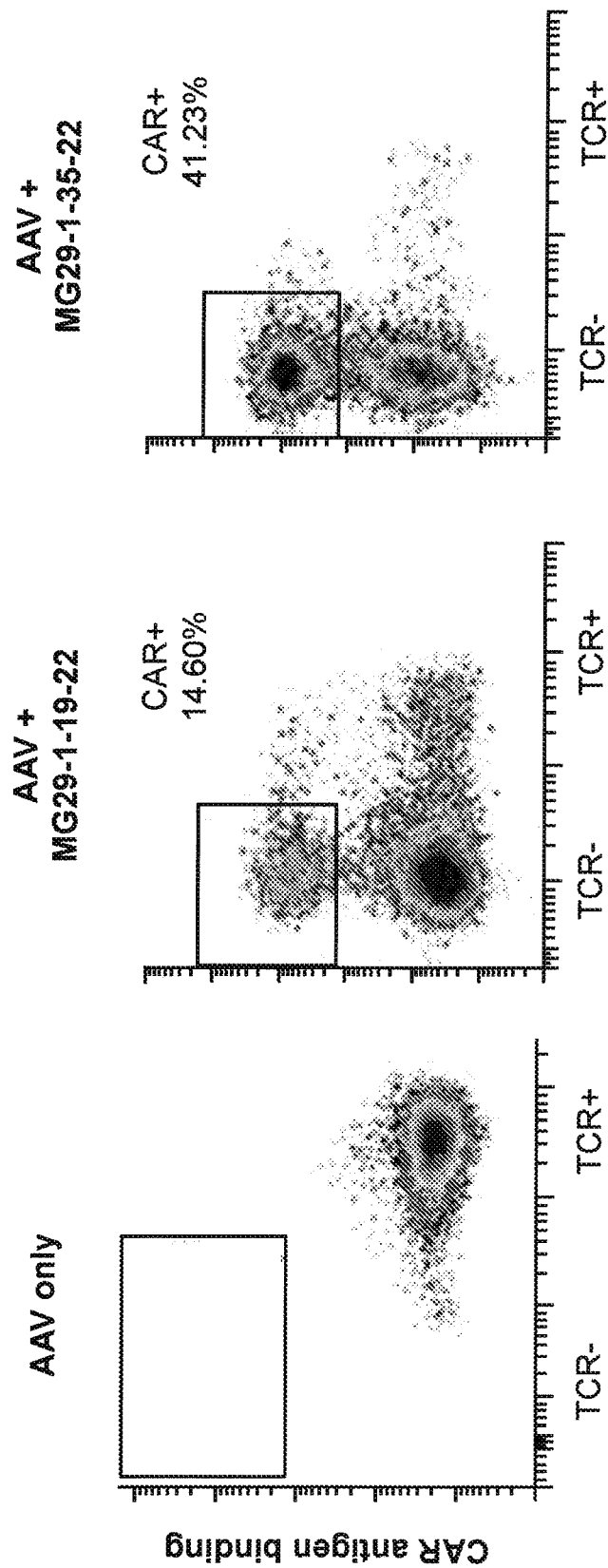
FIG. 43 depicts targeted transgene integration at TRAC stimulated by MG29-1 cleavage. Cells receiving only the transgene donor by AAV infection retain TCR expression and lack CAR expression; cells transfected with MG29-1 RNPs and infected with 100,000 vg (vector genomes) of a CAR transgene donor lose TCR expression and gain CAR expression. Shown are FACS plots of CAR antigen binding vs TCR expression for cells transfected with only AAV containing the CAR-T-containing donor sequence ("AAV"); AAV containing the CAR-T-containing donor sequence with MG29-1 enzyme and sgRNA 19 (SEQ ID NO: 4388) ("AAV+MG29-1-19-22" comprising a 22 nucleotide spacer), or AAV containing the CAR-T-containing donor sequence with MG29-1 enzyme and sgRNA 35 (SEQ ID NO: 4404) ("AAV+MG29-1-35-22" comprising a 22 nucleotide spacer).
Figure 44:
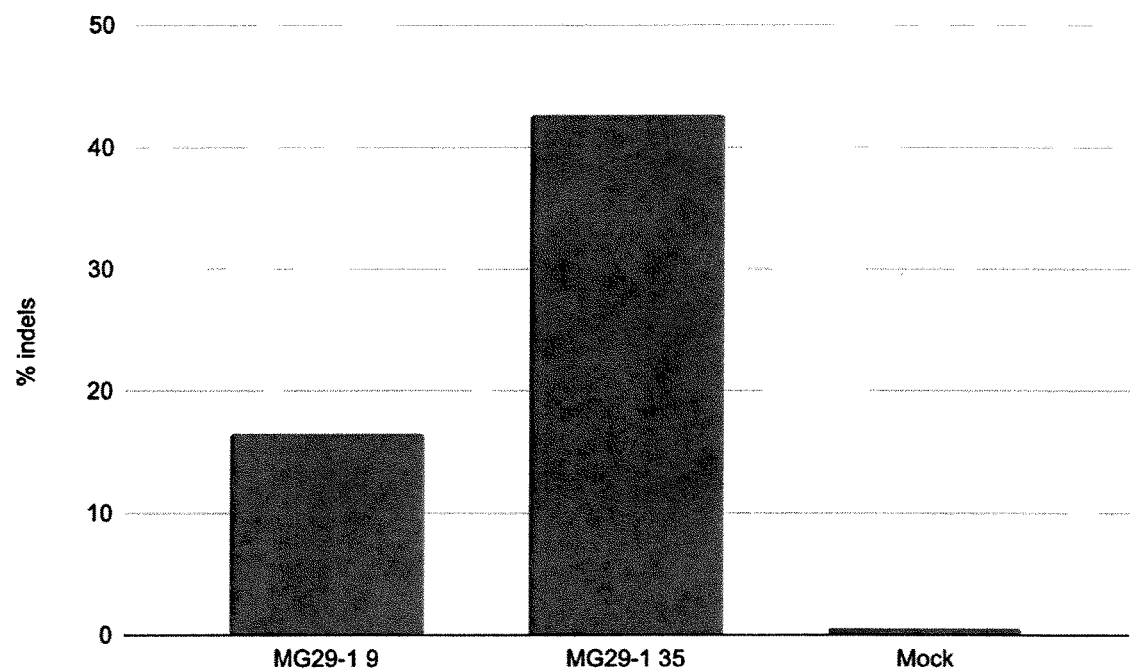
FIG. 44 shows MG29-1 gene editing at TRAC in hematopoietic stem cells. A bar graph shows the extent of indel creation at TRAC after transfection with MG29-1-9-22 ("MG29-1 9"; MG29-1 plus guide RNA #19) and MG29-1-35-22 ("MG29-1 35"; MG29-1 plus guide RNA #35) compared to mock-transfected cells.

The three exons of the T cell receptor alpha chain constant region were scanned for sequences matching 5'-TTN-3' and single-guide RNAs ordered from IDT using IDT's proprietary Alt-R modifications. Guides (80 pmol) were mixed with purified MG29-1 protein (63 pmol), incubated for 15 minutes at room temperature. T cells were purified from PBMCs by negative selection using (Stemcell Technologies Human T cell Isolation Kit #17951) and activated by CD2/ 3/28 beads (Miltenyi T cell Activation/Expansion Kit #130-091-441). After four days of cell growth, each MG29-1/ guide RNA mixture was electroporated into 200,000 T cells with a Lonza 4-D Nucleofector, using program EO-115 and P3 buffer. 100,000 vector genomes of a serotype 6 adeno-associated virus (AAV-6) containing the coding sequence for a customized chimeric antigen receptor flanked by 5' and 3' homology arms (5' arm SEQ ID NO: 4424 being about 500 nt in length and 3' arm SEQ ID NO: 4425 being about 500 nt in length) targeting the TRAC gene were added to the cells immediately following transfection. Replicates were analyzed for TCR expression versus TRAC indels (FIG. 42), showing that indels in the TRAC gene correlated with loss of expression of TCR. Cells were also analyzed by flow cytometry simultaneously for TCR expression as in Example 21 (FIG. 42) and for binding of the target antigen to the CAR (FIG. 43, in which the plots are gated on single, live cells). The results of the flow analysis in FIG. 43 indicated that while the guide RNAs alone were effective in eliminating TCR expression ("RNP only"), addition of guide RNA plus AAV resulted in a new population of cells binding the CAR antigen (top left of plots "AAV+MG29-1-19-22" and "AAV+MG29-1-35-22"). The sgRNA 35 (SEQ ID NO: 4404) was somewhat more effective in inducing integration of the CAR than sgRNA 19 (SEQ ID NO: 4388). One possible explanation for the difference is that the predicted nuclease cut site for Guide 19 is ~160 bp away from the end of the right homology arm.

TABLE 5B

Guide RNAs used in Example 22

| Entity Name | Sequence | SEQ ID NO: |
|---|---|---|
| MG29-1 TRAC Guide 19 Target-binding Sequence | TTGCTCCAGGCCACAGCACTGT | 4334 |
| MG29-1 TRAC Guide 19 full sgRNA synthesized | /AltR1/rUrArArUrUrUrCrUrArCrUrGrUrUrGrUrArGrArUrUr UrGrCrUrCrCrArGrGrCrCrArCrArGrCrArCrUrGrU/AltR2/ | 4388 |
| MG29-1 TRAC Guide 35 Target-binding Sequence | GAGTCTCTCAGCTGGTACACGG | 4350 |
| MG29-1 TRAC Guide 35 full sgRNA synthesized | /AltR1/rUrArArUrUrUrCrUrArCrUrGrUrUrGrUrArGrArUrGr ArGrUrCrUrCrUrCrArGrCrUrGrGrUrArCrArCrGrG/AltR2/ | 4404 |

/AltR1/ and /AltR2/ refer to IDT's proprietary Alt-R 5' and 3' modifications; m; 2'-O-methyl base (for example an A base with 2'-O-methyl modification is written as mA), i2F; internal 2'-flourine base (for example an internal C with 2'-flourine modification is written as /i2FC/), 52F; 2'-flourine base at the 5' end of the sequence (for example a 5' C with 2'-flourine modification is written as /52FC/), 32F; 2'-flourine base at the 3' end of the sequence (for example a 3' A base with 2'-flourine modification is written as /32FA/), r; native RNA linkage comprising the sugar ribose (for example the ribose or RNA form of the A base is written rA), d; deoxyribose sugar (DNA) linkage (for example a deoxyribose form of the A base is written dA), *; between bases in which one of the oxygen molecules in the phosphodiester bond is replaced with sulfur Example 23—MG29-1 TRAC Editing in HSCs Hematopoietic stem cells were purchased from Allcells and thawed per the supplier's instructions, washed in DMEM+10% FBS, and resuspended in Stemspan II medium plus CC110 cytokines. One million cells were cultured for 72 hours in a 6-well dish in 4 mL medium. MG29-1 RNPs were made, transfected, and gene editing analyzed as in Example 18 except for use of the EO-100 nucleofection program. The results are shown in FIG. 56, which shows gene editing at TRAC in hematopoietic stem cells using the #19 (SEQ ID NO:4388) and #35 (SEQ ID NO: 4404) sgRNAs in Table 5B below. The results again indicate that the #35 sgRNA is highly effective at targeting the TRAC locus.

TABLE 5C

Guide RNAs used in Example 23

| Entity Name | Sequence | SEQ ID NO: |
|---|---|---|
| MG29-1 TRAC Guide 19 Target-binding Sequence | TTGCTCCAGGCCACAGCACTGT | 4334 |
| MG29-1 TRAC Guide 19 full sgRNA synthesized | /AltR1/rUrArArUrUrUrCrUrArCrUrGrUrUrGrUrArGrArUrUr UrGrCrUrCrCrArGrGrCrCrArCrArGrCrArCrUrGrU/AltR2/ | 4388 |
| MG29-1 TRAC Guide 35 Target-binding Sequence | GAGTCTCTCAGCTGGTACACGG | 4350 |

TABLE 5C-continued

Guide RNAs used in Example 23

| Entity Name | Sequence | SEQ ID NO: |
|---|---|---|
| MG29-1 TRAC Guide 35 full sgRNA synthesized | /AltR1/rUrArArUrUrUrCrUrArCrUrGrUrUrGrUrArGrArUrGr ArGrUrCrUrCrUrCrArGrCrUrGrGrUrArCrArCrGrG/AltR2/ | 4404 |

/AltR1/ and /AltR2/ refer to IDT's proprietary Alt-R 5' and 3' modifications; m; 2'-O-methyl base (for example an A base with 2'-O-methyl modification is written as mA), i2F; internal 2'-flourine base (for example an internal C with 2'-flourine modification is written as /i2FC/), 52F; 2'-flourine base at the 5' end of the sequence (for example a 5' C with 2'-flourine modification is written as /52FC/), 32F; 2'-flourine base at the 3' end of the sequence (for example a 3' A base with 2'-flourine modification is written as /32FA/), r; native RNA linkage comprising the sugar ribose (for example the ribose or RNA form of the A base is written rA), d; deoxyribose sugar (DNA) linkage (for example a deoxyribose form of the A base is written dA), *; between bases in which one of the oxygen molecules in the phosphodiester bond is replaced with sulfur

Example 24—Further Analysis of PAM Specificity Associated with MG29-1

Figure 45:
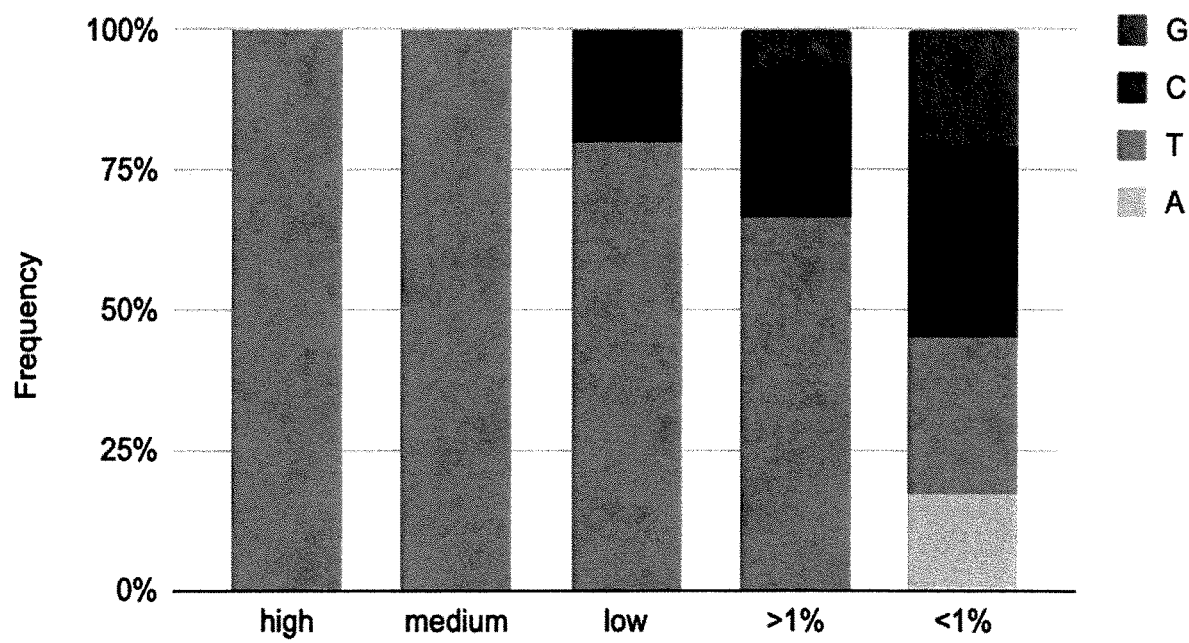
FIG. 45 shows the refinement of the MG29-1 PAM based on analysis of gene editing outcomes in cells. Guide RNAs were designed using a 5'-NTTN-3' PAM sequence and then sorted according to the gene editing activity observed. The identity of the underlined base (the 5'-proximal N) is shown for each bin. All of the guides with activity greater than 10% had a T at this position in the genomic DNA indicating that the MG29-1 PAM may be best described as 5'-TTTN-3'. The statistical significance of the over-representation of T at this position is shown for each bin.

Further analysis was performed to determine more precisely the PAM specificity of MG29-1. Guide RNAs were designed using a 5'-NTTN-3' PAM sequence and then sorted according to the gene editing activity observed (FIG. 45, in which the identity of the underlined base—the 5'-proximal N is shown for each bin). All of the guides with activity greater than 10% had a T at this position in the genomic DNA indicating that the MG29-1 PAM may be better described as 5'-TTTN-3'. The statistical significance of the over-representation of T at this position is shown for each bin. In FIG. 45, the various bins (High, medium, low, >1%, <1%) signify:

High: >50% indels (N=4)
Medium: 10-50% indels (N=15)
Low: 5-10% indels (N=5)
>1%: 1-5% indels (N=12)
<1% (N=82)

TABLE 6 p-values for nucleotide specificity analysis in Example 24

| | chi^2 p-value |
|---|---|
| high/med | 0.000005 |
| low | 0.035110 |

TABLE 6-continued p-values for nucleotide specificity analysis in Example 24

| | chi^2 p-value |
|---|---|
| >1% | 0.005416 |
| <1% | 0.126751 |

Figure 46:
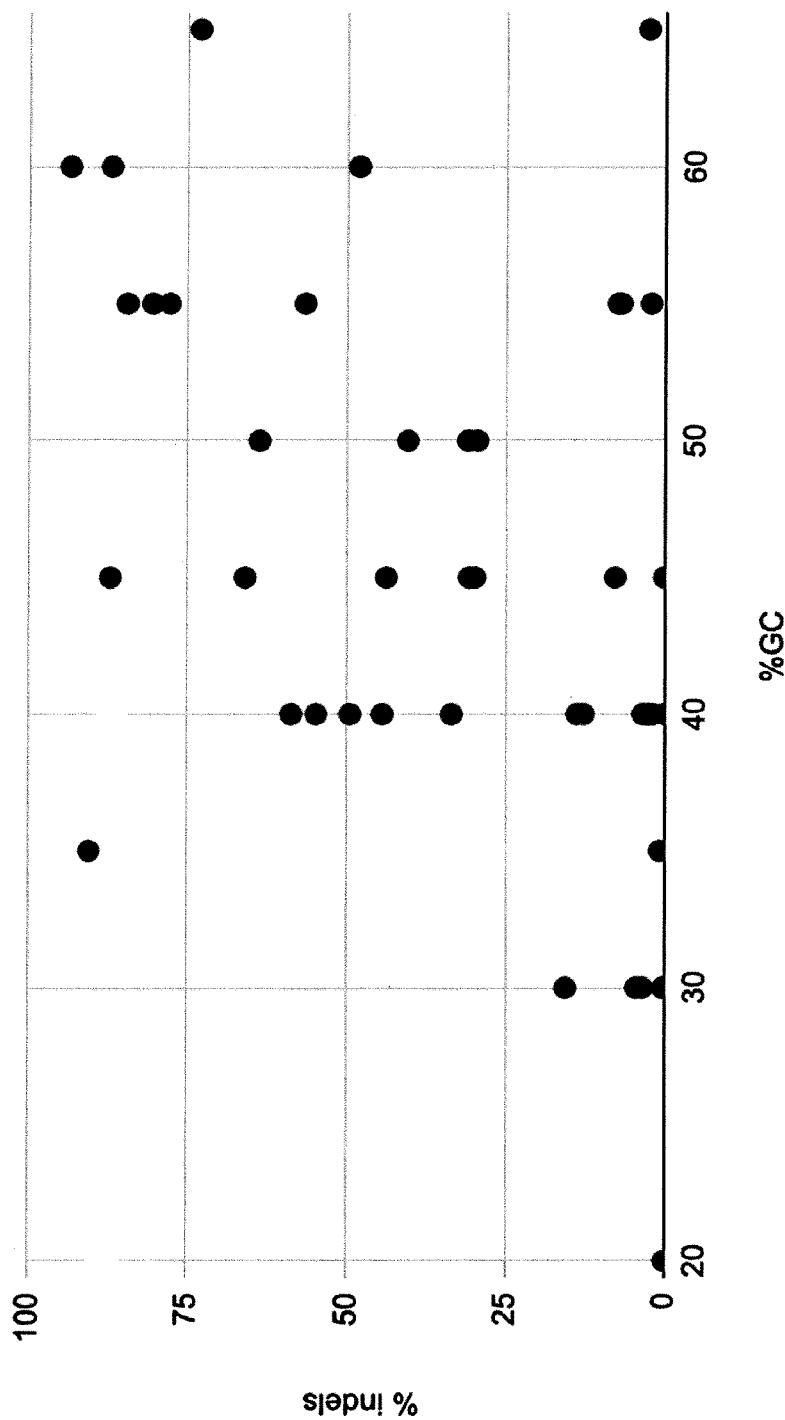
FIG. 46 depicts the analysis of gene editing activity versus the base composition of MG29-1 spacer sequences. A bar graph shows experimental data illustrating a relationship between GC content (%) and indel frequency ("high" signifies >50% indels (N=4); "medium" signifies 10-50% indels (N=15); ">1%" signifies 1-5% indels (N=12); "<1%" signifies less than 1% indels (N=82)).
Figure 46:
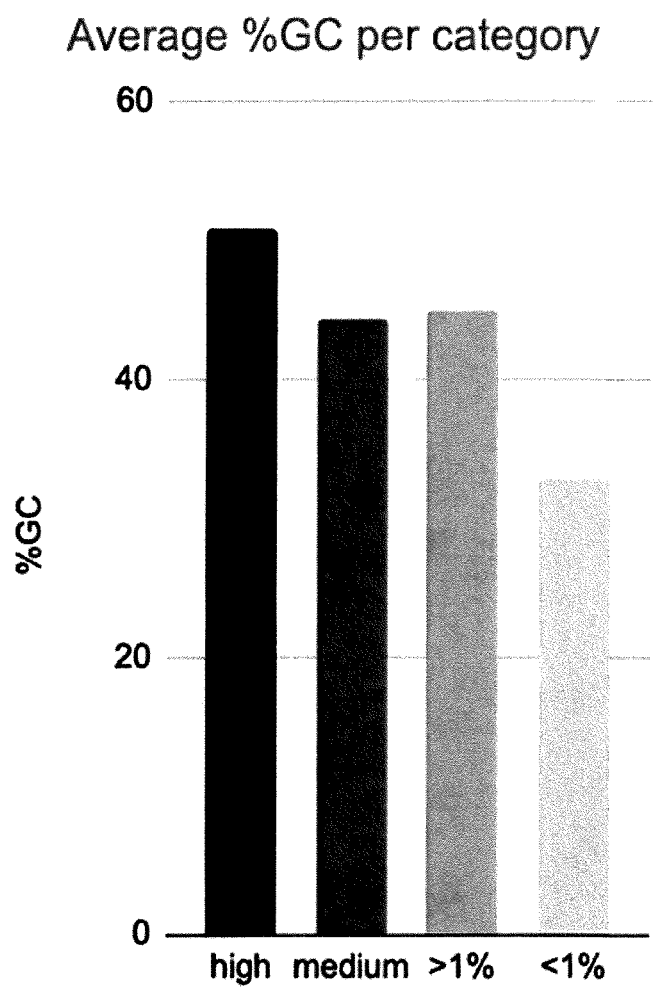

Example 25— Determining MG29-1 Indel Induction Ability Vs Spacer Base Composition Further analysis was conducted of gene editing activity versus the base composition of MG29-1 spacer sequences. The correlation was modest ($R^2=0.23$) but there is a trend towards better activity with higher GC content (see FIG. 46, in which correlation between indels induced in cultured cells versus GC content of spacer sequences is presented as a dot plot).

Example 26—MG29-1 Guide Chemistry Modifications

Figure 47:
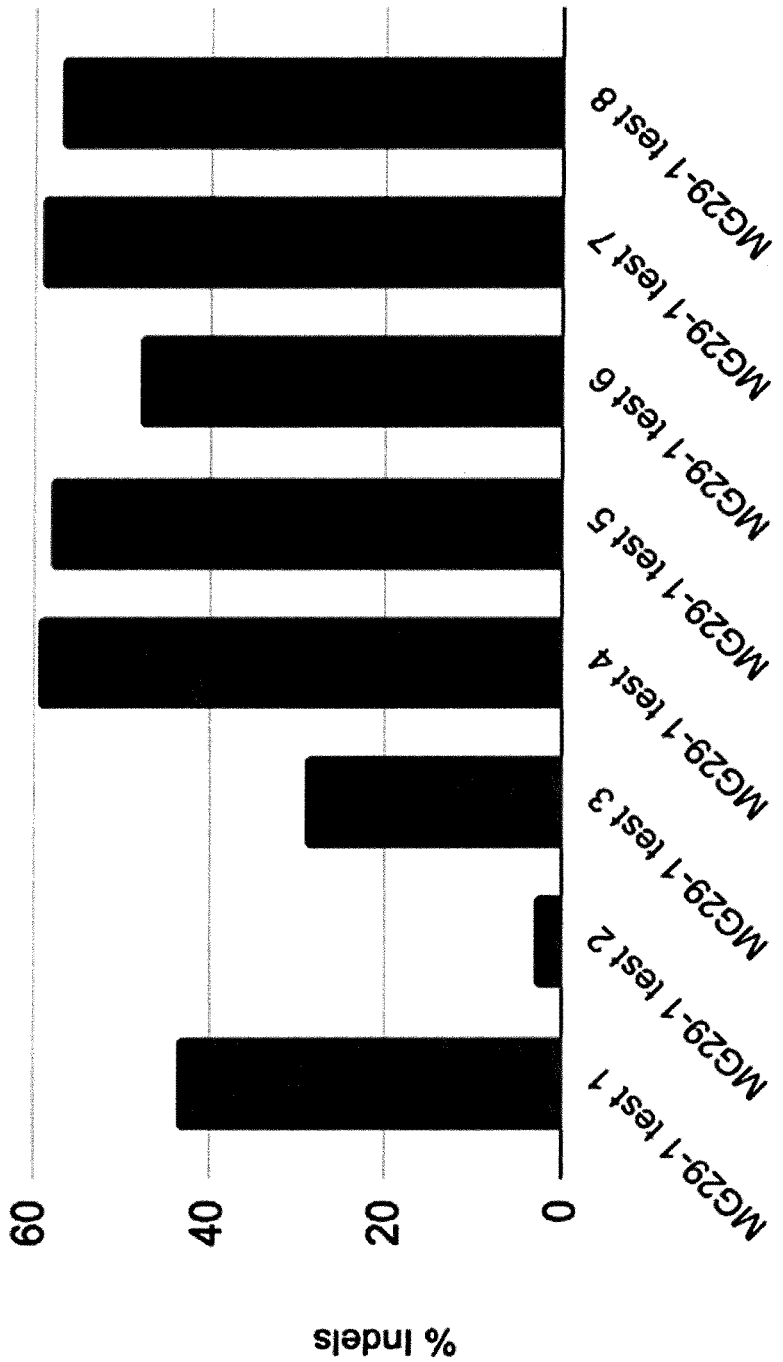
FIG. 47 depicts MG29-1 guide RNA chemical modifications. The bar graph shows the consequences of modifications from Table 7 on VEGF-A editing activity relative to an unmodified guide RNA (sample #1).

An experiment to optimize chemical modifications for targeting of the VEGF-A locus using MG29-1 was performed, using the procedure of Example 18 but with the indicated guide RNAs targeting VEGF-A (see Table 7 below). The experiment used 126 pmol MG29-1 and 160 pmol guide RNA. The results are presented in FIG. 47. Guides #4, 5, 6, 7, and 8 showed improved activity versus the unmodified guide #1, indicating that the corresponding modifications in these sequences improved the activity of these guide RNAs versus an unmodified RNA sequence.

TABLE 7

MG29-1 guide modifications

| MG29-1 Test No. | MG29-1 guide with targeting sequence in bold and modifications per legend below | SEQ ID NO: |
|---|---|---|
| 1 | UAAUUUCUACUCUUGUAGAUGAAAGGGGGTGGGGGGAGTTTGCT | 3985 |
| 2 | mu*mA*mA*UUUCUACUCUUGUAGAUGAAAGGGGTGGGGGGAGTTT*mG*mC*mT | 3986 |
| 3 | mu*mA*AUUUCUACUCUUGUAGAUGAAAGGGGTGGGGGGAGTTT*mG*mC*mT | 3987 |
| 4 | mu*AAUUUCUACUCUUGUAGAUGAAAGGGGTGGGGGGAGTTT*mG*mC*mT | 3988 |
| 5 | mu*AAUUUCUACUCUUGUAGAUGAAAGGGGTGGGGGGAGTTTGC*mT | 3989 |
| 6 | mc*UAAUUUCUACUCUUGUAGAUGAAAGGGGTGGGGGGAGTTT*mG*mC*mT | 3990 |

TABLE 7-continued

MG29-1 guide modifications

| MG29-1 Test No. | MG29-1 guide with targeting sequence in bold and modifications per legend below | SEQ ID NO: |
|---|---|---|
| 7 | mc*u*AAUUUCUACUCUUGUAGAUGAAAGGGGGTGGGGGGAGTTTG\*C*mT | 3991 |
| 8 | /AltR1/UAAUUUCUACUCUUGUAGAUGAAAGGGGGTGGGGGGAGTTTGCT/AltR2/ | 3992 |

Legend: /AltR1/ and /AltR2/ refer to IDT's proprietary Alt-R 5' and 3' modifications; m; 2'-O-methyl base (for example a base with 2'-O-methyl modification is written as mA), i2F; internal 2'-flourine base (for example an internal C with 2'-flourine modification is written as /i2FC/), 52F; 2'-flourine base at the 5' end of the sequence (for example a 5' C with 2'-flourine modification is written as /52FC/), 32F; 2'-flourine base at the 3' end of the sequence (for example a 3' A base with 2'-flourine modification is written as /32FA/), r; native RNA linkage comprising the sugar ribose (fro example the ribose or RNA form of the A base is written rA), d; deoxyribose sugar (DNA) linkage (for example a deoxyribose form of the A base is written dA), *; between bases in which one of the oxygen molecules in the phosphodiester bond is replaced with sulfur Example 27—Titration of Modified MG29-1 Guides from Example 26

Figure 48:
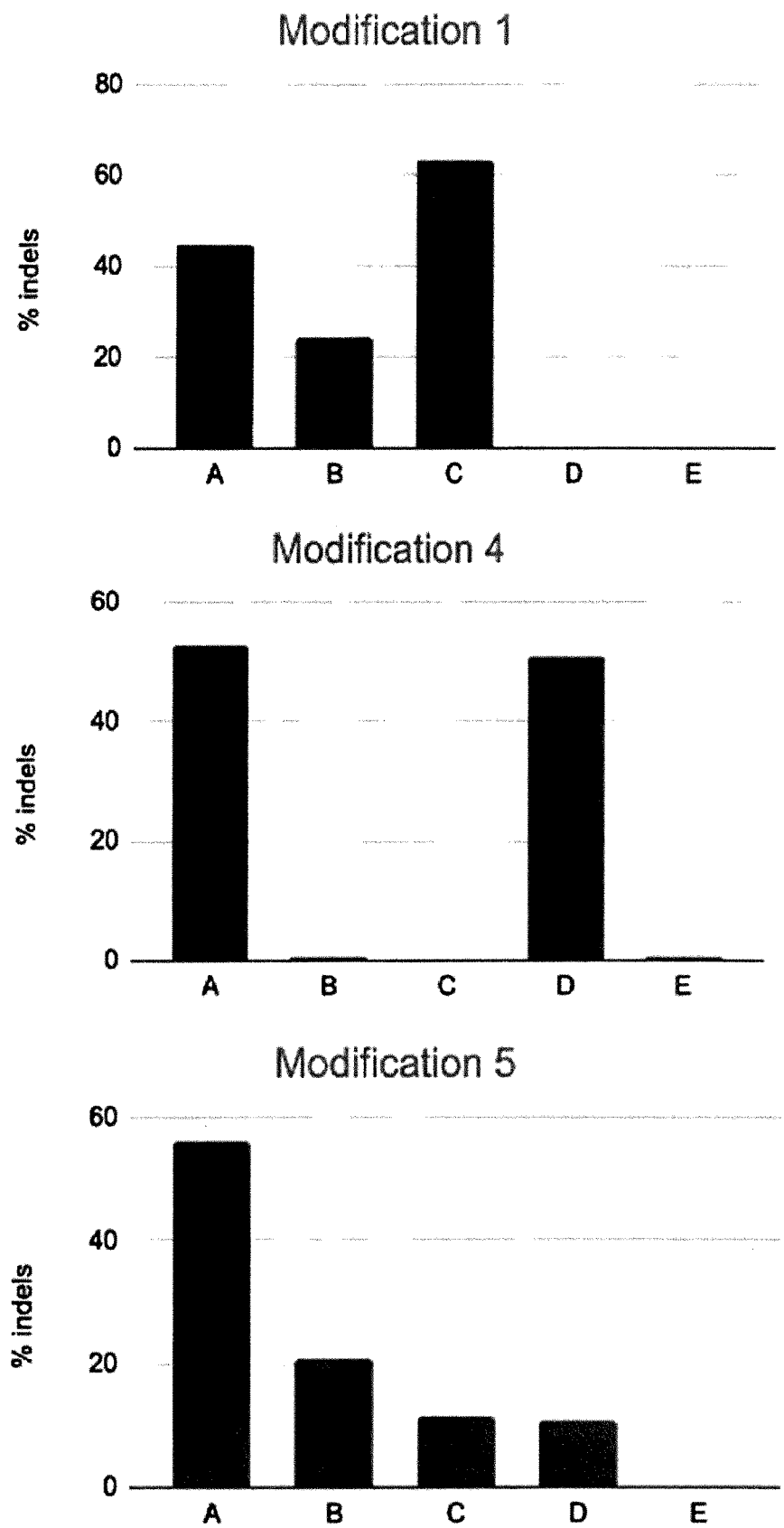
FIG. 48 depicts a dose titration of a variously chemically modified MG29-1 RNA. The bar graphs show indel generation after transfection of RNPs with guides using modification patterns 1, 4, 5, 7, and 8. RNPs doses were 126 pmol MG29-1 and 160 pmol guide RNA or as indicated. Full dose (A), ¼th (B), ⅛th (C), 1/16th (D), and 1/32nd (E).
Figure 48:
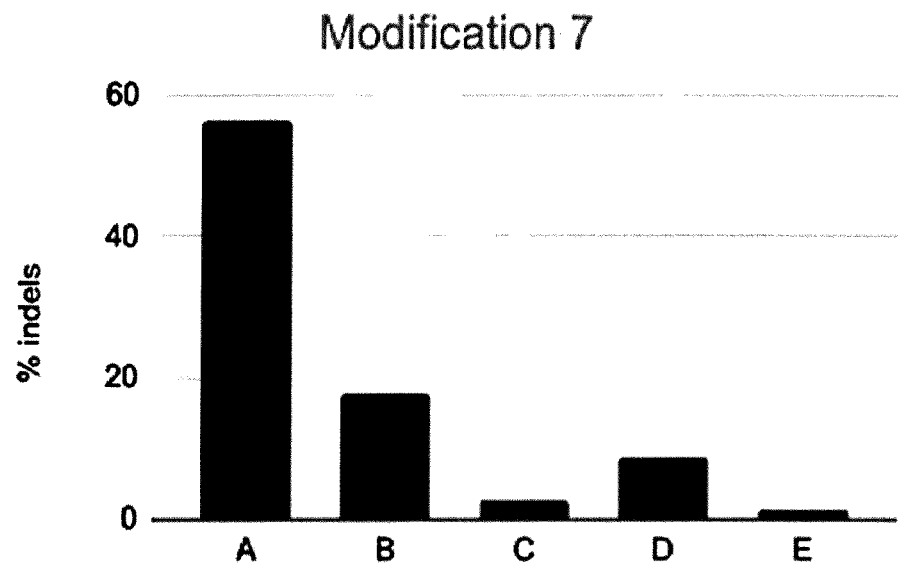
Figure 48:
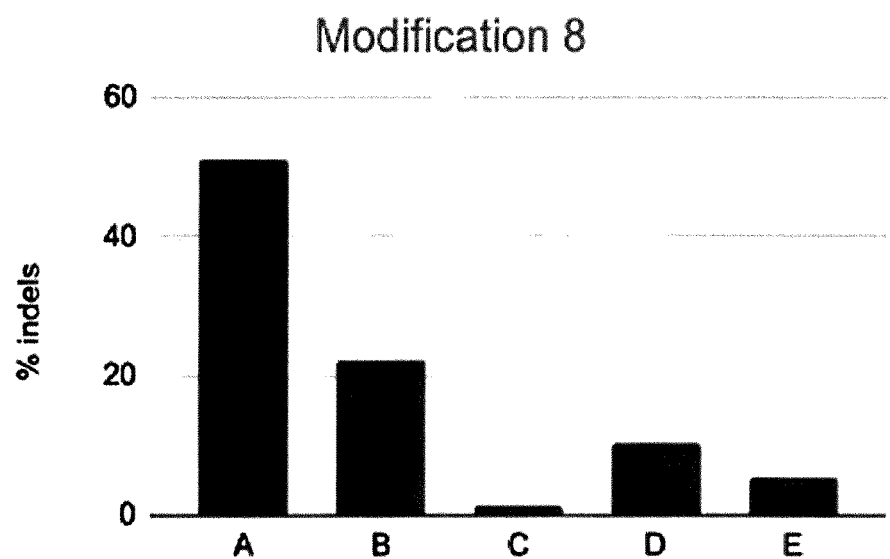

A further experiment was performed to determine the dose dependence of the activity of the modified guides used in Example 26 to identify possible dose-dependent toxicity effects. The experiment was performed as in Example 26 but with ¼th (B), ⅛th (C), ¹⁄₁₆th (D), and ¹⁄₃₂nd (E) of the starting dose (A, 126 pmol MG29-1 and 160 pmol guide RNA). The results are presented in FIG. 48).

Example 28—Large Scale Synthesis of Nucleases Described Herein Project Overview

Figure 49:
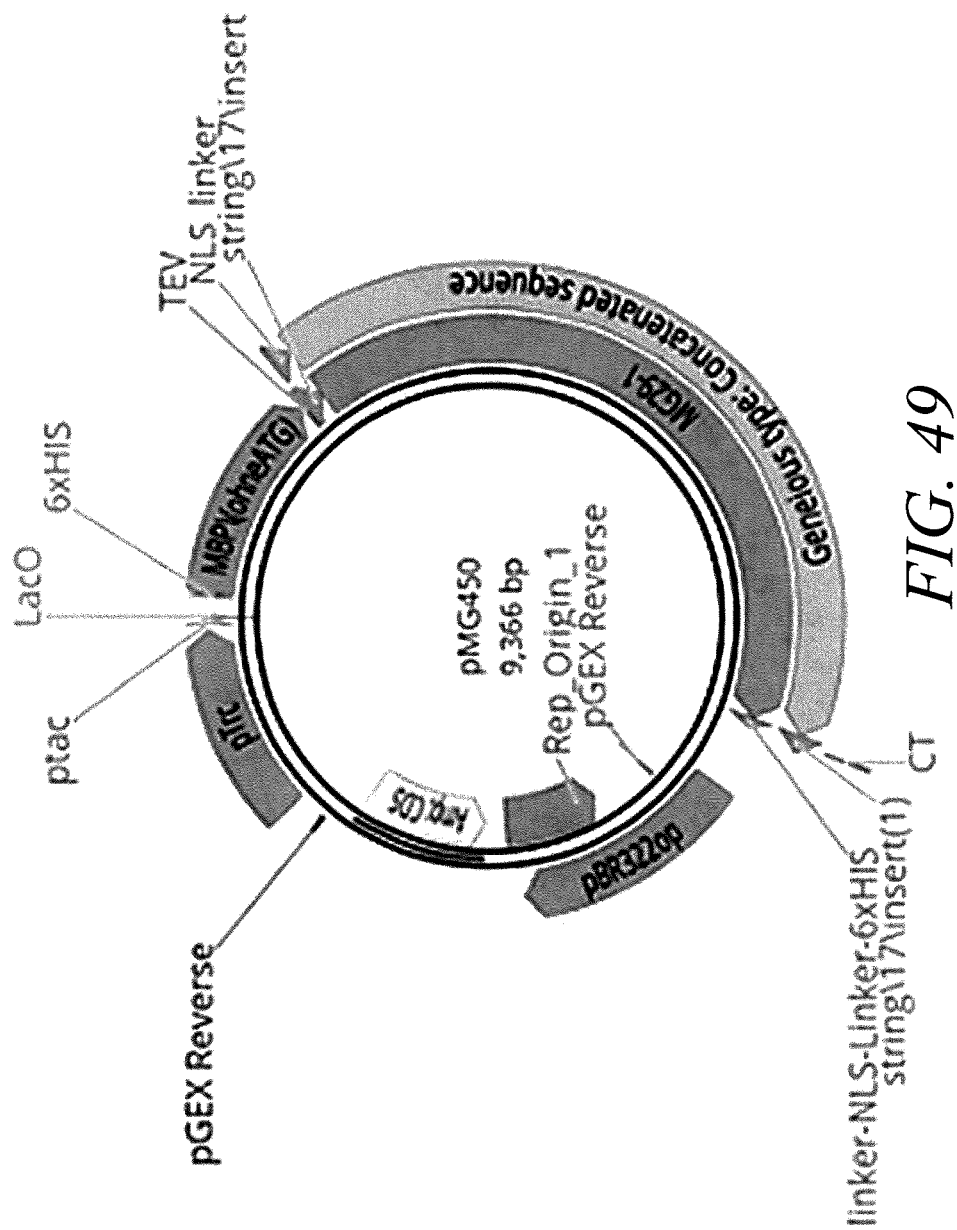
FIG. 49 depicts a plasmid map of pMG450 (MG29-1 nuclease protein in lac inducible tac promoter *E. coli* BL21 expression vector.

Production of Metagenomi's Type V-A CRISPR nuclease, MG29-1, is scaled up to an initial culture volume of 10 L. An expression screen, scaled-up expression, downstream development, a formulation study, and delivery of purified protein >=90% by SDS-PAGE are performed.
Expression and Purification Screen Expression of MG29-1 from the pMG450 vector depicted in FIG. 49 is tested while varying the following conditions: host strain, expression media, inducer, induction time, and temperature. Total soluble protein extracted from E. coli cell paste is analyzed by SDS-PAGE for all conditions. Immobilized metal affinity chromatography (IMAC) pull-down followed by SDS-PAGE is performed on the top three expression conditions to estimate yield and purity and to identify the optimal expression condition. A scaled-up method is developed for lysis. Critical parameters are identified for purification by IMAC and subtractive IMAC (including tobacco etch virus protease (TEV) cleavage). Column fractions are tested using SDS-PAGE. Elution pools are tested using SDS-PAGE and photometric absorbance at 280 nm (A280). A method for buffer exchange and concentration by tangential flow filtration (TFF) is developed.

An additional chromatography step is developed to achieve >90% purity, if necessary. One chromatography mode is tested (e.g., ceramic hydroxyapatite chromatography). Up to 8 unique conditions are tested (e.g., 2-6 resins each with 2-3 buffer systems). Column fractions are tested using SDS-PAGE. Elution pools are tested using SDS-PAGE and A280. One condition is selected, and a three-condition load study is performed. Column fractions and elution pools are analyzed as described above. A method for buffer exchange may be developed and concentration by TFF.

Transform E. coli, prepare culture in shake flasks and induce using materials and methods according to the optimal expression conditions identified during the expression screen. Harvest cell paste and verify expression by SDS-PAGE. Report results and use cell paste as starting material for purification. Cell culture volume is limited to 20 L. Purify up to 1 gram of protein using methods developed during downstream method development. Formulate into final storage buffer and perform the following QC tests: Yield and concentration by A280 and purity by SDS-PAGE.
Formulation Study Using purified protein, a formulation study is conducted to determine the optimal storage conditions for the purified protein. Study may explore concentration, storage buffer, storage temperature, maximum freeze/thaw cycles, storage time, or other conditions.

Example 29—Demonstration of the Ability of Nucleases Described Herein to Edit an Intronic Region in Cultured Mouse Liver Cells Intronic regions of expressed genes are attractive genomic targets to integrate a coding sequence of a therapeutic protein of interest with the goal of expressing that protein to treat or cure a disease. Integration of a protein coding sequence may be accomplished by creating a double strand break within the intron using a sequence specific nuclease in the presence of an exogenously supplied donor template. The donor template may be integrated into the double strand break via one of two main cellular repair pathways called homology directed repair (HDR) and non-homologous end joining (NHEJ) resulting in targeted integration of the donor template. The NHEJ pathway is dominant in non-dividing cells while the HDR pathway is primarily active only in dividing cells. The liver is a particularly attractive tissue for targeted integration of a protein coding sequence due to the availability of in vivo delivery systems and the ability of the liver to express and secrete proteins with high efficiency.

To evaluate the potential of MG29-1 to create double strand breaks at intronic regions the intron 1 of serum albumin was selected as the target locus. Single guide RNA (sgRNA) with a spacer length of 22 nt targeted to mouse albumin intron 1 were identified using the guide finding algorithm in the Geneious Prime nucleic acid analysis software (www.geneious.com/prime/). Using a PAM of KTTG (SEQ ID NO: 3870) located 5' to the spacer, a total of 112 potential sgRNA were identified within mouse albumin intron 1. Guides that spanned the intron/exon boundaries were excluded. Using Geneious Prime the spacer sequences of these 112 guides were searched against the mouse genome and a specificity score was assigned by the software based on the alignment to additional sites in the genome. Spacer sequences with 4 or more contiguous bases of the same base were excluded due to concerns about specificity. A total of 12 spacers with the highest specificity scores were selected for testing. To create the sgRNA the backbone sequence of "TAATTTCTACTGTTGTAGAT" was added to the 3' end of the spacer sequence. The sgRNA was chemically synthesized incorporating chemically modified bases known to improve the performance of sgRNA for cpf1 guides (AltR1/AltR2 chemistry available from Integrated DNA Technologies). The spacer sequences of these guides are listed in Table 8 below.

TABLE 8

Activity of MG29-1 sgRNA targeting mouse albumin intron 1 in Hepa1-6 cells nucleofected with MG29-1/sgRNA RNP or transfected with MG29-1 mRNA and sgRNA using Messenger Max

| sgRNA name | Spacer (DNA sequence, no PAM) | SEQ ID NO: | PAM | SEQ ID NO: | Specificity score | Activity (INDEL %) in Hepa1-6 cells | |
|---|---|---|---|---|---|---|---|
| | | | | | | RNP nucleofection | mRNA/sgRNA lipid transfection |
| mAlb29-1-1 | GTATAGCATGGTCGAGCAGCA | 3993 | TTTA | 4012 | 98.5 | 86.5 | 43 |
| mAlb29-1-2 | CCGATCGTTACAGGAAAATCTG | 3994 | GTTC | 4013 | 98.4 | 0 | 0 |
| mAlb29-1-3 | AATTTATTACGGTCTCATAGGG | 3995 | GTTG | 4014 | 98.2 | 0 | 0 |
| mAlb29-1-4 | TTACGGTCTCATAGGGCCTGCC | 3996 | TTTA | 4015 | 97.6 | 43.5 | 44 |
| mAlb29-1-5 | CCTGTAACGATCGGGAACTGGC | 3997 | TTTT | 4016 | 97.2 | 3 | 0 |
| mAlb29-1-7 | AGTATAGCATGGTCGAGCAGGC | 3998 | TTTT | 4017 | 96.8 | 11 | 15 |
| mAlb29-1-8 | CTGTAACGATCGGGAACTGGCA | 3999 | TTTC | 4018 | 95.9 | 77 | 45 |
| mAlb29-1-9 | GATACAGTTGAATTTATTACGG | 4000 | GTTG | 4019 | 95.3 | 0 | 0 |
| mAlb29-1-10 | TAGTATAGCATGGTCGAGCAGG | 4001 | TTTT | 4020 | 95.2 | 18 | 35 |
| mAlb29-1-11 | CATCTGAGAACCCTTAGGTGGT | 4002 | TTTG | 4021 | 95.0 | 7 | 2 |
| mAlb29-1-12 | AGTGTAGCAGAGAGGAACCATT | 4003 | TTTG | 4022 | 93.8 | NT | 47 |
| mAlb29-1-13 | CTAGTAATGGAAGCCTGGTATT | 4004 | TTTT | 4023 | 92.4 | 8 | 24 |
| mAlb29-1-14 | GGTATCTTTGATGACAATAATG | 4005 | TTTT | 4024 | 91.8 | 0 | 13 |
| mAlb29-1-15 | TCTAGTAATGGAAGCCTGGTAT | 4006 | TTTT | 4025 | 91.8 | 0 | 0 |
| mAlb29-1-16 | TAGTAATGGAAGCCTGGTATTT | 4007 | TTTC | 4026 | 89.8 | 90.5 | 51 |
| mAlb29-1-17 | GTATCTTTGATGACAATAATGG | 4008 | TTTG | 4027 | 87.8 | 10 | NT |
| mAlb29-1-18 | AAGATTGATGAAGACAACTAAC | 4009 | TTTA | 4028 | 87.4 | 76 | NT |
| mAlb29-1-19 | CTCTCTGCTACACTCAAAGTTA | 4010 | GTTC | 4029 | 85.7 | 0 | 0 |
| mAlb29-1-20 | AAACCCGTTAAGTGTTTATATC | 4011 | TTTA | 4030 | 87.3 | 0 | 4 |

Hepa1-6 cells, a transformed mouse liver cell line, were cultured under standard conditions (DMEM media with 10% FBS in 5% CO2 incubator) and nucleofected with ribonuclear proteins formed by mixing the sgRNA and purified MG29-1 protein in PBS buffer. Hepa1-6 cells ($1 \times 10^5$) in suspension in complete SF nucleofection reagent (Lonza) were nucleofected using a 4D nucleofection device (Lonza) with RNP formed by mixing 50 pmol of MG29-1 protein and 100 pmol of sgRNA. After nucleofection the cells were plated in 24 well plates in DMEM plus 10% FBS and incubated in a 5% CO2 incubator for 48 to 72 h. Genomic DNA was then extracted from the cells using a column-based purification kit (Purelink genomic DNA mini kit, ThermoFisher Scientific) and quantified by absorbance at 260 nm. The albumin intron 1 region was PCR amplified from 50 ng of the genomic DNA in a reaction containing 0.5 micro molar each of the primers mAlb90F (CTCCTCTTCGTCTCCGGC) (SEQ ID NO: 4031) and mAlb1073R (CTGCCACATTGCTCAGCAC) (SEQ ID NO: 4032) and 1×Pfusion Flash PCR Master Mix.

The resulting 984 bp PCR product which spans the entire intron 1 of mouse albumin was purified using a column-based purification kit (DNA Clean and Concentrator, Zymo Research) and sequenced using primers located within 150 to 350 bp of the predicted target site for each sgRNA. A PCR product generated using primers mAlb90F (SEQ ID NO: 4031) and mAlb1073R (SEQ ID NO: 4032) from un-transfected Hepa1-6 cells was sequenced in parallel as a control. The Sanger sequencing chromatograms were analyzed using Inference of CRISPR Edits (ICE) that determines the frequency of INDELS as well as the INDEL profile (Hsiau et. al, Inference of CRISPR Edits from Sanger Trace Data. BioArxiv.2018 biorxiv.org/content/early/2018/01/20/251082).

When a nuclease creates a double strand break (DSB) in DNA inside a living cell the DSB is repaired by the cellular DNA repair machinery. In actively dividing cells such as transformed mammalian cells in culture, and in the absence of a repair template, this repair occurs by the NHEJ pathway. The NHEJ pathway is an error prone process that introduces insertions or deletions of bases at the site of the double strand break (Lieber, M. R, Annu Rev Biochem. 2010; 79: 181-211). These insertions and deletions are therefore a hallmark of a double strand break that occurred and was subsequently repaired, is widely used as a readout of the editing or cutting efficiency of the nuclease. The profile of insertions and deletions depends on the characteristics of the nuclease that created the double strand break but also upon the sequence context at the cleavage site. Based on in vitro assays, the MG29-1 nuclease creates a staggered cut located 3' of the PAM. Staggered cuts will often lead to larger deletions due to the trimming of the single stranded ends prior to end-joining. Table 8 lists the total INDEL frequency generated by each of the 19 sgRNA targeting mouse albumin intron 1 that were tested in Hepa1-6 cells. Eleven of the 18 sgRNA resulted in detectable INDELS at the target site with 5 sgRNA resulting in INDEL frequencies greater than 50% and 4 sgRNA resulted in indel frequencies greater than 75%. These data demonstrate that the MG29-1 nuclease can edit the genome of cultured mouse liver cells at the predicted target site for the sgRNA with efficiencies greater than 75%.

The editing efficiencies of the same set of sgRNA were evaluated by co-transfection of the sgRNA and a mRNA encoding the MG29-1 nuclease using a commercial lipid-based transfection reagent (Lipofectamine MessengerMAX, Invitrogen). The mRNA encoding MG29-1 was generated by in vitro transcription using T7 polymerase from a plasmid in which the coding sequence of MG29-1 was cloned. The MG29-1 coding sequence was codon optimized using human codon usage tables and flanked by nuclear localization signals derived from SV40 at the N-terminus and from Nucleoplasmin at the C-terminus. In addition, a UTR was included at the 3' end of the coding sequence to improve translation. A 3' UTR followed by an approximately 90 to 110 nucleotide poly A tract was included at the 3' end of the coding sequence to improve mRNA stability in vivo (see e.g. SEQ ID NO: 4426 for wild-type MG29-1 and SEQ ID NO: 3327 for the S168R variant). The in vitro transcription reaction included the Clean Cap® capping reagent (Trilink BioTechnologies) and the resulting RNA was purified using the MEGAClear™ Transcription Clean-Up kit (Invitrogen) and purity was evaluated using the TapeStation (Agilent) and found to be composed of >90% full length RNA. As seen in Table 1, the editing efficiencies after mRNA/sgRNA lipid transfection of Hepa1-6 cells were similar but not identical to those seen with nucleofection of RNP but confirm that the MG29-1 nuclease is active in cultured liver cells when delivered in the form of an mRNA.

| SEQ ID NO: | Description | Sequence |
|---|---|---|
| 4426 | MG29-1 WT mRNA | TAATACGACTCACTATAAGGAAAAGCCAGCTCCAGCAGGCGC TGCTCACTCCTCCCCATCCTCTCCCTCTGTCCCTCTGTCCCTCT GACCCTGCACTGTCCCAGCACCATGGCCCCCAAGAAGAAGCG GAAAGTTGGCGGCGGAGGCAGCTTCAACAACTTCATCAAGAA ATACAGCCTGCAGAAGACCCTGCGGTTCGAACTGAAGCCCGT GGGCGAGACAGCGGACTACATCGAAGACTTCAAGAGCGAAT ACCTGAAGGACACGGTGCTGAAGGACGAACAGCGGGCAAAA GACTACCAGGAGATCAAAACACTGATCGACGACTACCACCGG GAGTACATCGAAGAATGCCTGAGGGAACCCGTGGACAAAAA GACCGGCGAGATCCTGGACTTCACACAGGACCTGGAAGACGC ATTCAGCTACTACCAGAAACTGAAAGAAAACCCCACCGAGA ACCGAGTGGGGTGGGAGAAAGAGCAGGAGAGCCTGAGAAAG AAGCTGGTGACCAGCTTCGTGGGGAACGACGGCCTGTTCAAG AAAGAGTTCATCACCCGCGACCTGCCCGAATGGCTGCAGAAA AAGGGGCTGTGGGGCGAATACAAGGACACCGTGGAGAACTT CAAAAAATTCACCACCTACTTCAGCGGCTTCCACGAGAACAG GAAGAATATGTACACAGCCGAAGCCCAGAGCACAGCCATCG CCAACAGGCTGATGAACGACAACCTGCCCAAGTTCTTCAACA ACTACCTGGCATACCAGACCATCAAGGAGAAACACCCCGACC TGGTGTTCCGACTGGACGACGCCCTGCTGCAGGCCGCCGGCG |

| SEQ ID NO: | Description | Sequence |
|---|---|---|
| | | TGGAGCACCTGGACGAGGCATTCCAGCCCAGATACTTCAGCA |
| | | GACTGTTCGCACAGAGCGGAATCACGGCCTTCAACGAGCTGA |
| | | TCGGAGGAAGGACCACGGAAAACGGCGAAAAGATCCAGGGC |
| | | CTGAACGAGCAGATCAACCTGTACAGACAGCAGAACCCCGA |
| | | GAAGGCCAAGGGCTTCCCAAGATTCATGCCCCTGTTCAAGCA |
| | | AATCCTGAGCGACAGGGAGACCCACAGCTTCCTGCCCGACGC |
| | | ATTCGAAAACGACAAAGAGCTGCTGCAGGCCCTGAGGGACT |
| | | ACGTGGACGCCGCCACCAGCGAAGAAGGAATGATCAGCCAA |
| | | CTGAACAAGGCCATGAACCAGTTCGTGACCGCCGACCTGAAA |
| | | AGGGTGTACATCAAAAGCGCCGCCCTGACCAGCCTGAGCCAG |
| | | GAACTGTTCCACTTCTTCGGCGTGATCAGCGACGCCATCGCGT |
| | | GGTACGCCGAGAAGAGACTGAGCCCCAAGAAAGCCCAGGAG |
| | | AGCTTCCTGAAACAGGAAGTGTACGCCATCGAAGAACTGAAC |
| | | CAGGCCGTGGTGGGCTACATCGACCAGCTGGAAGACCAGAG |
| | | CGAGCTGCAGCAGCTGCTGGTGGACCTGCCAGACCCCCAGAA |
| | | ACCAGTGAGCAGCTTCATCCTGACCCACTGGCAAAAAAGCCA |
| | | GGAGCCGCTGCAGGCCGTGATCGCGAAGGTGGAACCCCTGTT |
| | | CGAACTGGAGGAGCTGAGCAAAAACAAACGGGCCCCGAAAC |
| | | ACGACAAGGACCAGGGAGGGGAAGGCTTCCAGCAGGTGGAC |
| | | GCAATCAAGAACATGCTGGACGCATTCATGGAGGTGAGCCAC |
| | | GCCATCAAGCCCCTGTACCTGGTGAAGGGCCGGAAAGCAATC |
| | | GACATGCCGGACGTGGACACAGGATTCTACGCCGACTTCGCG |
| | | GAGGCATACAGCGCCTACGAGCAAGTGACGGTGAGCCTGTAC |
| | | AACAAGACCCGAAACCACCTGAGCAAGAAACCCTTCAGCAA |
| | | AGACAAAATCAAAATCAACTTCGACGCCCAACACTGCTGAA |
| | | CGGCTGGGACCTGAACAAGGAAAGCGACAACAAAAGCATCA |
| | | TCCTGAGAAAAGACGGAAACTTCTACCTGGCCATCATGCACC |
| | | CCAAACACACAAAGGTGTTCGACTGCTACAGCGCCAGCGAGG |
| | | CGGCCGGGAAATGCTACGAGAAAATGAACTACAAACTGCTG |
| | | AGCGGCGCCAACAAGATGCTGCCCAAAGTGTTCTTCAGCAAG |
| | | AAGGGAATCGAAACCTTCAGCCCACCCCAGGAAATCCTGGAC |
| | | CTGTACAAGAACAACGAACACAAGAAGGGAGCCACCTTCAA |
| | | GCTGGAGAGCTGCCACAAGCTGATCGACTTCTTCAAGCGGAA |
| | | CATCCCCAAGTACAAGGTGCACCCAACCGACAACTTCGGATG |
| | | GGACGTCTTCGGATTCCACTTCAGCCCAACCAGCAGCTACGG |
| | | CGACCTGAGCGGCTTCTACCGAGAGGTGGAAGCCCAGGGGTA |
| | | CAAACTGTGGTTCAGCGACGTGAGCGAGGCATACATCAACAA |
| | | GTGCGTGGAAGAGGGCAAACTGTTCCTGTTCCAGATCTACAA |
| | | CAAGGACTTCAGCCCCAACAGCACCGGGAAGCCAAACCTGC |
| | | ACACACTGTACTGGAAAGGACTGTTCGAACCCGAGAACCTGA |
| | | AGGACGTGGTGCTGAAACTGAACGGCGAGGCCGAGATCTTCT |
| | | ACAGGAAACACAGCATCAAGCACGAGGACAAGACGATCCAC |
| | | CGGGCCAAGGACCCAATCGCCAACAAAAACGCAGACAACCC |
| | | CAAGAAGCAGAGCGTGTTCGACTACGACATCATCAAGGACA |
| | | AGCGCTACACCCAGGACAAATTCTTCTTCCACGTGCCCATCA |
| | | GCCTGAACTTCAAGAGCCAGGGAGTGGTGCGGTTCAACGACA |
| | | AGATCAACGGCCTGCTGGCCCGCACGGACGACGTGCACGTGA |
| | | TCGGGATCGACCGAGGGGAACGCCACCTGCTGTACTACACCG |
| | | TGGTGAACGGCAAGGGCGAGGTGGTGGAACAGGGCAGCCTG |
| | | AACCAGGTGGCCACAGACCAGGGGTACGTGGTGGACTACCA |
| | | ACAGAAACTGCACGCCAAAGAGAAGGAGAGAGACCAGGCCA |
| | | GGAAGAACTGGAGCACCATCGAAAACATCAAGGAGCTGAAG |
| | | GCCGGGTACCTGAGCCAGGTGGTGCACAAACTGGCCCAGCTG |
| | | ATCGTGAAACACAACGCCATCGTGTGCCTGGAGGACCTGAAC |
| | | TTCGGATTCAAGAGGGGACGGTTCAAAGTGGAGAAGCAGGT |
| | | GTACCAGAAGTTCGAGAAAGCCCTGATCGACAAGCTGAACTA |
| | | CCTGGTGTTCAAGGAACGGGGGCCACCCAGGCAGGCGGAT |
| | | ACCTGAACGCCTACCAGCTGGCCGCACCATTCGAGAGCTTCG |
| | | AAAAACTGGGCAAGCAGACCGGCATCCTGTACTACGTGCGGA |
| | | GCGACTACACCAGCAAGATCGACCCCGCCACAGGCTTCGTGG |
| | | ACTTCCTGAAGCCCAAATACGAAAGCATGGCAAAGAGCAAA |
| | | GTGTTCTTCGAGAGCTTCGAAAGAATCCAGTGGAACCAGGCC |
| | | AAAGGCTACTTCGAGTTCGAATTCGACTACAAGAAAATGTGC |
| | | CCCAGCAGGAAGTTCGGCGACTACCGCACCCGGTGGGTGTG |
| | | TGCACATTCGGCGACACACGGTACCAGAACAGGCGCAACAA |
| | | AAGCAGCGGCCAATGGGAGACCGAGACAATCGACGTGACCG |
| | | CCCAGCTGAAGGCCCTGTTCGCGGCCTACGGCATCACCTACA |
| | | ACCAGGAGGACAACATCAAGGACGCCATCGCAGCCGTGAAG |
| | | TACACAAAATTCTACAAACAGCTGTACTGGCTGCTGAGACTG |
| | | ACGCTGAGCCTGCGGCACAGCGTGACCGGGACCGACGAGGA |
| | | CTTCATCCTGAGCCCCGTGGCCGACGAGAACGGCGTGTTCTT |
| | | CGACAGCAGGAAGGCCACGGACAAACAGCCCAAGGACGCAG |
| | | ACGCGAACGGCGCCTACCACATCGCCCTGAAGGGACTGTGGA |
| | | ACCTGCAGCAGATCAGGCAGCACGACTGGAACGTGGAAAAA |
| | | CCAAAAAAGCTGAACCTGGCCATGAAAAACGAAGAGTGGTT |

| SEQ ID NO: | Description | Sequence |
|---|---|---|
| | | CGGCTTCGCACAGAAGAAGAAATTCAGGGCCTCTGGCGGAA |
| | | AAAGACCTGCCGCCACAAAGAAAGCCGGACAGGCCAAGAAA |
| | | AAGAAGTGACCACACCCCATTCCCCCACTCCAGATAGAACT |
| | | TCAGTTATATCTCACGTGTCTGGAGTTGGATCCAAAAAAAA |
| | | AAAAAAAAAAAAAAAAAAAAAAAAAAAAAAAAAAAAAAAA |
| | | AAAAAAAAAAAAAAAAAAAAAAAAAAAAAAAAAAAAAAAA |
| | | AAAAAAAAAAAAAAAAAA |
| 4427 | MG29-1 S168R mRNA | TAATACGACTCACTATAAGGAAAAGCCAGCTCCAGCAGGCGC |
| | | TGCTCACTCCTCCCCATCCTCTCCCTCTGTCCCTCTGTCCCTCT |
| | | GACCCTGCACTGTCCCAGCACCATGGCCCCAAGAAGAAGCG |
| | | GAAAGTTGGCGGCGGAGGCAGCTTCAACAACTTCATCAAGAA |
| | | ATACAGCCTGCAGAAGACCCTGCGGTTCGAACTGAAGCCCGT |
| | | GGGCGAGACAGCGGACTACATCGAAGACTTCAAGAGCGAAT |
| | | ACCTGAAGGACACGGTGCTGAAGGACGAACAGCGGGCAAAA |
| | | GACTACCAGGAGATCAAAACACTGATCGACGACTACCACCGG |
| | | GAGTACATCGAAGAATGCCTGAGGGAACCCGTGGACAAAAA |
| | | GACCGGCGAGATCCTGGACTTCACACAGGACCTGGAAGACGC |
| | | ATTCAGCTACTACCAGAAACTGAAAGAAAACCCCACCGAGA |
| | | ACCGAGTGGGGTGGGAGAAAGAGCAGGAGAGCCTGAGAAAG |
| | | AAGCTGGTGACCAGCTTCGTGGGGAACGACGGCCTGTTCAAG |
| | | AAAGAGTTCATCACCCGCGACCTGCCCGAATGGCTGCAGAAA |
| | | AAGGGGCTGTGGGCGAATACAAGGACACCGTGGAGAACTT |
| | | CAAAAAATTCACCACCTACTTCAGGGGCTTCCACGAGAACAG |
| | | GAAGAATATGTACACAGCCGAAGCCCAGAGCACAGCCATCG |
| | | CCAACAGGCTGATGAACGACAACCTGCCCAAGTTCTTCAACA |
| | | ACTACCTGGCATACCAGACCATCAAGGAGAAACACCCCGACC |
| | | TGGTGTTCCGACTGGACGACGCCCTGCTGCAGGCCGCCGGCG |
| | | TGGAGCACCTGGACGAGGCATTCCAGCCCAGATACTTCAGCA |
| | | GACTGTTCGCACAGAGCGGAATCACGGCCTTCAACGAGCTGA |
| | | TCGGAGGAAGGACCACGGAAAACGGCGAAAAGATCCAGGGC |
| | | CTGAACGAGCAGATCAACCTGTACAGACAGCAGAACCCCGA |
| | | GAAGGCCAAGGGCTTCCCAAGATTCATGCCCCTGTTCAAGCA |
| | | AATCCTGAGCGACAGGGAGACCCACAGCTTCCTGCCCGACGC |
| | | ATTCGAAAACGACAAAGAGCTGCTGCAGGCCCTGAGGGACT |
| | | ACGTGGACGCCGCCACCAGCGAAGAAGGAATGATCAGCCAA |
| | | CTGAACAAGGCCATGAACCAGTTCGTGACCGCCGACCTGAAA |
| | | AGGGTGTACATCAAAAGCGCCGCCCTGACCAGCCTGAGCCAG |
| | | GAACTGTTCCACTTCTTCGGCGTGATCAGCGACGCCATCGCGT |
| | | GGTACGCCGAGAAGAGACTGAGCCCCAAGAAAGCCCAGGAG |
| | | AGCTTCCTGAAACAGGAAGTGTACGCCATCGAAGAACTGAAC |
| | | CAGGCCGTGGTGGGCTACATCGACCAGCTGGAAGACCAGAG |
| | | CGAGCTGCAGCAGCTGCTGGTGGACCTGCCAGACCCCCAGAA |
| | | ACCAGTGAGCAGCTTCATCCTGACCCACTGGCAAAAAAGCCA |
| | | GGAGCCGCTGCAGGCCGTGATCGCGAAGGTGGAACCCCTGTT |
| | | CGAACTGGAGGAGCTGAGCAAAAACAAACGGGCCCCGAAAC |
| | | ACGACAAGGACCAGGGAGGGGAAGGCTTCCAGCAGGTGGAC |
| | | GCAATCAAGAACATGCTGGACGCATTCATGGAGGTGAGCCAC |
| | | GCCATCAAGCCCCTGTACCTGGTGAAGGGCCGGAAAGCAATC |
| | | GACATGCCGGACGTGGACACAGGATTCTACGCCGACTTCGCG |
| | | GAGGCATACAGCGCCTACGAGCAAGTGACGGTGAGCCTGTAC |
| | | AACAAGACCCGAAACCACCTGAGCAAGAAACCCTTCAGCAA |
| | | AGACAAAATCAAATCAACTTCGACGCCCCAACACTGCTGAA |
| | | CGGCTGGGACCTGAACAAGGAAAGCGACAACAAAAGCATCA |
| | | TCCTGAGAAAAGACGGAAACTTCTACCTGGCCATCATGCACC |
| | | CCAAACACACAAAGGTGTTCGACTGCTACAGCGCCAGCGAGG |
| | | CGGCCGGGAAATGCTACGAGAAAATGAACTACAAACTGCTG |
| | | AGCGGCGCCAACAAGATGCTGCCCAAAGTGTTCTTCAGCAAG |
| | | AAGGGAATCGAAACCTTCAGCCCACCCCAGGAAATCCTGGAC |
| | | CTGTACAAGAACAACGAACACAAGAAGGGAGCCACCTTCAA |
| | | GCTGGAGAGCTGCCACAAGCTGATCGACTTCTTCAAGCGGAA |
| | | CATCCCCAAGTACAAGGTGCACCCAACCGACAACTTCGGATG |
| | | GGACGTCTTCGGATTCCACTTCAGCCCAACCAGCAGCTACGG |
| | | CGACCTGAGCGGCTTCTACCGAGAGGTGGAAGCCCAGGGGTA |
| | | CAAACTGTGGTTCAGCGACGTGAGCGAGGCATACATCAACAA |
| | | GTGCGTGGAAGAGGGCAAACTGTTCCTGTTCCAGATCTACAA |
| | | CAAGGACTTCAGCCCCAACAGCACCGGGAAGCCAAACCTGC |
| | | ACACACTGTACTGGAAAGGACTGTTCGAACCCGAGAACCTGA |
| | | AGGACGTGGTGCTGAAACTGAACGGCGAGGCCGAGATCTTCT |
| | | ACAGGAAACACAGCATCAAGCACGAGGACAAGACGATCCAC |
| | | CGGGCCAAGGACCCAATCGCCAACAAAAACGCAGACAACCC |
| | | CAAGAAGCAGAGCGTGTTCGACTACGACATCATCAAGGACA |
| | | AGCGCTACACCCAGGACAAATTCTTCTTCCACGTGCCCATCA |
| | | GCCTGAACTTCAAGAGCCAGGGAGTGGTGCGGTTCAACGACA |
| | | AGATCAACGGCCTGCTGGCCGCACAGGACGACGTGCACGTGA |

| SEQ ID NO: | Description | Sequence |
|---|---|---|
| | | TCGGGATCGACCGAGGGGAACGCCACCTGCTGTACTACACCG |
| | | TGGTGAACGGCAAGGGCGAGGTGGTGGAACAGGGCAGCCTG |
| | | AACCAGGTGGCCACAGACCAGGGGTACGTGGTGGACTACCA |
| | | ACAGAAACTGCACGCCAAAGAGAAGGAGAGAGACCAGGCCA |
| | | GGAAGAACTGGAGCACCATCGAAAACATCAAGGAGCTGAAG |
| | | GCCGGGTACCTGAGCCAGGTGGTGCACAAACTGGCCCAGCTG |
| | | ATCGTGAAACACAACGCCATCGTGTGCCTGGAGGACCTGAAC |
| | | TTCGGATTCAAGAGGGGACGGTTCAAAGTGGAGAAGCAGGT |
| | | GTACCAGAAGTTCGAGAAAGCCCTGATCGACAAGCTGAACTA |
| | | CCTGGTGTTCAAGGAACGGGGGGCCACCCAGGCAGGCGGAT |
| | | ACCTGAACGCCTACCAGCTGGCCGCACCATTCGAGAGCTTCG |
| | | AAAAACTGGGCAAGCAGACCGGCATCCTGTACTACGTGCGGA |
| | | GCGACTACACCAGCAAGATCGACCCCGCCACAGGCTTCGTGG |
| | | ACTTCCTGAAGCCCAAATACGAAAGCATGGCAAAGAGCAAA |
| | | GTGTTCTTCGAGAGCTTCGAAAGAATCCAGTGGAACCAGGCC |
| | | AAAGGCTACTTCGAGTTCGAATTCGACTACAAGAAAATGTGC |
| | | CCCAGCAGGAAGTTCGGCGACTACCGCACCCGGTGGGTGGTG |
| | | TGCACATTCGGCGACACACGGTACCAGAACAGGCGCAACAA |
| | | AAGCAGCGGCCAATGGGAGACCGAGACAATCGACGTGACCG |
| | | CCCAGCTGAAGGCCCTGTTCGCGGCCTACGGCATCACCTACA |
| | | ACCAGGAGGACAACATCAAGGACGCCATCGCAGCCGTGAAG |
| | | TACACAAAATTCTACAAACAGCTGTACTGGCTGCTGAGACTG |
| | | ACGCTGAGCCTGCGGCACAGCGTGACCGGGACCGACGAGGA |
| | | CTTCATCCTGAGCCCCGTGGCCGACGAGAACGGCGTGTTCTT |
| | | CGACAGCAGGAAGGCCACGGACAAACAGCCCAAGGACGCAG |
| | | ACGCGAACGGCGCCTACCACATCGCCCTGAAGGGACTGTGGA |
| | | ACCTGCAGCAGATCAGGCAGCACGACTGGAACGTGGAAAAA |
| | | CCAAAAAAGCTGAACCTGGCCATGAAAAACGAAGAGTGGTT |
| | | CGGCTTCGCACAGAAGAAGAAATTCAGGGCCTCTGGCGGAA |
| | | AAAGACCTGCCGCCACAAAGAAAGCCGGACAGGCCAAGAAA |
| | | AAGAAGTGACCACACCCCATTCCCCCACTCCAGATAGAACT |
| | | TCAGTTATATCTCACGTGTCTGGAGTTGGATCCAAAAAAAAA |
| | | AAAAAAAAAAAAAAAAAAAAAAAAAAAAAAAAAAAAAAA |
| | | AAAAAAAAAAAAAAAAAAAAAAAAAAAAAAAAAAAAAAA |
| | | AAAAAAAAAAAAAAAAA |

Figure 50:
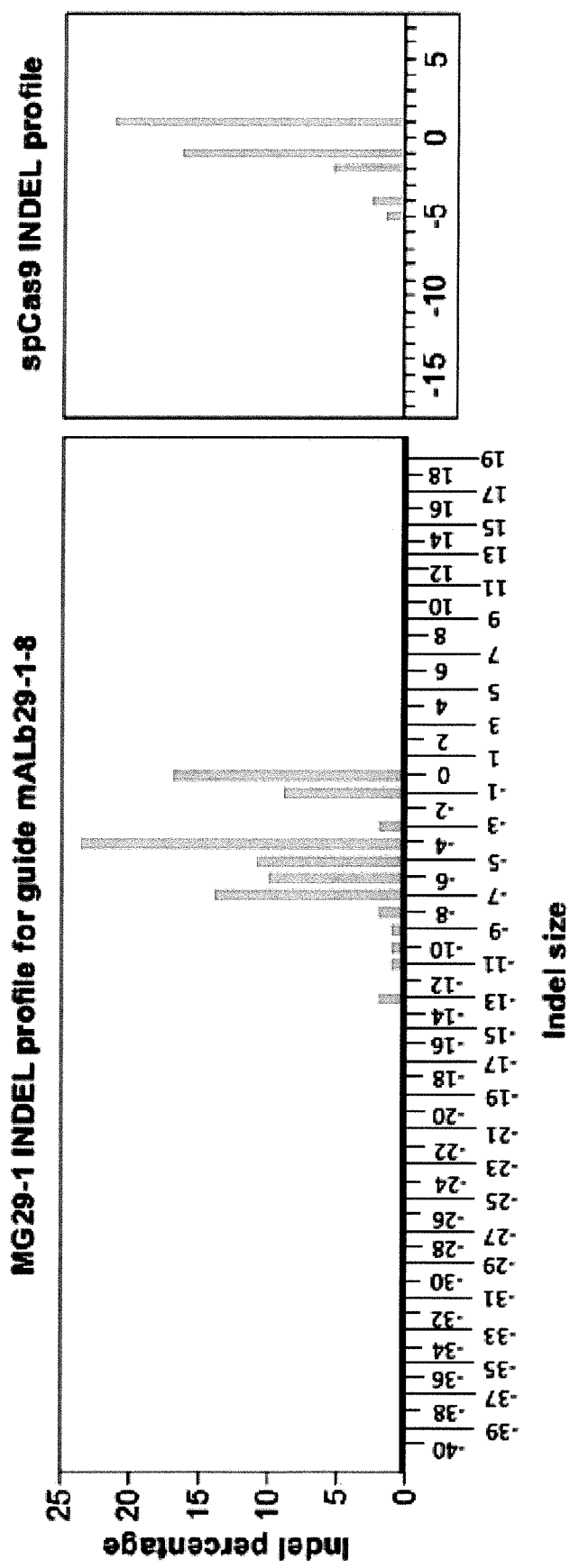
FIG. 50 depicts the indel profile of MG29-1 with spacer mALb29-1-8 (SEQ ID NO: 3999) compared to spCas9 with a guide targeting mouse albumin intron 1.

FIG. 50 is a representative example of the indel profile of MG29-1 as determined by ICE analysis using mALb29-1-8 as the guide (SEQ ID NO: 3999) and demonstrates that deletion of 4 bases was the most frequent event (25% of total sequences) and deletions of 1, 5, 6, or 7 bases each accounting for about 10 to 15% of the sequences. Longer deletions of up to 13 bases were also detected, but insertions were undetectable. By contrast, spCas9 with a guide targeting mouse albumin intron 1 generated primarily 1 base insertions or deletions.

FIG. 51 is a representative example of the indel profile of MG29-1 and sgRNA mAlb29-1-8 as determined by next generation sequencing (NGS) of the PCR product of the mouse albumin intron 1 region. In total approximately 15,000 sequence reads were obtained. By NGS deletion of 4 bases was the most frequent indel (about 20% of total) with deletions of 1, 5, 6 and 7 bases each accounting for about 10% of the indels. Larger deletions of up to 19 bp were also detected. The profile observed by NGS analysis matches closely that measured by ICE. These results demonstrate that MG29-1 generates large deletions at the target site consistent with the staggered cleavage observed in vitro.

Example 30—Demonstration of the Ability of a Nuclease Described Herein to Target an Intronic Region in Cultured Human Liver Cells (HepG2)

To evaluate the potential of MG29-1 to create double strand breaks at intronic regions in human cells, the intron 1 of human serum albumin was selected as the target locus. Single guide RNA (sgRNA) with a spacer length of 22 nt targeted to human albumin intron 1 were identified using the guide finding algorithm in the Geneious Prime nucleic acid analysis software (geneious.com/prime/). Using a PAM of KTTG (SEQ ID NO: 3870) located 5' to the spacer, a total of 90 potential sgRNA were identified within human albumin intron 1. Guides that spanned the intron/exon boundaries were excluded. Using Geneious Prime the spacer sequences of these guides were searched against the mouse genome and a specificity score was assigned by the software based on the alignment to additional sites in the genome. Spacer sequences with 4 or more contiguous bases of the same base were excluded due to concerns about specificity. A total of 23 spacers with the highest specificity scores were selected for testing. To create the sgRNA the backbone sequence of "TAATTTCTACTGTTGTAGAT" was added to the 3' end of the spacer sequence. The sgRNA was chemically synthesized incorporating chemically modified bases known to improve the performance of sgRNA for cpf1 guides (AltR1/AltR2 chemistry available from Integrated DNA Technologies). The spacer sequences of these guides are listed in Table 9.

TABLE 9

Spacer sequences of MG29-1 sgRNA targeting human albumin intron 1 and activity in HepG2 cells nucleofected with MG29-1/ sgRNA RNP

| sgRNA name | Spacer (DNA sequence, no PAM) | SEQ ID NO: | PAM | SEQ ID NO: | Specificity score | (INDEL %) in HepG2 cells |
|---|---|---|---|---|---|---|
| hAlb_g63 | GTAAACTCTGCATCTTTAAAGA | 4033 | TTTA | 4056 | 91.25% | 0 |
| hAlb_g59 | TTTCAAAATATTGGGCTCTGAT | 4034 | TTTG | 4057 | 90.64% | 0 |
| hAlb_g58 | AGTAAACTCTGCATCTTTAAAG | 4035 | TTTT | 4058 | 90.46% | 0 |
| hAlb_g56 | AAGATGCAGAGTTTACTAAAAC | 4036 | TTTA | 4059 | 90.23% | 0 |
| hAlb_g72 | AAAATATTGGGCTCTGATTCCT | 4037 | TTTC | 4060 | 93.26% | 0 |
| hAlb_g70 | AAATAAAGCATAGTGCAATGGA | 4038 | TTTT | 4061 | 92.31% | 63 |
| hAlb_g74 | AATAAAGCATAGTGCAATGGAT | 4039 | TTTA | 4062 | 95.41% | 93 |
| hAlb_g83 | TGAGATCAACAGCACAGGTTTT | 4040 | TTTA | 4063 | 98.39% | 93 |
| hAlb_g85 | TGTAGGAATCAGAGCCCAATAT | 4041 | TTTC | 4064 | 99.20% | 55 |
| hAlb_g89 | CTGTAGGAATCAGAGCCCAATA | 4042 | TTTT | 4065 | 100.00% | 43 |
| hAlb_g88 | TCTGTAGGAATCAGAGCCCAAT | 4043 | TTTT | 4066 | 100.00% | 45 |
| hAlb_g77 | GTGACTGTAATTTTCTTTTGCG | 4044 | TTTA | 4067 | 96.77% | 0 |
| hAlb_g69 | CTTTTGCGCACTAAGGAAAGTG | 4045 | TTTT | 4068 | 92.18% | 3 |
| hAlb_g66 | TGAAGTCTTACAAGGTTATCTT | 4046 | TTTG | 4069 | 91.80% | 19 |
| hAlb_g75 | AGTGTCTATCAACAGCAACCAA | 4047 | TTTT | 4070 | 95.96% | 13 |
| hAlb_g79 | CTTAGTGCGCAAAAGAAAATTA | 4048 | TTTC | 4071 | 97.45% | 60 |
| hAlb_g82 | TAGCCTTATATTCAAACTTAGA | 4049 | TTTA | 4072 | 98.32% | 0 |
| hAlb_g80 | GGATAGTTATGAATTCAATCTT | 4050 | TTTG | 4073 | 97.46% | 23 |
| hAlb_g84 | CACTTTCCTTAGTGCGCAAAAG | 4051 | TTTG | 4074 | 98.85% | 96 |
| hAlb_g81 | GTATTTGTGAAGTCTTACAAGG | 4052 | TTTT | 4075 | 98.07% | 17 |
| hAlb_g90 | GTGTCTATCAACAGCAACCAAG | 4053 | TTTA | 4076 | 100.00% | 91 |
| hAlb_g87 | CGCACTAAGGAAAGTGCAAAGT | 4054 | TTTG | 4077 | 100.00% | 97 |
| hAlb_g86 | GCGCACTAAGGAAAGTGCAAAG | 4055 | TTTT | 4078 | 100.00% | 42 |

HepG2 cells, a transformed human liver cell line, were cultured under standard conditions (MEM media with 10% FBS in 5% CO2 incubator) and nucleofected with ribonuclear proteins formed by mixing the sgRNA and purified MG29-1 protein in PBS buffer. A total of 1 e5 HepG2 cells in suspension in complete SF nucleofection reagent (Lonza) were nucleofected using a 4D nucleofection device (Lonza) with RNP formed by mixing 80 pmol of MG29-1 protein and 160 pmol of sgRNA. After nucleofection the cells were plated in 24 well plates in DMEM plus 10% FBS and incubated in a 5% CO2 incubator for 48 to 72 h. Genomic DNA was then extracted from the cells using a column-based purification kit (Purelink genomic DNA mini kit, ThermoFisher Scientific) and quantified by absorbance at 260 nm. The albumin intron 1 region was PCR amplified from 50 ng of the genomic DNA in a reaction containing 0.5 micro molar each of the primers hAlb 11F (TCTTCTGTCAACCCCACACGCC) (SEQ ID NO: 4079) and hAlb834R (CTTGTCTGGGCAAGGGAAGA) (SEQ ID NO: 4080) and 1×Pfusion Flash PCR Master Mix. The resulting 826 bp PCR product which spans the entire intron 1 of mouse albumin was purified using a column-based purification kit (DNA Clean and Concentrator, Zymo Research) and sequenced using primers located within 150 to 350 bp of the predicted target site for the sgRNA.

The PCR product generated using primers hAlb 11F (TCTTCTGTCAACCCCACACGCC) (SEQ ID NO: 4079) and hAlb834R (CTTGTCTGGGCAAGGGAAGA) (SEQ ID NO: 4080) from un-transfected HepG2 cells was sequenced in parallel as a control. The Sanger sequencing chromatograms were analyzed using Inference of CRISPR Edits (ICE) that determines the frequency of INDELS as well as the INDEL profile. When a nuclease creates a double strand break (DSB) in DNA inside a living cell the DSB is repaired by the cellular DNA repair machinery. In actively dividing cells such as transformed mammalian cells in culture, and in the absence of a repair template, this repair occurs by the NHEJ pathway. The NHEJ pathway is an error prone process that introduces insertions or deletions of bases at the site of the double strand break (Lieber, M. R, Annu Rev Biochem. 2010; 79: 181-211).

These insertions and deletions are therefore a hallmark of a double strand break that occurred and was subsequently repaired, and is widely used as a readout of the editing or cutting efficiency of the nuclease. The profile of insertions and deletions depends on the characteristics of the nuclease that created the double strand break but also upon the sequence context at the cleavage site. Based on in vitro assays, the MG29-1 nuclease cleaves the target strand at 22 nucleotides from the PAM (less frequently at 21 nucleotides from the PAM) and cleaves the non-target strand at 18 nucleotides from the PAM which therefore creates 4 nucleotide staggered end located 3' of the PAM. Staggered cuts will often lead to larger deletions due to the trimming of the single stranded ends prior to end-joining.

Table 9 lists the total indel frequency generated by each of the 23 sgRNA targeting human albumin intron 1 that were tested in HepG2 cells. Sixteen of the 23 sgRNA resulted in detectable indel at the target site with 8 sgRNA resulting in INDELS greater than 50% and 5 sgRNA resulted in indel frequencies than 90%. These data demonstrate that the MG29-1 nuclease can edit the genome of a cultured human liver cell line at the predicted target site for the sgRNA with efficiencies greater than 90%.

Example 31—Demonstration of the Ability of Nucleases Described Herein to Edit Exonic Regions in Cultured Mouse Liver Cells Sequence specific nucleases can be used to disrupt the coding sequences of genes and thereby create a functional knockout of a protein of interest. This can be of therapeutic use when the knockdown of a specific protein has a beneficial effect in a particular disease. One way to disrupt the coding sequence of a gene is to make a double strand break within the exonic regions of the gene using a sequence specific nuclease. These double strand breaks will be repaired via error prone repair pathways to generate insertions or deletions which can result in either frameshift mutations or changes to the amino acid sequence which disrupt the function of the protein.

To evaluate the potential of MG29-1 to create double strand breaks at exonic regions of a gene expressed in liver cells the gene encoding glycolate oxidase (hao-1) was selected as the target locus. Single guide RNA (sgRNA) with a spacer length of 22 nt targeted to exons 1 to 4 of mouse hao-1 were identified using the guide finding algorithm in the Geneious Prime nucleic acid analysis software (geneious.com/prime/). The first 4 exons of the hao-1 gene comprise approximately the N-terminal 50% of the hao-1 coding sequence. The first 4 exons were chosen because INDELS created towards the N-terminus of the coding sequence of a gene are more likely to create a frameshift or missense mutation that disrupts the activity of the protein. Using a PAM of KTTG (SEQ ID NO: 3870) located 5' to the spacer, a total of 45 potential sgRNAs were identified within mouse hao-1 exons 1 through 4. Guides that spanned the intron/exon boundaries were included because such guides may create INDELS that interfere with splicing. Using Geneious Prime, the spacer sequences of these 45 guides were searched against the mouse genome and a specificity score was assigned by the software based on the alignment to additional sites in the mouse genome. Spacer sequences with 4 or more contiguous bases of the same base were excluded due to concerns about specificity. A total of 45 spacers with the highest specificity scores were selected for testing.

To create the sgRNA the backbone sequence of "TAATTCTACTGTTGTAGAT" was added to the 3' end of the spacer sequence. The sgRNA was chemically synthesized incorporating chemically modified bases known to improve the performance of sgRNA for cpf1 guides (AltR1/AltR2 chemistry available from Integrated DNA Technologies). The spacer sequences of these guides are listed in Table 10.

TABLE 10

Spacer sequences of MG29-1 sgRNA targeting mouse hao-1 exons 1 to 4 and activity in Hepa1-6 cells nucleofected with MG29-1/sgRNA RNP

| sgRNA name | Spacer (DNA sequence, no PAM) | SEQ ID NO: | PAM | SEQ ID NO: | Specificity score | Activity (INDEL %) in Hepa1-6 cells |
|---|---|---|---|---|---|---|
| mH29-1 | CCCCAGACCTGTAATAGTCATA | 4081 | TTTG | 4126 | 100.00% | 92.2 |
| mH29-2 | AGGACAGAGAGTCAGCATGCCA | 4082 | TTTT | 4127 | 100.00% | 0 |
| mH29-3 | GGAGACAACAGTGGACTTGCTG | 4083 | TTTT | 4128 | 100.00% | 0 |
| mH29-4 | CCCTACCCTGCCACAATGTTGC | 4084 | GTTG | 4129 | 100.00% | 0 |
| mH29-5 | CTTACCTAGAAAATGCTTGGAT | 4085 | GTTT | 4130 | 100.00% | 0 |
| mH29-6 | ACAGATCGATATCAGCAACGTT | 4086 | GTTG | 4131 | 100.00% | 0 |
| mH29-7 | CGAAGCATCCGTGGATAGAGCT | 4087 | GTTG | 4132 | 100.00% | 0 |
| mH29-8 | TTGGGCTACCTCCTCAATAGAA | 4088 | GTTC | 4133 | 100.00% | 0 |
| mH29-9 | AAGCTGCCACCACAACTCAGGT | 4089 | GTTC | 4134 | 100.00% | 0 |
| mH29-10 | TGGTGGCAGCTTGAACCTGTTC | 4090 | GTTG | 4135 | 100.00% | 0 |
| mH29-11 | CGCACGTCATCAATGCGGTTGC | 4091 | GTTC | 4136 | 100.00% | 0 |
| mH29-12 | CCCAGGTAAGGGGTGTCCACAG | 4092 | GTTG | 4137 | 100.00% | 0 |
| mH29-13 | CATCCAGCGAAGTGCCTCTGGG | 4093 | GTTG | 4138 | 100.00% | 0 |

TABLE 10-continued

Spacer sequences of MG29-1 sgRNA targeting mouse hao-1 exons 1
to 4 and activity in Hepa1-6 cells nucleofected with MG29-1/sgRNA RNP

| sgRNA name | Spacer (DNA sequence, no PAM) | SEQ ID NO: | PAM | SEQ ID NO: | Specificity score | Activity (INDEL %) in Hepa1-6 cells |
|---|---|---|---|---|---|---|
| mH29-14 | AAATTCCAGATGGAAGCTCTAT | 4094 | TTTT | 4139 | 99.04% | 0 |
| mH29-15 | TGACTGTGGACACCCCTTACCT | 4095 | TTTG | 4140 | 99.04% | 97.5 |
| mH29-16 | ATTACAGCCTGTCAGACCATGG | 4096 | TTTC | 4141 | 99.30% | 91 |
| mH29-17 | GAGACAACAGTGGACTTGCTGA | 4097 | TTTG | 4142 | 98.37% | 27.5 |
| mH29-18 | CAACAATAGGCAGTGATGTCAA | 4098 | TTTA | 4143 | 99.22% | 85 |
| mH29-19 | CCTCGACTGGTCTGCATCAGTG | 4099 | GTTG | 4144 | 97.69% | 0 |
| mH29-20 | ATAATCACTGATGCAGACCAGT | 4100 | GTTC | 4145 | 98.07% | 0 |
| mH29-21 | TCAGCTAACGTCTCCTGATCAT | 4101 | GTTA | 4146 | 99.33% | 0 |
| mH29-22 | CTGATATCGATCTGTCAACTTC | 4102 | GTTG | 4147 | 99.22% | 0 |
| mH29-23 | TAAAGGGCATTTTGAGAGGTTT | 4103 | GTTG | 4148 | 99.22% | 0 |
| mH29-24 | AATAGCAAAGTTTCTTACCTAG | 4104 | TTTA | 4149 | 95.75% | 0 |
| mH29-25 | GGACAGAGAGTCAGCATGCCAA | 4105 | TTTA | 4150 | 95.73% | 47 |
| mH29-26 | TCCATTTCATTACAGCCTGTCA | 4106 | TTTC | 4151 | 94.08% | 79 |
| mH29-27 | AGTCTGTGAGATCATACTGACC | 4107 | TTTG | 4152 | 96.85% | 65 |
| mH29-28 | TAGATGTACAGTTGCATCCAGC | 4108 | TTTG | 4153 | 98.20% | 29 |
| mH29-29 | CCTTAGGAGAAAATGCCAAATC | 4109 | TTTC | 4154 | 96.18% | 94.5 |
| mH29-30 | CTCCTAAGGGAAATTTTGGAGA | 4110 | TTTT | 4155 | 98.06% | 0 |
| mH29-31 | GCTGATAACATCCAAGCATTTT | 4111 | GTTA | 4156 | 93.30% | 0 |
| mH29-32 | AAATAGCAAAGTTTCTTACCTA | 4112 | GTTT | 4157 | 97.31% | 0 |
| mH29-33 | TAGGACAGAGAGTCAGCATGCC | 4113 | GTTT | 4158 | 95.84% | 0 |
| mH29-34 | GGGCTACTGCCATGCAGTGCAT | 4114 | GTTG | 4159 | 97.53% | 0 |
| mH29-35 | TCTCCAAAATTTCCCTTAGGAG | 4115 | GTTG | 4160 | 96.94% | 0 |
| mH29-36 | AATTCCAGATGGAAGCTCTATC | 4116 | TTTA | 4161 | 96.74% | 0 |
| mH29-37 | TCCTAAGGGAAATTTTGGAGAC | 4117 | TTTC | 4162 | 97.59% | 53.5 |
| mH29-38 | TTACCTAGAAAATGCTTGGATG | 4118 | TTTC | 4163 | 94.99% | 21.8 |
| mH29-39 | CAAGGCCATATTTGTGACTGTG | 4119 | GTTA | 4164 | 93.57% | 0 |
| mH29-40 | CTCCATTTCATTACAGCCTGTC | 4120 | TTTT | 4165 | 93.71% | 0 |
| mH29-41 | GCATTTTCTCCTAAGGGAAATT | 4121 | TTTG | 4166 | 92.30% | 59 |
| mH29-42 | TTACCTCGCACAGTGGCCAGCT | 4122 | TTTC | 4167 | 77.16% | 32 |
| mH29-43 | TCTCTCTTTTCTTACCTCGCAC | 4123 | TTTG | 4168 | 87.70% | 0 |
| mH29-44 | CTTACCTCGCACAGTGGCCAGC | 4124 | TTTT | 4169 | 95.19% | 0 |
| mH29-45 | AAACCAATGATTTGGCATTTTC | 4125 | TTTG | 4170 | 91.09% | 0 |

Hepa1-6 cells, a transformed mouse liver cell line, were cultured under standard conditions (DMEM media with 10% FBS in 5% $CO_2$ incubator) and nucleofected with ribonuclear proteins formed by mixing the sgRNA and purified MG29-1 protein in PBS buffer. A total of 1 $e^5$ Hepa1-6 cells in suspension in complete SF nucleofection reagent (Lonza) were nucleofected using a 4D nucleofection device (Lonza) with RNP formed by mixing 50 pmol of MG29-1 protein and 100 pmol of sgRNA. After nucleofection the cells were plated in 24 well plates in DMEM plus 10% FBS and incubated in a 5% CO2 incubator for 48 to 72 h. Genomic DNA was then extracted from the cells using a column-based purification kit (Purelink genomic DNA mini kit, ThermoFisher Scientific) and quantified by absorbance at 260 nm. Exons 1 through 4 of the mouse hao-1 gene 1 were PCR amplified from 40 ng of the genomic DNA in a reaction containing 0.5 micro molar pairs of the primers specific for each exon. The PCR primers used for exon 1 were PCR_mHE1_F_+233 (GTGACCAACCCTACCCGTTT) (SEQ ID NO: 4171), PCR_mHE1_R_-553 (GCAAGCACCTACTGTCTCGT) (SEQ ID NO: 4172). The PCR primers used for exon 2 were HAO1_E2_F5721 (CAACGAAGGTTCCCTCCAGG) (SEQ ID NO: 4173), HAO1_E2_R6271 (GGAAGGGTGTTCGAGAAGGA) (SEQ ID NO: 4174). The PCR primers used for exon 3 were HAO1_E3_F23198 (TGCCCTAGACAAGCTGACAC) (SEQ ID NO: 4175), HAO1_E3_R23879 (CAGATTCTGGAAGTGGCCCA) (SEQ ID NO: 4176). The PCR primers used for exon 4 were HAO1_E4_F31087 (CCTGTAGGTGGCTGAGTACG) (SEQ ID NO: 4177), HAO1_E4_R31650 (AGGTTTGGTTCCCCTCACCT) (SEQ ID NO: 4178).

In addition to primers and genomic DNA the PCR reactions contained 1×Pfusion Flash PCR Master Mix (Thermo Fisher). The resulting PCR products comprised single bands when analyzed on agarose gels demonstrating that the PCR reaction was specific, and were purified using a column-based purification kit (DNA Clean and Concentrator, Zymo Research). For sequencing, primers complementary to sequences at least 100nt from each cut site were used. The primer to sequence Exon 1 was Seq_mHE1_F_+139 (GTCTAGGCATACAATGTTTGCTCA) (SEQ ID NO: 4179). The primer to sequence Exon 2 was 5938F Seq_HAO1_E2 (CTATGCAAGGAAAAGATTTGGCC) (SEQ ID NO: 4180). The primers to sequence Exon 3 were HAO1_E3_F23476 (TCTTCCCCCTTGAATGAAACACT) (SEQ ID NO: 4181) and the reverse PCR primer, HAO1_E3_R23879 (CAGATTCTGGAAGTGGCCCA) (SEQ ID NO: 4182). The primer to sequence Exon 4 was the reverse PCR primer, HAO1_E4_R31650 (AGGTTTGGTTCCCCTCACCT) (SEQ ID NO: 4183).

Sequencing of the PCR products showed that they contained the expected sequences of the hao-1 exons. PCR products derived from Hepa-16 cells nucleofected with different RNP or untreated controls were sequenced using primers located within 100 to 350 bp of the predicted target site for each sgRNA. The Sanger sequencing chromatograms were analyzed using Inference of CRISPR Edits (ICE) that determines the frequency of INDELS as well as the INDEL profile (Hsiau et. al, Inference of CRISPR Edits from Sanger Trace Data. BioArxiv. 2018 biorxiv.org/content/early/2018/01/20/251082). When a nuclease creates a double strand break (DSB) in DNA inside a living cell the DSB is repaired by the cellular DNA repair machinery. In actively dividing cells such as transformed mammalian cells in culture, and in the absence of a repair template, this repair occurs by the NHEJ pathway. The NHEJ pathway is an error prone process that introduces insertions or deletions of bases at the site of the double strand break (Lieber, M. R, Annu Rev Biochem. 2010; 79: 181-211). These insertions and deletions are therefore a hallmark of a double strand break that occurred and was subsequently repaired, and is widely used in the art as a readout of the editing or cutting efficiency of the nuclease. As presented in Table 10, 14 guides demonstrated detectable editing at their predicted target sites. Four guides exhibited editing activity greater than 90%. All 14 of the active guides had PAM sequences of TTTN demonstrating that this PAM is preferred in vivo. However not all guides utilizing a TTTN PAM were active. These data demonstrate that the MG29-1 nuclease can generate RNA guided, sequence specific, double strand breaks in exonic regions in cultured liver cells with high efficiency.

Example 32—Design of Further sgRNAs for Disruption of Hao-1 Gene

Further sgRNAs were designed to target exonic parts of the hao-1 gene. These are designed to target the first 4 exons because these comprise approximately 50% of the coding sequence and indels created towards the N-terminus of the coding sequence of a gene are more likely to create a frameshift or missense mutation that disrupts the activity of the protein. Using the more restrictive PAM of KTTG (SEQ ID NO: 3870) which was shown in Example 31 to be more active in mammalian cells, a total of 42 potential sgRNA were identified within human hao-1 exons 1 through 4 (Table 11).

TABLE 11

Spacer sequences for MG29-1 identified in exons 1 to 4 of the human hao-1 gene

| sgRNA name | Spacer (DNA sequence, no PAM) | SEQ ID NO: | PAM | SEQ ID NO: | Specificity score |
|---|---|---|---|---|---|
| hH29-1 | GCATGTTGTTCATAATCATTGA | 4184 | TTTA | 4226 | 96.25% |
| hH29-2 | GAAGTACTGATTTAGCATGTTG | 4185 | TTTG | 4227 | 98.37% |
| hH29-3 | TATCAATGATTATGAACAACAT | 4186 | TTTG | 4228 | 87.44% |
| hH29-4 | CCCCAGACCTGTAATAGTCATA | 4187 | TTTG | 4229 | 99.04% |
| hH29-5 | TTCATCATTTGCCCCAGACCTG | 4188 | TTTC | 4230 | 95.59% |
| hH29-6 | TTACCTGGAAAATGCTGCAATA | 4189 | TTTC | 4231 | 80.36% |
| hH29-7 | CTTACCTGGAAAATGCTGCAAT | 4190 | TTTT | 4232 | 79.67% |
| hH29-8 | GCTGATAATATTGCAGCATTTT | 4191 | TTTG | 4233 | 92.20% |
| hH29-9 | AAAAATAAATTTTCTTACCTGG | 4192 | TTTA | 4234 | 58.56% |
| hH29-10 | AAAAAATAAATTTTCTTACCTG | 4193 | TTTT | 4235 | 44.93% |
| hH29-11 | ATTTTATTTTTAATTCTAGAT | 4194 | TTTT | 4236 | 10.22% |

TABLE 11-continued

Spacer sequences for MG29-1 identified in exons 1 to 4 of the human hao-1 gene

| sgRNA name | Spacer (DNA sequence, no PAM) | SEQ ID NO: | PAM | SEQ ID NO: | Specificity score |
| --- | --- | --- | --- | --- | --- |
| hH29-12 | TTTTATTTTTAATTCTAGATG | 4195 | TTTA | 4237 | 10.64% |
| hH29-13 | ATTTTTTAATTCTAGATGGAAG | 4196 | TTTT | 4238 | 70.62% |
| hH29-14 | TTTTTTAATTCTAGATGGAAGC | 4197 | TTTA | 4239 | 44.69% |
| hH29-15 | TTAATTCTAGATGGAAGCTGTA | 4198 | TTTT | 4240 | 99.13% |
| hH29-16 | TAATTCTAGATGGAAGCTGTAT | 4199 | TTTT | 4241 | 97.06% |
| hH29-17 | AATTCTAGATGGAAGCTGTATC | 4200 | TTTT | 4242 | 96.74% |
| hH29-18 | ATTCTAGATGGAAGCTGTATCC | 4201 | TTTA | 4243 | 98.94% |
| hH29-19 | AGCAACATTCCGGAGCATCCTT | 4202 | TTTC | 4244 | 97.81% |
| hH29-20 | AGGACAGAGGGTCAGCATGCCA | 4203 | TTTT | 4245 | 97.75% |
| hH29-21 | GGACAGAGGGTCAGCATGCCAA | 4204 | TTTA | 4246 | 100.00% |
| hH29-22 | TTTCTCAGCCTGTCAGTCCCTG | 4205 | TTTC | 4247 | 88.19% |
| hH29-23 | TCAGCCTGTCAGTCCCTGGGAA | 4206 | TTTC | 4248 | 100.00% |
| hH29-24 | TGACAGTGGACACACCTTACCT | 4207 | TTTG | 4249 | 100.00% |
| hH29-25 | AATCTGTTACGCACATCATCCA | 4208 | TTTG | 4250 | 100.00% |
| hH29-26 | ATGCATTTCTTATTTAGGATG | 4209 | TTTT | 4251 | 80.79% |
| hH29-27 | TGCATTTCTTATTTAGGATGA | 4210 | TTTA | 4252 | 76.81% |
| hH29-28 | TTATTTTAGGATGAAAAATTTT | 4211 | TTTC | 4253 | 52.38% |
| hH29-29 | AGGATGAAAAATTTTGAAACCA | 4212 | TTTT | 4254 | 90.56% |
| hH29-30 | GGATGAAAAATTTTGAAACCAG | 4213 | TTTA | 4255 | 89.17% |
| hH29-31 | CTCAGGAGAAAATGATAAAGTA | 4214 | TTTC | 4256 | 90.51% |
| hH29-32 | cCTCAGGAGAAAATGATAAAGT | 4215 | TTTT | 4257 | 88.16% |
| hH29-33 | GAAACCAGTACTTTATCATTTT | 4216 | TTTT | 4258 | 86.74% |
| hH29-34 | AAACCAGTACTTTATCATTTTC | 4217 | TTTG | 4259 | 91.02% |
| hH29-35 | TCATTTTCTCCTGAGGAAAATT | 4218 | TTTA | 4260 | 83.29% |
| hH29-36 | CTCCTGAGGAAAATTTTGGAGA | 4219 | TTTT | 4261 | 91.88% |
| hH29-37 | TCCTGAGGAAAATTTTGGAGAC | 4220 | TTTC | 4262 | 96.24% |
| hH29-38 | GCCACATATGCAGCAAGTCCAC | 4221 | TTTA | 4263 | 100.00% |
| hH29-39 | GGAGACGACAGTGGACTTGCTG | 4222 | TTTT | 4264 | 90.43% |
| hH29-40 | GAGACGACAGTGGACTTGCTGC | 4223 | TTTG | 4265 | 99.01% |
| hH29-41 | ATATCTTCCCAGCTGATAGATG | 4224 | TTTG | 4266 | 99.18% |
| hH29-42 | CAACAATTGGCAATGATGTCAG | 4225 | TTTG | 4267 | 95.26% |

Guides that spanned the intron/exon boundaries were included because such guides may create indels that interfere with splicing. Using Geneious Prime the spacer sequences of these 42 guides were searched against the human genome and a specificity score was assigned by the software based on the alignment to the human genome. A higher specificity score indicates a lower probability of that guide recognizing 1 or more sequences in the human genome other than the site to which the spacer was designed. The specificity scores ranged from 10% to 100% with 25 guides having a specificity score greater than 90% and 33 guides having a specificity score greater than 80%. This analysis demonstrates that guides targeting exonic regions of a human gene with high specificity scores can be readily identified and it is expected that a number of highly active guides would be identified.

Example 33—Comparison of the Editing Potency of Nucleases Described Herein to that of spCas9 in Mouse Liver Cells The CRISPR Cas9 nuclease from the bacterial species *Streptococcus pyogenes* (spCas9) is widely used for genome editing and is among the most active RNA guided nucleases identified. The relative potency of MG29-1 compared to spCas9 was evaluated by nucleofection of different doses of RNP in the mouse liver cell line Hepa1-6. sgRNA targeting intron 1 of mouse albumin were used for both nucleases. For MG29-1, the sgRNA mAlb29-1-8 identified in Example 29 was selected. Guide mAlb29-1-8 (see Example 29) was chemically synthesized incorporating chemically modifications called AltR1/AltR2 (Integrated DNA Technologies) designed to improve the potency of guides for the Type V nuclease cpf1 that has a similar sgRNA structure as MG29-1. For spCas9 a sgRNA that efficiently edited mouse albumin intron 1 was identified by testing 3 guides selected from an in-silico screen. The spCas9 protein used in these studies was obtained from a commercial supplier (Integrated DNA technologies AltR-sPCas9).

Figure 52:
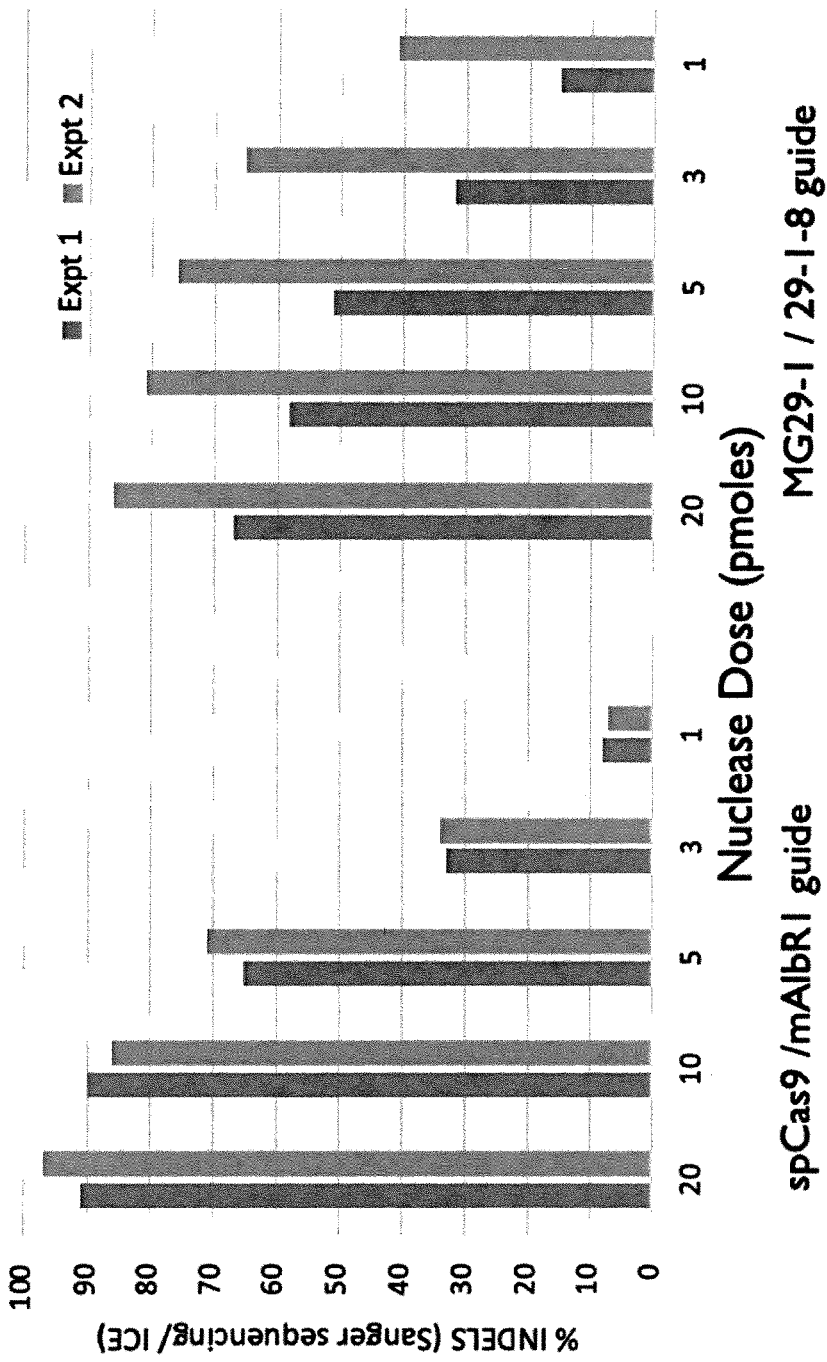
FIG. 52 shows the editing efficiency of MG29-1 compared to spCas9 in mouse liver cell line Hepa1-6 nucleofected with RNP as in Example 29.

The sgRNA mAlbR1 (spacer sequence TTAGTATAG-CATGGTCGAGC) was chemically synthesized and incorporated chemical modifications comprised of 2' O methyl bases and phosphorothioate (PS) linkages on the 3 bases on both ends of the guide that improve potency in cells. The mAlbR1 sgRNA generated INDELS at a frequency of 90% when RNP comprised of 20 pmol spCas9 protein/50 pmol of guide was nucleofected into Hepa1-6 cells indicating that this is a highly active guide. RNP formed with a range of nuclease protein from 20 pmoles to 1 pmole and a constant ratio of protein to sgRNA of 1:2.5 were nucleofected into Hepa1-6 cells. INDELS at the target site in mouse albumin intron 1 were quantified using Sanger sequencing of the PCR amplified genomic DNA and ICE analysis. The results shown in FIG. 52 demonstrate that MG29-1 generated a higher percentage of INDELS than spCas9 at lower RNP doses when the editing was not saturating. These data indicate that MG29-1 is at least as active and potentially more active than spCas9 in liver-derived mammalian cells.

Example 34—Engineering Sequence Variants of Nucleases Described Herein and Evaluation in Mouse Liver Cells In order to improve the editing efficiency of MG29-1 a set of mutations substituting one or two amino acids was introduced in the MG29-1 coding region. The set of amino acid substitutions was determined by alignment to *Acidaminococcus* sp. Cas12a (AsCas12a). Structured-guide engineering (Kleinstiver, et al, Nat Biotechnol. 2019, 37 276-282) substituted different amino acid in AsCas12a with the goal of altering or improving PAM binding. Four amino acid substitutions in AsCas12a: S170R, E174R, N577R and K583R, showed higher editing efficiencies with canonical and non-canonical PAMs. Sites matching these substitutions were identified in MG29-1 by multiple alignment and correspond to: S168R, E172R, N577R and K583R in MG29-1.

In order to test the single amino acid substitutions a 2-plasmid delivery system was used. Expression plasmids encoding MG29-1 with single amino acid substitutions were constructed using standard molecular cloning techniques. One plasmid encoded for MG29-1 under CMV promoter, the second plasmid contained the mAlb29-1-8 sgRNA (see Table 8), which has high editing efficiency in Hepa 1-6 cells. Transcription of the guide was driven by a human U6 promoter. Confirmation of initial results from single amino acid substitutions using the 2-plasmid system and testing of double amino acid substitutions was done using in vitro transcribed (IVT) mRNA encoding MG29-1 (see Example 33 for details of how the IVT mRNA was made) and chemically synthesized guides incorporating the AltR1/AltR2 chemical modifications that had been optimized by Integrated DNA Technologies for Cpf1 (synthesized at Integrated DNA technologies). For delivery of the 2-plasmid system 100 ng of plasmid encoding MG29-1 and 400 ng of plasmid encoding the guide were mixed with Lipofectamine 3000, added to Hepa1-6 cells and incubated for 3 days prior to genomic DNA isolation.

For delivery of IVT mRNA and synthetic guides, 300 ng of mRNA and 120 ng of synthetic guide were mixed with Lipofectamine Messenger Max, added to cells and incubated for 2 days prior to genomic DNA isolation. Synthetic guides screened using IVT mRNA correspond to guides detailed in Table 8 but for simplicity the names of the guides in FIG. 53 have been shortened so that guide "mAlb29-1-1" is represented as g1-1, "mAlb29-1-8" is represented as g1-8 and so on. One guide targeting the human T cell receptor locus (TRAC) was also tested (35 TRAC on FIG. 53D). Guide 35 TRAC spacer is: GAGTCTCTCAGCTGGTACACGG (SEQ ID NO: 4268) with a TTTG PAM. Guide 35 TRAC was ordered with the same modifications as mentioned before. Genomic DNA and PCR amplification was performed as described in the previous example for MG29-1 editing of mouse albumin intron 1. For guide 35 TRAC, the human TRAC locus was amplified with Primer F: TGCTTTGCTGGGCCTTTTTC (SEQ ID NO: 4269), Primer R: ACAGTCTGAGCAAAGGCAGG (SEQ ID NO: 4270). The resulting 957 bp PCR product was purified as described previously. Editing was assessed by Sanger sequencing using primer ATCACGAGCAGCTGGTTTCT (SEQ ID NO: 4271).

Figure 53:
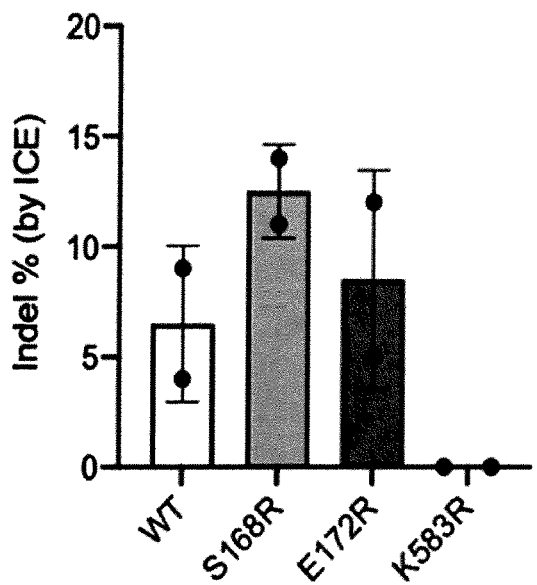
FIG. 53 shows the editing efficiencies in mammalian cells of MG29-1 variants with single and double amino acid substitutions compared to wild type MG29-1.
Figure 53:
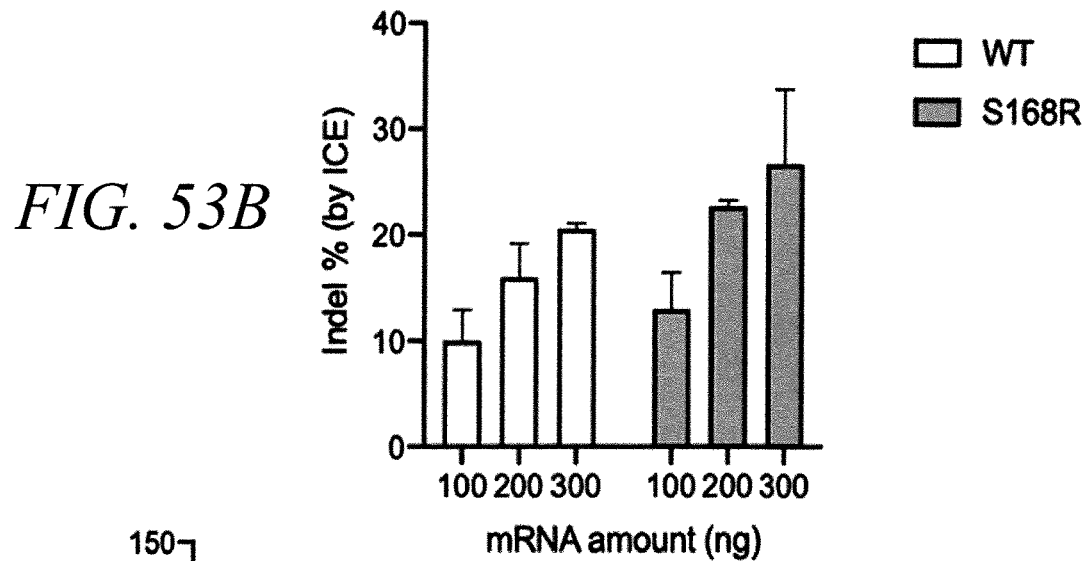
Figure 53:
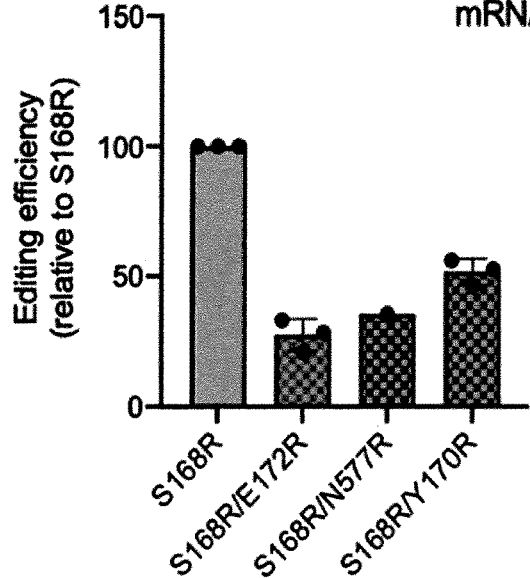
Figures 53, 53D:
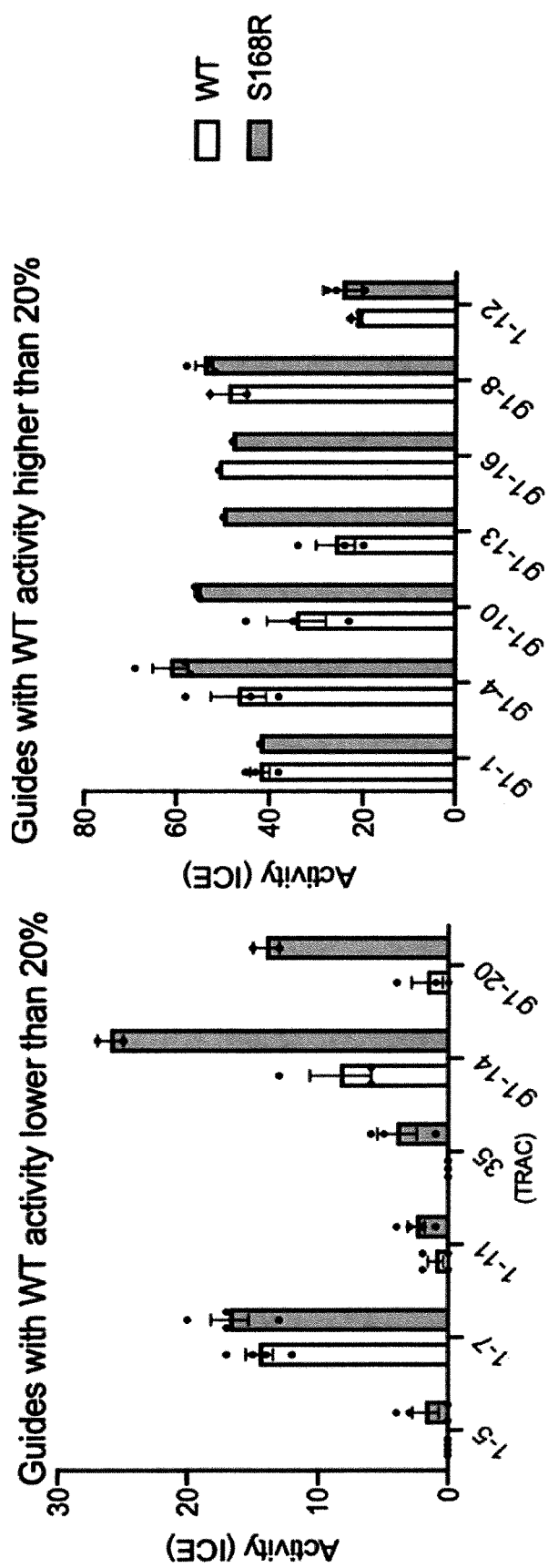
FIG. 53D depicts the editing efficiency in Hepa 1-6 and HEK293T cells transfected with MG29-1 WT vs S168R in combination with 13 guides. 12 guides correspond to guides in Table 7. Guide "35 (TRAC)" is a guide targeting the human locus TRAC.

Editing efficiency for mouse albumin intron 1 and human TRAC locus was quantified using Sanger sequencing of the PCR products followed by Inference of CRISPR Edits (ICE). Data representing up to 4 biological replicates are plotted in FIG. 53. The single amino acid substitution S168R demonstrated improved editing efficiency when using guide mAlb29-1-8 in the 2-plasmid system (FIG. 53A). Mutation E172R did not provide a major improvement with guide mAlb29-1-8 while the mutation K583R completely prevented editing with the mAlb29-1-8 guide. Transfection with MG29-1 mRNA and synthetic guide mAlb29-1-8 confirmed the results from plasmid transfection (FIG. 53B). The single amino acid substitution S168R conferred higher editing efficiency across the different concentrations of mRNA tested with guide mAlb29-1-8 (FIG. 53B). The double amino acid substitutions of S168R with E172R (substitution that did not impair activity alone as seen in FIG. 53A), or N577R (a substitution not tested in MG29-1 plasmid transfection but conferred higher editing efficiency of cpf1) and Y170R (which it was hypothesized might improve editing efficiency based on the predicted MG29-1 protein structure) were tested and compared to the single S168R mutant.

None of the double mutations conferred improved editing efficiencies under the conditions tested (FIG. 53C). The editing efficiencies of the S168R variant of MG29-1 and MG29-1 WT were compared in parallel with 12 guides targeting mouse albumin intron 1 and 1 guide targeting the human T cell receptor locus (TRAC). The S168R variant of MG29-1 exhibited improved editing efficiency with all 13 guides with some guides benefiting more than others (FIG. 4d). Importantly S168R did not impair mammalian editing efficiency for any of the guides tested. These results demonstrate that the S168R (serine at amino acid position 168 changed to arginine) variant of MG29-1 has improved editing activity and which is advantageous in identifying highly active guides for therapeutic use.

Example 35—Identification of Chemical Modifications of the sgRNA of Nucleases Described Herein that Improve Guide Stability and Improve Editing Efficiency in Mammalian Cells RNA molecules are inherently unstable in biological systems due to their sensitivity to cleavage by nucleases. Modification of the native chemical structure of RNA has been widely used to improve the stability RNA molecules used for RNA interference (RNAi) in the context for therapeutic drug development (Corey, J Clin Invest. 2007 Dec. 3; 117(12): 3615-3622, J. B. Bramsen, J. Kjems Frontiers in Genetics, 3 (2012), p. 154). The introduction of chemical modifications to the nucleobases or the phosphodiester backbone of RNA have been pivotal in improving the stability and thus the potency of short RNA molecules in vivo. A wide range of chemical modifications with different properties in terms of stability against nucleases and affinity to complementary DNA or RNA have been developed.

Similar chemical modifications have been applied to the guide RNA for CRISPR Cas9 nucleases (Hendel et al, Nat Biotechnol. 2015 September; 33(9): 985-989, Ryan et al Nucleic Acids Res 2018 Jan. 25; 46(2):792-803., Mir et al Nature Communications volume 9, Article number: 2641 (2018), O'Reilly et al Nucleic Acids Res 2019 47, 546-558, Yin et al Nature Biotechnology volume 35, pages 1179-1187 (2017), each of which is incorporated by reference herein in its entirety).

The MG29-1 nuclease is a novel nuclease with limited amino acid sequence similarity to known Type V CRISPR enzymes such as cpf1. While the sequence of the structural (backbone) component of the guide RNA identified for MG29-1 is similar to that of cpf1 it was not known what chemical modifications to the MG29-1 guide will enable improved stability while retaining activity. A series of chemical modifications of the MG29-1 sgRNA were designed in order to evaluate their impact on sgRNA activity in mammalian cells and stability in the presence of mammalian cell protein extracts.

We selected the sgRNA mAlb29-1-8 which was highly active in the mouse liver cell line Hepa1-6 when the guide contained a set of proprietary chemical modifications developed by IDT known as AltR1/AltR2 that were designed to improve the activity of the guide RNA for cpf1 and are available commercially (IDT). We selected to test 2 chemical modifications of the nucleobase; 2'-O-Methyl in which the 2' hydroxyl group is replaced with a methyl group, and 2'-fluoro in which the 2' hydroxyl group is replaced with a fluorine. Both 2'-O-Methyl and 2'-fluoro modifications improve resistance to nucleases. The 2'-O-methyl modification is a naturally occurring post-transcriptional modification of RNA and improves the binding affinity of RNA:RNA duplexes but has little impact on RNA:DNA stability. 2'-fluoro modified bases have reduced immunostimulatory effects and increase the binding affinity of both RNA: RNA and RNA:DNA hybrids (Pallan et al Nucleic Acids Res 2011 April; 39(8):3482-95, Chen et al Scientific Reports volume 9, Article number: 6078 (2019), Kawasaki, A. M. et al. J Med Chem 36, 831-841 (1993)).

The inclusion of phosphorothioate (PS) linkages in place of phosphodiester linkages between the bases was also evaluated. PS linkages improve resistance to nucleases (Monia et al Nucleic Acids, Protein Synthesis, and Molecular Genetics|Volume 271, ISSUE 24, P14533-14540, Jun. 14, 1996).

Figure 54:
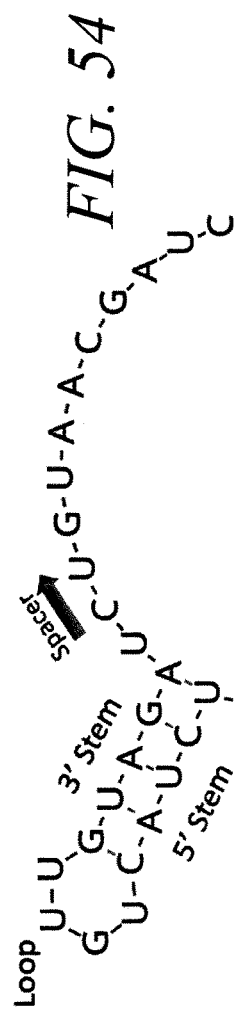
FIG. 54 shows the predicted secondary structure of the MG29-1 guide mAlb29-1-8 (SEQ ID NO: 4274).

The predicted secondary structure of the MG29-1 sgRNA with the spacer targeting mouse albumin intron 1 (mAlb29-1-8) is shown in FIG. 54. The stem-loop in the backbone portion of the guide was presumed to be critical for interaction with the MG29-1 protein based on what is known about other CRISPR-cas systems. Based on the secondary structure a series of chemical modifications was designed in different structural and functional regions of the guide. A modular approach was taken that allowed initial testing of guides with fewer chemical modifications that would inform which structural and functional regions of the guide could tolerate different chemical modifications without significant loss of activity. The structural and functional regions were defined as follows. The 3' end and 5' end of the guide are targets for exonucleases and can be protected by various chemical modifications including 2'-O-methyl and PS linkages, an approach that has been used to improve the stability of guides for spCas9 (Hendel et al, Nat Biotechnol. 2015 September; 33(9): 985-989).

The sequences comprising both halves of the stem and the loop in the backbone region of the guide were selected for modification. The spacer was divided into the seed region (first 6 nucleotides closest to the PAM) and the remaining 16 nucleotides of the spacer (referred as the non-seed region). In total 43 guides were designed and 39 were synthesized. All 43 guides contain the same nucleotide sequence but with different chemical modifications. The editing activity of 39 of the guides was evaluated in Hepa1-6 cells by nucleofection of RNP or by co-transfection of mRNA encoding MG29-1 and guide or by both methods. These two methods of transfection may impact the observed activity of the guide due to differences in the delivery to the cell.

When nucleofection of a RNP is used the guide and the MG29-1 protein are pre-complexed in a tube and then delivered to the cell using nucleofection in which an electric current is applied to the cells' suspension in the presence of the RNP. The electric current transiently opens pores in the cell membrane (and possibly the nuclear membrane as well) enabling cellular entry of the RNP driven by the charge on the RNP. Whether the RNP enters the nucleus via pores created by the electric current or via the nuclear localization signals engineered in the protein component of the RNP, or a combination of the two is unclear.

When co-transfection of mRNA and guide with a lipid transfection reagent such as Messenger MAX is used, the mixture of the two RNA forms a complex with the positively charged lipid and the complex enters the cells via endocytosis and eventually reaches the cytoplasm. In the cytoplasm the mRNA is translated into protein. In the case of an RNA guided nucleases such as MG29-1 the resulting MG29-1 protein will presumably form a complex with the guide RNA in the cytoplasm before entering the nucleus in a process mediated by the nuclear localization signals that were engineered into the MG29-1 protein.

Because translation of the mRNA into sufficient amounts of MG29-1 protein followed by the binding of the MG29-1 protein to the guide RNA takes a finite amount of time, the guide RNA may need to remain intact in the cytoplasm for longer than is the case when pre-formed RNP is delivered by nucleofection. Thus lipid-based mRNA/sgRNA co-transfection may require a more stable guide than is the case for RNP nucleofection which may result in some guide chemistries being active as RNP but inactive when co transfected with mRNA using cationic lipid reagents.

Guides mAlb298-1 to mAlb298-5 contain chemical modifications only on the 5' and 3' ends of the sequence using a mixture of 2'-O-methyl and 2' fluoro bases plus PS linkages. In comparison to the sgRNA without chemical modifications these guides were 7 to 11-fold more active when delivered via RNP demonstrating that end modifications to the guide improved guide activity, presumably through improved resistance to exonucleases. sgRNA mAlb298-1 to mAlb298-5 exhibited 64 to 114% of the editing activity of the guide containing the commercial chemical modifications (AltR1/AltR2). Guide 4, which contains the largest number of chemical modifications, was the least active of the end modified guides but was still 7-fold more active than the un-modified guide. Guide mALB298-30 contains three 2'-O methyl bases and 2 PS linkages at the 5' end and 4 2'-O methyl bases and 3 PS linkages at the 5' end and also exhibited activity about 10-fold higher than the unmodified guide and similar or slightly improved in the case of RNA co-transfection compared to mAlb298-1. These data demonstrate that 2'O-methyl combined with PS linkages on both ends of the MG29-1 guide significantly enhanced guide activity compared to an unmodified guide.

A combination of 2'-fluoro bases and PS linkages were also tolerated at the 3' end of the guide. Guide mALb298-28 contains three 2'-fluoro bases and 2 PS linkages on the 5' end and four 2'-fluoro bases and three PS linkages on the 3' end. This end modified guide retained good editing activity similar to the guides with 2'-O methyl and PS modifications on both ends demonstrating that 2'-fluoro can be used in place of 2'-O methyl to improve guide stability and retain editing activity.

The sgRNAs mALb298-6, mALb298-7, and mALb298-8 contain the same minimal chemical modifications on the both 5' and 3' ends present in mAlb298-1 plus PS linkages in different regions of the stem. PS linkages in the 3' stem (mALb298-6) and the 5' stem (mALb298-7) reduced activity by about 30% compared to mALb298-1 in the RNP nucleofection assay, indicating that these modifications could be tolerated. Larger reductions in activity were observed by lipid-based transfection.

Introducing PS linkages in both the 3' and 5' stems (mALb298-8) reduced activity by about 80% compared to mAlb298-1 in the RNP nucleofection assay and by more than 95% in the lipid transfection assay, indicating that the combination of two PS linkage modifications significantly impaired the function of the guide.

The sgRNA mAlb298-9 contains the same minimal chemical modifications on the both 5' and 3' ends present in mAlb298-1 plus PS linkages in the loop and exhibited similar activity as mAlb298-1 indicating that PS linkages in the loop were well tolerated.

The sgRNAs mAlb298-10, mAlb298-11, and mAlb298-12 contain the same minimal chemical modifications on the both 5' and 3' ends present in mAlb298-1 plus 2'-O methyl bases in different regions of the stem. Including 2'-O methyl bases in either the 3' stem (mAlb298-11) or the 5' stem (mAlb298-12) or both halves of the stem (mAlb298-10) was generally well tolerated with only small reductions in activity compared to mAlb298-1 with guide mAlb298-12 (5' stem modified) being the most active.

Guide mAlb298-14 contains the same minimal chemical modifications on the both 5' and 3' ends present in mAlb298-1 plus a combination of 2'-O-methyl bases and PS linkages in both halves of the stem and had no editing activity by RNP nucleofection or by lipid-based RNA co-transfection. This confirms and extends the result with mAlb298-8 that contained only PS linkages in both stems had retained low levels of activity and shows that extensive chemical modification of both halves of the stem makes the guide inactive.

The sgRNA mAlb298-13 contains the same minimal chemical modifications on the both 5' and 3' ends present in mAlb298-1 plus PS linkages spaced every other base throughout the remainder of the backbone and spacer except for in the seed region of the spacer. These modifications resulted in a dramatic loss of editing activity to close to background levels. While the purity of this guide was only about 50% compared to >75% for most of the guides, this alone could not have caused the complete loss of editing activity. Thus, distributing PS linkages in an essentially random fashion throughout the guide is not an effective approach to improve guide stability while retaining editing activity.

Guides mALb298-15 and mALb298-16 contain the same minimal chemical modifications on the both 5' and 3' ends present in mAlb298-1 plus extensive PS linkages in the backbone. While both guides retained about 35% of the activity of mAlb298-1 by RNP nucleofection they retained only 3% of the activity of mAlb298-1 by lipid-based RNA co-transfection indicating that extensive PS modification of the backbone significantly reduced editing activity. Combining the PS linkages in the backbone with PS linkages in the spacer region as in mAlb298-17 and mAlb298-18 resulted in further loss of activity consistent with the observation the random inclusion of PS linkages is blocks the ability of the guide to direct editing by MG29-1.

Guide mAlb298-19 contains the same chemical modifications in the spacer as mALb298-1 but in the backbone region the 5' end has additional 4 2'O-methyl bases and an additional 14 PS linkages. The activity of mAlb298-19 was about 40% of that of mAlb298-1 by RNP nucleofection but only 22% by RNA co-transfection demonstrating again that extensive chemical modifications in the backbone region of the guide are not well tolerated.

Guides mAlb298-20, mAlb298-21, mAlb298-22, and mAlb298-23 have identical chemical modifications in the backbone region comprised of a single 2'-O methyl and 2 PS linkages at the 5' end which are the same 5' end modifications as in mAlb298-1. The spacer regions of Guides mAlb298-20, mAlb298-21, mAlb298-22, and mAlb298-23 contain combinations of 2'-O-methyl and 2'-fluoro bases as well as PS linkages. The most active of these 4 guides was mAlb298-2 in which 2'-fluoro modifications were made on all bases in the spacer except for the 7 bases closest to the PAM (seed region) and the last base at the 3' end which was modified with a 2'-O-methyl and 2 PS linkages. This demonstrates that including 2'-fluoro modifications on most of the spacer except for the seed region did not significantly reduce activity and thus represents a good strategy to enhance guide stability.

Guides mAlb298-24, mAlb298-25, mAlb298-26, and mAlb298-8 have identical chemical modifications in the backbone. mAlb298-8 which has PS linkages in both halves on the stem had significantly reduced editing activity with only 24% and 2% of guide mAlb298-1 demonstrating that these PS linkages impaired activity. Interestingly, while mALb298-24 and mALb298-25 also had low editing activity the activity of mALb298-26 was improved compared to mAlb298-8 indicating that the additional modifications in mALb298-26 which comprise 2'-fluoro bases in 14 of the bases in the spacer (excluding the seed region) could rescue the reduced editing activity caused by the PS linkages in the stem. This provides additional evidence of the beneficial impact of 2'-fluoro bases in the spacer upon editing activity.

Guides mAlb298-27 and mAlb298-29 contain extensive base and PS modifications throughout the backbone and spacer regions had no activity again indicating that not all chemical modifications of the guide retain editing activity.

Based on the structure activity relationships obtained from the analysis of guides mALb298-1 to mALb298-30, an additional set of seven guides were designed and tested by RNP nucleofection and lipid-based RNA co-transfection of Hepa1-6 cells. These guides combined chemical modifications that were observed to retain good editing activity in guides mALb298-1 to mALb298-30. Guides mALb298-31 to mALb298-37 all contain end modifications comprised of at least one 2'-O methyl and 2 PS linkages at the 5' end and one 2'-O methyl and 1 PS linkage at the 5' end. In addition to the end modifications, combining 2'-O methyl bases in both halves of the stem with 2'fluoro bases in 14 bases of the spacer (excluding the seed region) as in mAlb298-31 resulted in editing activity that was slightly improved or similar to end modifications alone and 10-fold improved compared to the unmodified guide. Combining 2'-O methyl bases in just the 5' stem with 2'fluoro bases in 14 bases of the spacer (excluding the seed region) as in mALb298-32 resulted in a guide that was among the most active tested.

Similarly, combining PS linkages in just the loop with 2'fluoro bases in 14 bases of the spacer (excluding the seed region) as in mALb298-33 resulted in potent activity up to 15-fold higher than the unmodified guide. Guide mAlb298-37 combines more extensive 3' end modifications with 2'-O methyl bases in the 5' stem, PS linkages in the loop and 14 2'fluoro bases and 3 PS linkages in the spacer (excluding the seed region) and still retained editing activity similar to that of the AltR1/R2 modifications and significantly improved compared to the unmodified guide. mALb298-37 thus represents a heavily modified MG29-1 guide that retains potent editing activity in mammalian cells. Guide mAlb298-38 exhibited potent editing activity when delivered as a RNP but was completely inactive when delivered to cells by lipid-based RNA co-transfection suggesting that thus guide may have some unexpected sensitivity to nucleases. Guide mALb298-39 which is identical to guide mAlb298-37 except that it has 11 fewer 2'-fluoro bases and 1 less PS linkage in the spacer had the highest editing activity when considering both RNP and mRNA transfection methods but has fewer chemical modifications than some of the other guide designs which might be detrimental in terms of performance in vivo.

Additional combinations of chemical modifications were designed to create mAlb298-40 to mALb298-43 that might also retain good editing activity while having more extensive chemical modifications. For example, in mAlb298-41 which also incorporates some DNA bases only 6 of the bases are un-modified ribonucleotides. Similarly, mAlb298-42 contains 2'-fluorogroups throughout the entire spacer and has 5 un-modified ribonucleotides. We envisage that testing of these and other guide chemical modifications will lead to one or more optimized designs. Nevertheless, within the set of guides mALb298-1 to mALb298-39 and particularly among the set of guides mALb298-31 to mALb298-39 we have identified guides with extensive chemical modifications that retain editing activity similar or superior to that of unmodified guides or guides with just end modifications.

In order to test the stability of the chemically modified guides compared to the guide with no chemical modification (native RNA), a stability assay using cell crude extracts was used. Crude cell extracts from mammalian cells were selected because they should contain the mixture of nucleases that a guide RNA will be exposed to when delivered to mammalian cells in vitro or in vivo. Hepa 1-6 cells were collected by adding 3 ml of cold PBS per 15 cm dish of confluent cells and releasing the cells from the surface of the dish using a cell scraper. The cells were pelleted at 200 g for 10 min and frozen at −80° C. for future use. For the stability assays, cells were resuspended in 4 volumes of cold PBS (e.g. for a 100 mg pellet cells were resuspended in 400 µl of cold PBS). Triton X-100 was added to a final concentration of 0.2% (v/v), cells were vortexed for 10 seconds, put on ice for 10 minutes and vortexed again for 10 seconds. Triton X-100 is a mild non-ionic detergent that disrupts cell membranes but does not inactivate or denature proteins at the concentration used.

Figure 55:
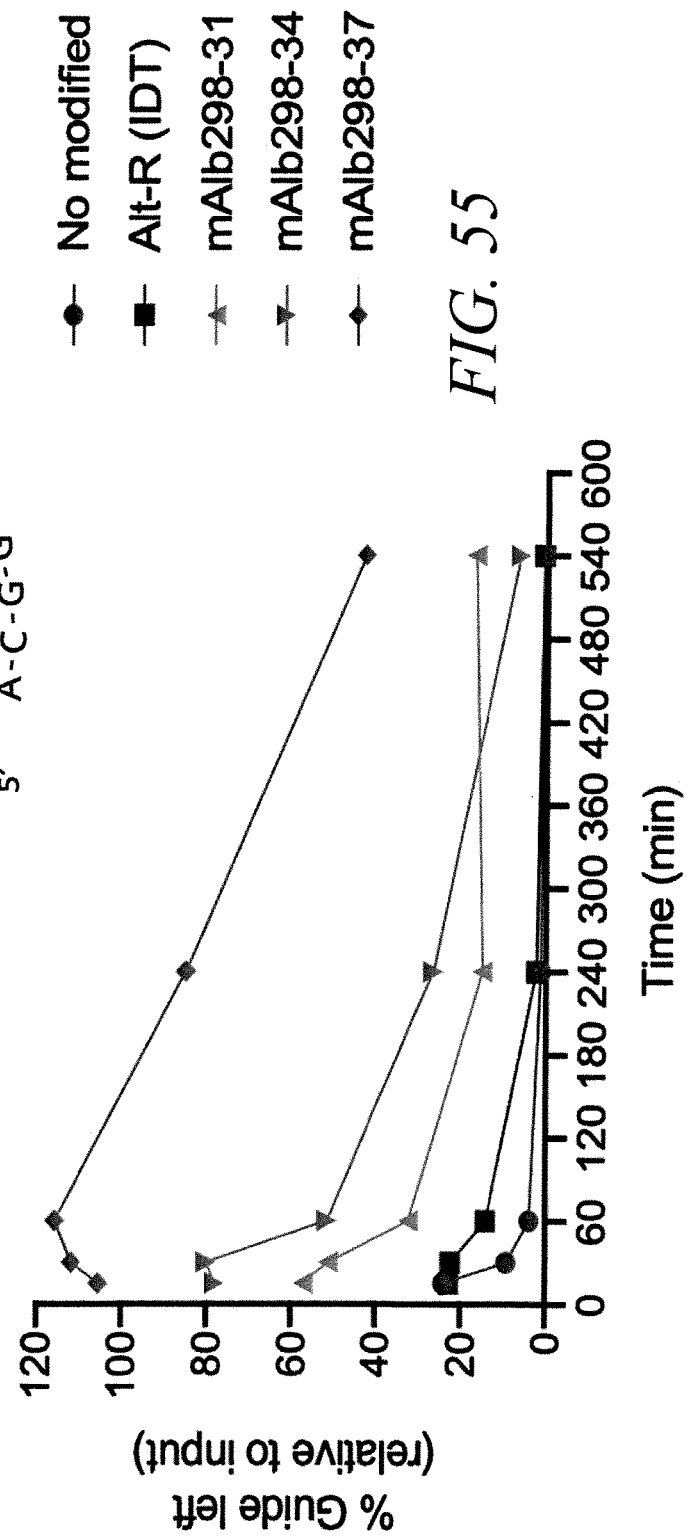
FIG. 55 shows the impact of chemical modifications of the MG29-1 sgRNA sequence upon the stability of the sgRNA in whole cell extracts of mammalian cells.

Stability reactions were set up on ice and consisted of 20 µl of cell crude extract with 100 fmoles of each guide (1111 of a 100 nM stock). Six reactions were set up per guide consisting of: input, 15 min, 30 min, 60 min, 240 min and 540 min (The time in minutes referring to the length of time each sample was incubated). Samples were incubated at 37° C. from 15 minutes up to 540 min while the input control was left on ice for 5 minutes. After each incubation period the reaction was stopped by adding 300 µl of a mixture of phenol and guanidine thiocyanate (Tri reagent, Zymo Research) which immediately denatures all proteins and efficiently inhibits ribonucleases and facilitates the subsequent recovery of RNA. After adding Tri Reagent the samples were vortexed for 15 seconds and stored at −20° C. RNA was extracted from the samples using Direct-zol RNA miniprep kit (Zymo Research) and eluted in 100 µl of nuclease-free water. Detection of the modified guide was performed using Taqman RT—qPCR using the Taqman miRNA Assay technology (Thermo Fisher) and primers and probes designed to specifically detect the sequence in the mAlb298 sgRNA which is the same for all of the guides. Data was plotted as a function of percentage of sgRNA remaining in relation to the input sample. The guide with no chemical modifications was the most rapidly eliminated when incubated with the cell extract (FIG. 55) with more than 90% of the guide degraded within 30 minutes. The guide with the AltR1/AltR2 (AltR in FIG. 55) chemical modifications was slightly more stable in the presence of cell extract than the un-modified guide with about 80% of the guide degraded in 30 minutes. Guide mALb298-31 that contains chemical modifications at both ends as well as 2' O-methyl bases in both stems and 2'-fluoro bases at all positions of the spacer except for the seed region was significantly more stable than either unmodified guide or the AltR guide.

Guide mAlb298-34 exhibited improved stability compared to guide mALb298-31. Guide mALb298-34 differs to guide mALb298-31 only in the chemical modifications within the spacer. mALb298-34 has 9 fewer 2'-Fluoro bases in the spacer than mALb298-31 but contains 4 PS linkages in the spacer compared to 2 PS linkages in mALb298-31. Because 2'-fluoro bases improve the stability of RNA this suggests that the additional PS linkages in the spacer were responsible for the improved stability of mALb298-34 compared to mALb298-31.

Guide mALb298-37 was the most stable of all the guides tested and was significantly more stable than mALb298-34 with 80% of the guide remaining after 240 min (4 h) compared to 30% for mALb298-34. The chemical modifications of mALb298-37 differ from guide mALb298-34 in both the spacer and backbone regions. mALb298-37 has an additional two 2'-O-methyl groups and 2 additional PS linkages at the 5' end. In addition, the loop region of mALb298-37 contains PS linkages and does not contain the 2'-O-methyl groups present in the second half of the stem in mALb298-34. In addition, the spacer of mALb298-37 contains 9 more 2'-fluoro bases but the same number of PS linkages as mALb298-34 albeit in different locations.

Overall, these data suggest that additional PS linkages at the 5' end of the spacer and in the loop of the backbone region significantly improve stability of the guide RNA. Guide mALb298-37 which exhibited the greatest stability in the cell extracts among the guides tested also exhibited potent editing activity in Hepa1-6 cells that was similar or improved compared to the AltR1/Altr2 modifications and improved compared to chemical modifications of the 5' and 3' ends only.

TABLE 12

Impact of chemical modifications of the MG29-1 sgRNA sequence upon editing activity in mammalian cells

| sgRNA name | sgRNA sequence | SEQ ID NO: | Editing activity (% of AltR1/AltR2 control) | |
|---|---|---|---|---|
| | | | RNP | mRNA |
| mAlb298-1_AltR1/R2 | /AltR1/rCrUrUrArArUrUrUrCrUrArCrUrGrUrUrGrUrArGrArUrCrUrGrUrArArCrGrArUrCrGrGrArArCrUrGrGrCrA/AltR2/ | N/4272 | 100 | 100 |
| mAlb298-0 | rCrUrUrArArUrUrUrCrUrArCrUrGrUrUrGrUrArGrArUrCrUrGrUrArArCrGrArUrCrGrGrArArCrUrGrGrCrA | 4272 | 13.5 | NT |
| mAlb298-1 | mC*rU*rUrArArUrUrUrCrUrArCrUrGrUrUrGrUrArGrArUrCrUrGrUrArArCrGrArUrCrGrGrArArCrUrGrG*rC*mA | 4273 | 114.7 | 76.2 |
| mAlb298-2 | mC*rU*rU*rArArUrUrUrCrUrArCrUrGrUrUrUrGrUrArGrArUrCrUrGrUrArArCrGrArUrCrGrGrArArCrUrG*rG*rC*mA | 4274 | 111.7 | 70.2 |
| mAlb298-3 | mC*mU*rU*rArArUrUrUrCrUrArCrUrGrUrUrUrGrUrArGrArUrCrUrGrUrArArCrGrArUrCrGrGrArArCrUrG*rG*mC*mA | 4275 | 100.2 | 63.7 |
| mAlb298-4 | mC*mU*mU*rArArUrUrUrCrUrArCrUrGrUrUrUrGrUrArGrArUrCrUrGrUrArArCrGrArUrCrGrGrArArCrUrG*mG*mC*mA | 4276 | 72.5 | 69.6 |
| mAlb298-5 | mC*rU*rUrArArUrUrUrCrUrArCrUrGrUrUrUrGrUrArGrArUrCrUrGrUrArArCrGrArUrCrGrGrArArCrUrG*/i2FG//i2FC/*/32FA/ | 4277 | 76.9 | 87.5 |
| mAlb298-6 | mC*rU*rUrArArUrUrUrCrUrArCrUrGrUrUrUrG*rU*rA*rG*rArUrCrUrGrUrArArCrGrArUrCrGrGrArArCrUrGrG*rC*mA | 4278 | 89.4 | 40.4 |
| mAlb298-7 | mC*rU*rUrArArUrU*rU*rC*rU*rArCrUrGrUrUrGrUrArGrArUrCrUrGrUrArArCrGrArUrCrGrGrArArCrUrGrG*rC*mA | 4279 | 83.2 | 24.5 |
| mAlb298-8 # | mC*rU*rUrArArUrU*rU*rC*rU*rArCrUrGrUrUrG*rU*rA*rG*rArUrCrUrGrUrArArCrGrArUrCrGrGrArArCrUrGrG*rC*mA | 4280 | 28.4 | 2.6 |
| mAlb298-9 | mC*rU*rUrArArUrUrUrCrUrArCrU*rG*rU*rU*rGrUrArGrArUrCrUrGrUrArArCrGrArUrCrGrGrArArCrUrGrG*rC*mA | 4281 | 110.9 | 87.5 |
| mAlb298-10 | mC*rU*rUrArArUrUmUmCmUmArCrUrGrUrUrGmUmAmGmArUrCrUrGrUrArArCrGrArUrCrGrGrArArCrUrGrG*rC*mA | 4282 | 87.5 | 61.6 |
| mAlb298-11 | mC*rU*rUrArArUrUrUrCrUrArCrUrGrUrUrGmUmAmGmArUrCrUrGrUrArArCrGrArUrCrGrGrArArCrUrGrG*rC*mA | 4283 | 94.5 | 63.5 |
| mAlb298-12 | mC*rU*rUrArArUrUmUmCmUmArCrUrGrUrUrGrUrArGrArUrCrUrGrUrArArCrGrArUrCrGrGrArArCrUrGrG*rC*mA | 4284 | 121.8 | 84.0 |

TABLE 12-continued

Impact of chemical modifications of the MG29-1 sgRNA sequence upon editing activity in mammalian cells

| sgRNA name | sgRNA sequence | SEQ ID NO: | Editing activity (% of AltR1/AltR2 control) | |
|---|---|---|---|---|
| | | | RNP | mRNA |
| mAlb298-13 # | mC*rU*rU*rArA*rUrU*rUrC*rUrA*rCrU*rGrU*rUrG*rUrA*rGrA*rUrCrUrGrUrArA*rCrG*rArU*rCrG*rGrG*rArA*rCrU*rGrG*mC*mA | 4285 | 1.0 | 0.0 |
| mAlb298-14 | mC*rU*rUrArArUrU*mU*mC*mU*mArCrUrGrUrUrG*mU*mA*mG*mArUrCrUrGrUrArArCrGrArUrCrGrGrGrArArCrUrGrG*rC*mA | 4286 | 0.0 | 0.0 |
| mAlb298-15 # | mC*rU*rU*rArArU*rU*rU*rC*rU*rA*rC*rU*rG*rU*rU*rG*rU*rA*rG*rA*rUrCrUrGrUrArArCrGrArUrCrGrGrGrArArCrUrGrG*rC*mA | 4287 | 39.3 | 2.4 |
| mAlb298-16 | mC*rU*rU*rArArU*rU*rU*rC*rUrArCrU*rG*rU*rU*rG*rU*rA*rG*rA*rUrCrUrGrUrArArCrGrArUrCrGrGrGrArArCrUrGrG*rC*mA | 4288 | 41.6 | 17 |
| mAlb298-17 # | mC*rU*rU*rArArU*rU*rU*rC*rUrArCrU*rG*rU*rU*rG*rU*rA*rG*rA*rUrCrUrGrUrArArA*rCrG*rArU*rCrG*rGrG*rArA*rCrU*rGrG*mC*mA | 4289 | 0.0 | 1.2 |
| mAlb298-18 | mC*rU*rU*rA*rA*rU*rU*rU*rC*rU*rA*rC*rU*rG*rU*rU*rG*rU*rA*rG*rA*rUrCrUrGrUrArA*rCrG*rArU*rCrG*rGrG*rArA*rCrU*rGrG*mC*mA | 4290 | 5.2 | 1.2 |
| mAlb298-19 | mG*mU*mA*mG*mC*rU*rU*TATA*rUrU*rUrC*rUrA*rCrU*rGrU*rUrG*rUrA*rGrA*rUrCrUrGrUrArArCrGrArUrCrGrGrGrArArCrUrGrG*rC*mA | 4291 | 50.1 | 17.4 |
| mAlb298-20 | mC*rU*rUrArArUrUrUrCrUrArCrUrGrUrUrGrUrArGrArArUrCrUrGrUrArArCrGrArUrCrGrGrGrArArC*/i2FU//i2FG/*/i2FG//i2FC/*/32FA/ | 4292 | 316 | 86.3 |
| mAlb298-21 | mC*rU*rUrArArUrUrUrCrUrArCrUrGrUrUrGrUrArGrArArUrCrUrGrUrArArC/i2FG//i2FA//i2FU//i2FC//i2FG//i2FG//i2FA//i2FA//i2FC//i2FU//i2FG//i2FG/*/i2FC/*mA | 4293 | 119.0 | 80.6 |
| mAlb298-22 | mC*rU*rUrArArUrUrUrCrUrArCrUrGrUrUrGrUrArGrArUrCrUrGrUrArArCrGrArUrCrGrGrGrA*rA/i2FC/*/i2FU//i2FG/*/i2FG//i2FC/*mA | 4294 | 25.1 | 98.8 |
| mAlb298-23 | mC*rU*rUrArArUrUrUrCrUrArCrUrGrUrUrGrUrArGrArUrCrUrGrUrArArCrGrArUrCrGrGrGrA/i2FA//i2FC//i2FU//i2FG//i2FG/*mC*mA | 4295 | 22.6 | 61.9 |
| mAlb298-24 | mC*rU*rUrArArUrU*rU*rC*rU*rArCrUrGrUrUrG*rU*rA*rG*rArUrCrUrGrUrArArCrGrArUrCrGrGrGrArArC*/i2FU//i2FG/*/i2FG//i2FC/*/32FA/ | 4296 | 7.4 | 12.2 |
| mAlb298-25 | mC*rU*rUrArArUrU*rU*rC*rU*rArCrUrGrUrUrG*rU*rA*rG*rArUrCrUrGrUrArArCrGrArUrCrGrG/i2FG//i2FA/*/i2FA//i2FC/*/i2FU//i2FG/*rGrC*mA | 4297 | 0.0 | 0.0 |
| mAlb298-26 | mC*rU*rUrArArUrU*rU*rC*rU*rArCrUrGrUrUrG*rU*rA*rG*rArUrCrUrGrUrArArC/i2FG//i2FA//i2FU//i2FC//i2FG//i2F | 4298 | 55.5 | 29.8 |

TABLE 12-continued

Impact of chemical modifications of the MG29-1 sgRNA sequence upon editing activity in mammalian cells

| sgRNA name | sgRNA sequence | SEQ ID NO: | Editing activity (% of AltR1/AltR2 control) | |
|---|---|---|---|---|
| | | | RNP | mRNA |
| | G//i2FG//i2FA//i2FA//i2FC//i2FU//i2FG//i2FG/*/i2FC/*mA | | | |
| mAlb298-27 | /52FC/*/i2FU/*/i2FU/*rUrUrArArU/i2FU//i2FU/rC*rU/i2FA/*/i2FC/rU/i2FG/*/i2FU//i2FU/rG/i2FU//i2FA//i2FG//i2FA/rU/i2FC/rUrG*rUrA/i2FA/rC/i2FG/*/i2FA/*/i2FU/*/i2FC/*/i2FG/rG*rGrA*rA/i2FC/*rU*/i2FG//i2FG/*/i2FC/*/32FA | 4299 | NT | 0 |
| mAlb298-28 | /52FC/*/i2FU/*/i2F/rUrUrArArUrUrCrArCrUrGrUrUrGrUrArGrArUrCrUrGrUrArArCrGrArCrGrGrArArCrU*/i2FG//i2FG/*/i2FC/*/52FA/ | 4300 | NT | 84.8 |
| mAlb298-29 | mC*mU*mU*rUrUrArArUmUmUrC*rUmA*mCrUmG*mUmUrGmUmAmGmArUrCrUrG*rUrAmArCmG*mA*mU*mC*mGrG*rGrA*rAmC*rU*mGmG*mC*mA | 4301 | 0.0 | 0.0 |
| mAlb298-30 | mC*mU*mUrUrUrArArUrUrUrCrUrArCrUrGrUrUrGrUrArGrArUrCrUrGrUrArArCrGrArUrCrGrGrArArCrU*mGmG*mC*mA | 4302 | 101.1 | 1054 |
| mAlb298-31 | mC*rU*rUrArArUrUmUmCmUmArCrUrGrUrUrGmUmAmGmArUrCrUrGrUrArArC/i2FG//i2FA//i2F0//i2FC//i2FG//i2FG//i2FA//i2FA//i2FC//i2FU//i2FG//i2FG/*/i2FC/*mA | 4303 | 140.5 | 744 |
| mAlb298-32 | mC*rU*rUrArArUrUmUmCmUmArCrUrGrUrUrGrUrArGrArUrCrUrGrUrArArC/i2FG//i2FA//i2FU//i2FC//i2FG//i2FG//i2FG//i2FA//i2FA//i2FC//i2FU//i2FG//i2FG*/i2FC/*mA | 4304 | 1703 | 911 |
| mAlb298-33 | mC*rU*rUrArArUrUrCrUrArCrU*rG*rU*rUrGrUrArGrArUrCrUrGrUrArArC/i2FG//i2FA//i2FU//i2FC//i2FG//i2FG//i2FG//i2FA//i2FA//i2FC//i2FU//i2FG/*/i2FC/*mA | 4305 | 202.7 | 644 |
| mAlb298-34 | mC*rU*rUrArArUrUmUmCmUmArCrUrGrUrUrGmUmAmGmArUrCrUrGrUrArArCrGrArUrCrGrGrGrA*rA/i2FC/*/i2FU//i2FG/*/i2FG//i2FC/*mA | 4306 | 818 | 107.0 |
| mAlb298-35 | mC*rU*rUrArArUrUrCrUrArCrU*rG*rU*rU*rGrUrArGrArUrCrUrGrUrArArCrGrArUrCrGrGrA*rA/i2FC/*/i2FU//i2FG/*/i2FG//i2FC/*mA | 4307 | 24.3 | 67.9 |
| mAlb298-36 | mC*rU*rUrArArUrUmUmCmUmArCrUrGrUrUrGrUrArGrArUrCrUrGrUrArArCrGrArUrCrGrGrGrA*rA/i2FC/*/i2FU//i2FG/*/i2FG//i2FC/*mA | 4308 | 412 | 116.2 |
| mAlb298-37 | mC*mU*mU*U*rUrArArUrUmUmCmUmArCrU*rG*rU*rU*rGrUrArGrArUrCrUrGrUrArArC/i2FG//i2FA//i2FU//i2FC//i2FG//i2FG//i2FG//i2FA//i2FA//i2FC/*/i2FU/*/i2FG//i2FG/*/i2FC/*mA | 4309 | 164.9 | 84.5 |
| mAlb298-38 | mC*mU*mU*rU*rUrArArUrUmUmCmUmArCrU*rG*rU*rU*rGmUmAmGmArUrCrUrGrUrArArC/i2FG//i2FA//i2FU//i2FC//i2FG//i2FG//i2FG//i2FA//i2FA//i2FC/*/i2FU/*/i2FG//i2FG/*/i2FC/*mA | 4310 | 140.5 | 0.0 |

TABLE 12-continued

Impact of chemical modifications of the MG29-1 sgRNA sequence upon editing activity in mammalian cells

| sgRNA name | sgRNA sequence | SEQ ID NO: | Editing activity (% of AltR1/AltR2 control) | |
|---|---|---|---|---|
| | | | RNP | mRNA |
| mAlb298-39 | mC*mU*mU*rU*rUrArArUrUmUmCmUmArCrU*rG*rU*rU*rGrUrArGrArUrCrUrGrUrArArCrGrArUrCrGrGrGrArArCrU*/i2FG//i2FG/*/i2FC/*mA | 4311 | 135.1 | 114.0 |
| mAlb298-40 | mC*mU*mU*U*UAAUUmUmCmUmACU*G*U*U*GUAGAU/i2FC//i2FU//i2FG//i2FU//i2FA//i2FA//i2FA//i2FC//i2FG//i2FA//i2FU//i2Fc//i2FG//i2FG//i2FA//i2FA//i2FC/*/i2FU/*/i2FG//i2FG/*/i2FC/*mA | 4312 | NT | NT |
| mAlb298-41 | mC*mU*mU*U*UAAUUmUmCmUmACU*G*U*U*dGdTdAdGdAdT/i2FC//i2FU//i2FG//i2FU//i2FA//i2FA//i2FC//i2FG//i2FA//i2Fu//i2Fc//i2FG//i2FG//i2FG//i2FA//i2FA//i2FC/*/i2FU/*/i2FG//i2FG/*/i2FC/*mA | 4313 | NT | NT |
| mAlb298-42 | mC*mU*mU*U*UAAUUmUmCmUmACU*G*U*U*/i2FG//i2FU//i2FA//i2FG//i2FA//i2FU//i2FC//i2FU//i2FG//i2FU//i2FA//i2FA//i2Fc//i2FG//i2FA//i2Fu//i2Fc//i2FG//i2FG//i2FG//i2FA//i2FA//i2Fc/*/i2FU/*/i2FG//i2FG/*/i2FC/*mA | 4314 | NT | NT |
| mAlb298-43 | mC*mU*mU*U*UAAUUmUmCmUmAmCU*G*U*U*GUAGAU/i2FC//i2FU//i2FG//i2FU//i2FA//i2FA//i2FC//i2FG//i2FA//i2FU//i2Fc//i2FG//i2FG//i2FA//i2FA//i2FC/*/i2FU/*/i2FG//i2FG/*/i2FC/*mA | 4315 | NT | NT |

: these guides had less than 75% purity based on analytical HPLC with purity ranging from 54 to 64%. All other guides exceeded 75% purity
NT: not tested
Nomenclature of chemical modifications: a "/" is used to separate bases with 2'-flourine modifications, m; 2'-O-methyl base (for example a A base with 2'-O-methyl modification is written as mA), i2F; internal 2'-flourine base (for example an internal C with 2'-flourine modification is written as /i2FC/), 52F; 2'-flourine base at the 5' end of the sequence (for example a 5' C with 2'-flourine modification is written as /52FC/), 32F; 2'-flourine base at the 3' end of the sequence (for example a 3' A base with 2'-flourine modification is written as /32FA/), r; native RNA linkage comprising the sugar ribose (fro example the ribose or RNA form of the A base is written rA), d; deoxyribose sugar (DNA) linkage (for example a deoxyribose form of the A base is written dA), *; between bases in which one of the oxygen molecules in the phosphodiester bond is replaced with sulfur; AltR1 and AltR2 refer to IDT technologies' proprietary 5' and 3' AltR modifications Example 36—Therapeutic Gene Editing in Mice Using Nucleases Described Herein Gene editing platforms described herein have the potential to effect reparative alterations in vivo. Liver tissue is an example of a tissue that can be advantageously targeted using the gene editing compositions and systems described herein for in vivo gene editing, for example by introduction of indels that function to knock down expression of deleterious genes and/or that are used to replace defective genes. For example, several inherited diseases arise from defects in proteins expressed primarily in the liver, and in vivo delivery to the liver has been proven safe and effective in clinical trials of adeno-associated virus (AAV) vectors. Lipid nanoparticles have also been shown to deliver nucleic acids and approved drugs for RNAi strategies. Liver tissue also includes appropriate cellular machinery for efficient secretion of proteins into the systemic circulation.

Subjects having a condition in Table 13 or Table 14 are selected for gene editing therapy. For example, a human or mouse model subject having hemophilia A is identified for treatment with gene replacement therapy using a gene editing platform.

TABLE 13

Some Indications for Subject Selection in Therapeutic Gene Replacement

| | | | |
|---|---|---|---|
| Hemophilia A | Factor VIII | | 1 in 5,000 males |
| Hemophilia A | Factor VIII | Secreted | 1 in 5,000 males |
| Hemophilia B | Factor IX | Secreted | 1 in 20,000 |
| Hereditary | C1 inhibitor | Secreted | 1 in |

TABLE 13-continued

Some Indications for Subject Selection in
Therapeutic Gene Replacement

| | | | |
|---|---|---|---|
| Hemophilia A | Factor VIII | | 1 in 5,000 males |
| Angioedema | protein | | 25,000 |
| Argininosuccinate Lyase deficiency | Argininosuccinate Lyase | Intracellular | 1 in 70,000 |
| Mucopolysaccharidosis type IV (MPS IV), | Arylsulfatase B | Intracellular | 1 in 200,000 |
| Progressive familial intrahepatic cholestasis type 2 | ATP binding cassette family B | Intracellular | 1 in 50,000 |
| Classical galactosemia | Galactose-1-phosphate uridyltransferase | Intracellular | 1 in 50,000 |

TABLE 14

Some Indications for Subject Selection
in Therapeutic Gene Knockdown

| Indication | Target Gene | Prevalence |
|---|---|---|
| Primary Hyperoxluria type 1 | Glyoxylate oxidase (HAO1) | Est 1 in 100,000, up to 5,000 patient in US + EU |
| Familial ATTR Amyloidoisis | Transthyretin | 1 in 100,000 in US, more frequent in Japan, Sweden |
| Acute Hepatic Porphoryia | Aminolevulinic Acid Synthase (ALASI) | 1 in 50,000 |
| Cardiovascular disease without adequate LDL lowering by statins | PCSK9 | High (1 in 3 deaths in US due to CVD) |
| Rare Hyperlipidemias | Angiopoietin like 3 | Various, approx 1 in 500,000 |
| Homozygous Familial Hypercholersterolemia | ApoB100 | 1 in 1 million |
| Hereditary Angioedema | Kallikrein | 1 in 25,000 |

A gene editing platform comprising a lipid nanoparticle (LNP) encapsulating an sgRNA and an mRNA encoding an MG nuclease described herein and an AAV (e.g., AAV serotype 8) comprising a donor template nucleic acid encoding a therapeutic gene are introduced into the liver intravenously to the subject. The LNP is targeted to hepatocytes via surface functionalization of the LNPs.

For example, the subject having hemophilia A is treated with a gene replacement platform comprising LNPs containing mRNA encoding a MG29-1 nuclease described herein (SEQ ID NO: 214). LNPs also contain sgRNA specific for albumin I, which is highly expressed in the liver (e.g., albumin can be expressed at about 5 g/dL in the liver, whereas factor VIII can be expressed at about 10 μg/dL in the liver, or 1 million times less than albumin). In addition to the LNPs, AAV8 (AAV serotype 8) viral particles comprising plasmids, which encode replacement template DNA encoding a replacement factor VIII nucleotide sequence, are delivered to the subject as well. Once inside the cell, the mRNA, sgRNA, and template DNA are transiently expressed. The MG29-1 nuclease targets the target locus of the host hepatocyte DNA using the sgRNA and then cleaves the host DNA. The donor template DNA transcribed from the plasmid delivered to the host hepatocyte in the AAV8 is spliced into the cell and stably integrated into the host DNA at the target site of the albumin I gene, and the inserted factor VIII DNA is expressed under the albumin promoter.

The gene editing platform is also used in subjects selected for gene knockdown therapy. For instance, a subject presenting with familial ATTR amyloidosis is treated with LNPs containing mRNA encoding an MG29-1 nuclease described herein (SEQ ID NO: 214) and a sgRNA specific to a target site in the transthyretin gene. The MG29-1 nuclease and sgRNA are delivered to and expressed in hepatocytes of the subject. In some embodiments, the sgRNA is targeted to a stop codon of the transthyretin gene, and the MG29-1 nuclease's activity removes the endogenous stop codon, effectively knocking down the expression of the gene. In some embodiments, the gene knockdown platform comprises an AAV8 containing a plasmid encoding a polynucleotide comprising a stop codon. When the AAV8 is delivered to the same cell that is expressing the nuclease and sgRNA, an exogenous stop codon is spliced into the tranthyretin gene, leading to knockdown of the gene's expression as a result of premature truncation of proteins translated from RNA produced from the edited DNA.

While preferred embodiments of the present invention have been shown and described herein, it will be obvious to those skilled in the art that such embodiments are provided by way of example only. It is not intended that the invention be limited by the specific examples provided within the specification. While the invention has been described with reference to the aforementioned specification, the descriptions and illustrations of the embodiments herein are not meant to be construed in a limiting sense. Numerous variations, changes, and substitutions will now occur to those skilled in the art without departing from the invention. Furthermore, it shall be understood that all aspects of the invention are not limited to the specific depictions, configurations or relative proportions set forth herein which depend upon a variety of conditions and variables. It should be understood that various alternatives to the embodiments of the invention described herein may be employed in practicing the invention. It is therefore contemplated that the invention shall also cover any such alternatives, modifications, variations or equivalents. It is intended that the following claims define the scope of the invention and that methods and structures within the scope of these claims and their equivalents be covered thereby.

SEQUENCE LISTING (4547 sequences)

SEQ ID NO: 1 - protein, 1235 aa, unidentified
  REGION 1..1235: note = Description of Unknown:uncultivated organism sequence
  REGION 1..1235: note = Category: MG11 effectors
  REGION 1..1235: note = Description: MG11-1 effector
MLDKFASLYPVTKTLRFRLLPQGRTEENMQAAKVLENDLERSEAAAVVKGLIKKYHLQFISDTLSGSTLSWQALTETLDKFKADHTATAELDSALAAYRCKLAELFTKSPKYKVMATPVSIIKEILKTETDPENIAALNKLNGYTYIIFDYVSTRMLTYSADAKATSLAYRLVDENYLRFYQDISAAAEISAVLEEAGLDNAEVEAFIRTDYNTCLTSEGIASFNAAAGSINQFVNQLLQQNPVLQSEPALRRHLQPLYKMLLDEAESKIIKFEDYGQLRDAVENFRRNFQYLPQSLIDIFAGRYDYSKIYVGYKYLNEASSQIAGGYNWKLLENALEDFYSKPYLVNGKMPVKYKTVVNKKMNQLAYSFTELQEALDAGESGSSITDLFGKYAELHAAYAAADGNVFYKEYDRKSIASLKNYLDAVNAIARFIKIFAVPEVYVKDEGFYGIVDGAADKLRDFDLLYNMVRNYITKKPYKKSKVALTFNSSSFGRGWDENKIYDELTTIFTYNGKYYLGVINKNDKPDLAAAVSKDEGGYKRMVYKTFDIVKQLPRLSFTKAVKAHFEESDEDYIFDGPKFAKPLRVPKEIYLQSFTDNGDKLVDSAKKYTKAYLDMSGDYKGYYEAIVKRIDYTKEFLSAYKSTSIYDLAFLKPADQYEQWSNFTDDVQTALYKIRWDNIPAAAVDEMVESGKLYLFEIYSADLYKNPAEGRKIDTQAQIFKEIFSENGQKVIKLLGNCEVYFRPASLPAVVTHPKGSILVNKQLVNGKTLPDEVYREIYRYLNKKSENLSPLAKQLLDKELVKYRVAQEDIIKDKRFTENQYSFHLPVTLNYKVKQQFYINMEVMNMLRSRKDINILGINRGTRNLLYVTVINQQGEILYSRSLNEFNGVDYRDKLLVKERGIKDAAMNWQAADSIKNIKEGYLSRALGEIVRLMVKFNAICVVENLSSNFRNAGGGIFAYGNFYKGFETNLIKKLNCLIIKNAEKDKAGSVLRSLQMTRSFESFEKAGRQSGWLFMLDPAYISAVDPLTGFVNLFSFRNLKTIRQKAEFLQKFKSINYVPETKAFDFVFDYKDFGVAVCGPVSCWVATSDVERIVKTTENGKVKFESVLPSMQLAKLFTDKDIDFTDGHNLISEITADSRLVTETLSIFMNIMRLYNYDIDRNNDYVSSPVMGRFDTRYDKKLHNPDELAAYNMARKGLMIIKRAQASEKDSKVDLFIKNADWFSFLQTGNI

SEQ ID NO: 2 - protein, 1223 aa, unidentified
  REGION 1..1223: note = Description of Unknown:uncultivated organism sequence
  REGION 1..1223: note = Category: MG11 effectors
  REGION 1..1223: note = Description: MG11-2 effector
MSINSFISNTKVFTGQPVSKTITAKLVPVGKTRENIDKMNILEMDKQREEAFVQVKKYIDRIHKDFIEDCLTSQDMGLGIAIHSYEFNKLYELRVNLKNLTGKERKDVQKQIKLEENRLRVLISKYFEFNPKYKKLFNIELFKELLPAYCSEEEMKDVNLFDGYTSYFKRFNDTREMLYSSEEIHNAVAYRIINENYPVFVDNKLSLEYISTYFHELFDFSENGQKLFHEFADFCDSSYGMSSKYIAKYNSFISGTFDEEGKQITRGLNQLINEYIQKNKDAHVSYFKPLYKNIMSDKKPLFSVSCFESTAEIKDAVISYNESICKPHERFISYITKSFPADFWCVDKKNLNRLSHIICSNPFTLDNLVSASNKFSKKKPDIYCASDFKELLSENILEETEFHFDFLKYKDYLVQFNPNDFYSKIPFDKINDLQYDKKQSLELKEYLQAALDYYNMLRILHIDTEDERIISKEISYDEQYYAELSLILDAMEPIVKLYNKVRNFVTKSVKQEKKIKLNFNCSQFLGGWSESQEKVKNGLIFHDEEEDKYYLGIYNQNMKKPDINYTSDSSFKKMVLNTIPEPYKMLPKVFFSKKGLETYKPCEEIIEGYKNELHKKSNSNFDINFCHKLIDYYKVCIKQRKEWDCFTFDFKPTEEYQDTSGFFDDVSKGGYSLVMKGIDKENLMNAVEEGSIFLFEIYNKYLAKKGHGKDTYTQLLRTALCGKESNIQFCAGAQVYYRPALLEKEVTHEKGSVIVNKITREGFTINSEVYENIYSYFNYQTPLSSEAKTLLDSGSVIYKTADRDLIKDRRYTEESFSFHCPVIINWKGKEINPFTFNKKVLEVIRNDESLNILSVNRGENNLVYVVLMNRNGKVLLDKSFNLIQTGKQNINYKNKLIEKSKERANSRTNWQEINGIKDLKSGYLSFIVAEITRLMIDNNAVLVLESLSSDFKSGRQFIESNIYQQFEEALLTKLACVILKEREAGTPGSLEHPYQLVPKFESFEKIYLQFGFVFFVNPSYISKIDPANGVFNFFNFNVLTNNEKRTEFFKKFESITEENGKLVFEYCPGNFNKDFKEIDRTFRVVASGSRNVWNPKTKTFESIDLELEGHAVYENLYQVNYRNIAELFKDKCNASCLPHPAATERLLRVFIAAVSFRTFVLDDWKYVSPLGIDNEFTGKSMDYIAAYNLANKFRTILELSSDSEYLINIKTAEYVNKINSANP

SEQ ID NO: 3 - protein, 1264 aa, unidentified
  REGION 1..1264: note = Description of Unknown:uncultivated organism sequence
  REGION 1..1264: note = Category: MG11 effectors
  REGION 1..1264: note = Description: MG11-3 effector
MEQFTNLYQLQKTLRFDIIPTEETLEILKEKGVKKSDKKLLEADKKRDSDFHDAQKVIDRYHRYFINSTLDAIKNDSEIIDKLRNCSNERGKDELRKIISDYFQKDSQFNRLFGKELFAKKNEKKDVEDSPLFTYAKTKNEKNALESFVNFTVFFKRYNENRKNMYVDKKQTTAIAYRIANVNLPKFEENNNCFLEIKKTKLMEILNKNRQLKKLLKGKKCEEVFRLDYYINVWKQTEIDEYNEIVGIINTNIKQYNDTLSGKKKSELPLMKKLHKQILGFKEEDKNKWEYRGFDSDKEMLTAVREFYSTYELKIKEKLRQLLETINDFDLSGIHVHQKSLRTISSFMFDDGYAIARFLIPQKSDETYEDYKDRIKKGNKSFTIKGINKKANTDLCQYFSKHSFIKVNEDDEKREEKEIFETINIAYENAKEIIDNANNYTEKNLAGSGDEQKLRTLLDNLKALQHFVQPLLGKGDEKKRDCSFYNKFMELWEDLLPLNILYDKVRSHMTKKPFSKEKIKVIFDVKKDFLNGWTDNMTKSDNGTQYGGFLFRKKNSIGEYDYFLGICKKAWILRKREGVSGDYERLDYYQINSRTFYKYYYYGENGFEEDKNSLMKAIKAYLEITAQDEDDRDLLEDVKAKDTPIAMITIIQERSQSKLSELLNDKCFADINKTVIENLRKSILSLSRIPEAQDYKDKEYYLFSDIQQDIEELCRTKRIFDYFYVCNEEIRDAQNNKESPLLLFKISNKDLSYADTSSEGKRKSRGTENLHTMYFKALMEGKQNVFDLGSGQIFFRESSLKRKVTHPAGIPIDNKNELVCKQRPTRILNYDLIKDKRYTIDKYLFHLSVKINYPQKELPKPENKKSVNDFIADFNKKTIEYLRQNKQDINIIGIDRGERNLIYVSLINAKGEHVTSDFPRSYNLINNFDYQKKLKQVAKNRDEERKNWTIPEKITDIKKGYLSQVVHEIASLAVRHHAIIVMENLSRGFKHGRFPIEHQVYQLFENMLIEKLSYFAFKKDWPSKEYGNIKNGVQLAVPMNKEDWVNQNGWLFYVPAGFTSKIDPATGFVNLFNMSKPLDNLKEFFGAFDEIAFRNGLFYFKFNYSKETFHKIRKDFTNEWTLTSHGERIEKKRPEDLTSKFKSFFAKTDVNIPLENVSVESVCSLSEDNLKELWGLFKLMLKMRNSSDDQDFIISPVASETPFVTGPENYMQIANADANGAYNIALKGLYWLYYNFPTDEKGYLKYIKDEDWFRFIQTKPYCNK

SEQ ID NO: 4 - protein, 1275 aa, unidentified
  REGION 1..1275: note = Description of Unknown:uncultivated organism sequence
  REGION 1..1275: note = Category: MG11 effectors
  REGION 1..1275: note = Description: MG11-4 effector
MKDLKQFIGRYGVEKTLRFELEPVGKTEEWMNLANDKERADKYAFVKELIDRYHKVCIRESLAECDFDWRPLAECLETCRKSRNKDNLDALNNAQKELRSKIAQKFHLFKDFAQLTASTPDKLLKNILPNCVRSKSQPEFSDIESIDNAIKSMSMFDGFASYFEGYQNSRKNLYAANIISSSVAHRVVHENFPKFLSNIKVFENIRVVCPEVIERCAAELGQYLNGLQLDEVFSVDYYNKVLTQGGIDLYNTIIGGVSEKEGESKHQGINELVNLFLQSHEMGGSQKNALTMVPLFKQILSDKKSYSYITEEIKEENELISVIQGYHSHISSFYFNGKAINILEELQHLLDNLCSYNLEGIYVENKKLNTISNKLYGNWSELRFRLTDHLTSQGMKKATIEKFFKKETFSLAELNLSSRDILKLFADLKQCTKGINRFWKDFEERNKKSMPKKYKESNKGIEIVRMLLESYKKFISICSLLDVENEGDSDTNFYGIFTPLITEMQDIDTLYNKARNFLSQKPSDKSKYLLKFDNCICANGWDAPQTKSVLIFRRQGMFLLGVVDNNHRSCLNGISHHQPVSVDDQIEYLVYRQGGHMDQNLQTLMVRDGKTVMVKGKRDENGENQELERQLKELLPPDIYRIRKSQSYINNSDNFCKEDLTLFIDYYKQRAKEYYAQFEFEFKESCDYASFKEFAEEINSKAYRIAFLPTSYKSLASLVNAGELYLFTIKNKDYEPGAHGKKNLHTLYWEQLFNQENLHNLVIKLNAKSTLFCRPQVIKAPTSHKKGSMLLNRKDKDGMPIPEPIYQQLYKYVNGKIREDGLSDDAKAYLDKIIAKEAQYTIIKDKRYTKQKYFIHISTTLNANATNATGINEDVWDYLRDNPDVNIIGIDRGERNLLYLTLINQKGEILLQKSLNVINGFDYHAKLEQREKERDEARKSWQTVGNITDLKEGYLSAAIHEITTMMIENNAIIVLEDLNRKGFMPKRFKFEKQVYQLFEKKLIEKLNYLCSKDIAPTESGGVLRGYQLTEKFVSFEKMTKQNGFLFYVRPDYTSAIDPVTGFVSHFGFKDIRNTKSRKDFFEKMESIIFTNGHVEFVFDYSAFKPKEKDYQNRWTISSVGRRIVWDKQSKLYSDYYPTNIIVGAFADRGIALEEGTDIKALLAGIDDSAHNAEFYNILFEAFKRTVQLRNSNSETGEDYILSPALHDGKQYSSLEERKKWDEGAEMSQLPIDADANGAYHIALKGLYLIMNPQEKKVDNEKWFRFVVEKPFMDKF

SEQ ID NO: 5 - protein, 1284 aa, unidentified
  REGION 1..1284: note = Description of Unknown:uncultivated organism sequence
  REGION 1..1284: note = Category: MG11 effectors
  REGION 1..1284: note = Description: MG11-5 effector
MKDLNKFIGKYKVEKTLRFRLEPIGKTEAWMESKGVIANDKRRADNYAIVKNLIDRYHKVCIRESLTGCNLNWTKLSEAVETYRRCQDTESRKALQKCQDEYRKKIAENFLSFRGFAELTAPSPSVLIKDTLPYNITSKVHPEFSDIGDVDSAKQALLLFEGFAMYFESYQKNRSNLYTAKNIASSVAHRIVHDNFSKFLANIKVFENLRVIYPEILEQCSTELKQHLKGKQLEEVFCVEFFNNVLTQEGIDFYNTVIGGVSGQEGERKCQGINELVNLSLQKENQGRGKRTALTMVPLFKQILSDRNSYSYIPERINDEEELISAIRAFHAHIESFYLNGREVNVMEELLKIVENINCFDPNGIFIDAEKLNGVSKKLYNDLFELRARMTSHLEEQNLTKKNIEKFFQKDAFSITDLCLDKKHSLAKYFSGLKGVNKAIDQKWKQFETRNNKDGQKKYKDSHAGIELVRILLDGYKEFFAVCSILDVDSDNNLDNNFYGVYTPLFTELRGIIPLYNQVRNFLSQKPSDDKKYLLKFDNSKCSNGWDSPQTKSLLIFRRQDRFLLGVVDSENRSCLNDLTTYTPVSPDDRIDFLDYSQGGHMGQNLLTLVVRDGKTVMVKGHKENGENPELERQLKDLLPPDIYRIRKSQSYKNESPNFSKEDLLLFVGYYKQRAKEYYSHFNFTFKDSCDYASFTELVEDIDEKAYQIKFVPTSYKTLQRLINEGKLYLFDIKSKDYEPGAHGKKNLHTLYWEQLFSQENIENLAIKLNAKSTLFCRPQVVTNPMTHKKGSMLLNRKDKNGQPIPEPIYQQLYKYVNGKMAESKLSDEAKGYLGKIVAKEAQYAITKDNRYTKQKYFIHFSTTLNANAPKTADINEDVLNYINDNPDVNIIGIDRGERNLLYVTLINQKGEILDQKSLNVINGFDYHTKLEQREKERDDARKSWQTVGNITDLKEGYLSAAIHEITTMMIENNAIIVLEDLNRKGFMPKRFKFEKQVYQSFEKKLIEKLNYLCSKDIKPTANGGVLRGYQLTEKFVSFEKMTKQNGFLFYVRPDYTSAIDPVTGFVSHFNFKDITNTQGRKDFFEKMESIIVRNGHIEFSFDYRKYKPKDKDFKNIWTVCSSGKRILWNRDSKEYADYNPTAAIIEAFASKGVTLEEGTDIKSLLSEIDGSTANAEFYRIMIEAFKRTVQLRNSNSVTGEDYILSPVIHDGKQYSSLDVLKEWKNAGGHSIPSLPKDADANGAYHIALKGLYLMMNPQTKQIGNEKWFKFVVEKPFKEEKSIG

SEQ ID NO: 6 - protein, 1282 aa, unidentified
  REGION 1..1282: note = Description of Unknown:uncultivated organism sequence
  REGION 1..1282: note = Category: MG11 effectors
  REGION 1..1282: note = Description: MG11-6 effector
MKDLNQFIGKYKVEKTLRFELAPIGKTEAWMESKGVIANDKRRADNYTIVKSLIDRYHKVCIRESLTGCDLNWTRLSEAVETYRRCQDTESRKALLKCQDEYRTEIAKRFLSFEDFAELTAPSPSVLIKEILPYHVTNKVHSEFSGIDDVDNAKQALSLFEGFAMYFESYQKNRSNLYTAKNIASSVAHRIVHDNFSKFLANIKVFENLRVIYPEIIEQCTNELRQLLKGEQLEEVFRVESFNNVLTEEGIDFYNTIIGGVSVQEGEKKFQGINELVNITLHKENQGRGKRTALTMVPLFKQILSDRNTYSYIPERINDEEELISVLRAFHSHLASFYLNGKEVNVMEELLKIVENINHFDPNGIFVDAKKLNGISQKLYDDLFELRAKLTSRLEEQKQTKKNIEKFFQKDAFSITELSLDKKHSLVKYFTGLKDVLKAIDQKWKQFETRNNKDGQKKYKDCHTGIELVRILLDGYKEFFAVCSVLDVDGENDLDNNFYGIFTPLLTELRGIIPIYNQVRNFLSQKPSDEKKYLLKFDNSKCSDGWDAPQTKSVRIFRGQGKFLLGVVDSENRSCLNDLSSYTPISSDDQIDFLDYSQGGHMGQNILTLVVRDGKTVMVKGRKENGKNSGLERQLKELLPPDIYRIRKSQSYKNESPNFSKEDLLLFVDYYKQRAKEYYSHFSFTFKDSCDYASFTELVEDIDEKAYQIKFVPTSYKNLLRLVNEGKLYLFDIKNKDYEPGAHGKKNLHTLYWEQLFCQENLENLTIKLNAKSTLFCRPQVVANPKTHKKGSMLLNRKDKNGQPIPESIYQQLYKYVNGKIAEAKMSDEAKGYLDKIAVKEAQYAITKDKRYTKQKYFIHFSATLNANAPKTADINKDVLDYIKDNPDVNIIGIDRGERNLLYVTLINQKGEILDQKSLNIINGFDYHAKLEQREKERDEAQRSWQTIGNITDLKEGYLSAAIHEITTMMIENNAIIVLEDLNRGFKRGRFKFEKQVYQMFEKKLIEKLNYLCSKDYSPTADGGVLRGYQLTEKFVSFEKMTKQNGILFYVRPDYTSAIDPVTGFVSHFNFRDITNTKGRKDFFEKMESITYKNGYFEFTFDYRKYKPKVKDFKNIWTVCSSGKRVLWSKETKEYTDYYPTTAISGAFASRGITLDEGADVKALLSGIDDSISNADFYRILFEAFKRIVQLRNTNSNTGEDYIHSPAIQDGKQYCSLDELKKWKDNGESSIPSLPIDADANGAYHIALKGLYLMLNPQAKQIENEKWFRFVVEKPFKEEKVM

SEQ ID NO: 7 - protein, 1320 aa, unidentified
  REGION 1..1320: note = Description of Unknown:uncultivated organism sequence
  REGION 1..1320: note = Category: MG11 effectors
  REGION 1..1320: note = Description: MG11-7 effector
MKNLKQFTEIYPVDRTLRFELKPELLEGQTIDDFWSNYLDENKKDSFYNKDKKRNDDYPIVKLILDQFHKNFISLALSSFLPESAPKCPTWNDLFDAYCKDRKSKDFANLQDKMRESISNHFKKHEWWQYISSYSKLIGSLLKQLVENDDDFVESIQERDSSLTREKMLEALETFNRFSVYFGNYADNRSNMYKKEAQGTSIANRIVNENLPKFFDNISVYRKLKATCPIDLESIQDNLKDTLKGMSLDEIFTPCYFNECLTQDGIEKYNWILGGNPNEDVLGINSVGNEYLQHHPESKLKLKDLVMTQLYKQILSDRVQPSFLPQQYKSEEDLMDSVFSFLSAVEKQGLLESVKRIMETLYDNDTDLSKVYVLGSNLTKLSHLLYGDWNLLGEKLREKLVTSNTKKAQQERDKEIEKWLDNKCFSLLQIKEIEDELLEQTQHPLSTEELFTTLNIWKKENETSLWQKVSLIEQCKTAYIVQFATLRKSFKDGKSISTDESKQILKEVLDKYMELYHIVELLRLGNKSAYLEKDSFYVDYERLFESSDEDTLSLSYIIPLYNKVRSFLTRKLSNEGKMLLKFDSPTLADGWDANKEDANNATILKHSDKYYLMLINPLNKPRLEDGICENGSYRKIVYHQIADASKDLPNLMMIDGKTVRKTGRKSQDGFNHILEDLKNKYLPDEINRIRKCGSYLKTSDSFNKEDSQAYLKYYMQRLLDYKKDEMVFHFKEPNEYESYADFLNDVAMQKYSISFVSFSKDKIDEWRKENKVMLFQVSNKDFKEGACGTENIHTLYWKELFSSRNMDNTIFKLNGGAELFYRSKLSSKPFMHKKGSILVNKTLSDGTPISDEMYKHFVDHFNGKGIVLTDEEVRLLPQVRTNRAKLDIIKDKRYYEHKFFMHVPITINFKAPKITQQQFNERTLELLRQNKKQLNIIGIDRGERNLIYVSVINQRGENIIPPKHFNLIETKTYDEVTRKYNYLEKLKQTEQNRDEARKNWTTIERIKDLKSGYLSQVVHEIAKMVVKYNAIVVLEDLNFGFKRGRFNVERQVYQNFEKMLIQKLNYLAFKKDAPSPDYGNVWNGLQLTAPFTSFKDLGKQSGWLFYVPAGYTSKIDPATGFVNLFNMNKPAKDFKTFFGSFTQICYKDDMFYFTFDYSNEKFNTVRTDYTNVWTLSTHGERIVREKDELREIQLIQKFKKFFSDDGVNIPLSEVSVERIKLLEEVKLKELFGLFKLLLKMRNTNGQEDYIISPVAGENPFKTGSNNYMGLTDADANGAYNIALKGLYWVHNGFPVEDKYLKYIKDTDWFEFIQTKPYLND

SEQ ID NO: 8 - protein, 1169 aa, unidentified
  REGION 1..1169: note = Description of Unknown:uncultivated organism sequence
  REGION 1..1169: note = Category: MG11 effectors
  REGION 1..1169: note = Description: MG11-8 effector
MKVTEKYAGKELSYPVSKTLTFQLVPVGKTRQFIEEKNILESDLDKLEKSKKVKGYLDRIHRSFIQDILAKNILDVTELERLFTELQKETDAAKKAGIRKLIRTEEDKKRNEISSWFHKEKDFKELFGAAVFKNKIKDFTTENELKDVEVFNRFTQYFVSYNEGREHIYSKDDTHDTIAFRIVNENFRIYFENLHKLNDAVPGTDALRSFPLTDAQIADYNQVISGNPAEGRKGYNQTANELEEKIPLLKKLYKNILSESTPLFSVEKFASTNDVIESIKDFVVSVKETFVEFELLARYKKNPDGIYVSRKRLANFSLLTTGKPLLLSQVVKTELKEVPEYVSVGKLKEMFFKQLEENPKFEGEEFNPEKYFAMTALVEKTRETLSALDFGKITDLQHDKAQVLPLKVFLDSALELYHHVLTVHVDEEEFTDKKDEGFYNILGSIEEYLSPVTIIYNKTRNFVTKKLSKEEKIPLNFDSPTLLSGWDINKESTSNSMLFHDESEDKYYLAVMDVKDRPKIIEKSDSSFKKMYYKLLPQPNKMLPHVFFSKSGIETYCPSEEILNGYKEGKHIKGENFDIGFCHKLIDFFKDCIARYDGWKVFDFRFSPTSSYEDISGFYREVSEQGYKIQLRGVDKDDVFRMAESGRIYLFLITNRHLSGKSKSFCTMTESLKKALSENSKIQLNGGANIYYRPKLIEAKVTHPKGSWLVNKITKSGFAVPKELYKNIYAHLNFQEKLSPESELLFKSGEVVYKKADFDLIKDRRYSKEDFKFHVTVKHNYKSRDCMLKAFNMSVLEDFRNNEDMNILSVTRGEKNLLYCVLINKKGEVLFEKNFNIMHSANAEINFKHKLEEIEKIRMRERKEWQEIDKIRDAKDGFLGLALHEICDLMIKYNAVLVTENLDSVFKDSRMKIESNVYKVFESNLAKKLSCLILKNNVEAGSVDCPYQLVPSLDLLKKSGTQFGWMFFVNPYCISKISPDNGCVTSFNFSEITNFEGRKKFLSKFSCISFTDETLVLEYECSDFSKNFSGKKRMFITGKRTLWNKVEKKYSEYDLDSVVKAAFAMLGIDGSFSGDIRKNIGELKFSLANNNALELLIECIRAASEMKTLSGDSYVFINPSDPHDRYNGKDIDFISCLNLAKKALLMIESGEEGIRQVKADEYVASLSKV

SEQ ID NO: 9 - protein, 1235 aa, unidentified
  REGION 1..1235: note = Description of Unknown:uncultivated organism sequence
  REGION 1..1235: note = Category: MG11 effectors
  REGION 1..1235: note = Description: MG11-9 effector
MLDKFASLYPVTKTLRFRLLPQGRTEENMQAAKVLENDLERSEAAAVVKGLIKKYHLQFISDTLSGSTLSWQALTETLDKFKADHTATAELDGALAAYRCKLAELFTKSPKYKVMATPVSIIKEILKTETDPENIAALNKLNGYTYIIFDYVSTRMLTYSANAKATSLAYRLVDENYLRFYQDISAAAEISAVLEEAGFDNAEVEAFIRTDYNTCLTSEGIASFNAAAGSINQFVNVLLQQNPVLQSEPALRRHLQPLYKMLLDEAESKIIKFEDYGQLRDAVENFRRNFQDLPQSLIDIFAGRYDYSKIYVGYKYLNEASSQIAGGYNWKLLENALEDFYSKPYLVNGKMPVKYKTVVNKKMNQLAYSFTELQEALDAGESGSSITDLFGKYAELHAAYAAADSNIFYKEYDRKSIASLKNYLDAVNAIARFIKIFAVPEVYVKDEGFYGIVDGAADKLRDFDLLYNMVRNYITKKPYKKSKVALTFNSSSFGRGWDENKIYDELTTIFTYNGKYYLGVINKNDKPDLAAAVSKDEGGYKRMVYKTFDIVKQLPRLSFTKAVKAHFEESDEDYIFDGPKFAKPLRVPKEIYLQSFTDNGDKLADSAKKYTKAYLDMSGDYKGYYEAIVKRIDYTKEFLSAYKSTSIYDLAFLKPADQYEQWSNFTDDVQTALYKIRWDNIPAAAIDEMVESGKLYLFEIYSADLYKNPAEGRKIDTQAQIFKEIFSENGQKVIKLLGNCEVYFRPASLPAVVTHPKGSILVNKQLVNGKTLPDEVYREIYRYLNKKSENLSPLAKQLLDKELVKYRVAQEDIIKDKRFTENQYSFHLPVTLNYKVKQQFYINMEVMNMLRSRKDINILGINRGTRNLLYVTVINQQGEILYSRSLNEFNGVDYRDKLLVKERGIKDAAMNWQAADSIKNIKEGYLSRALGEIVRLMVKFNAICVVENLSSNFRNAGGGIFAYGNFYKGFETNLIKKLNCLIIKDAEKDKAGSVLRSLQMTRSFESFEKAGRQSGWLFMLDPAYISAVDPLTGFVNLFSFRNLKTIRQKAEFLQKFKSINYVPETKAFDFVFDYKDFGLTACGPVSCWVVTSDVERIVKTTENGKVKFESVLPSMQLAKLFTDKDIDFTDGHNLISEITADSRLVTETLSIFMNIMRLYNYDIDRNNDYVSSPVMGRFDTRYDKKLHNPDELAAYNMARKGLMIIKRAQASEKDSKVDLFIKNADWFSFLQTGSI

SEQ ID NO: 10 - protein, 1235 aa, unidentified
  REGION 1..1235: note = Description of Unknown:uncultivated organism sequence
  REGION 1..1235: note = Category: MG11 effectors
  REGION 1..1235: note = Description: MG11-10 effector
MLDKFASLYPVTKTLRFRLLPQGRTEENMQAAKVLENDLERSEAAAVVKGLIKKYHLQFISDTLSGSTLSWQALTETLDKFKADHTATAELDSALAAYRCKLAELFTKSPKYKVMATPVSIIKEILKTETDPENIAALNKLNGYTYIIFDYVSTRMLTYSADAKATSLAYRLVDENYLRFYQDISAAAEISAVLEEAGFDNAEVEAFIRTDYNTCLTSEGIASFNAAAGSINQFVNVLLQQNPVLQSEPALRRHLQPLYKMLLDEAESKIIKFEDYGQLRDAVENFRRNFQDLPQSLIDIFAGRYDYSKIYVGYKYLNEASSQIAGGYNWKLLENALEDFYSKPYLVNGKLPVKYKTVVNKKMNQLAYSFTELQEALDAGDSGSSITDLFGKYAELHAAYAAADGNVFYKEYDRKSIASLKNYLDAVNAIARFIKIFAVPEVYVKDEGFYGIVDGAADKLRDFDLLYNMVRNYITKKPYKKSKVALTFNSSSFGRGWDENKIYDELTTIFTYNGKYYLGVINKNDKPDLAAAVSKDEGGYKRMVYKTFDIVKQLPRLSFTKAVKAHFAESDEDFIFDGPKFAKPLRVPKEIYLQSFTDNGDKLPDSAKKYTKAYLDMSGDYKGYYEAIVKRIDYTKEFLSAYKSTSIYDLAFLKPADQYEQWSNFTDDVQTALYKIRWDNIPAAAVDEMVESGKLYLFEIYSADLYKNPAEGRKIDTQAQIFKEIFSENGQKVIKLLGNCEVYFRPASLPAVVTHPKGSILVNKQLVNGKTLPDEVYREIYRYLNKKSENLSPLAKQLLDKELVKYRVAQEDIIKDKRFTENQYSFHLPVTLNYKVKQQFYINMEVMNMLRSRKDINILGINRGTRNLLYVTVINQQGEILYSRSLNEFNGVDYRDKLLVKERGIKDAAMNWQAADSIKNIKEGYLSRALGEIVRLMVKFNAICVVENLSSNFRNAGGGIFAYGNFYKGFETNLIKKLNCLIIKDAEKDKAGSVLRSLQMTRSFESFEKAGRQSGWLFMLDPAYISAVDPLTGFVNLFSFRNLKTIRQKAEFLQKFKSINYVPETKAFDFVFDYKDFGVTACGPVSCWVATSDVERIVKTTENGKVKFESVLPSMQLAKLFTDKDIDFTDGHNLISEITADSRLVTETLSIFMNIMRLYNYDIDRNNDYVSSPVMGRFDTRYDKKLHNPDELAAYNMARKGLMIIKRAQASEKDSKVDLFIKNADWFSFLQTGSI

SEQ ID NO: 11 - protein, 1235 aa, unidentified
  REGION 1..1235: note = Description of Unknown:uncultivated organism sequence
  REGION 1..1235: note = Category: MG11 effectors
  REGION 1..1235: note = Description: MG11-11 effector
MLDKFASLYPVTKTLRFRLLPQGRTEENMQAAKVLENDLERSEAAAVVKGLIKKYHLQFISDTLSGSTLSWQALTETLDKFKADHTATAELDSALAAYRCKLAELFTKSPKYKVMATPVSIIKEILKTETDPENIAALNKLNGYTYIIFDYVSTRMLTYSADAKATSLAYRLVDENYLRFYQDISAAAEISAVLEEAGFDNAEVEAFIRTDYNTCLTSEGIASFNAAAGSINQFVNVLLQQNPVLQSEPALRRHLQPLYKMLLDEAESKIIKFEDYGQLRDAVENFRRNFQDLPQSLIDIFAGRYDYSKIYVGYKYLNEASSQIAGGYNWKLLENALEDFYSKPYLVNGKLPVKYKTVVNKKMNQLAYSFTELQEALDAGDSGSSITDLFGKYAELHAAYAVADSNVFYKEYDRKSIASLKNYLDAVNAIARFIKIFAVPEVYVKDEGFYGIVDGAADKLRDFDLLYNMVRNYITKKPYKKSKVALTFNSSSFGRGWDENKIYDELTTIFTYNGKYYLGVINKNDKPDLAAAVSKDEGGYKRMVYKTFDIVKQLPRLSFTKAVKAHFAESDEDFIFDGPKFAKPLRVPKEIYLQSFTDNGDKLPDSAKKYTKAYLDMSGDYKGYYEAIVKRIDYTKEFLSAYKSTSIYDLAFLKPADQYEQWSNFTDDVQTALYKIRWDTIPVAAIDEMVESGKLYLFEIYSADLYKNPAEGRKIDTQAQIFKEIFSENGQKVIKLLGNCEVYFRPASLPAVVTHPKGSILVNKQLVNGKTLPDEVYREIYRYLNKKSENLSPLAKQLLDKELVKYRVAQEDIIKDKRFTENQYSFHLPVTLNYKVKQQFYINMEVMNMLRSRKDINILGINRGTRNLLYVTVINQQGEILYSRSLNEFNGVDYRDKLLVKERGIKDAAMNWQAADSIKNIKEGYLSRALGEIVRLMVKFNAICVVENLSSNFRNAGGGIFAYGNFYKGFETNLIKKLNCLIIKDAEKDKAGSVLRSLQMTRSFESFEKAGRQSGWLFMLDPAYISAVDPLTGFVNLFSFRNLKTIRQKAEFLQKFKSINYVPETKAFDFVFDYKDFGVAVCGPVSCWVATSDVERIVKTTENGKVKFESVLPSMQLAKLFSDKDIDFTDGHNLISEITADSRLVTETLSIFMNIMRLYNYDIDRNNDYVSSPVMGRFDTRYDKKLHNPDELAAYNMARKGLMIIKRAQASEKDSKVDLFIKNADWFSFLQTGSI

SEQ ID NO: 12 - protein, 1235 aa, unidentified
  REGION 1..1235: note = Description of Unknown:uncultivated organism sequence
  REGION 1..1235: note = Category: MG11 effectors
  REGION 1..1235: note = Description: MG11-12 effector
MLDKFASLYPVTKTLRFRLLPQGRTEENMQAAKVLENDLERSEAAAVVKGLIKKYHLQFISDTLSGSTLSWQALTETLDKFKADHTATAELDSTLAAYRCKLAELFTKSPKYKVMATPVSIIKEILKTETDPENIAALNKLNGYTYIIFDYVSTRMLTYSADAKATSLAYRLVDENYLRFYQDISAAAEISAVLEEAGLDNAEVEAFIRTDYNTCLTSEGIASFNAAAGSINQFVNVLLQQNPVLQSEPALRRHLQPLYKMLLDEAESKIIKFEDYGQLRDAVENFRRNFQDLPQSLIDIFAGRYDYSKIYVGYKYLNEASSQIAGGYNWKLLENALEDFYSKPYLVNGKMPVKYKTVVNKKMNQLAYSFTELQEALDAGESGSSITDLFGKYAELHAAYAAADGNVFYKEYDRKSIASLKNYLDAVNAIARFIKIFAVPEVYAKDEGFYGIVDGAADKLRDFDLLYNMVRNYITKKPYKKTKVALTFNSSSFGRGWDENKIYDELTTIFTYNGKYYLGVINKNDKPDLAAAVSKDEGGYKRMVYKTFDIVKQLPRLSFTKAVKAHFAESDEDFIFDGPKFAKPLRVPKEIYLQSFTDNGDKLPDSAKKYTKAYLDMSGDYKGYYEAIVKRIDYTKEFLSAYKSTSIYDLAFLKPADQYEQWSNFTDDVQTALYKIRWDNIPAAAIDEMVESGKLYLFEIYSADLYKNPAEGRKIDTQAQIFKEIFSENGQKVIKLLGNCEVYFRPASLPAVVTHPKGSILVNKQLVNGKTLPDEVYREIYRYLNKKSENLSPLAKQLLDKELVKYRVAQEDIIKDKRFTENQYSFHLPVTLNYKVKQQFYINMEVMNMLRSRKDINILGINRGTRNLLYVTVINQQGEILYSRSLNEFNGVDYRDKLLVKERGIKDAAMNWQAADSIKNIKEGYLSRALGEIVRLMVKFNAICVVENLSSNFRNAGGGIFAYGNFYKGFETNLIKKLNCLIIKDAEKDKAGSVLRSLQMTRSFESFEKAGRQSGWLFMLDPAYISAVDPLTGFVNLFSFRNLKTIRQKAEFLQKFKSINYVPETKAFDFVFDYKDFGVTACGPVSCWVATSDVERIVKTTENGKVKFESVLPSMQLAKLFTDKDIDFTDGHNLISEITADSRLVTETLSIFMNIMRLYNYDIDRNNDYVSSPVMGRFDTRYDKKLHNPDELAAYNMARKGLMIIKRAQASEKDSKVDLFIKNADWFSFLQTGSI

SEQ ID NO: 13 - protein, 1309 aa, unidentified
  REGION 1..1309: note = Description of Unknown:uncultivated organism sequence
  REGION 1..1309: note = Category: MG11 effectors
  REGION 1..1309: note = Description: MG11-13 effector
MNNLKQFTGIFPVSKTLRFELNPVLLEGQTLNDFWQVYLDGPEGNDLHKLYKNDKERNVNYPIMKAILDQFHKKFIASALEQFVVGDTGVTWESLALAYQEDKKSKAYQKLQGEMRGKMRKAFMGHNWWPYISSYSQLISTLMKKMVEEDDDFVESIQESNPKMNLDRNKMLEAIKAFNNFSVYFGNYQDNRDNMYSEKDQTTSVANRIVNENYPKFLDNIVVYHRLKETCPDELKAIEENLAAVLNGLMLDDIFTPRYYNKCLTQDGIEKYNWLLGGNPNEGVLGINSVGNEYLHQHPDSQLKLRSLEMAQLHKQILSDRVRISFLPEQFNSDEELMQSVSAFFEGFDSFNLFEHIQETMNILKDSTTDLNRVYVQGKNLSRLSTLLYGKWDVLGEKLRSVMVTGNAKKAQKEKDKEIEAWLENKCFSLAQIQSVENELMELSAHPLSLIELLTDLTMWKYDSENKIWSKKSLLKLCMDARITEFSVLMNKYKQGMSIKTDTAKEILKSVLDQYMELLHVLELLRLGTKAQYIEKDDFYNSYELLFESTDDAVSVSHIVPLYMKVQSYLTRKLADKGKMLLKFDSPTLADGWDANKESANNATILLRDGKFFLMIVNPYNKPNISEGICEKGSYLKIVYHQIADASTDIPNLMVENGVTVRKTGRKDPDGINRRLEAEKDRLLPLDINMIRKKGSYLKSSSTFNTADSQTYLAYYMQRIIEYKGREIDFHFKRPDEYECYQDFIDDVSKQKYSLSLVPFSEYMLETWRQQGKAFLFEITNKDFREKSSGMANLHTLYWKELFSAQNLKDSVFKLNGEAELFFREKADSVSFIHKKGSVLVNKTFSNGTPIDTVFYKKLLRHFNGLDVDLTPEEVSLLPLVKTKNAQFDLVKDKRYHEHKFFLHVPITINYKVSGTTQKQFNERTLDIFRNNKKELNIIGIDRGERNLIYVAVINQKGENLIPPRHYNLIGNYDYLAKLKQTEKNRDEARKNWTTQERIKDLKSGYLSQVVHEIAKLVVRYNAVIVLEDLSFGFKRGRFNVERQVYQNFEKMLIQKLNYLAFKRDAPSLEFGTIRTGLQLTAPFTSFKELGKQSGWLFYVPAGYTSKIDPSTGFVNLFNMTKPASSLREFFGAFNEISYRNGLFYFTFDYSKEKFNTVKTDYTNRWTLASHGLRIVGKEKELKNLTSEFANFFEKAKLALGEVSVKTVSALDEGMLKELWGLFKILLKMRNSNDDKDFIISPVASDTPFLTGPDNSMQIADADANGAYNIALKGLFWLYYNFPTDEKGYLKYIKDEEWFRFIQTKPYRD

SEQ ID NO: 14 - protein, 1309 aa, unidentified
  REGION 1..1309: note = Description of Unknown:uncultivated organism sequence
  REGION 1..1309: note = Category: MG11 effectors
  REGION 1..1309: note = Description: MG11-14 effector
MNNLKQFTGIFPVSKTLRFELNPVLLEGQTLNDFWQVYLDGPEGNDLHKLYKNDKERNVNYPIMKAILDQFHKKFIASALEQFVVGDTGVTWESLALAYQEDKKSKAYQKLQGEMRGKMRKAFMGHNWWPYISSYSQLISTLMKKMVEEDDDFVESIQESNPKMNLDRNKMLEAIKAFNNFSVYFGNYQDNRDNMYSEKDQTTSVANRIVNENYPKFLDNIVVYHRLKETCPDELKAIEENLAAVLNGLMLDDIFTPRYYNKCLTQDGIEKYNWLLGGNPNEGVLGINSVGNEYLHQHPDSQLKLRSLEMAQLHKQILSDRVRISFLPEQFNSDEELMQSVSAFFEGFDSFNLFEHIQETMNILKDSTTDLNRVYVQGKNLSRLSTLLYGKWDVLGEKLRSVMVTGNAKKAQKEKDKEIEAWLENKCFSLAQIQSVENELMELSAHPLSLIELLTDLTMWKYDSENKIWSKKSLLKLCMDARITEFSVLMNKYKQGMSIKTDTAKEILKSVLDQYMELLHVLELLRLGTKAQYIEKDDFYNSYELLFESTDDAVSVSHIVPLYMKVQSYLTRKLADKGKMLLKFDSPTLADGWDANKESANNATILLRDGKFFLMIVNPYNKPNISEGICEKGSYLKIVYHQIADASTDIPNLMVENGVTVRKTGRKDPDGINRRLEAEKDRLLPLDINMIRKKGSYLKSSSTFNTADSQTYLAYYMQRIIEYKGREIDFHFKRPDEYECYQDFIDDVSKQKYSLSLVPFSEYMLETWRQQGKAFLFEITNKDFREKSSGMANLHTLYWKELFSAQNLKDSVFKLNGEAELFFREKADSVSFIHKKGSVLVNKTFSNGTPIDTVFYKKLLRHFNGLDVDLTPEEVSLLPLVKTKKAQFDLVKDKRYHEHKFFLHVPITINYKASGTTQKQFNERTLDIFRNNKKELNIIGIDRGERNLIYVAVINQKGENLIPPRHYNLIGNYDYLAKLKQTEKNRDEARKNWTTQERIKDLKSGYLSQVVHEIAKLVVRYNAVIVLEDLSFGFKRGRFNVERQVYQNFEKMLIQKLNYLAFKRDAPSLEFGTIRTGLQLTAPFTSFKELGKQSGWLFYVPAGYTSKIDPSTGFVNLFNMTKPASSLREFFGAFNEISYRNGLFYFTFDYSKEKFNTVKTDYTNRWTLASHGLRIVGKEKELKNLTSEFANFFEKAKLALGEVSVKTVSALDEGMLKELWGLFKILLKMRNSNDDKDFIISPVASDTPFLTGPDNSMQIADADANGAYNIALKGLFWLYYNFPTDEKGYLKYIKDEEWFRFIQTKPYRD

SEQ ID NO: 15 - protein, 1314 aa, unidentified
  REGION 1..1314: note = Description of Unknown:uncultivated organism sequence
  REGION 1..1314: note = Category: MG11 effectors
  REGION 1..1314: note = Description: MG11-15 effector
MNNLKQFTGIYPVSKTLRFELKPVLLEGQTINDFWNIYLNGSNDNVLHKLYLHDKKRNDNYPIMKVILDQFHKKFIASALEQFEVGDKGVTWESLALSYQEDKKSKTFQKLQEEMRGKIHKAFTEHKWWPYISSYSKLIGTLMRQMVEDDDDFVESIQESNPKMSLDRNKMLQAIETFNKFSVYFGNYQDNRDNMYSEKDQATSVANRIVNENYPKFLDNIVVYNRLKDTCNNELKAIEGNLNAVLNGLSLDDVFTPKYYNRCLTQNGIETYNWMLGGSPNEGVLGINSVGNEYLHHHPDSQLKLRSLKMTQLHKQILSDRVRISFLPEQFNSDEELMQNVSAFFEEFESSNLFVRIQETLSILKDSDTDLNKIYVLGKNLSRLSTLLYGKWDVLGEKLRSVMVTGNTKKAQKDKDQEIEAWLENKCFSLAQIKAVENELMELSSRPLSLMELLTDLTLWKYDSENRTWSKNSLLKLCKDARITEFNALTDEYRQGKLTIKTDAAKEVLKSVLDLYMELFHVIELLRLGKKSPFLEKDDFYISYEQLFESTDNTVLVSHIVPLYMKVQSYLTRKLADQGKMLLKFDSPTRANGWNDCSIAIKDGKYYLLLYLESLTNEEIAALYSGDSADLVIYQQQKTDYRNAPRLFINSKGDNQAPAVSKYHLPIEMVESLYKERKALKTQSAKREFDERHPDYLEKLINYYKIGFLRHEDFQPFQRTFENMWKDSLEYNSVQEFFEHTQELCYLLTFKPIDFDSLLNLQKSKKLLLFSITNKDYKEKAKGTPNMHTLYWEELFSKDNLSNVVYKLSGQGIEIFHREAISPELSFVHKKGSILVNKTFSDGTPIDAELYKKLLRHFNGLDVDLKPEEVNLLPLVRTKKAQFDLMKDKRYYEHKFFLHVPITINFKASAISQKQFNERTLNILRNNKESLNIIGIDRGERNLIYVSVINQRGENLIAPRHFNLIETKTFDGKERKFDYLTKLKQTEKNRDEARKNWTTQERIKDLKSGYLSQVVHEIAKLVVQYNAVIVLEDLNFGFKRGRFNVERQVYQNFEKMLIQKLNYLAFKKDAPSEEYGTIQSGLQLTAPFTSFKELGKQSGWLFYVPAGYTSKIDPSTGFINLFNMNKPANSLREFFEAFDDITYRDGLFYFTFDYSKDVFNKVKRDYTNHWTLASHGSRIVGKGKELKDLTAEFVKFFEKEAKIPLEKVSVKSISVLDESKLQTLWGLFKLLLKMRNSNDDIDYVISPVAGDSPFITGEGNSMQIVDADANGAYNIALKGLYWLYNDFPMEQGYLKYIKDEDWFRFIQTKPYRQD

SEQ ID NO: 16 - protein, 1314 aa, unidentified
  REGION 1..1314: note = Description of Unknown:uncultivated organism sequence
  REGION 1..1314: note = Category: MG11 effectors
  REGION 1..1314: note = Description: MG11-16 effector
MNNLKQFTGMYPVSKTLRFELKPVLLEGQTVNDFWNIYLNGSIDNDLHKLYLHDKERNDYYPIMKAILDQFHKKFIALSLEQFEVGDKGVTWESLALAYQEDKKSKTFQKLQGEMRGKIRKAFTEHGWWLYIASYSQLIGSFTKKMVEDDDDFVKSIQESNPKMGLDRDMMIQAIETFKNFSVYFGNYKANRDNMYSEKDQTTSVANRIVNENYPKFLDNIVVYNRLKDTCYSELNAIEDNLSAILNGLSLDDVFTPKYYNKCLTQDGIEKYNWVLGGNPNEGVLGINSVGNEYLHQHPESRLNLRSLKMTQLHKQILSDRVRISFLPEQFDSDEELMQSVSAFIEGFESSNLFAHIKDTLNILKDSDTDLDKVYVQGKNLSRLSTLLYGKWDVLGEKLRSVMVTGNTKKAQKDKEKEIEAWLENKCFSLAQIKAVENELMELSAHPLSLMELLTDLTVWKYDSENKTWSKKSLQKLCKDASITEFNVLMDKYKQGEFSIKTDAAKEVLKSVLESYMELFHVIELLRLGKKSPYLEKDNFYIPYELLFESTDDDVLVPHIVPLYMKVQSYLTRKLANQGKMLLKFDSPTRANGWKDCSIAIKDGKYYLLLYLENLTNEEITALYSRDSADLVIYQQQKTDFRNAPRLFINSKGDNQAPAVSKYHLPIEMVESLYKERKSLKTQSAKREFDERHPDYIERLIDYYKIGFLRHEDFRPFQYTFESMWKDSSEYSSVQEFFDHTKEMCYMLTFRPIDFDFLYNLQKGKKLVLFSITNKDYKKEAKGTPNMHTLYWEELFSQDNLANIVYKLSGQGIELFHREAISPKLAFVHKKGSILVNKTFSDGTPIDAEFYKKLIRHFNGVKVELTPEEVNLLPLVRTKKAQFDLMKDKRYHEHKFFLHVPITINFKASGTSQKQFNERTLNILRDNKEGLNIIGIDRGERNLIYVSVINQKGENLIAPRHFNLIETETYNGIVRKFDYLTKLKQTEKNRDEARKNWTTQEKIKDLKSGYLSQVVHEIAKLVVRYNAIIVLEDLNFGFKRGRFNVERQVYQNFEKMLIQKLNYLVFKKDAPSKEYGTIQSGLQLTAPFTSFKELGKQSGWLFYVPAGYTSKIDPVTGFVNLFNMNKPANSLREFFGAFDDITYRDGLFYFTFNYSKDVFNKVKADYTNHWTLASHGLRIVGKDKEPKDLTKEFELFFKEAYLPLDEVSVQTISSLDESKLQKLWGVFKLLLKMRNSNDEQDYIISPVASNKPFITGPDNPMQIADADANGAYNIALKGLYWLYYDFPTDENGYLKYIKDENWFRFIQTKPYLND

SEQ ID NO: 17 - protein, 1226 aa, unidentified
  REGION 1..1226: note = Description of Unknown:uncultivated organism sequence
  REGION 1..1226: note = Category: MG11 effectors
  REGION 1..1226: note = Description: MG11-17 effector
MRAIDNFISNTKEFAGLPVSKTITAKLVPVGKTRDNIDKMNILESDKQREEAFVRVKKYIDRVHKYFIEECLKQQDSGKGVYVPENEFNKLYTLRVNLKNLTGKERKNAQKEIQAEENKLRKLISEIFKAHPNYKNLSGVNLFTELLPSYCNEEEMKDVNLFKGFYSYFTKFNKLREQLYVSDDIHTAVAHRIINDNYPVYIDNKLILERIRSEYKELYDLSENGRQLFHELNQTYTMAYGMSSSYISMYNSTISGTFDEDGNQTCRGLNQLINEYRQKNKECRIPYFKPLYKNLMSDKKPLFSVSYFESTAEIKDAVITFNESIRKPYERFISYITKSFPVDSWCVEKKNLNRLSHIICSNPFTLDNLVSASKKFSKNQPDIYSASDFKELLSENILEETEFHFDFLKYKDYLLQFRPQDFFSKIPFDKITDIQYDKKQALELKEYLQSVLDYYNMLRILVIDPEDERIVSSEITYDEEYYTELELIIDALNPIVKLYNKVRNFVTKSLKQEKEIKLNFDCSSLLDGWAESQEKVKNGLIFHDESEDKYYLGIYNQNMKKPDFEYVSDSTFKKMVLNTIPEPYKMLPKVFFSKKGLETYKPSEEIIEGYKNELHKKSSGKFDLSFCHKLIDYYKDSIGQRDEWKCFNFNFRPTEEYQDTFEFFKEVSEGGYSLEMVGINKDILMKAVDEGSIFLFEIYNKYLANKAHGKDTYTQIIRSALSGKKSNVQFCGGAQIYYRPALIKEEATHKKGSVIVNKISKEGFTINSDVYKNICSHFNHNTALSSEAKTLLDSGSVIYKTADRDLYKDRRYMYESFSFHCPVKINWQAKDINPLTFNKAVLDAIRSDDDVKILSVNRGENNLVYAVLMDKKGKVLLDKSFNLIQSGKQNVNYKNKLIEKSKDRANSRTNWQEIDKIKDLKSGYLSFVIAEITRLIIENNAVLVLESLSNDFKSGRQFIESNIYQQFEMALVTKLSCIILKENEYGTPGSLEHPYQLVPKFTSFDNIFLQFGFVFFINPAYISKIDPESGIINFFNFNALTNNEKRTEFFKNFDNITVENDKLVFLYHPGNFNKDFKSIDLFKVIAAGKRNIWNPKTKKFEIIDLELEGKAVYENLLSYDYTNIAELFKDKCCNGVLPHPAATERLLRIFMAAVSSRTFVLDDWQYISPMGNENEFTGKSFDFIAAYNLANKFKTILERSKDGEYLSNIKTVEYVSSLIWNRVANL

SEQ ID NO: 18 - protein, 1235 aa, unidentified; identical to SEQ ID NO: 12
  REGION 1..1235: note = Description of Unknown:uncultivated organism sequence
  REGION 1..1235: note = Category: MG11 effectors
  REGION 1..1235: note = Description: MG11-20 effector

SEQ ID NO: 19 - protein, 1226 aa, unidentified
  REGION 1..1226: note = Description of Unknown:uncultivated organism sequence
  REGION 1..1226: note = Category: MG11 effectors
  REGION 1..1226: note = Description: MG11-21 effector
MKEHTFNQFVKAGPITKAFNFEIIPEGKTRETIENLGLLDDDAHFRECTKAATPYIDAVVRNIADKALSKLDYDFNKLAIVKDDKKKREKEEIVLEKAIARCVKENLPTDMKSTKDIMSAAFLSTVLPAEVKKVPTLTTEEKDKAGVLFEELKGKTQLLTKFLQTRVIALNTWLPQRVIENFYRYTDNFDTINNIISEKLPVENIEELPSMLLPSYYSQFVTQEGINAYNLHISGIYTEDKVVMQGLNEIINIHNQVAKKNGKTQIAKMKPLYKQILMPSEKSFTIEALNSDKDCVDVVRRALAQVDNAESLVNHIAKARTESMVVRGSRLHGLSYIGLGSHAELPNSILEIKTEEFLAEHKKLTKKGERELNGIAAKVRSSTYSLDYIEKVAPGITASYKEEVSDTMKLLKELAVSTERVISDPSNISTSKTALKTIKDFFDTFTELRTMIGIVGRSDNKMGENDFYNRYDELNACLTVTWKAENLFRNYVTRKPVDAHAKTETVLGTALRKTSLWWKKGDLLKVPSQLMTCEDGKYYYYLPLPVSIGGRNIDPQGKDDNCMLMSQIKVQDAVKWIPAQTFTKAKKYFSENQSKDTYTIEEKVHEPVTITREVSEIYERKLHTKGALQNGEETEEEYRKNLLAVLNVIDTFARNYVLYDSFEIKTKPIEEYEDAKQYYDELNLCLTPVIEWVTGNKRLLDEGVANGSLLKFLIHSRNLYAPAEYTEARKTSYTKMLSFILSPANKGQITLNSRPVLMYRPAVISEERIVKHKKGSILVSKNTTRGEHIPDEIYNELKLYFNQNKPLSDEGAQYFNAHKNEISHHKAETTIIKDKRYTMEKFFLNMSYKKNADTIESKTLSYDLNKKMKAYAAAGCNVLSVIRSRNDLVYVSVVDQNNNVLEERSLNVIDGVDFAGRIKEAAQIKQKDKAENWKYDRKIKDLKTGFISRAISEIVSLAVKYEAVICIEYLSQNFKDKYSALDDTVYKSFETALVSRLSDLWFKNIDEGKAGSMSNPLQLATNNGNSFQDGILFYTGQKYIKKTDPETGYADLFDTRFITTITNKKSFFSKFSSIRYNAETKKIDMEFDYGNFRTFALTSKTKWKISIGGEGTIYQREQKCNVYEPQVSKILVLAMEQSGVALTSDLSDLARNGELPNNVTNALWDVFTVTRTGIVKAHNNKSAVFISPVTGKKYLASHVAALNLAKKFRIELSEGRKEEWIDYVQV

SEQ ID NO: 20 - protein, 1211 aa, unidentified
  REGION 1..1211: note = Description of Unknown:uncultivated organism sequence
  REGION 1..1211: note = Category: MG11 effectors
  REGION 1..1211: note = Description: MG11-22 effector
MNGLNLKELTKRNKVVKSCTFELVPQGATSKTIEQSKFLNTDADWKQLISEIAPYIDAFIRNIVSCALSRVELDCSKDEMDEVKLASEINLAINSALNEKYGIYVKQIKSAKFINSVLPDFVDTLDLDENESIAVHNVLEELRGKTELVNEFLTSRVTALNTSVARRVCENFERYQENVKVFEKLQASSLWDTIVALYPNAGDFANVDSYNECITQEQIDTYNDMINGISDENGIIVKGIRGLINEYRMLEKNEKLPSPKELYKQILIPGKKAFSIICIDNDDELYDVISEASEHAVAAGKRFCDLIDNASAYDIVVQYKNLHTISHIVTGEHRTIPDAVKDVMYAAINQQIEAATTAKKRLALQKKVDDIEKALKKCDWTMDELEKISNLGIFSAYKTSAKNAYLLASGTVGTIPALTKDIRNNDAQREELKSIFNVWTEFRDLVRLVKRQTLDKGYHAFYDALDEIIFELSYMAKAETLTIAYVTRKPKDVSKKALASMGYQARMGAAWLQPDKKLSICDMTILKRDGKYYLYMLAPGVKPVNITTDKSDEYVFVQKKGQDASKALPKVTFYTASKFFEENPDAEEFVITNNVTEPVTISRELFDMKENGLFKTDAVKKGLITQEEYEKNLFEILSFYRHFMDVYTEYSKFDVQTKSDLHDYKDSGEFFTDVNAANVSSEWLPADTKKMDEMVDKGEALMFLITNRNMYSQFGKKTAYAELFLTAMSDSNMGVFLNSSPKMYFRAKSITKPIVHKKGSILVHKHDTNGNKIPKAIYDEIYKYYNNKLFATDLSQEARDYIDRGLVGKKKADTDIVKDNRYTEDKWMIQFSYTKNRTVIPASTKLNDIIRQNAANMNVLSIIRSETDLAYYMVTAPDGTVLEKQSLNIIDGRDYWSELSTISAKRKDEKSQSWNYSRQVKDQRDPYIVRAISVIARKVIEYNAIVVIERIRPEIKNRFDAMDNTVFKKFEGMLISRLADLYFSDVPAGEPGSVMNPYQLCENSGNDYQDGIVFFVSNAYTGNVDNQTGFVNIFDLGNVGTVSAKRLFLSKFDSIVYDPAQNRFVFDFDYDNFVTKTCMKKTKWSILAGGEALIFNRKFKYNTYYPETASMITKIMAEKNVSLSDNLAKLAATGELPGDVTTALFDAFRRAISGVISKHEDMPKRYISPVTGEAVIYNDNAAENLTRRFRFNMAELEKDKTAREEWIDNIA

SEQ ID NO: 21 - protein, 1250 aa, unidentified
  REGION 1..1250: note = Description of Unknown:uncultivated organism sequence
  REGION 1..1250: note = Category: MG11 effectors
  REGION 1..1250: note = Description: MG11-23 effector
MAQNRTDAFGAMRNLYPVSKTVALRGIPIAETLKYMTEREIMQKGNTLSENRKLVKQAGDRYIKDFINMSLMHASLKIHSDGSKDSIEELNALLKEKPSKKGDNDERRSKEKEIQAIATKLKNQLAASFKDTAFLKKLGSEAFFKEVLAGADLNEKEAKALEAIKKNTTYMADYQKRRLSLFDPKFTGYSIMTRSIDDNLPIHLRNCEVFRKVAPIIREDLAPIFKEVRLNTSAESLDEVFTPAMFNVLLAQCDIETYNTIIGGKTLSERKMIHGVNACIERYNKTAAQDQKLPSMKKLKKQILSDREPVSWLPEEFKNDNEVVEAVDMLIKNFHMLCKDTPVEAAVREPDTDGIFVNAKNLNSFSNIAYGRFFLAKNAVIDELKHQFPKRPRKSIEKYEKEIEAKFKKQDHFSVAFLDRCIAAYNPTLGRSSADAFGDIIKNKADVETKIADYLQERGTEEVEKIDEALKQKIRLLLNEMMKFHHSVERFLLKDMPTAYDVTFYELVEENEANAESLIKTFNMIRNRMTKKPYNTSKVRLYFDNPTLGAGWAVTKEYTNRILLFKDMENGEDKIYFGIVPTECKNLTRNSKGELKEDILAGDGKQLEKVEITIIPDAAKMLSAMFFSANWARTGSVKASDYVLEIHDKVKASGSAKDLSPEEKVAMIDYYKKCIATVEHWKRFNLKYRPSDEYESVKEFCDSVTEQAVNVSSRPVSEEKVFAAVARGDLYLFQLDNQDMHKKHHGTVGNPTVWLREAISCDPAAAVRLCGNVAVYYRKASLNRKVTHPAGVPMENKNPDNPRKTRTLTYDLIKDKRYTEDNFSFHIPLEVNFRADNRNNKSIVINDLVNRAVKANPDMPVLGINRGERHLIAYAVTAPDGKILEQGNFNVINGYNYRELLATRERERSTNKQNWENIKDIANLKDGYLSLVIGEIARLVQKYNCVVAIENLDDDFINTRQKFERNVYSRFETALEQKFTLLTDKTTSRRSSESLQLAATNKSGSFEVQNGILFRTMPWMISRTDPSTGFISFLKLFHKNNESSQKYLSSFDSFRYNQKEDLFELSFDYKALRVDLQAGERTKWTVCTYGERTECHLDKEHMKLMVTDVHDLTKEMKTLLDGQGIKYASGKDILKDVAEAKNGGFYRDFFTIISRTVCGSSWYEDKKEYRFIGCTRNSEGRFYDTRTCRPDQPCDVDTLAAWNLSRRVHRILDNIRSFDPENPPLDEDGKKLKSPKKGLSRAEWLKIAQK

SEQ ID NO: 22 - protein, 1166 aa, unidentified
  REGION 1..1166: note = Description of Unknown:uncultivated organism sequence
  REGION 1..1166: note = Category: MG11 effectors
  REGION 1..1166: note = Description: MG11-24 effector
MKSIDKYCGEKFGYSVNKTFMFELKPVRETLEYIKQRKIIENDKVRTDKAVLVKDYIDRLHRKFIQNVLTAHCTELKTDDLGKLYSMLQNENSDKSKIKKSIKEIEAAKRKQVSEWFKKDDGYKKLFGKTLFDELIATAETEEERNSINHFKGYLQYFLNYNQVREYVYSDEEKHNTIPFRIINENLKIYFENLNKLEDIGIDTSILYHFPVTDDQIACYNLVIGGNSKEIKGYNQLVNEKKLEVPYLTQLYKNILSETKPLFTTESFKTTEEVKETCKELFESVAGLKNDFRRITSGGDESKIYIHRKNISKFSLIVSGDPLLVKNVLANENIIVTDYVSVGQIKQAFINQKKAGYYENFELNVSKYYTMESVFSDILKNISECDLTKITDLQTDKIQVLPLKDALDKILELFQQVKIVFLDEDFVGKYDAEFYNVLNKVYNALKPVVSVYNKTRNFVTKKLGEQKKLPLNFESSTLLGGWDVNKESASNSVIFYDEKEGKYYLGIFNVENRPSFTAKPGTGFKKMYYKYLPQPNKMIPHVVFSKKGLDTFSPSNEIIEGYKKGLHLKGENFDINFCHKIIDFFKNCIYQYESWKVFDFKFSNTTEYNDLSDFYNEINQQGYNVKLSDVDRDEVYSSVSDGKLYLFEITNRFMSGKSHKRHIPSEIFKSIFDKDSTVQLNGGAEIFYRPEMLKPKITHKKGSFLVNKYTTTGFSVSAEDYKSIYEHLNYNKPLTSSARTLLDTGTVVYKKADYDLIKDRRYSSDKFEFHVPVTINYKYKSSCSVKEFNKSVLNELRENHDINILSVTRGENNLVYAVLQSQEGKILLEKSFNIIGEKTKVNYKDKLHKVELSRNEARKNWQNVQQIKDLKEGFMGNVLNEIVRIMIENNAVLVTEDLSGAFKDSRMKIESNVYKIFETSLVNKLSCLILKNAENEGSIKNPYQLTPPLEGFSKAGSQYGWVFFINPAYISKIVPASTFINIFGLNSVNTFDQKKTFFLKFDSIEYTGDSIFLSYNNGVFVPKFKGKNVIEIKGSRTLWNKETKKYENYNTKDYISEAVVNLGIEEKGNIKPLLEKLQFNIRNNKGLEKLIQAVKIVCEMKTFAVDNYHFVSPTQDDNYDGKDIDFIACVNLAEKFKLAVRNTAEESFVKQPKTEELINTKAQEFK

SEQ ID NO: 23 - protein, 1315 aa, unidentified
  REGION 1..1315: note = Description of Unknown:uncultivated organism sequence
  REGION 1..1315: note = Category: MG11 effectors
  REGION 1..1315: note = Description: MG11-25 effector
MSVFENFVGLYPVSKTLRFELKPELLDGQTIDDFWSVYLNGSEEDDLHKLYMHDDERSKQYPVVKAILDQFHKMFIASALEHFEEGDKGVTWLSLASAYRQDKRSKEFQKLQDEMRKKLRISFEKHEWWSYMKSYSKLIGELIMRMVANNDKFVEAVQESNPELASNPEIRLDRDGMIKALKTFERFSVYFGNYATNRDNMYSEKAQTSSIANRVVNENLPKFLDNIVVYERLKELCPDELKAIEENLSSTLDGFKLDDIFVPDYFNNCLAQVGIEKYNRLLGGNPNEGVLGINSVGNQYLQHHPETSVKLRSLQMTQLFKQILSDRVRLSFLPEQFKSDEELMQSVSDFLEGLESCEVFARIQRTFEILKDESTDLTRIYIQGSNLTKLSTLLYGKWDVLGERLRSTIETGNSKKVRRELDKEIEAWLENKCFSIAQIQAVESELIERSSHSLSVNELFSSLSPWKYDTETHEWSRKPLLKICDDARIVNFKELMRKFKEGCSIRTDAAKEELKYVLDQYIDLFHVVELLRLGNKSAYLEKDDFYVTYEQLFISDDEVILSHIVPLYMKVQSYLTRQLKDEGKILLKFDSPTLADGWDANKEDANNATILLKEGKYYLMIMNPNKKPNLSDGLCDKGDYHKIVYHQIADASKDIQNLMVEKGVTVRKTGRKDSDNINRRLEAEKERLLPKIINEIRIKRSYLRSSEQFNKEDSQTYLAYYMERIVEYKRGEIDFHFKKPEEYECYQDFVDDVSRQKYSLSLVPFSGVIVELWRRQKRIFLFQISNKDFSEKSSGTANLHTLYWNEVFSELNLSDSIFKLNGEAEIFYRKKSDADSFTHKKGSILVNKTFSDGKPIEDKLYGRLLKFFNGTHVELSEEERKLLPMVITKEAKFDIVKDKRYHEHKFFLHVPITINFKASTKSAKQFNEWTLQTLRENRKELNIIGIDRGERNLVYVSVINQRGENLIPPRHFNLIGNYDYLAKLKQTERNRDDARKNWTAMARIKDLKSGYLSQVVHEIAKLAVQYRAIVVLEDLNFGFKRGRFNVERQVYQNFEKMLIQKLNYLAFKTETPSPNCGNIRSGLQLTAPFTSFREMGKQCGWLFYVPAGYTSKIDPATGFVNLFNMNKPAESLRKFFGAFTEISYKDGLFYFTFDYSNEVFNTVKSDYTNRWKLSSHGARIIGKEKELKDLTKEFINFFEKKARIPLDKVSVQTISSLDDANLQQLWGLFKLLLKMRNSNDQFDFIISPVAGEKPFLTGEDNPMQILDADANGAYNIALKGLYWVMNDFPIEDGYLKYIRDTKWFEFVQTKPYLNE

SEQ ID NO: 24 - protein, 998 aa, unidentified
  REGION 1..998: note = Description of Unknown:uncultivated organism sequence
  REGION 1..998: note = Category: MG11 effectors
  REGION 1..998: note = Description: MG11-26 effector
MSIFSGFTRRNNLIKTLQFKLTPMYGTAEQMEKLGVLYSDKERSRCWKILLDVLRRVDAAFIANALCAENSLDWQPLAEALAEGKKERIARQQAAMRKAVAKLLTKHSDYKNLVNPTKAIKLAAAATENAAEADAVTKYARFTTVLVDYFNLKKVFFSSEEKQTTIAYRIAHVNFSLYWQNLSLLKKYRDAGLDFQDKFSFPYTEINGYNQCLVQSQIDAYNRAVGKINMELQTLYRQHKLPQALKGVAVKLRMLHKQVMSGGSDKKVPFDLYTEMQNAVISLQNSLKEIFSLLDEAFGADLELADTYQKLRQQIVDSAKNLLFCEHDEQSIISIKNFLTAVVALRRFIKKTLRDYEQNFESDQEEIFLACSNVWSLLEEVPQLYIRVRGFLTRKPYKTDKIRMFFDCAAFGKGWDVNKESAYLLTLFRREELYYLGIRRQGAKINFADMLANTAEACYEKMVYKSFDFVKGFPGVVFAKSVLQKFVEGAERVVLDGDLYSCPLVVIREDFEQKYFVENGVLHEKEAGEVKYLKEYYAQTGDLAGYKQAVRQRIKLAKQFIAAYKNFAFFDMSQLKSASEYESWTDFLVHVNEFTYGLRWQRISAAAIEKLVAAGDLFFFRLDNQDFALADSKNRAEDEQTLFLREIFSERNARERVLKLLGDVEVYYRPASLAAEVTHRKGSVLVNKKDVHNNLLPRQLHQNICQYLNGEDEKLLPEAEELLAKGMVRYKRADTDIIKDKRFTEAQLSVHFPVSINYRCPNKDYSFNKDFRSMLKNNAAVNILGVHLGGKNLAEAVLIDQKGQILLRKEFNEFNQYNFYQALVLRAEERRQAQQNWLQMEKIKNIRSGFLSALVSEVSKLALAYNAVIVLENFENSRVKKDRGAAFAHTQFAMSLLHKLNYLVLKKREYLEPGGVLNGYQLAPKAESLAGFANQIGCVFLVLPDYDGGEDEKAAYNLALKGLLLLRRIHEAENVDKVDLLITKKNWLEFLREYGSRS

SEQ ID NO: 25 - protein, 1309 aa, unidentified
  REGION 1..1309: note = Description of Unknown:uncultivated organism sequence
  REGION 1..1309: note = Category: MG11 effectors
  REGION 1..1309: note = Description: MG11-27 effector
MKQFTNLYPVSKTLRFELKPELLEGQTIDDFWNSYLNGSGNSELHKLYMHDKERNESYPIMKAILDEFHKRFVASVLDGFELREDCSLTWNELLKEYQNDKKSKIYQKLQGNVRKAIHKAFLEHEWWPYLSSYSKLIGSLMRKLVGEDDDFVESVIENFRDMPLNREKMLKAIDVFDRFSVYFVKYQSNRDNVYSDKAQNTSIANRIVNDNFPKFVDNLIVYQRLKDCCPDELEAIEDNLQDKLKGLALDDVFEISYYNQCLTQNGIEKYNWILGGNPNENVFGLNSVGNQYLQHHPESNLKLRNLQMTPLYKQILSDRVRLSFLPEQFKSDDELMRSVSDFLNGLESQDCFAQIEKTMNSLKERETDLNKIFVQGANLTKLSTLLYGNWSLLGEKLRSTLITGNTKKDKEARNKEIEAWLENKCFSLSQIIAVEEELMEQVAHPLSVIELFTNMTIWKYDVERHEWVKKSLLKQCHDARITEFNTLMNRYKKGMPIKSDAAKETLKSVLDNYMELLHVVELLRLGNKTAYLEKDDFYLPYENLFETDNDNTSILSIVPLYMKVQTYLTRKLKKSEKLLLKFDSPTRANGWNDCSIAIKNGKYYLVLYLQKLLDEEVSKLYSGDSAEIVIYHQQKADFRNAPRLFINSKGDRRSPSVSKYHLPIEMIESLYKEQKGLKTQTEKKLFEERHPDYNEKLIDYYKIGFMHHEDFAAYRHTFESMWKKSSDYDSVQEFFEHTQEMCYMLTLKSIDYDYLYRLQNTGKLLLFRISNKDFNEQAKGTPNMHTLYWNELFSKENLTDVIYKLSSQGIEFFYRNAVSQQSFIHEKGSILVNKTFSDGAPIEDELYRKFLLHFNGKQVELSDDEVVLLPKVVTKKAKFNIVKDKRYHEHKFFLHIPITINFKESGISQKQFNERTLDILRDNKDGLNIIGIDRGERNLIYVSVINQKGENLITPRHFNLIESSTFEGLVRKFDYLAKLKQTEKNRDSARKNWTTMDRIKDLKSGYLSQVVHEIAKLVVQYKAIVVLEDLNFGFKRGRFNVERQVYQNFEKMLIQKLNYLVFKRDAPSSEYGNIRSGLQLTAPFTSFKDLGKQSGWIFYVPAGYTSKIDPVTGFVNLFNMNKPASSLKQFFGAFKNIKYEKGLFYFTFDYSNKDFNTVKIDYKNQWTLSSHGTRIVGKEKEFKDLTTEFVEFFRKVNLPLQQVSVQSILTLDDIQLQKLWGLFKLLLKMRNSNDKTDFIISPVSGECPFITGSDNLLGIEDADANGAYNIALKGLYWVYYGFPKDGDFLKYISDSEWFKFIQTKPYLTD

SEQ ID NO: 26 - protein, 1314 aa, unidentified
  REGION 1..1314: note = Description of Unknown:uncultivated organism sequence
  REGION 1..1314: note = Category: MG11 effectors
  REGION 1..1314: note = Description: MG11-28 effector
MNNLRQFTGIYPVSKTLRFELKPVLLDGQTVNDFWDIYLNGSTDNDLHKLYLHDKRRNDYYPIMKVILDQFHKKFIALALEQFEVGDKGVTWESLALAYQEDKKSKTFQRLQEEMRGKIRKAFTEHEWWSYISSYSKLIGSLIKQKVEDDDDFVESIQESNPKMSLDRDKMLQAIETFNNFSVYFGNYRDNRNNMYSDKDQATSVANRIVNENYPKFLDNIVVYNRLKDTCNNELKAIESNLSKVLNGISLDDVFTPKYYNRCLTQNGIETYNWVLGGSPNEGVLGINSVGNEYLHHHPDSQLKLRSLKMTQLHKQILSDRVRISFLPEQFNSDEELMQNVSAFFEAFESSKLFVHIQETLNILKDSDTDLNKIYVLGKNLSRLSTLLYGKWDVLGEKLRSVMVTGNTQKAQKDKDKEIEAWLENKCFSLAQIKAVENELMELSTRPLSLMELLTNLTIWKYDSENKIWSKKSLPKLCMDARITEFNVLMDKYKQGKLTIKTDAAKEVLKSVLELYMELFHVIELLRLGNKSPYLEKDDFYIPYEHLFESTDDTVLVSHIVPLYMKVQSYLTRKLADQGKMLLKFDSPTRANGWNDCSIAIKDGKYYLLLYLESLTNEEIAALYSGDSADLVIYQQQKTDYRNAPRLFINSKGDNQAPAVSKYHLPIEMVESLYKERKALKTQSAKREFDERHPDYLEKLINYYKIGFLRHEDFQPFQRTFENMWKDSLEYNSVQEFFEHTQELCYLLTFKPIDFDSLLNLQKSKKLLLFSITNKDYKEKAKGTPNMHTLYWEELFSKDNLSNVVYKLSGQGIEIFHREAISPELSFVHKKGSILVNKTFSDGTPIDTELYKKLLRHFNGLDVDLKPEEVNLLPMVRTKKAQFDLMKDKRYYEHKFFLHVPITINFKASATSQKQFNERTLNILRDSKEGLNIIGIDRGERNLIYVSVINQRGENLIAPRHFNLIETRTYDGKERKFDYLTKLKQTEKNRDEARKNWTTQEKIKDLKSGYLSQVVHEIAKLVVRYNAVIVLEDLNFGFKRGRFNVERQVYQNFEKMLIQKLNYLAFKKDAPSMDYGTIQSGLQLTAPFTSFKELGKQSGWLFYVPAGYTSKIDPSTGFVNLFNMNKPADSLREFFGAFDEITYRDGLFYFSFDYSKDVFFKVRTDFKNKWTLASHGERIVGKEKERKDLTAQFVKFFEEEANVPLEKVSVQTVSSLDESQLKTLWGLFKLLLKMRNSNDDTDFIISPVASDHPFITGKDNSMQIADADANGAYCIALKGLYWLYNDFPAEQGYLKYIKDEDWFRFIQTKPYRQD

SEQ ID NO: 27 - protein, 1235 aa, unidentified
  REGION 1..1235: note = Description of Unknown:uncultivated organism sequence
  REGION 1..1235: note = Category: MG11 effectors
  REGION 1..1235: note = Description: MG11-29 effector
MLDKFASLYPVTKTLRFRLLPQGRTEENMQAAKVLENDLERSEAAAVVKGLIKKYHLQFISDTLSGSTLSWQALTETLDKFKADHTATAELDSALAAYRCKLAELFTKSPKYKVMATPVSIIKEILKTETDPENIAALNKLNGYTYIIFDYVSTRMLTYSADAKATSLAYRLVDENYLRFYQDISAAAEISAVLEEAGFDNAEVEAFIRTDYNTCLTSEGIASFNAAAGSINQFVNVLLQQNPVLQSEPALRRHLQPLYKMLLDEAESKIIKFEDYGQLRDAVENFRRNFQDLPQSLIDIFAGRYDYSKIYVGYKYLNEASSQIAGGYNWKLLENALEDFYSKPYLVNGKMPVKYKTVVNKKMNQLAYSFTELQEALDAGDSGSSITDLFGKYAELHAAYAAADGNVFYKEYDRKSIASLKNYLDAVNAIARFIKIFAVPEVYVKDEGFYGIVDGAADKLRDFDLLYNMVRNYITKKPYKKTKVALTFNSSSFGRGWDENKIYDELTTIFTYNGKYYLGVINKNDKPDLAAAVSKDEGGYKRMVYKTFDIVKQLPRLSFTKAVKTHFAESDEDFIFDGPKFAKPLRVPKEIYLQSFTDNGDKLPDSAKKYTKAYLDMSGDYKGYYEAIVKRIDYTKKFLSAYKSTSIYDLAFLKPADQYEQWSNFTDDVQTALYKIRWDNIPAAAIDEMVESGKLYLFEIYSADLYKNPAEGRKIDTQAQIFKEIFSENGQKVIKLLGNCEVYFRPASLPAVVTHPKGSILVHKQLVNGKTLPDEVYREIYRYLNKKSENLSPLAKQLLDKELVKYRVAQEDIIKDKRFTENQYSFHLPVTLNYKVKQQFYINMEVMNMLRSRKDINILGINRGTRNLLYVTVINQQGEILYSRSLNEFNGVDYRDKLLVKERGIKDAAMNWQAADSIKNIKEGYLSRALGEIVRLMVKFNAICVVENLSSNFRNAGGGIFAYGNFYKGFETNLIKKLNCLIIKDAEKDKAGSVLRSLQMTRSFESFEKAGRQSGWLFMLDPAYISAVDPLTGFVNLFSFRNLKTIRQKAEFLQKFKSINYVPETKAFDFVFDYKDFGVTACGPVSCWVATSDVERIVKTTENGKVKFESVLPSMQLAKLFTDKDIDFTDGHNLISEITADSRLVTETLSIFMNIMRLYNYDIDRNNDYVSSPVMGRFDTRYDKKLHNPDELAAYNMARKGLMIIKRAQASEKDSKVDLFIKNADWFSFLQTGSI

SEQ ID NO: 28 - protein, 167 aa, unidentified
  REGION 1..167: note = Description of Unknown:uncultivated organism sequence
  REGION 1..167: note = Category: MG11 effectors
  REGION 1..167: note = Description: MG11-30 effector
MPLNKFVLTSKGKKWINVNNNGQWETIPTEPTKDLLKLFENRIDINGDIRAQITENKMSSEFYYDLTHIFKNVVQLRNSKIGDASVDYILSPYLLEDGTTFNSLDIQEQVQNGKNVMLPIDADANGAYHIALKGLMALETITEDGKIKISNKNTDWFEFIQKKKYRN

SEQ ID NO: 29 - protein, 496 aa, unidentified
  REGION 1..496: note = Description of Unknown:uncultivated organism sequence
  REGION 1..496: note = Category: MG11 effectors
  REGION 1..496: note = Description: MG11-31 effector
MKNNQFNENFREFTNQYSLTKTIRMELVPYNNDAKKLIHDYKSGCENGISKGKKFANNYVIVKKILDDYYRSQINEKLSVINLNDDKKIENAFDLFVNNKNDKNNKQFENSLKSLRIIIASALKPIKEIKYEKLINLYEVKGEKTCELIEFIKQNETLSEPDKEKYINAVSLFNSFVGYFSGYKENRNNMFSEKAEITAISNRLINENMLLYFENCLKLEKIKNNAEELHDELCEILKEFVLPKNYSMLLTQDKIEEYNKLIGHDASDKFAKGCNQLINEYRLKYPEKKKVIPFLNQLYNQILFRDIKTQNGIEKISTDKELFEIINVYIQNTLDDYLKTADNLFYDKTLFSDIYFLSNKFSSLSTILFESKNKSYSILKRKLAESNFDISKPVKINDIENNFKIDVYKILKCKYDQMNLEIKKNIERIKPILMLEKLNDDKSVPKIDNGNDKGGIGFQQIAIIQSLFNSIIELNRFMQLFSLELNGQKIEIENKN

SEQ ID NO: 30 - protein, 1282 aa, unidentified
  REGION 1..1282: note = Description of Unknown:uncultivated organism sequence
  REGION 1..1282: note = Category: MG11 effectors
  REGION 1..1282: note = Description: MG11-32 effector
MKDLNQFIGKYKVEKTLRFELAPIGKTEAWMESKGVIANDKRRADNYTIVKSLIDRYHKVCIRESLTGCNLNWTRLSEAVETYRRCQDTESRKALLKCQDEYRTEIAKKFLSFEDFAELTAPSPSALIKDTLPHHVTNKVHPEFSDIDDVDNAKQALSLFEGFAMYFESYQKNRSNLYTAKNIASSVAHRIVNDNFSKFLANIKVFENLRVIYPEIIEQCTNELRQLLKGKQLEEVFRVESFNNVLTQEGIDFYNTIIGGVSVQEGEKKFQGINELVNLTLHKEDQGRGKRTALTMVPLFKQILSDRNTYSYIPERINDEEELISVLRAFHAHLASFYLNGKEVNVMEELLKIVENINHFDPNGIFVDAKKLNGISKKLYDGLFELRTKMTSHLEEQKQTKKNIEKFFQKDAFSITELSLDKKHSLVKYFTGLKDVLKAIDQKWEQFETRNNKDGQKKYKDCHTGIELIKNLLDGYKEFFAVCSVLDVDSENALDNNFYGIFTPLLTELRGIIPLYNQVRNFLSQKPSDEKKYLLKFDNSKCSDGWDAPQTKSVRIFRGQGKFLLGVTDSENRSCLNDLSSYTPISPDDQIVFLDYSQGGHMGQNLLTLVVREGKTVMVKGRKENGENLGLERQLKELLPPDIYRIRKSQSYKNESPNFSKEDLLLFVDYYKQRAKEYYSHFSFTFKDSCYYASFTELVEDIDEKAYQIKFVPTSYKNLLRLVNEGKLYLFDIKNKDYEPGAHGKKNLHTLYWEQLFCQENLENLTIKLNAKSTLFCRPQIVANPKTHKKGSMLLNRKDKNGQPIPESIYQQLYKYVNGKIAEAKMSDEAKGYLDKIAVKEAQYAITKDKRYTKQKYFIHFSTTLNANAPKTTDINKEVLDYIKDNPDVNIIGIDRGERNLLYVTLINQKGEILDQKSLNIINGFDYHAKLEQREKERDEAQRSWQSVGNITDLKEGYLSAAIHEITTMMIENNAIIVLEDLNRGFKRGRFKFEKQVYQMFEKKLIEKLNYLCSKDIKPTANGSVLRGYQLTEKFVSFEKMTKQNGILFYVRPDYTSAIDPVTGFVTHFNFKDITNTKGRKDFFENMESITYKNGYFEFTFDYRKYKPKVKDFKNIWTVCSSGKRVLWSKETKEYTDYYPTTAISGAFASRGITLDEGADVKALLSGIDDSISNADFYRILFEAFKRIVQLRNTNSNTGEDYIHSPAIQDGKQYCSLDELRKWKDNGESSIPSLPIDADANGAYHIALKGLYLMLNLQAKQIENEKWFRFVVEKPFKEEKVM

SEQ ID NO: 31 - protein, 1308 aa, unidentified
  REGION 1..1308: note = Description of Unknown:uncultivated organism sequence
  REGION 1..1308: note = Category: MG11 effectors
  REGION 1..1308: note = Description: MG11-33 effector
MKDLNQFIGLYPVSKTLRFELKPVLQEGQTIDDFWNVYLNGPEKDVLHTLYTHDKERNDNYPIMKALLDQFHKNFIASALEDFEDGNGNVTWQKLEMEYQKNKKSKDYQDLQKKMRNKIREAFKKHELWPCISSYSTLISKQLKQMVKENEDGFVEAVQESHPKMELDRDKMLKAIETFNRFSVYFGNYQDNRNNMYSEEAQSTSIANRIVNENLPKFLDNIIVYQRLKDNCPNELKEIETNLSTTLNGLSLDDIFVPEYYNNCLTQNGIEKYNWILGGNPNEGVLGINSIGNDYLQHNPDSNLKLRNLEMTKLYKQILSDRERIAFLPEQFANDDELMQSINDFLDAFDSMNIFSCIQETMKILKDSNTNLEKIYVQGSKLTKLSTLLYGKWDVLGEKLRSTTVTGNTKKAQKEREEEIEKWLESKCFSLAEIKAVEDELMAQSAHPLSLMELLTDLTLWKYDQENNIWSKKSLIKLCEDSRITEFNVLMNDYQQGSISIKKDEAKEILKSVLDHYMELLHVLELLRLGKKSEYVEKDDFYTPYESLFEADDDKITISHIIPLYMKVQGYLTRKLTDQGKILLKFDSPTLANGWDDCSIVIKDNKYYLMMYLERLDDKETRALYAGNSADLVIYQQQKTDFRNAPRLFINSKGENRSPAVSKYNLPIEMVESLYKERKSLSSQAAKKAFDEQHPDYNTKLIDYYKIGFLRHDDFAPFRHTFESMWKSSSEYGSIQEFFEHTQEMCYMLSFKPIAFDYLCHLQKDGKVLLFNITNKDFNDGAKGTPNIHTLYWKELFSKDNLSNIVYKLSSQGIEFFYRKAIEKETAFVHKKGSVLVNKTFSDGTPIAGELYKKFVKHFNGSEVNLTQEEIVLLPMVKTKTAKFNITKDKRYYEHKFFLHVPITINFKASETTQKQFNERTLDIFRRNKQDLNIIGIDRGERNLVYVSVINQRGENLIPPRSYNLIGNYNYLAKLKQTEKNRDEARKNWTTIERIKDLKTGYLSQVVHEIAKLMVQYNAIVVLEDLNIGFKRGRFNVERQVYQNFEKMLIQKLNYLAFKKEMPSQECGNIRSGLQLTAPFTSFKDLGKQCGWLFYVPAGYTSKIDPSTGFVNLFNMNKPSTSLQEFFGAFDEIAYRNGLFYFTFDYSKEEFNTVKTDYTNRWTLSSHGNRIIGKEKELKDLTTKFREFFEKEVNMPLAEVSVQKVSSLEENKLQELWGLFKLLLKMRNSNDEYDYIISPVASETPFITGKDNRMQITDADANGAYNIALKGLYWLWNDFPTAEKGYLSYIKDEEWFRFIQTKPYLRDA

SEQ ID NO: 32 - protein, 1298 aa, unidentified
  REGION 1..1298: note = Description of Unknown:uncultivated organism sequence
  REGION 1..1298: note = Category: MG11 effectors
  REGION 1..1298: note = Description: MG11-34 effector
MRFSTNLDPNFSKMFEVKKTIRMELVPYNEDAKHLIHDYKSGLKNGISKGKKFADNYLLVKKVLDEWYRREINKKLLNINLNDDKKIENAFDLFVNNKIEKNEKQLEKALKTLRREIALLLKPIKDEKYDKLINLHNDGDSKTCELIKVIKKNENFSDVEKENYINAVKLFDAFAGYFSGYKENRNNMFSEKAEITAISNRLINENMILYFENCLKIEKIKNNAEELYDELCKILKEFVLPMNYSMLLTQDKIEKYNKLIGHEASDKFAKGCNQLINEYRLKYPEKKKVIPFLNQLYNQILFRDIETQNGIEKISTDKELFEIINVYIQNTLDDYLKTADNLFYDKTLFSDIYFLSNKFSSLSTILFEPENKSYSILKRKLAESNFDISKPVNINDIENNFKIDVYKILKCKYDQINLEIKKNVERIKPILLLEKLNDDKSVPKIDNGNDKGGIGFQQIAIIQNLFNSIIELNRFMQLFSLELNGQKIEIENKNLDFYYQYEKICELNKDFTIYLKTKDYLTKKPYSNDKIRLFFDNNSYFLNGFVESKTDTSDHGTQYGGYLFRKRNSFGEYDYFLGCSKNTKLFREHLASSISEEDRSEFERFYYYQLKTQTIYNNYKNQNGESYEIDKQKLKDAILDATKECGLPFSYEREDTPTNYLKKIEDENPSLFKLVISNENVMQLQLSIIKNLKTVFGKYVSKVPALKDVIDREYKLLKDFNDDIQTVSSNKIIYYAPVNQKELEDLQNQKEHLKKDAKFYLFKIENKDLRDKSKRINKIGTDNLHTMYFKALMSENQYTFDIGAGMVFFREQNYTGKKIIHEKNKPIKNKTYRYTKKESVFEYDIIKDKRYFEDKFFLHLSLSINYTKSSLKISDLNSKVNKFLYKNRNEITIMGIDRGERNLIYLTIIDLKGNIILQKSMNELIYNVKTDGTEFQVQKNYHTMLNNRVKERDLAKKSWGVIDSIKELKEGYLSQVVHEIILLMMRYNSIIVMEDLNPNFKHSRISIDSQIYQKFEKALIDKLGYLVLKRDEVIDGEIIEKGNVLNGFQLACPVPAIKDMKNQNGFIFYVWPQYTSKIDPISGFVSMFDTSEKNIDGYIAFFKKFSAIKYNGQDFEFYIDDYQLFFDKKNKMPLNKFVLTSKGTRWVNVKNNGKWESIPTEPTKDLLKLFENRIDINGDIRTQITENKMSSEFYYDLTLIFKNVVQLRNSKTGDASVDYILSPYLLENGTTFNSLEIQEQVQNGKNVMLPIDADANGAYHIALKGLMALETITEDGKIKISNKNTDWFEFIQKKKYKN

SEQ ID NO: 33 - protein, 1304 aa, unidentified
  REGION 1..1304: note = Description of Unknown:uncultivated organism sequence
  REGION 1..1304: note = Category: MG11 effectors
  REGION 1..1304: note = Description: MG11-35 effector
MARIIDEFCGQENFNDFVGLFSLTKTIRMELVPYNENAKHLVCDIQTDSDNAIERARTFANNYVIVKKILDNYYRQEINNKLLNYNLNVDNKIGKAFDLFLANKTTKETKLFDTILKDLRGQVVNELKSIKEIKYDNLINLHDVNGEKTCLLIELIKKDKSLSESEKEKKINAIKTFDKFAGFFSGYKENRNNMFSDKTEMTAIANRLINENMIFYFENCFKLEKIKNYALDLYNALCEILHDFVCPTNYGKLITQDAIEGYNTLIGHSFADKYSKGCNQIINEYRINHPDLKKHIPFLNRIYNQILFRDKKIENNSNEIITDKELFERIDSYTRYSLSDYLQSVDSLFNDRDLFSEIYFLPNKLNILSQILFEKERNSFSILKKKLAEKNIDSSIPVTLENISLVCSLDVYEILKCKYDQISSAIKTNLEHLKPILLLDKLNDDRSVPKLGAEYDKGGLGFQQIGIIQHFFNSVIELNRFVQLFSLELNGKEVEIENKNFDFYHRYCLINEFKDDFSIYLKVKDYLTRKPYSNDKVRVYFENNSYFLNGFVESRTEKSDHGTQYGGYLFRKLNSSGDYDYFLGCSKNAKLFREHLASSVSENDKSTYERFYYYQLKTQTIYYNYRNEQGETYEIEKQKLKDVILQATKENGRLFEYDDKDTPTNYLNKIERENQSLYKAIIENENVKQLQLSIIKNLKFAFEKYVSKVPALKDILDKDYQFLKDFNDDIQEVSNNKIIYYAPVSQQEWESVLNFTEDSSDKGKFYLFKIQNKDLKDKSNRKNKSGIDNLHTLYFKTLMSEHQHTFDIGAGMVFFREKNYRGKKIIHQRNKPIQNKTPNYSKLESLFEYDIVKDKRYFENKFFLHLSMMINYSKSSLRMADLNTKVNKFIYNNKDSINIMGIDRGERNLIYITIIDQKGNILLQKTMNNLTYMVKNAEADFFVNKDYHKLLSNRVKERDVAKKNWGTIDSIKELKEGYLSQVVHEIVLLMMRYNAIIVMEDLNPNFKRSRINIESQIYQKFEKALTDKLNYLVLKKDEVIDGKKIVKGDVQNGLQLTCPVPAIKDMKNQNGFIFYVWPQYTSQIDPITGFVSLFDTRAKNIEGYLSFFKKFSAIRFNGEDFEFTVDNYQQFCNQKDVMPFNSFVITSRGVRLIKVKKGSRWETITVEPTKQLYQLFENKIDIYGDIRAQITDVNMSSDFYYELMLIFKSIVQLRSSKSGDSSIDYILSPILLDDGTTFDSYQQKILEENGERALLPIDADANGAYHIALKGLMALDTITSDGKIKISNKNSDWFMFIQKKDYKK

SEQ ID NO: 34 - protein, 1302 aa, unidentified
  REGION 1..1302: note = Description of Unknown:uncultivated organism sequence
  REGION 1..1302: note = Category: MG11 effectors
  REGION 1..1302: note = Description: MG11-36 effector
MRNVENFTGLYQISKTLRFELKPMLKSGETTEDFWNRYINGNEDDRLHKLYMSDDGRHEKYPLMKAMLDQWHKIFISRVLSQFSETVVTWQQIAEAYINKSDDYKTLQEEMRKSIRKSFESHVWWKYMSAEFKNLISEQIRYMVENNENNFIETVQNSNPKMNATREDMLEAIDSFANFSAFFDIYKDNRMNMYSHEDKTTSIANRVVNENFPKFLDNIKVYEKLKEICPDELKIAENSLQAQLNGKTLDDVFKPEYYNNCISQQGIEVYNWIIGGNPNENVIGINSIGNEYIQSHPDTNYKLRNLKMTQLFKQILSDRVRLSFIPEQFGSDDELMQSISSFLDEVESSKLMTRIKETMGSLLDGTVNLEKVYIQGTNLTKLSAMMYGGSNWNALGEKLRAMTVNSKTKKGQAEIDEKIDSWLAKKCFSVAQTQKASYEISKEIQSSVTLLDVLGRLVAHKCDSETKTWSDKSYIDICNNARIIQFKELMNGYKSGNVSIKDDSAKEIIKTVLDNYIELFNVVNLLRLNKKMDSLDKDDFYVAYNALFESEDELTITQIIPLYNKVRNYLTRKLSNGGKIELKFDSPTRANGWNDCSIIIKDGKYYLAMYIDKISNVDTERLYAGNTASLVESKQQKTDFKNLSRLFFYSKGTKLAPAVTEYNLPIETISDMYNEKRGISGAAKLKEFNKKYPDFTRKMIDYLKVGLSKHSSFSMFSENFRSLWKDSSEYKSIKEFCDHTQTICYAVSLRPISFEYLYTLQNENKMLLFNITNKDFNSGSYGTPNLHTLYWKELFSEENMKNPVYKLSSQGVKFFFREAITEEKPYKHRKGSTLVNKTFADGTPIEGTLYKRLMLFLNGADIQLTDKEKELLPKLKTRKAKHEIVKNRRYYENKFFFHVPIVINYNVAAETPSLYQFNKSVLDNFRANKRDINIIGIDRGENNLIYVSVIDQHGKNIITPRSYNLIGNYNYMEKMKQVEKNRDEARKNWTTIEKIKDLKNGYLSQVVHEISSLIFRYNAIVIMENLDSEFKRGRYKIERQVYQNFEKMLMDKLNYLVFKRNANETCGTVRDGLQLTAPANFNELGKQNGWIFYVPAAYTSMMDPSTGFVNLFNMKKPAESLQKFFGSFNEITYKNSMFYFTFDYRNFKTIRNDYTNVWTLSSHGMRNYGKNKRLEVLTGLFCNFFDKVGIQYTDVSVKTVSELDESKLVELWNIFKCMLKMRNYNGDNVGFDISPVASENPFITGTNNSMGIMDADANDAYNIAIKGLYWLHNDFPVNDKGYLEYIKDEDWFKFVQSKPYSK

SEQ ID NO: 35 - protein, 1235 aa, unidentified
  REGION 1..1235: note = Description of Unknown:uncultivated organism sequence
  REGION 1..1235: note = Category: MG11 effectors
  REGION 1..1235: note = Description: MG11-37 effector
MLDKFASLYPVTKTLRFRLLPQGRTEENMQAAKVLENDLERSEAAAVVKGLIKKYHLQFISDTLSGSTLSWQALTETLDKFKADHTATAELDSALAAYRCKLAELFTKSPKYKVMATPVSIIKEILKTETDPENIAALNKLNGYTYIIFDYVSTRMLTYSADAKATSLAYRLVDENYLRFYQDISAAAEISAVLEEAGLDNAEVEAFIRTDYNTCLTSEGIASFNAAAGSINQFVNQLLQQNPVLQSEPSLRRHLQPLYKMLLDEAESKIIKFEDYGQLRDAVENFRRNFQDLPQSLIDIFAGRYDYSKIYVGYKYLNEASSQIAGGYNWKLLENALEDFYSKPYLVNGKLPVKYKTVVNKKMNQLAYSFTELQEALDAGESGSSITDLFGKYAELHAAYAAADGNVFYKEYDRKSIASLKNYLDAVNAIARFIKIFAVPEVYVKDEGFYGIVDGAADKLRDFDLLYNMVRNYITKKPYKKSKVALTFNSSSFGRGWDENKIYDELTTIFTYNGKYYLGVINKNDKPDLAAAVSKDEGGYKRMVYKTFDIVKQLPRLSFTKAVKAHFEESDEDYIFDGPKFAKPLRVPKEIYLQSFTDNGDKLADSTKKYTKAYLDMSGDYKGYYEAIVKRIDYTKEFLSAYKSTSIYDLAFLKPADQYEQWSNFTDDVQTALYKIRWDTIPAAAIDEMVESGKLYLFEIYSADLYKNPAEGRKIDTQAQIFKEIFSENGQKVIKLLGNCEVYFRPASLPAVVTHPKGSILVNKQLVNGKTLPDEVYREIYRYLNKKSENLSPLAKQLLDKELVKYRVAQEDIIKDKRFTENQYSFHLPVTLNYKVKQQFYINMEVMNMLRSRKDINILGINRGTRNLLYVTVINQQGEILYSRSLNEFNGVDYRDKLLVKERGIKDAAMNWQAADSIKNIKEGYLSRALGEIVRLMVKFNAICVVENLSSNFRNAGGGIFAYGNFYKGFETNLIKKLNCLIIKDAEKDKAGSVLRSLQMTRSFESFEKAGRQSGWLFMLDPAYISAVDPLTGFVNLFSFRNLKTIRQKAEFLQKFKSINYVPETKAFDFVFDYKDFGVTACGPVSCWVATSDVERIVKTTENGKVKFESVLPSMQLAKLFTDKDIDFTDGHNLISEITADSRLVTETLSIFMNIMRLYNYDIDRNNDYVSSPVMGRFDTRYDKKLHNPDELAAYNMARKGLMIIKRAQASEKDSKVDLFIKNADWFSFLQTGSI

SEQ ID NO: 36 - protein, 844 aa, unidentified
  REGION 1..844: note = Description of Unknown:uncultivated organism sequence
  REGION 1..844: note = Category: MG11 effectors
  REGION 1..844: note = Description: MG11-38 effector
KYAELHAAYAAADSNIFYKEYDRKSIASLKNYLDAVNAIARFIKIFAVPEVYVKDEGFYGIVDGAADKLRDFDLLYNMVRNYITKKPYKKSKVALTFNSSSFGRGWDENKIYDELTTIFTYNGKYYLGVINKNDKPDLAAAVSKDEGGYKRMVYKTFDIVKQLPRLSFTKAVKAHFEESDEDYIFDGPKFAKPLRVPKEIYLQSFTDNGDKLADSAKKYTKAYLDMSGDYKGYYEAIVKRIDYTKEFLSAYKSTSIYDLAFLKPADQYEQWSNFTDDVQTALYKIRWDNIPAAAIDEMVESGKLYLFEIYSADLYKNPAEGRKIDTQAQIFKEIFSENGQKVIKLLGNCEVYFRPASLPAVVTHPKGSILVNKQLVNGKTLPDEVYREIYRYLNKKSENLSPLAKQLLDKELVKYRVAQEDIIKDKRFTENQYSFHLPVTLNYKVKQQFYINMEVMNMLRSRKDINILGINRGTRNLLYVTVINQQGEILYSRSLNEFNGVDYRDKLLVKERGIKDAAMNWQAADSIKNIKEGYLSRALGEIVRLMVKFNAICVVENLSSNFRNAGGGIFAYGNFYKGFETNLIKKLNCLIIKDAEKDKAGSVLRSLQMTRSFESFEKAGRQSGWLFMLDPAYISAVDPLTGFVNLFSFRNLKTIRQKAEFLQKFKSINYVPETKAFDFVFDYKDFGLTACGPVSCWVVTSDVERIVKTTENGKVKFESVLPSMQLAKLFTDKDIDFTDGHNLISEITADSRLVTETLSIFMNIMRLYNYDIDRNNDYVSSPVMGRFDTRYDKKLHNPDELAAYNMARKGLMIIKRAQASEKDSKVDLFIKNADWFSFLQTGSI

SEQ ID NO: 37 - protein, 391 aa, unidentified
  REGION 1..391: note = Description of Unknown:uncultivated organism sequence
  REGION 1..391: note = Category: MG11 effectors
  REGION 1..391: note = Description: MG11-39 effector
MLDKFASLYPVTKTLRFRLLPQGRTEENMQAAKVLENDLERSEAAAVVKGLIKKYHLQFISDTLSGSTLSWQALTETLDKFKADHTATAELDGALAAYRCKLAELFTKSPKYKVMATPVSIIKEILKTETDPENIAALNKLNGYTYIIFDYVSTRMLTYSANAKATSLAYRLVDENYLRFYQDISAAAEISAVLEEAGFDNAEVEAFIRTDYNTCLTSEGIASFNAAAGSINQFVNVLLQQNPVLQSEPALRRHLQPLYKMLLDEAESKIIKFEDYGQLRDAVENFRRNFQDLPQSLIDIFAGRYDYSKIYVGYKYLNEASSQIAGGYNWKLLENALEDFYSKPYLVNGKMPVKYKTVVNKKMNQLAYSFTELQEALDAGESGSSITDLFG

SEQ ID NO: 38 - protein, 798 aa, unidentified
  REGION 1..798: note = Description of Unknown:uncultivated organism sequence
  REGION 1..798: note = Category: MG13 effectors
  REGION 1..798: note = Description: MG13-2 effector
FESDEDVLVAIEKAYVELYERVLCNERSLKELLCHLSDYDLNNIYVCNDLQLTDISQRLFGGWEVIQKAMIEELKRTVPRKSKSEKDEAYEERIQKMYKTFKSISIAQINHCLTSCKENDVQTIEGYFSNLGAIHTDTIQRENLFVRIENAYTDVKELLNTPYPKEKLLAQDKYNVEKIKTLLDSIKDLQHFVKPLLGKGDEAEKDEKFYGELVALWEELDKITPLYNMVRNYVTKKPYSIKKIKLNFENSTLMNGWDVNKERDNTTVILRKDGLYYLAIMNKKYNRVFDVDVMEMHGDCYEKMEYKLLPGANKMLPKVFFSKSRIDEFQPSEVLLENYKKETHKKGENFKLSDCHALIDFFKSSIEKHEDWNKFGFKFSDTCTYQDLSGFYREVEQQGYKISFRNVSVDYINSLVDEGKIYLFQIYNKDFSPYSKGTPNLHTLYWKMLFDERNLTDVVYKLNGEAEVFYRESSIHVEKPTHPANQSIKNKNELNEKKHSVFPYDLIKHRRYTVDKFQFHVPITMNFKGMGQENINHSVNEYIRESEDLHIIGIDRGERHLLYLTLIDMKGNIKEQYSLNEIVNEYKGNTYRVDYHDLLEKREKERMEARQSWQTIENIKELKEGYLSQVIHKISQLMVKYHAIVVLEDLNTGFMRGRQKIEKQVYQKFEKMLIDKLNYLADKQKSPEELGGILNAYQLTSKFVSFQKLGKQSGFLFYTPAWNTSKIDPVTGFVNLFDTRYETREKSRAFFGKFDFICYNADKDWFEFTFDYGKFTSKAEGTRTRWTLCTQGMRIETY

SEQ ID NO: 39 - protein, 1256 aa, unidentified
  REGION 1..1256: note = Description of Unknown:uncultivated organism sequence
  REGION 1..1256: note = Category: MG13 effectors
  REGION 1..1256: note = Description: MG13-3 effector
MEFKDFTNQYKMNKTLRFELKPVGHTLELIRQNAIISSDEGLAEAYQKVKKIIDEYHRYYIETQLANLQLQCEEQTDAKGKGKCNSLAEYYALRGDESDSGKKNFKKVKELLRKQVSDCLQKSAEYKTIFKKELIQVDLINFVNGLDISEEEKSKRRKLIEAFNNFTSYFVGFHQNRENMYTFEEKSTSIAYRLINENLPKFIDNISVFVKISEVPELKDKISQLTEDFSSYLGGVSVENVFKLEYFNKVVTQRQIEVYNALIGGRSEGDTKIQGLNEYINLYNQKHPEAKLPRFKVLYKQILSDREPISWLPEQFKRDGDLLDAVREYHEEMQLVAENIMVLLSDIKNYNLDGIFVSNDTQLTSISKALDENGNWGRIQRDFIEYFKSQNKKKKNEGDEKYYERMKDLYDANKSFSISEINSVAGLNVEEYFANMEVRDYTDDTARKKINVFDAISDAYSDVEYLLTSEYPKEKHLISEENDIESIKCLLDTWKSLQHFVKPLLGTGDEPAKDNAFYGEFNEYWDKLNKLNALYNKVRNYLTRKPYSDEKIKLNFRSAQLLGGWDQNKETDCLSVLFMKDGKYYLGIMNKRVKEDLDYNENKGNNKIFATKLSSTGDCYQKMVYKLLPGANKMLPKVFFSESRINEFAPSAKILHIREIGSYKSGDTFNLDDCHALIDFYKESLQKHEDWSKFNFEFPDTSEYSNINEFFEDVERQGYKVEFQPISVKVIDKFVNEGKLYLFEIYNKDFSEHSKGTPNLHTIYWKMLFDERNLKDVVYQLNGQAEVFFRKKSLDNKFPTHPAGTPIKNKNKQNPKKESVFEIDLIKNKRYTEDKFLFHVPITMNFKSGKIGSLNSKVLEYIKEADDLHIIGIDRGERNLLYVVVIDKNGNICEQVSLNQIGNVNYHNLIDEREGNRQKQRENWKTIEGIKDLKQGYLSQAVRIIADLMVKYKAIVVLENLNLGFMRGRQKVEKSVYQQFEKMLIEKLNYLVDKKAAPNLPGGALKAYQLANKFESFRAIGRQCGFLFYIPAWNTSKIDPATGFVNMLNPRYESIEKSKDYIGKFDAIRYNADKDYFEFDIDYSEFTVRAEGTKLKWPLCSYGTRIENYVDSQSGKWASRTVILTDEFKRAFKDLDINGDLKGQILSQSEKSFFEDLFRVLRLLVQLRNSEIQEHGESVKEPEDYILSPVANSEGVFFDSRKADDSMPKDADANGAYNIARKGLMIVNQVKQEKDLDKFKSDLTNKNWLNFAQEGK

SEQ ID NO: 40 - protein, 1256 aa, unidentified
  REGION 1..1256: note = Description of Unknown:uncultivated organism sequence
  REGION 1..1256: note = Category: MG13 effectors
  REGION 1..1256: note = Description: MG13-4 effector
MEFKDFTNQYKMNKTLRFELKPVGHTLELIRQNAIISSDEGLAEAYQKVKKIIDEYHRYYIETQLANLQLQCEEQTDAKGKGKCNSLAEYYALRGDESDSGKKNFKKVKELLRKQVSDCLQKSAEYKTIFKKELIQVDLINFVNGLDISEEEKSKRRKLIEAFNNFTSYFVGFHQNRENMYTFEEKSTSIAYRLINENLPKFIDNISVFVKISEVPELKDKISQLTEDFSSYLGGVSVENVFKLEYFNKVVTQRQIEVYNALIGGRSEGDTKIQGLNEYINLYNQKHPEAKLPRFKVLYKQILSDREPISWLPEQFKRDGDLLDAVREYHEEMQLVAENIMVLLSDIKNYNLDGIFVSNDTQLTSISKALDENGNWGRIQRDFIEYFKSQNKKKKNEGDEKYYERMKDLYDANKSFSISEINSVAGLNVEEYFANMEVRDYTDDTARKKINVFDAISDAYSDVEYLLTSEYPKEKHLISEENDIESIKCLLDTWKSLQHFVKPLLGTGDEPAKDNAFYGEFNEYWDKLNKLNALYNKVRNYLTRKPYSDEKIKLNFRSAQLLGGWDQNKETDCLSVLFMKDGKYYLGIMNKRVKEDLDYNENKGNNKIFATKLSSTGDCYQKMVYKLLPGANKMLPKVFFSESRINEFAPSAKILHIREIGSYKSGDTFNLDDCHALIDFYKESLQKHEDWSKFNFEFPDTSEYSNINEFFEDVERQGYKVEFQPISVKVIDKFVNEGKLYLFEIYNKDFSEHSKGTPNLHTIYWKMLFDERNLKDVVYQLNGQAEVFFRKKSLDNKFPTHPAGTPIKNKNKQNPKKESVFEIDLIKNKRYTEDKFLFHVPITMNFKSGKIGSLNSKVLEYIKEADDLHIIGIDRGERNLLYVVVIDKNGNICEQVSLNQIGNVNYHNLIDEREGNRQKQRENWKTIEGIKDLKQGYLSQAVRIIADLMVKYKAIVVLENLNLGFMRGRQKVEKSVYQQFEKMLIEKLNYLVDKKAAPNLPGGALKAYQLANKFESFRAIGRQCGFLFYIPAWNTSKIDPATGFVNMLNPRYESIEKSKDYIGKFDAIRYNADKDYFEFDIDYSEFTVRAEGTKLKWTLCSYGTRIENYVDSQSGKWASRTVILTDEFKRAFKDLDINGDLKGQILSQSEKSFFEDLFRVLRLLVQLRNSEIQEHGESVKEPEDYILSPVANSEGVFFDSRKADDSMPKDADANGAYNIARKGLMIVNQVKQEKDLDKFKSDLTNKNWLNFAQEGK

SEQ ID NO: 41 - protein, 1255 aa, unidentified
  REGION 1..1255: note = Description of Unknown:uncultivated organism sequence
  REGION 1..1255: note = Category: MG13 effectors
  REGION 1..1255: note = Description: MG13-6 effector
MNDFIRLYPLSKTLRFKLIPLRKTLEYIVSNGLLEQDRHRAESYVRVKDIIDNYHKAFIERVLSTFKLQYADRQSKDSLEEYYTYYMVGNKTEEQLKVFSEIQEKLRKQIAGCLVSDPVFKRIDKKELIKEDLVDFVSTEEERQLIAEFKDYTTYFTGFHENRRNMYSSEAQSTAIAYRLIHENLPKFIDNLQVFSKMAATSVAEKLPQLYADFEEYLNVAEINDMFRLDYFNVLLTQTQIDVYNAIIGGKALEDGTRIQGLNEYINLYNQQQKDKHVRLPKFKLLYKQILSDRNAISWLPDEFVSDNETLEAIERCYEDLESQILNRKVEGEHSLKTLLEGLEEYDLAKIYVRNDLQLTDISQKIFGDWSVVQRTYIDTFKNENPLTKKETMDKYEERIEKYWKGLKMLSIADIDARLILSGKDKTQTFACYFRRLGKDVKNDVEQNVFERIEIAYLNVKDLLNTPYPAHKNLAQDKESVEKIKLFLDAVKDLQYFVKPLLEKGLEVEKDERFYGEFIPLWEELDKITPLYNKVRNYLTRKPYSTQKIKLNFENSTLMDGWDENKERDNCTVILRKDGLYYLAIMNRNHRKIFDKKIMPSSGECYEKMVYKLLPGANKMLPKVFFSKSRIGEFNPSVRVREIYEKGTFKKGNDFNLEDCYAMIDFFKESINKHEDWSKFGFHFSKTEDYKDLSDFYKEVEQQGYKVSFVNVSQSYVDQLVDEGKLYLFQIYSKDFSPYTKGTPNMHTLYWKMLFDEQNLADVVYKLNGQAEVFYRKASIKSDRPTHPANVPIANKRKGTEKKESVFAYDLIKDKRYTVDHFQFHVPITLNFKSRGADNINQLVNEYIKQTGDELKIIGIDRGERHLLYLTLIDTKGRIVSGMQFSLNQVDQTDYHQLLTQREEERLKARQSWRTIENIKELKEGYLSQVVHTIATLMVEHNAIVVLEDLNMGFMRGRQKVEKQVYQKFERMLIDKLNYLVDKKKESSEAGGLLKAYQLTSKFESFQKLSKQSGFLFYVPAWNTSKIDPVTGFVNLFDIRYESVDKSKIFLAKFDDIRYNAGKDWFEFSFDYSHFTSKAQDTRQNWTVCSYGERIETYRNPTKNMNWDNREVLLTDEFKNLFQTYGIDYSAGSLKEQILNQTEKSFFCNEKLDKKTPIGLLQLLKLTLQMRNSITGTEVDYLVSPVVDEKGQFYDSRTCGDDLPQNADANGAYNIARKGLWVVQQIRQSTDLKKLKLTISNKEWLRFVQQKLYLE

SEQ ID NO: 42 - protein, 1298 aa, unidentified
  REGION 1..1298: note = Description of Unknown:uncultivated organism sequence
  REGION 1..1298: note = Category: MG13 effectors
  REGION 1..1298: note = Description: MG13-7 effector
MNDNRTDFNQFSNLYSQSKTLRFSLEPEPKEKTLENLGFIKKENVWVLDEKNSLLGQDKERADDYKKVKGLIDDYIKDFIEKSLSHLELNKEDLENFEKLYKKKGKNEEERICFDEIKAKLRGQIADYLKNDPCYPSILKESKGKGKGKGKKVVDHSSNASTNPSVPEVNKKKEKGKSKKEDNETFFFEHLYNFVEEDDRRYIDKFKKFTTYFRGFNENRKNLFTEEAQATAIAYRLVHDNLPKFIDNMQCFEAFKDAGLADKLPELYASLGAEPGVGTIDEMFRLDYYSRLLTQSHIDIYNAVIGGKTTDKEKIQGLNELVNLYNQQQTDRSMRLPLFKPLFKQILSDRGSLSWLPEQFGSDNEVLESIEACYKELEYTFSSLKQLLEELGNYDLHKVYVYYAMLPPISLAVYDDWSAIYRALDAAFMRENPRKKNEKDEKYEERRQKYFKNKSACSIAEVEEALVVQDADSPHALAGYFSRLDAGREDGEASADLFARIAALHKEAEPLLTASYPKEKNLARDKEGVGKLKNLLDAVKALQHFVAPLAATAEQPDKDERFYGQLMPLWHSLGQVTPLYNQVRDYLTRKPYSVEKIKLNFENSTLMDGWDVNKIRDNTTVILRKDGAYFLAIMDKKHNKTFDAKNIQTDGVCYEKMDYKLIPGPNKMLPKVFFSQKGKSEFNPSSQIMEIYEERGSFKKGDSFRIEDCRALIDFYKDAISRHPDWKNFGFQFSETQSYNDISDFYHEVEMQGYSISFSPVSENYINSMVDGGKLYLFKIYSKDFSSKSKGRPNLHTIYWRMLFDPRNLADVSFRLNGGGEVFYRKASLPNEPEKPTHPAGRPIANKRAGAKKKESCFNYDLIKDERFTERHFELHVPITLNFKSRQIKDINQMVKEYIHDAADLHVIGIDRGERNLLYLSLIDMQGRIVKQESLNRVDRTDYHALLEKREVERQKARRSWQTIESIKELKEGYLSQVVRVVANWMVEYHAIVALENLNFGFKRGRQKVEKQVYQKFEKMLTDKLCYLVDKTKDADEPGGALRAYQLAKPLEKSANMGFQNGFLFYVPAWNTSKIDPVTGFVNLFDTRYESKDKAKDFFKKFDAIRYNEATGLFEFVFQYSEFPTKAEGTRDGWTLCSHGERIEAFKDKAGHWDTCTVNLTEELKKLFAHYGIALDGDLRAAISRQTDKKFFQNDKREGDCPRGLMQLFRLMVQMRNSEPGTNTDYLISPVADAQGRFFDSREVGDDLPKDADANGAYNIARKGLWLVRKIKEGASPEELKLTNQEWLSFAQEKPYEE

SEQ ID NO: 43 - protein, 1231 aa, unidentified
  REGION 1..1231: note = Description of Unknown:uncultivated organism sequence
  REGION 1..1231: note = Category: MG13 effectors
  REGION 1..1231: note = Description: MG13-9 effector
MKFQDFTNLYPLNKTLRFELQPIGKTKENIERKGFLFNDKQRAGDYKKVKRIIDEYHKKLIDESLASFTLQYENKGKKDSLLEYYESLKSARTSNNETFAKIRTNLRQQISKCLRRSEEYKRIYKKELFSQDLPQFVAEENLDLIKKFNGFATYFSGFHQNRQNMYSDDAKSTAIAFRMIHENLPKFIDNIDIFNKIKHIPEIAENLAQLYKDFEQYINVGKIDEVFELPYFNYTLTQSQIEIYNAIIGGKSEGDIKIKGLNEYINIYNQTHKESRLPKFKVLYKQILSDREHISWLPEQFNDDNELLQAIKEYYDSIYNHLANLRVILETLDTYDLCGVFVRNDQQLTNISKRVSNDWSKIQSAITEDLKQVRRQKKKEDSETYEEELRKLYKKQGSFSIDYIYKVADLQINSYFTNLDAINTEDLQQENIFARITNAYTEIRSLLEEPYPANKKLIQDKNDVVTIKVFLDTLLELLHFVKPLLGTGEESDKDNRFYSEFIPIWEKLNLLTPLYNKVRNYVTRKPYSVEKYKLNFGSPQLLGGWDKNKEKDCLSVLLRKDGKYFLGVMNKHNNKIFEQFPCDGDCYEKVVYKLLPGANKMLPKVFFSKSRIGEFMPSEEVLDIYDSGSFKKGANFNLQDCHKLIEFYKGAIAKHEDWSKFEFDFSNTESYDDISGFYREVEEQGYKLTYQLISVSYIDTLVEEGKLYLFQIYNKDFSKHSKGTPNMHTLYWKMLFDERNLADVVYQLNGGAELFYRERSIEYDKPTHPAKIPIKNKNTHNPKNESCFRYDLIKNRRYTIDKFQFHVPITLNFKSPGRDNINSLVCDYLHSTENTHIIGIDRGERNLLYLVVINPKGEICEQISLNEICNYHNGNLHKTDYHNLLDKREKDRHNERQSWQTIEGIKELKEGYLSQVIHKISELMVKYNAIVVLEDLNSEFMRGRQKVEKSVYQKFEKMLIDKLNYLVDKKADPAIPGGLLRAYQLTNKFDSFTKLGKQSGFLFYVPAWNTSKIDPATGFVNLLDLRYESEDKAKLLLSKFDSIRYNNDKDRFEFKIDYNKFTTKAAGTRTKWTICTYGTRIETFRNPAKNSQWDSREVNLTAEFKDLFEGMDICGNLKEIIMQQNGKQFFERLLHLLRLTLQIRNSITGTDVDYIISPVANDRGEFFDSRNSDTTMPQDADANGAYNIARKGLMIIEQIKNSDTPQSIKFDLSNKRWLQFAQQEDKDVVYL

SEQ ID NO: 44 - protein, 1254 aa, unidentified
  REGION 1..1254: note = Description of Unknown:uncultivated organism sequence
  REGION 1..1254: note = Category: MG13 effectors
  REGION 1..1254: note = Description: MG13-10 effector
MKNILEQFVGLYPLSKTLRFELKPLGKTLEHIEKKGLIAQDEQRAEEYKLVKDIIDRYHKAFIHMCLKHFKLKMYSEQGYDSLEEYRKLASISKRNEKEEQQFDKVKENLRKQIVDAFKNGGSYDDLFKKELIQKHLPRFIEGEGEEEKRIVDNFNKFTTYFTGFHENRKNMYSDEKESTAIAYRLIHENLPLFLDNMKSFAKIAESEVAARFTEIETAYRTYLNVEHISELFTLDYFSTVLTQEQIEVYNNVIGGRVDDDNVKIQGLNEYVNLYNQQQKDRSKRLPLLKSLYKMILSDRIAISWLPEEFKSDEEMIEAINNMHDDLKDILAGDNEDSLKSLLQHIGQYDLSKIYIANNPGLTDISQQMFGCYDVFTNGIKQELRNSITPTKKEKADNEIYEERINKMFKSEKSFSIAYLNSLPHPKTDAPQKNVEDYFALLGTCNQNDEQQINLFAQIEMARLVASDILAGRHVNLNQSENDIKLIKDLLDAYKALQHFVKPLLGSGDEAEKDNEFDARLRAAWNALDIVTPLYNKVRNWLTRKPYSTEKIKLNFENAQLLGGWDQNKEPDCTSVLLRKDGMYYLAIMDKKANHAFDCDCLPSDGACFEKIDYKLLPGANKMLPKVFFSKSRIKEFSPSESIIAAYKKGTHKKGPNFSLSDCHRLIDFFKASIDKHEDWSKFRFRFSDTKTYEDISGFYREVEQQGYMLGFRKVSETFVNKLVDEGKLYLFHIWNKDFSKHSKGTPNLHTIYWKMLFDEKNLTDVVYKLNGQAEVFYRKKSLDLNKTTTHKAHAPITNKNTQNAKKGSVFDYDIIKNRRYTVDKFQFHVPITLNFKATGRNYINEHTQEAIRNNGIEHIIGIDRGERHLLYLSLIDLKGNIVKQMTLNDIVNEYNGRTYATNYKDLLATREGERTDARRNWQKIENIKEIKEGYLSQVVHILSKMMVDYKAIVVLEDLNTGFMRSRQKIERQVYEKFEKMLIDKLNCYVDKQKDADETGGALHPLQLTNKFESFRKLGKQSGWLFYIPAWNTSKIDPVTGFVNMLDTRYENADKARCFFSKFDSIRYNADKDWFEFAMDYSKFTDKAKDTHTWWTLCSYGTRIKTFRNPAKNNLWDNEEVVLTDEFKKVFAAAGIDVHENLKEAICALTDKKYLEPLMRLMTLLVQMRNSATNSETDYLLSPVADESGMFYDSREGKETLPKDADANGAYNIARKGLWTIRRIQATNSEEKVNLVLSNREWLQFAQQKPYLND

SEQ ID NO: 45 - protein, 1249 aa, unidentified
  REGION 1..1249: note = Description of Unknown:uncultivated organism sequence
  REGION 1..1249: note = Category: MG13 effectors
  REGION 1..1249: note = Description: MG13-11 effector
MKEFTNLYPVSKTLRFDLQPIGRTKENIERNGILQRDEKRAEDYKTVKGFIDEYHKQFIKDRLWSYKLPLYSEGHLNSLEEYQALYELSKRDETQEREFAEVKDNLRAFIAKRLTEGGSAYDRIFKKELIREDLVDFLENEDDREIVRQFADFTTYFGGFHENRKNMYSAEEKSTAIAYRLIHQNLPKFMDNMKAFAKIAESSVSEHFEEIYEGWKEYLNVGSLEEIFRLDYFSVTLTQPHIEVYNYIIGKKILEDGTEIKGINEYVNLYNQQQKDKTKRLPFLVPLYKQILSDREKLSWMAEEFDSDDQMLTAINESYSHLHDLLMGDDNESLRSLLEHLKDFNLEQINITNDLSLTDISQHLFGRYDVFTNGIKDELRIITPRKKKEDDESFEDRISKIFKTQKSFSIALLDKLPQPVMEDGKLRTVEDYFLSLGAVNTGLTQKENLFAQIENAYEDARTILQLKNTDDTLSQDKPAVAKIKTLLDALKDLQHFIKPLLGSGEENEKDELFYGSFQMMWDELDTVTPLYNKVRNWLTRKPFSTEKIKLNFDNSQLLGGWDVNKEPDCTGVLLRKDGLYYLGIMDKKSNRIFEADVTPTDGVCYEKFDYKLLPGANKMLPKVFFSKSRIDEFSPSETIIASYKRGAHKKGANFNLAECHRLIDFFKQSISKHEDWSKFGFHFSDTKTYEDISGFYREVEQQGYMLSYHPVSSSYINQLVDEGKLYLFRIWNKDFSEFSKGTSNLHTLYWKMLFDEQNLANVVYKLNGQAEVFYRKASIKSENRIIHKANQPINNKNELNKKDTSTFEYDIIKDRRYTVDKFQFHVPITINFKATGQTNINPIVQDVIRQGGFSHIIGIDRGERHLLYLSLIDLQGNIVKQMTLNDIINEYKGQTYKTNYHDLLAKREGERTDARRSWETIETIKELKEGYLSQVVHIISKMMVEYNAIVVLEDLNTGFMRGRQKIERQVYEKFEKMLIEKLNCYIDKHAEPTEETGLLHPLQLTCDAKKWTRSHQCGCLFYIPAWNTSKIDPVTGFVNLLDTRYDTREKARLFFSKFQRISFNVDMGWFEFAFDYNDFNTKAEGTRTQWNLCTFGERIRSFRNPKKNNQWDDERIVLTDEFKQLFEKYDIDIAGNLKEAISAQSDAQFFKELLGLMKLLLQMRNSVTNSEEDYLLSPVADENGHFFDSREGISSLPIDADANGAYNIARKGLWVIRKIQETQEDEKVSLNITNKEWLQFAQTKPYRND

SEQ ID NO: 46 - protein, 1262 aa, unidentified
  REGION 1..1262: note = Description of Unknown:uncultivated organism sequence
  REGION 1..1262: note = Category: MG13 effectors
  REGION 1..1262: note = Description: MG13-12 effector
MRKFDEFVGLYPISKTLRFELKPIGKTLEHIQRNKLLEEDAVRADDYVKVKKIIDKYHKCLIDEALSGFTFETEVDGRSNNSLSEYYLYYNLRKRNEQEQKTFKTIQNNLRKQIVNKLTQSEKYKRIDKKELITTDLPDFLTNESEKELVEKFKNFTTYFTEFHKNRKNMYSKEEKSTAIAFRLINENLPKFVDNIAAFEKVASSPLAEKINALYEDFKEYLNVEEISRVFRLDYYNELLTQKQIDLYNAIVGGRTEEDNRIQIKGLNQYINEYNQQQTDRSNRLPKLKPLYKQILSDRESVSWLPPKFESDKELLIKIKECYDALSEKEKVFDKLESILKSLSTYDLSKIYISNDSQLSYISQKMFGRWDIIGKAIREDCAKGNPQKNRESLEKFAERIDKKLKAIDSISIGDVDECLAQLGEPYVKRVEDYFAAMGASDMVEEQTDTTSFKKNIERAYKSVKELLNNADNITDNNLMQDKGNVEKIKTLLDTIKDLQRFIKPLLGKGDEADKDGVFYGEFTSLWTKLDAVTPLYNMVRNYLTSKPYSTKKIKLNFENSTLMDGWDLNKEPDNTTVIFRKDGLYYLGIMGKRYNRVFVDREDLPHDGECYDKMEYKLLPGANKMLPKVFFSETGIQRFRPSEELLGKYERGTHKKGAGFDLGDCRALIDFFKKSIERHDDWKKFDFKFSDTSTYQDISEFYREVEQQGYKMSFRKVSVDYIKSLVEEGKLYLFQIYNKDFSAHSKGTPNMHTLYWKMLFDEENLKNVVYKLNGEAEVFFRKSSITVRTPTHPANSPIKNKNKDNQKKESKFEYDLIKDRRYTVDKFLFHVPITMNFKSVGGSNINQLVKRHIRSATDLHIIGIDRGERHLLYLTVIDSRGNIKEQFSLNEIVNEYNGNTYRTDYHELLDTREGERTEARRNWQTIQNIRELKEGYLSQVIHKISELAIKYNAVIVLEDLNFGFMRSRQKVEKQVYQKFEKMLIDKLNYLVDKKKPVAETGGLLRAYQLTGEFESFKTLGKQSGILFYVPAWNTSKIDPVTGFVNLFDTHYENIEKAKGFFDKFKSIRYNSDKDWFEFVVDDYTRFSPKAEGTRRDWTICTQGKRIQNYRNPQRNNEWEGRKIDLTKAFKEHFEAYGVDISKDLREQINTQNKKEFFEELLRLLRLTLQMRNSMPSSDIDYLISPVADDTGCFFDSRKQAELKENAVLPMNADANGAYNIARKGLLTIRKMKQEENDSAKISLAISNKEWLKFAQTKPYLED

SEQ ID NO: 47 - protein, 1261 aa, unidentified
  REGION 1..1261: note = Description of Unknown:uncultivated organism sequence
  REGION 1..1261: note = Category: MG13 effectors
  REGION 1..1261: note = Description: MG13-13 effector
MKQKKSQNPFNQFTGLYPLSKTLRFELRPIGKTKENIISAGILAEDNHRAESYKKVKKIIDEYHKAFIERVLKNLDLDKGALQAFYECYKKSTKEEKREETLQEIGNNLRSQISNAFKKDPKYSTLTSKDLINKELPSIATTEEERILLEEFHGFSTYFVGFHQNRENMYSKEEKATSIAYRLINENLPKFIDNIRSFEKIANSPIADKLESIYNEYAKEGYMNVNNLNEMFEISFYNRVLTQTQIDLYNAIIGGKTEKDGRKTQGINEYINLYNQRGEVQKKDRLPLLKPLFKQILSDREHISWFEEGFVDDQAMLSAIKDFYLKLTETEPTTTESILDRTRSLLRNIADYDLTKIYLEYTSLSKISQQIFGEWDRIQRALEAEYDATHLQRKKTKTYEEQKEQYFQSLKSVSIGFIDECLNSFETEKQLSLSIKEYIAQVGKKNDDPDLIEHITASYKAVKAILTTEWPKERNVAQEKDIVALIKKLLDRIKDLQYFIKPLLGSGKESDKDNLFYGELASIWEVINTVTPLYDKVRNRMTRKPYSTEKIKVNFRNSHFLSYWPQDYETKGGILFEKEGLYYLAIIDKKLKAKDIERLHCTKSNAVRIIVDTQKPDNKNTPRLFIRSKGENYAPAIDEYKLPIHEIIDLYDRKLFKKPLKGASPEDTEIFKASLTKLIDYFKLGFSRHESYRHYKFNWKKSDEYNDIDEFYQDTIESCYQIIRQPIDWDVVEEYTKEGKIYLFQIYNKDFSSHSKGTPNMHTLYWKTLFDEQNLANVVYKLNGEAEIFFREASLERKVTHPANEPIKTKNPETSIREKTFAYDLIKDKRYTEDKFQLHVPITMNFKGLNVKNINSRVNNYIKTEEDLHFIGIDRGERNLLYVCVIDSKGNIKEQYSLNEIVTQYNRTDYKYLLEKREEEREKERRSWQTIENIKDLKQGYLSQVVHKIAQLMVQYHAIVVLEDLNSGFKRSRQKVEKSVYQQFEKSLIDKLNYLVDKQLPIDEEGGVLRAYQLTNKFESFKTMKMQNGFLFYIPAWNTSKMDPTTGFVNLFDTRYTNINKSKEFFEKFEAIRYNEEKDWFELEFDYKNFTAKAEGTQTQWTLCTWGERINTFRNKSKNSSWDYKTINLTEEYKALFEQFSINYRGNLKKEILEQTSKDFFERLLSLLRLTLQMRNSIPNTDTDYLISPVADANGCFYYSEQCGDNLPKNADANGAYNIARKGMWMAEQIRRSNEGDELNLAISNKEWLRFVQEKPYLEEK

SEQ ID NO: 48 - protein, 1253 aa, unidentified
  REGION 1..1253: note = Description of Unknown:uncultivated organism sequence
  REGION 1..1253: note = Category: MG13 effectors
  REGION 1..1253: note = Description: MG13-14 effector
MNNLEQFTGLYPVSKTLRFELLPIGKTKENIEKNGILQRDEKRAEDYKLVKVFIDEYHKQFIKDRLWNFKLPILNEGNHDSLEEYQALYELSKRDDVQEAEFTEVKDNLRGIIAKRLTEKGSAYERIFKKELIREDLVDFLENEEDKNIVRQFEEFTTYFGGFHENRKNMYSAEEKSTAIAYRLIHQNLPKFMDNMKAFAKIAESSVSEHFEEIYEGWKEYLNVGSIEEIFRLDYFSETLTQPHIEVYNYIIGKKILDDGTEIKGINEYVNLYNQQQRDKSKRLPFLVPLYKQILSDREKLSWMAEEFDSDEKMLAAINESYNHLHDLLMGDENESLRSLLTHLKDFNLERINITNDLSITDISQHLFGRYDVFTNGIKGKLREITPRKRKESDEGFEERISKIFKTQKSFSISFLNKLPQPVMEDGKSRSIEEYFMSLGAINTVTTQKENLLAQIENTFENARDVLHMKDTGDALSQNKPAVAKIKAFLDTLKDLQHFIKPLLGSGDENDKDELFYGSFQMMWDELDTVTPLYNKVRNWLTRKPYSTEKIKLNFDNSQLLAGWDVNKEPDCTGILLCKGSFYYLGIMDKRSNRIFDSRITPSDGDCYDKIDYKLLPGANKMLPKVFFSKSRIDEFAPSESIVSNYKRGTHKKGTGFNLSDCHKLIDFFKESINKHDDWSKFNFHFSDTKTYDDISGFYREVEQQGYMLSTHPVSSAYINQMVNEGKLYLFRIWNKDFSEFSKGTPNLHTLYWKMLFDERNLANVVYKLNGQAEVFYRKASIKPENCIIHRANQPIINKNEFNKKQTSTFEYDIIKDRRYTVDKFQFHVPITINFKAMGQANINPIVQETIRKGGFSHIIGIDRGERHLLYLSLIDLKGNIVKQMTLNDIINEYKGQTYKTNYHDLLTKREGDRTDARRSWDTIETIKELKEGYLSQVIHIISKMMIEYNAIVVLEDLNTGFMRGRQKIERQVYEKFEKMLIEKLNCYIDKQANPQSIGGQLRPIQLTNKFDSFQKLGKQSGCLFYIPAWNTSKIDPVTGFVNLLDTRYETREKARLFFSKFQRISYNAEKGWFEFAFDYNDFTTKAESTRTQWTLCTYGERIRTFRNPLKNHQWDDERIILTDEFKHLFEKYDIDIRGNIKEAISAQSDAQFYRNLLGLIKLLLQMRNSITNSKEDYLISPVADDFGHFFDSREGISTLPIDADANGAYNIARKGLWIIRKVQETREGEKPSLTIKNKEWLQFAQNKPYLND

SEQ ID NO: 49 - protein, 1243 aa, unidentified
  REGION 1..1243: note = Description of Unknown:uncultivated organism sequence
  REGION 1..1243: note = Category: MG13 effectors
  REGION 1..1243: note = Description: MG13-15 effector
MKQFTNLYPVSKTLRFELIPQGETRAHLNDLIAEDEQRAEDYKEVKKYIDRYHKWFIDDCLSKVPNSPLGEEMIRLLNKFIEANDEKDGEGPDKVQDDLRKLIVKALKSGVSLDKDPEQEERFKSLFSEELVKNILPNFVQTEEEKSKVAKFRDMTTYFVGFHKNRENMYSEEAQTTAISYRLIHENLPRFLDNIAVYEKIKPVLSDEIVSLEEQLHQNGYVEACCIDSLFSVDFYLRVLTQRGIEQYNAVIGKIVNDESDEIKGLNERINLYNQVHKKEKLPLFKPMYKQILSDREQLSWLPETFENDASLLDAVKGFHQDLLSNDILSRIDKLLSSLQDFNLDQIWIANDVQLRGLSKDLYGDWSLIDRALGIERSEDVVQGLTAAQKKAASAAKKRSSFSIVELNAAIRSRVPDEKYVPVQNYFSAMGKVCAQGEATRENFVTRICAAYQELEEYIPSIRKSLLQEKRATEFIKNYLDAVNDLLRFIKPLLGRGNETDKDANFYGEFAFLTDCLFAIVPLYNEVRNYLTQKPYSTEKFKLNFRGSTLLNGWDKNKEKDNLGVILRKEGKYFLAIMNKKHNTLFTEGKLQQHTGGECYEKMEYKLIPGSKMLPKVFFSQKGISTFQPSEELLLNYRIGTYKKGEKFNLEHLHKLIDFYKHSIAVHEDWSKFDFHFSDTSSYRDISGFYKEVEQQGYKLTFRNVSVSYINRLVEEGKLYLFQIYNKDFSEYSKGTPNLHTLYWKMLFDLENLKDVVYKLSGEAEVFFRKKSLDVSHPTHPQNEPIEKKNINNKGEKSLFSYDLIKDRRFTVDKFQFHVPITMNFKGEQGDRVNQMVQSYVRNHKGLNVIGIDRGERNLLYLAVINEHGEILEQFSLNEIRNAYNGKEHKIDYHTLLEERSKKRQDARQSWQTIEGIKDLKTGYLSQVIHVITQLMVKYNAIVVLEDLNFGFKSSRQKFEQSVYQQFERKLIDKLNFLVNKKVAPNEVGGLLNAYQLTAPLGNSRKMGKQNGFLFYVPAWHTSKIDPRTGFVNLLDTRYENVANSKEFFAKFASITYNPEKKWFEFAFDYKAFGNRADGSRTKWTICSYGERIETFRNPKNNNQWDTKTVPLTERLTELFSNYGIDYTTNLKEQILNQTDKAFFVELLGALRLTLQLRNSRKSTGEDFLFSPVADENGCFFDSRKANDNEPKDADANGAYHIALKGLWVLDTIRNTEEGKNPKLAITNKEWLSFAQAKPFAHE

SEQ ID NO: 50 - protein, 1262 aa, unidentified
  REGION 1..1262: note = Description of Unknown:uncultivated organism sequence
  REGION 1..1262: note = Category: MG13 effectors
  REGION 1..1262: note = Description: MG13-16 effector
MRKFNEFVGLYPISKTLRFELKPIGKTLEHIQRNKLLEHDAVRADDYVKVKKIIDKYHKCLIDEALSGFTFETEADVRSNNSLSEYYLYYNLKKRNEQEQKTFKTIQNNLRKQIVNKLTQSEKYKRIDKKELITTDLPDFLTNESEKELVEKFKNFTTYFTEFHKNRKNMYSKEEKSTAIAFRLINENLPKFVDNIAAFEKVASSPLAEKINALYEDFKEYLNVEEISRVFRLDYYNELLTQKQIDLYNAIVGGRTEEDNRIQIKGLNQYINEYNQQQTDRSNRLPKLKPLYKQILSDRESVSWLPPKFDSDKDLLIKIKECYDALSEREKVFDKLESILKSLSTYDLSKIYISNDSQLSYISQKMFGRWDIIGKAIREDCAKRNPQKSRESLEKFAERIDKKLKAIDSISIGDVDECLAQLGETYVKRVEDYFAAMGELEIDDEQIDTTSFKKNIEEAYESVKELLNNADNITDNNLMQDKGNVEKIKNLLDAIKDLQRFIKPLLGKGDEADKDGVFYGEFTSLWTKLDQVTPLYNMVRNYLTSKPYSTKKIKLNFENSTLMDGWDLNKEPDNTTVIFCKDGLYYLGIMGKKYNRVFVDREDLPHDGECYDKMEYKLLPGANKMLPKVFFSETGIQRFRPSEELLGKYERGTHKKGAGFDLGDCRALIDFFKKSIERHDDWKKFDFKFSDTSTYQDISEFYREVEQQGYKMSFRKVSVDYIKSLVEEGKLYLFQIYNKDFSAHSKGTPNMHTLYWKMLFDEENLKDVVYKLNGEAEVFFRKSSITVQSPTHPANSPIKNKNKDNQKKESEFEYDLIKDRRYTVDKFLFHVPITMNFKSVGGSNINQLVKRHIRSATDLHIIGIDRGERHLLYLTVIDSRGNIKEQFSLNEIVNEYNGNTYRTDYHELLDTREGERTEARRNWQTIQNIRELKEGYLSQVIHKISELAIKYNAVIVLEDLNFGFMRSRQKVEKQVYQKFEKMLIDKLNYLVDKKKPVAETGGLLRAYQLTGEFESFKTLGKQSGILFYVPAWNTSKIDPVTGFVNLFDTHYENIEKAKGFFDKFKSIRYNSDKDWFEFVVDDYTRFSPKAEGTRRDWTICTRGKRIQICRNHQRNNEWEGREIDLTKAFKEHFEAYGVDISKDLREQISTQNKKEFFEELLRLLRLTLQMRNSMPSSDIDYLVSPVADDAGCFFDSRKQAELKENAVLPMNADANGAYNIARKGLLAIRKMKQEENDSAKISLAISNKEWLKFAQTKPYLED

SEQ ID NO: 51 - protein, 1262 aa, unidentified
  REGION 1..1262: note = Description of Unknown:uncultivated organism sequence
  REGION 1..1262: note = Category: MG13 effectors
  REGION 1..1262: note = Description: MG13-17 effector
MRKFNEFVGLYPISKTLRFELKPIGKTLEHIQRNKLLEDDAVRADDYVKVKKIIDKYHKCLIDEALSGFTFDTEVDGRSNNSLSEYYLYYNLRKRNEQEQKTFKTIQNNLRKQIVNKLTQSEKYKRIDKKELITTDLPDFLTNESEKELVEKFKNFTTYFTEFHKNRKNMYSKEEKSTAIAFRLINENLPKFVDNIAAFEKVASSPLAEKINALYEDFKEYLNVEEISRVFRLDYYNELLTQKQIDLYNAIVGGRTEEDNRIQIKGLNQYINEYNQQQTDRSNRLPKLKPLYKQILSDRESVSWLPPKFDSDKELLTKIKECYDALSEKEKVFDKLESILKSLSTYDLSKIYISNDSQLSYISQKMFGRWDIIGKAIREDCAKRNPQKNRESLEKFAERIDKKLKAIDSISIGDVDECLAQLGEPYVKRVEDYFATMGASEIGEEQIGQEFFKKNIEEAYESVKELLNNADNITDNNLMQDKGNVEKIKNLLDAIKDLQRFIKPLLGKGDEADKDGVFYGEFTSLWTKLDTVTPLYNMVRNYLTSKPYSTKKIKLNFENSTLMDGWDLNKEPDNTTVIFRKDGLYYLGIMGKKYNRVFVDREDLPHDGECYDKMEYKLLPGANKMLPKVFFSETGIQRFRPSEELLGKYERGTHKKGAGFDLGDCRALIDFFKKSIERHDDWKKFDFKFSDTSTYQDISEFYREVEQQGYKMSFRKVSVDYIKSLVEEGKLYLFQIYNKDFSAHSKGTPNMHTLYWKMLFDEENLKDVVYKLNGEAEVFFRKSSITVQSPTHPANSPIKNKNKDNQKKESKFEYDLIKDRRYTVDKFLFHVPITMNFKSVGGSNINQLVKQHIRSATDLHIIGIDRGERHLLYLTVIDSRGNIKEQFSLNEIVNEYNGNTYRTDYHELLDTREGERTEARRNWQTIQNIRELKEGYLSQVIHKISELAIKYNAVIVLEDLNFGFMRSRQKVEKQVYQKFEKMLIDKLNYLVDKKKPVAETGGLLRAYQLTGELESFKTLGKQSGILFYVPAWNTSKIDPVTGFVNLFDTHYENIEKAKGFFDKFKSIRYNSNKDWFEFVVDDYTRFSPKAEGTRRDWTICTQGKRIQICRNHQRNNEWEGREIDLTKAFKEHFEAYGVDISKDLREQINTQNKKEFFEELLRLLRLTLQMRNSMPSSDIDYLISPVADDTGCFFDSRKQAELKENAVLPMNADANGAYNIARKGLLAIRKMKQEENDSAKISLAISNKEWLKFAQTKPYLED

SEQ ID NO: 52 - protein, 1239 aa, unidentified
  REGION 1..1239: note = Description of Unknown:uncultivated organism sequence
  REGION 1..1239: note = Category: MG13 effectors
  REGION 1..1239: note = Description: MG13-18 effector
MDNIMKKLNDFTGLYSLNKTLRFELQPVGETADKIKEAGILKDDEYRANNYEAVKKIIDKYHRSFIERVLSGFTFICESSNKENSLEEFYNFYTSTIRDEKKFRTIRSNLRKQIVTAFNEDKDFALLFKKDFIKKVLMEFVETKEEQLLIKKFEKDTTFFKRFNDKRKNIYSADAKHTTIVYRLVHDNLPRFIDNISRFNKLVNCLGLDELQTLCADLKNSLGVRDISNLFELKYYNQVLTQGQIDVYNKIIGGVNKYVNLYNQSQKNRSACLPKLNFLFKQILSEKETISWLPEQFESDNALLASVRNAYQELYIKNKSDLVRLLSNLPEYDLDKIYIKNDDQLSRISKNMFGCSDTIQEALKKELRNTSRKKKDESRIEKEFQKRQSIPIGYINRCLSTEGTETKKIEEYFRECGVTHEDEKSLWNQVEDAYAKVCDLLESAYPQDKTLITDDINIENIKVLLDALKRIQLFVKPLLGNGDETEKDERFYGDFVAVCDTLNEITPLYNRVRNYLTRKPYSKDKIKLIFGESQLLNGWDLNKEQACKSVIFRKGELFYLGIMNKKYNKILEVKNEQSDGDCYEKMELKSFGESFRRIPKSSVAMNEVKTHFDKSEKDYVLDNKKNFLLPLYISKEIYDLGKGGVLDNLRKIEDLEIRRKKLNLWINFCIDFLEKYKSTSIYDVKNLKNKDYEDVNDFYNDVDHICYRITFRNVSVQYIDSLVSDGKLYLFKIHNKDFEPSSKGTPNMHTLYWRMLFDERNLSDVVYQLNGGAEVFFRKASLERRITHPANRPINNKNKNNSKRQSIFKYDLIKDKRYTIDKYLFHVPITLNFNSLNDSDLNTSVQEYIRKSNDLHIIGIDRGERNLVYISVIDLYGNIKAQYSLNEIKNSYLSYSTDYHDLLLNRERERQEARSGWKAIKNIKDLKEGYLSQVVHVIAELMLEYNAIVVLEKLNKGFYRGRQKVEMSVYAKFEKMLIDKLSYYVNKKKDPEDVGGLLNALQLTNKDMDEKSSQNGFLFYVRPQYTSKIDPVTGFVDLFKVQYENKEKAKQFFESFDFIRYNKEKDWFEFSFDYEHFPTKGKSARTSWTVCTHGSRIRSTKSITKNGHWSSEEIILTEEFKRHFEHYGIDWNFDLKDAILAQEDSSFFKDLLSLFKLTLQLRNSRSDVDYIVSPVINENGDRCYDEFLPKDGDANGAYNIARKGLYLVRKIKESNSLDCLSIEDKEWFDFAQKRPYLKI

SEQ ID NO: 53 - protein, 1243 aa, unidentified
  REGION 1..1243: note = Description of Unknown:uncultivated organism sequence
  REGION 1..1243: note = Category: MG13 effectors
  REGION 1..1243: note = Description: MG13-19 effector
MKTFNDLTGLYSLSKTLRFELKPVGKTKDNIETKGIIAQDEKRAEEYKKVKDIIDRYHKSFIDMCLAGLVLKTTSDGNNDSLKDYVALASKSNRDEKEDKDFDDVKTALRKQIVDAFKKGGSYSDLFKKELIQVHLPDFVTDEQEKQMVENFGKFTTYFTGFNENRQNMYSDEEKSTSIAYRLIHENLPMFIDNIKSFAKIAEHEDIDFLPDIENGFKEELKRLKVQSISEVFDLANFTNTLTQSQIDSYNAIIGARYDENGDKVQGINEYVNLYNQQHKDARLPLLKPLYKMILSDRVALSWLPEEFATDEEMLAAINETHGNLKNVMTDVRKLLQNIDSYDTEHIYIANDKGLTDISQQIFGQYDVYTSAIKAELRDSITPSAKERKDPELLEKRINDIFKASKSFSIEYLNSHVDSDKTIQSYYKELGAYDRNGEQRINLLSQIELAYVDAHDVLLGKHTNLNQSEDSIKKIKALLDAYKALQHFIKPLLGNGDEADKDNEFDAKLRAIWDELDIVTPLYDKVRNRLTRKPYSTEKIKLNFDNAQLLNGWDMNKEPDCTSVLLRKDGQYYLAIMDKKSNHAFDIDELPCDGECYDKMDYKLLPGANKMLPKVFFSKSRIKEFAPSKEICDAYQKGTHKKGANFSIKDCRRLIDFFKDSIAKHEDWSKFPFTFSDTSTYEDISGFYREVEQQGYMLGYRKVSVSFINQLVDEGKLYLFQIWNKDFSEYSKGTPNMHTLYWKMLFDERNLANVVYKLNGQAEVFYRKRSLDLNKTTIHRANQPIANKNMQNEKRESTFSYDIVKNRRYTVDKFQFHVPITINFKATGSDNINASVLDVIRNNGIEHIIGIDRGERHLLYLSLIDMKGNIVKQMTLNDIINEYKGNTYTTNYKELLQAREGDRKEARQNWQKIENIKELKEGYLSQVVHVITKMMVEYKAIVVLEDLNGGFMRGRQKIERQVYEKFEKMLIDKLNYYVDKQKDANENGGLLHAYQLASKFDTFKKLGKQSGCLFYIPAWNTSKIDPVTGFVNMLDTRYENADKARKFFSKFKSISYNADKNWFEFVIDDYSKFTDKAKDTRTDWVLCTYGTRIKTFRNPEKLNQWDNKEIVLTDEFKKVFMEAGIDINGNLKEAICTLTEKKHLESLMQLMKLLVQMRNSETNSEVDYLLSPVADTEGHFYDSRNCDDNLPKDADANGAYNIARKGLWAVMKIKASKPQENLKLGISNKEWLQFAQEKPYLND

SEQ ID NO: 54 - protein, 1238 aa, unidentified
  REGION 1..1238: note = Description of Unknown:uncultivated organism sequence
  REGION 1..1238: note = Category: MG13 effectors
  REGION 1..1238: note = Description: MG13-20 effector
MNTYEELTGLYSLIKTINFALNPIGETLRHIEEKGFIAQDEQRAEDYKKVKDIIDRYHKYFITMCLDGFKFSTDKLMKYVALAENAKRDEDAFDEVKTQLRKEIVAAFEKGETYKDLFKKELILKHLPNFVTDENEKRLVASFNKFTTYFKKFHKCRKNMYSDEAKSTAIAHRLIHENLPMFYDNMKSFKKIAACEDCIDLAEFEAAFSEEFKAFKVEHLADIFQLEYFNNTLTQRKIDFYKLVVGGKVLEDGTKLKGVNEYVNLYNQQHKDARLPLLKPLYKMILSDKVALSWLPEEFKSDEEMVEAIQEMHKNLKGALTDNAENNLRDLLLNMGKYDLAHIYIANDLGLRDISQNIFGQYDVYTSALKQALRNEYAPTTDECQNLELYDERINKLFKSRTSFSIAELNSLADCDHTIENHFKQLGAAERNGKQEIDLFSQIETAYAKASDILSGKHGNIGQSEAETALVKNLLDAYKSLQHFIKPLLGHGDEAEKDNEFDAKLRAAWDALDIINPLYNKVRNWLTRKPYSTEKIKLNFENAQLLDGWDKNKETVNTSVLLRKDGMYYLAIMNKKANDAFACDELPSDGDCYEKIDYKQISNARMDLPRVLLPPKNIDKYAPSEEIKDIYSKRTYRKGKNFNLEHCRRLIDFFKRSITKHKDWKNFQFIFSPTEKYECISSFYNEVEQQAYMLDFRKVSVAYINQLVESGNLYLFQIWNKDFSKFSKGTPNMHTLYWKQLFDERNLADVVYKLNWQAEVFYRKRSLKLEETTVHHAHQPIPNKNKQNEKRQSQFNYDIVKNRRFTVDKFQFHVSITLNFKATGGGDINDKVLEIIRNNGIKHVIGIDRGERHLLYLSLIDLKGNIIKQMTLNDIVNEYRGHTYTTNYKDLLAEREDNRTEARRNWKRIDNIKEIKQGYLAQVVHIISKMMVEYKAIVILEDLNMGFMRRWQKIERSVYEQFEKSLIEKLNYYVDKQKDENEVGGLLHAFQLTSKFKSFKELGKQSGCLFYVPAWNTSKIDPVTGFVNLFDTKNVKGEKVRAFFSNFDAIRYNAERDWFEFAFNYSNFTNKARDTREEWTLCTHGTSIRTFRNPSKINHRDSEEVVLTDEFKKVFEKAGIDICGNLKNAICALKEKAHLEKLMQLMKLLLQMRNSKPNTEVDYMISPVADEQGNFYDSRCGNSALPDNADANGAYNIARKGLWVIKQIRETPAGKRPDWAIKNKEWLKFAQQKPYLDD

SEQ ID NO: 55 - protein, 1262 aa, unidentified
  REGION 1..1262: note = Description of Unknown:uncultivated organism sequence
  REGION 1..1262: note = Category: MG13 effectors
  REGION 1..1262: note = Description: MG13-21 effector
MRKFDEFVGLYPISKTLRFELKPIGKTLEYIQRNKLLEHDAVRADDYVKVKKIIDKYHKCLIDEALSGFTFDTEADGRSNNSLSEYYLYYNLRKRNEQEQKTFKTIQNNLRKQIVNKLTQSEKYKRIDKKELITTDLPDFLTNESEKELVEKFKNFTTYFTEFHKNRKNMYSKEEKSTAIAFRLINENLPKFVDNIAAFEKVASSPLAEKINALYEDFKEYLNVEEISRVFRLDYYNELLTQKQIDLYNAIVGGRTEEDNRIQIKGLNQYINEYNQQQTDRSNRLPKLKPLYKQILSDRESVSWLPPKFDSDKDLLIKIKECYDALSEKEKVFDKLESILKSLSTYDLSKIYISNDSQLSYISQKMFGRWDIIGKAIREDCAKRNPQKNRESLEKFAERIDKKLKAIDSISIGDVNECLAQLGEPYVKRVEDYFAAMGASEIGEEQIGQEFFKKNIEEAYESVKELLNNADNITDNNLMQDKGNVEKIKTLLDAIKDLQRFIKPLLGKGDEADKDGVFYGEFTSLWTKLDQVTPLYNMVRNYLTSKPYSTKKIKLNFENSTLMDGWDLNKEPDNTTVIFCKDGLYYLGIMGKKYNRVFVDREDLPHDGECYDKMEYKLLPGANKMLPKVFFSETGIQRFRPSEELLGKYERGTHKKGAGFDLGDCRALIDFFKKSIERHDDWKKFDFKFSDTSTYQDISEFYREVEQQGYKMSFRKVSVDYIKSLVEEGKLYLFQIYNKDFSAHSKGTPNMHTLYWKMLFDEENLKDVVYKLNGEAEVFFRKSSITVQSPTHPANSPIKNKNKDNQKKESKFKYDLIKDRRYTVDKFLFHVPITMNFKSVGGSNINQLVKRHIRSATDLHIIGIDRGERHLLYLTVIDSRGNIKEQFSLNEIVNEYNGNTYRTDYHELLDTREGERTEARRNWQTIQNIRELKEGYLSQVIHKISELAIKYNAVIVLEDLNFGFMRSRQKVEKQVYQKFEKMLIDKLNYLVDKKKPVAETGGLLRAYQLTGEFESFKTLGKQSGILFYVPAWNTSKIDPVTGFVNLFDTHYENIEKAKGFFDKFKSIRYNSDKDWFEFVVDDYTRFSPKAEGTRRDWTICTQGKRIQIYRNPQRNNEWEGREIDLTKAFKEHFEAYGVDISKDLREQINTQNKKEFFEELLRLLRLTLQMRNSMPSSDIDYLISPVADDTGCFFDSRKQAELKENAVLPMNADANGAYNIARKGLLAIRKMKQEENDSAKISLAISNKEWLKFAQTKPYLED

SEQ ID NO: 56 - protein, 1275 aa, unidentified
  REGION 1..1275: note = Description of Unknown:uncultivated organism sequence
  REGION 1..1275: note = Category: MG13 effectors
  REGION 1..1275: note = Description: MG13-22 effector
MNNLNDLTGQYPVSKTIRFDLQPIGKTKENIEKGGILQQDEQRAEDYKTVKGFIDEYHKQFIKDRLWNFRLPLISEGHLDSLEEYQTLYLLAKRNDAQEAEFKEVKDNLRSIIARRLTEKGSAFERIFKKELIREDLIDFVEKPEDKDLVKSFADFTTYFTEFHKNRANMYTAEEKSTAIAYRLIHQNLPKFMDNIKAFAKIAQTSVAGHFVEIYNGSKEYLNVGSLEEVFQLDYFSDTMTQPHIEVYNSIIGKRVLEDGTEIKGINEYVNLYNQQQKDKRQRLPLLVPLYKQILSDREKLSWLAQEFDSDKKMLAAINETFIHLREILMGEDSESLRSILTHLKDFDLTQINITNDLSLTDISQHLFKRFDVFSNGIKAKIRSITPKKKKESDEELEDRVSKIFKTQKSFSIAFLDNLPQPEMEDGKRRSVADYFTALGAVNNEVTQKENLFAQIEIAYEDARDVLQMTETGDTLSQDKPAVAKIKALLDALKDLQHFIKPLRGSGEENEKDELFYGSFLMMWDELDTVTPLYNKVRNWLTRKPYSTEKIKLNFDSPTLLNGWPNPQTNSGAIFRDEEGLYYLAILDAQNRACLNELSSNVNGNEDHIEMMKYLQGGDMGKNVQNLMVIDGEVRKVNGRKETSGEFAGQNLRLENAKHQYLPKNINEIRLKQSYLTSSPTFNKKDLVSFIEYYIPLVEAYYSDYVFHFRKSSEYKSFADFTEHINQQAYQVQFKPVSKTSLYSLVEEGKLYLFRIWNKDFSEFSKGTPNLHTLYWKMLFDERNLADVVYKLNGQAEVFYRKASIKPENKIVHPANRAIANKNELNKKRTSSFDYDIIKDRRYTVDKFQFHVPITINFKATGQTNVNPIVQDTIRRGGFTHIIGIDRGERHLLYVSLIDLKGNIVKQMTLNEILNEYKGLTHKTNYHDLLAKREGERTDARRSWDTIENIKELKEGYLSQVVHIISKMMVEYNAIVVLEDLNPGFMRGRQKIERQVYEKFEKMLIEKLNCYIDKKAEPIEIGGLLHPLQLSCDIKKWKKSHQCGCLFYIPAWNTSKIDPVTGFVNLFDTHYETREKARSFFSKFQRIHFNSEKNWFKFTFDYGNFTTKAEGTRTQWTLCSYGTRIRNFRNPLKNHQWDDEEVELVDEFKHLFDKYSIDIFGNLKESICNQTDAQFYKELMGLMKLLLQMRNSRTNSEVDYLLSPVADEQGHFFDSREGIGSLPDNADANGAFNIARKGLWIIRKVQGTPSDEKMSLAISNKEWLQFAQNRPYLND

SEQ ID NO: 57 - protein, 1263 aa, unidentified
  REGION 1..1263: note = Description of Unknown:uncultivated organism sequence
  REGION 1..1263: note = Category: MG13 effectors
  REGION 1..1263: note = Description: MG13-23 effector
MRDFNEFVGLYPISKTLRFELKPIGKTLEHIQRNELLEDDAVRADDYVKVKKIIDKYHKCLIDEALSGFTFDTEADGRSNNSLSEYYLYYNLKKRNEQEQKTFKTIQNNLRKQIVNKLTQSEKYKRIDKKELITTDLPDFLTNESEKKLVEKFKNFTTYFTEFHKNRKNMYSKEEKSTAIAFRLINENLPKFVDNIAAFEKVASSPLAEKINALYEDFKEYLNVEEISRVFRLDYYNELLTQKQIDLYNAIVGGRTEEDNRIQIKGLNQYINEYNQQQTDRSNRLPKLKPLYKQILSDRESVSWLPPKFDSDKDLLIKIKECYDALSEREKVFDKLESILKSLSTYDLSKIYISNDSQLSYISQKMFGRWDIIIGKAIREDCAKRNPQKSRESLEKFAERIDKKLKAIDSISIGDVDECLAQLGETYVKRVEDYFAAMGESEIDDEQTDTTSFKKNIEGAYESVKELLNNADNITDNNLMQDKGNVEKIKTLLDAIKDLQRFIKPLLGKGDEADKDGVFYGEFTSLWTKLDQVTPLYNMVRNYLTSKPYSTKKIKLNFENSSLMKGWDLNKEPDNTTVIFRKDGLYYLGIMGKKYNRVFVDREDLPHDGECYDKMEYKLLPGANKMLPKVFFSETGIQRFRPSEELLGKYERGTHKKGAGFDLGDCRALIDFFKKSIERHDDWKKFDFKFSDTSTYQDISEFYREVEQQGYKMSFRKVSVDYIKSLVEEGKLYLFQIYNKDFSAHSKGTPNMHTLYWKMLFDEENLKDVVYKLNGEAEVFFRKSSITVQSPTHPANSPIKNKNKDNQKKESEFKYDLIKDRRYTVDKFLFHVPITMNFKSVGVSNINQLVKRHIRSATDLHIIGIDRGERHLLYLTVIDSRGNIKEQFSLNEIVNEYNGNTYRTDYHELLDTREGERTEARRNWQTIQNIRELKEGYLSQVIHKISELAIKYNAVIVLEDLNFGFMRSRQKVEKQVYQKFEKMLIDKLNYLVDKKKPVAETGGLLRAYQLTGELESFKTLGKQSGILFYVPAWNTSKIDPVTGFVNLFDTHCENIEKAKGFFDKFKSIRYNSDKDWFEFVVDDYTRFSPKAEGTRRDWTICTQGKRIQIYRNPQRNNEWEGREIDLTKAFKEHFEAYGVDISKDLREQINTQNKKEFFEELLRLLRLTLQMRNSMPSSDIDYLISPVADDTGCFFDSRKQAELKENAVLPMNADANGAYNIARKGLLAIRKMKQEENDSAKISLAISNKEWLKFAQTKPYLED

SEQ ID NO: 58 - protein, 1250 aa, unidentified
  REGION 1..1250: note = Description of Unknown:uncultivated organism sequence
  REGION 1..1250: note = Category: MG13 effectors
  REGION 1..1250: note = Description: MG13-24 effector
MEQLTNLYPVSKTLRFELQPIGKTRENIEKRGILQQDEERAENYKLVKGFIDEYHKQYIKSRLWNFELPLDDEGRHNSLAEYRALYELPKRDAEQETAFTEVKDNLRAIIARRLTEKGSAYDRIFKKELIREDLIEFLEDENDKEIVRQFADFTTYFTGFHENRANMYSSEEQSTAIAYRLIHQNLPKFMDNMKSFTKIAETSVAEHFADIYAGWEEYLNVGSINDMFRLDYFSQTLTQEHIEVYNYIIGKRILDDGTEIKGINEYVNLYNQQQKDKKQRLPLLVPLYKQILSDREKLSWLSEEFDSDIKMQQAIKETYDHLYDLLMGDENESLKSLLMHLGDFDLSQINITNDLSLTDISQHLFGKYDVFTNGIKDKLRIITPRKKKETDEDFEERITKLFKTQKSFSIAELNSLPHPIIEGSQPKNIEDYYMALGAVNTETVQKENLFAQIENAYTDVLPILQLTDTGDKLSQNKAEVAKIKKLLDAFKDLQHFVKPLLGSGEEVEKDERFYGAFQTIWDELDTEIPLYNKVRNWLTRKPYSTEKIKLNFDNAQLLGGWDVNKEPDCTGVLLRKDGFYYLGIMNKKNNRIFEKDMTPSDGDCYDKIDYKLLPGANKMLPKVFFSKSRIDEFAPSASLVEKYKAGTHKKGANFSLKDCHKLIDFFKQSIAKHEDWSKFGFHFSDTNTYEDISGFYREVEHQGYSLSSHNVSVDYIHRMVDEGKLFLFRLWNKDFSEYSKGTPNLHTLYWKMLFDERNLNDVFYKLNGQAEVFYRKASIKEENRIIHPAKKDINNKNALTDKQTSRFDYDIIKDRRFTVDKFQFHVPITINFKAIGQTNINPVVHDIIRQGGIKHIIGIDRGERHLLYLSLIDLQGRIVKQMTLNEIINEYSGHKYKTNYHDLLAKREGERTDARRSWDTIENIKELKEGYLSQVVHVITRMMVKYKAIVVLEDLNMGFMRGRQKIERQVYEKFEHMLIDKLNCYIDKQEDPSKPGGMLHALQLSNKFESFARLGKQSGCLFYIPAWNTSKIDPVTGFVNLLDTHYDTMKAAKSFFSKFECIRYNGENDWFEFTFDYDEFNKKAEGTKTRWTLCTYGTRIRNFRNPQKNNQWDDEEVVLTDMFKKLFDVYGIDYRGNLKEAIQQPTEAKFYQELMLLMKSLLQMRNSKINSEVDYLLSPVADENGHFFDSRQGDATLPDNADANGAYNIARKGLWAIRKIQESPKDEKVSLAISNKEWLTFAQTKPYLDK

SEQ ID NO: 59 - protein, 1252 aa, unidentified
  REGION 1..1252: note = Description of Unknown:uncultivated organism sequence
  REGION 1..1252: note = Category: MG13 effectors
  REGION 1..1252: note = Description: MG13-25 effector
MKNLKQFTNLYPVSKTLRFELQPIGKTKENIEKNGILTRDEKRAKDYQVVKGFIDEYHKQFIKDRLWDFKLPLISEGNLDSLEEYQMLYEMARRDDAQEAEFSEIKDNLRAIIAKRLTENGSAYDRIFKKELIREDLVDFLDNEEDKALVRQFADFTTYFSGFHENRRNMYSAEEKSTAIAYRLIHQNLPKFMDNMKAFTKIAETSVAEHFINIYKGWEEYLNVGSIEEIFRLDYFSETLTQPHIEVYNYIIGKKVLEDGTEIKGINEYVNLYNQQQKDKSKRLPFLVPLYKQILSDREKLSWMAEEFDSDEKMLAAINESYTHLHELLMGNENESLRSLLLHLREYDLSQINITNDLSLTDISQHLFGRYDVYTNAIKEQLKIITPRKKKETDEDFEDRISKIFKTQKSFSISFLNNLPHPETEDGKPRSVEEYFISTGAINTETTQKENLFAQIENAYENVRVILKMKDTDDALSQNKPAVTKIKALLDAFKDLQHFIKPLLGSGEELEKDELFYGSFQMIWDELDNVTPLYNKVRNWLTRKPYSTEKIKLNFDNSQLLGGWDVNKEPDCTGILLRKDGFYYLGIMDKKSNRVFEADVTPSDGDCYEKIDYKLLPGANKMLPKVFFSKSRIDEFAPSKSIVSSYKRGTHKKGKDFNLSDCHRLIDFFKRSINKHEDWCKFGFHFSDTHTYDDISGFYREVEDQGYMLSSHSVSSSYINQLVDEGKLYLFRIWNKDFSEYSKGTPNLHTLYWKMLFDERNLSNVVYKLNGQAEVFYRKASIQPENRIIHKAKQSIANKNELNKKRTSTFEYDIIKDRRYTVDKFQFHVPITINFKGTGQFNINPIVQETIRQGDFTHIIGIDRGERHLLYLSLIDLNGNIVKQMTLNDIINEYKGQTYKTNYHDLLVKREGDRTNARRSWDTIETIKELKEGYLSQVVHVISKMMVEYKAIVVLEDLNSGFMRGRQKIERQVYEKFEKMLIEKLNCYIDKQADATEVTGLLHPLQLTCEAKKWKRSHQCGCIFYIPAWNTSKIDPVTGFVNLLDTRYDTREKARLFFSKFQRISFNTEKGWFEFTFDYNDFTTKADGTRTQWTLCTYGERIRTFRNSQKNNQWDNERIILTDEFKKLFDEKEIDISGNIKEAICNQADAQFYRDLLGLMKLLLQMRNSITNSEEDYLLSPVADENGHFFDSRESISNLPIDADANGAYNIARKGLWIVRKIRDNPEDEKLSLTITNKEWLLFAQNKSYLND

SEQ ID NO: 60 - protein, 1249 aa, unidentified
  REGION 1..1249: note = Description of Unknown:uncultivated organism sequence
  REGION 1..1249: note = Category: MG13 effectors
  REGION 1..1249: note = Description: MG13-26 effector
MKQFTNLYPVSKTLRFELQPIGKTKENIEKKGILTRDEKRAKDYQIVKGFIDEYHKQFIKDRLWNFKLPLASEGNLDSLEEYQMFYEMPRRDDAQETDFSEVKDNLRVIIANRLRESGSAYDRIFKKELIREDLVEFLSDEEDKNIVRQFADFTTYFSGFHENRRNMYSAEEKSTAIAYRLIHQNLPKFMDNMKAFTKIAKTSVAEHFADIYAGWKEYLNVGSIEEVFRLDYFSETLTQPHIEVYNYIIGKKVLEDGKEIKGINEYINLYNQQQKDKSKRLPFLVPLYKQILSDREKLSWLAEEFDSDEKMLAAIDKLYTHLHELLMGEENESLRSLLMHMKDYDLSQINITNDLSLTDISQHLFNRYDVYTNGVKEQLKGITPRKKKENDEDFEDRISKIFKTQKSFSISLLNGLPHPEIEDSQPRRIEEYFMAMGAVNTATIQRENLFSKIESAYEDARAILQMKDTGDSLSQNKPAVAKIKALLDAFKDLQHFIKPLLGSGEELEKDELFYGSFQMIWDELDTVTPLYNKVRNWLTRKPYSTEKIKLNFDNSQLLGGWDVNKEPDCTGVLLRKDGFFYLGIMDKRYNHIFEADLPHSDDDCYDKVDYKLLPGANKMLPKVFFSKSRIDEFAPSAAIVSSYKRGTHKKGKNFDLSDCHRLIDFFKQSIQKHADWCKFGFHFSDTQTYEDISGFYREVEEQGYMLSSHQVPSSYINELVDGGKLYLFRIWNKDFSENSKGTPNLHTLYWKMLFDKRNLSDVVYKLNGQAEVFFRKASIKPENRVVHKANQSITNKNALNKKTTSTFEYDIIKDRRYTVDKFQFHVPITINFKASGQTNINPIVQETIRQGGFKHIIGLDRGERHLLYLSLIDLNGNIVKQMTLNDIVNEYNGQTYKTNYHDLLTKREGERTDARRSWDTIETIKELKEGYLSQVIHIISKMMVEYKAIVVLEDLNTGFMRGRQKIERQVYEKFEKMLIEKLNCYIDKKADATDATGLLHPLQLTCDAKKWNRSHQCGCLFYIPAWNTSKIDPVTGFVNLLDTRYETREKAHLFFSKFQRISFNQKKGWFEFAFDYADFTTKAEGTRTQWTLCTYGERIRTFRNPQKNNQWDNERIVLTDEFKRIFDEKGIDIFGNLKDAICNQRDAKFFKDLLGLMKLLLQMRNSITNSEEDYLLSPVADEKGHFFDSREGISSLPIDADANGAYNIARKGLWVIRKIQETPENERPSLSITNKEWLQFAQTKPYLKE

SEQ ID NO: 61 - protein, 1238 aa, unidentified
  REGION 1..1238: note = Description of Unknown:uncultivated organism sequence
  REGION 1..1238: note = Category: MG13 effectors
  REGION 1..1238: note = Description: MG13-27 effector
MNTYEELTGSYPLIKTINLALNPIGETLRHIEEKGFIAQDEQRAEDYEKVKDIIDRYHKYFITMCLDEFKFSTDKLMKYVALAEDSKRDEDAFDEVKTQLRKEIVAAFEKGETYNDLFKKKLILKHLPNFVTDENEKRLVASFNKFTTYFKKFHKCRKNMYSDEAKSTAIAHRLIHENLPMFYDNMKSFKKIAACEDCIDFAEFEAAFSEEFKEFKVEHLADIFQLEYFNNTLTQRKIDFYKLVIGGKVLEDGTKLKGVNEYVNLYNQQHKDARLPLLKPLYKMILSDKVALSWLPEKFESDEEMVEAIQEMHKNLKGTLIDNAENNLRDLLLNMGKYDLAHIYIANDLGLRDISQSIFGQYDVYTSALKQALRNEYAPTTDECQNLELYDERINKLFKSRTSFSIAELNSLADCDHTIENHFKQLGAAERNGKQEIDLFSQIETAYAKASDILSGKHGNIGQSEVETALVKNLLDAYKSLQHFIKPLLGHGDEAEKDNEFDAKLRAAWDALDIINPLYNKVRNWLTRKPYSTEKIKLNFENAQLLDGWDKNNETVNTSVLLRKDGMYYLAIMNKKANDAFACDELPSDGDCYEKIDYKQISKAKMNLPHGFFPQKNIDKYAPSEEIKDIYSKRTYRKGKNFNLEHCRRLIDFFKRSFTKHKDWKNFQFIFSPTEKYECISSFYNEVEQQAYMLDFRKVSVAYINQLVESGKLYLFQIWNKDFSKFSKGTPNMHTLYWKQLYDERNLADVVYKLNGQAEVFYRKRSLKLEETTVHQAHQPIPNKNKQNEKRQSQFNYDIVKNRRFTVDKFLFHVPIVLNFKATGGGDINDKVLEIIRNNGIKHVIGIDRGERHLLYLSLIDLKGNIIKQMTLNDIVNEYRGHTYATNYKDLLAEREDNRTEARRNWKRIDNIKEIKQGYLAQVVHIISKMIVEYKAIVILEDLNMGFMRGRQKIERSVYEQFEKSLIEKLNYYVDKQKDEKEVGGLLHALQLTSKFKSFKELGKQSGCLFYVPAWNTSKIDPVTGFVNLFDTRYVNVEKARAFFSNFDAIRYNAEKDWFEFAFNYSNFTDKAKDTREEWTLCTHGTSIRMFRNPSKLDHWDGEEVVLTDEFKKVFEKAGIDICGNLKNAICALKEKAHLEKLMQLMKLLLQMRNSKPNTEVDYMISPVADEQGNFYDSRCGNSALPDNADANGAYNIARKGLWVIKQIRETPAGKRPDWAIKNKEWLKFAQQKPYLDD

SEQ ID NO: 62 - protein, 1249 aa, unidentified
  REGION 1..1249: note = Description of Unknown:uncultivated organism sequence
  REGION 1..1249: note = Category: MG13 effectors
  REGION 1..1249: note = Description: MG13-28 effector
MKQFTNLYPVSKTLRFELQPIGKTKENIEKKGILTRDEKRAKDYQIVKGFIDEYHKQFIKDRLWNFKLPLASEGNLDSLEEYQMFYEMPRRDDAQETDFSEVKDNLRAIIANRLRESGSAYDRIFKKELIREDLVEFLSDEDDKNIVRQFADFTTYFSGFHENRRNMYSAEEKSTAIAYRLIHQNLPKFMDNMKAFTKIAKTSVAEHFADIYAGWKEYLNVGSIEEVFRLDYFSETLTQPHIEVYNYIIGKKVLEDGKEIKGINEYINLYNQQQKDKSKRLPFLVPLYKQILSDREKLSWLAEEFDSDEKMLAAIDKLYTHLHELLMGEENESLRSLLMHMKDYDLSQINITNDLSLTDISQHLFNRYDVYTNGVKEQLKGITPRKKKENDEDFEDRISKIFKTQKSFSISLLNGLPHPEIEDSQPRRIEEYFMAMGAVNTATTQRENLFSKIESAYEDARAFLQMKDTGDSLSQNKPAVAKIKALLDAFKDLQHFIKPLLGSGEELEKDELFYGSFQMIWDELDTVTPLYNKVRNWLTRKPYSTEKIKLNFDNSQLLGGWDVNKEPDCTGVLLRKDGFFYLGIMDKRYNHIFEVDLPHSDDDCYDKVDYKLLPGANKMLPKVFFSKSRIDEFAPSAAIVSSYKRGTHKKGKNFDLSDCHRLIDFFKQSIQKHADWCKFGFHFSDTQTYEDISGFYREVEKQGYMLSSHQVPSSYINELVDGGKLYLFRIWNKDFSENSKGTPNLHTLYWKMLFDKRNLSDVVYKLNGQAEVFFRKASIKPENRVVHKANQSITNKNALNKKTTSTFEYDIIKDRRYTVDKFQFHVPITINFKASGQTNINPIVQETIRQGGFKHIIGLDRGERHLLYLSLIDLNGNIVKQMTLNDIVNEYNGQTYKTNYHDLLTKREGERTDARRSWDTIETIKELKEGYLSQVIHIISKMMVEYKAIVVLEDLNTGFMRGRQKIERQVYEKFEKMLIEKLNCYIDKKADATDATGLLHPLQLTCDAKKWNRSHQCGCLFYIPAWNTSKIDPVTGFVNLLDTRYETREKAHLFFSKFQRISFNQKKGWFEFAFDYADFTTKAEGTRTQWTLCTYGERIRTFRNPQKNNQWDNERIVLTDEFKRIFDEKGIDIFGNLKDAICNQRDAKFFKDLLGLMKLLLQMRNSITNSEEDYLLSPVADEKGHFFDSREGISSLPIDADANGAYNIARKGLWVIRKIQETPENERPSLSITNKEWLQFAQTKPYLKE

SEQ ID NO: 63 - protein, 1262 aa, unidentified
  REGION 1..1262: note = Description of Unknown:uncultivated organism sequence
  REGION 1..1262: note = Category: MG13 effectors
  REGION 1..1262: note = Description: MG13-29 effector
MRDFNEFVGLYPISKTLRFELKPIGKTLEHIQRNKLLEDDAVRADDYVKVKKIIDKYHKCLIDEALSGFTFETEADVRSNNSLSEYYLYYNLKKRNEQEQKTFKTIQNNLRKQIVNKLTQSEKYKRIDKKELITTDLPDFLTNESEKELVEKFKNFTTYFTEFHKNRKNMYSKEEKSTAIAFRLINENLPKFVHNIAAFEKVASSPLAEKINALYEDFKEYLNVEEISRVFRLDYYNELLTQKQIDLYNAIVGGRTEEDNRIQIKGLNQYINEYNQQQTDRSNRLPKLKPLYKQILSDRESVSWLPPKFDSDKDLLIKIKECYDTLSEREKVFDKLESILKSLSTYDLSKIYISNDSQLSYISQKMFGRWDIIGKAIREDCAKRNPQKSRESLEKFAERIDKKLKAIDSISIGDVDECLAQLGETYVKRVEDYFAAMGASDMGEKQTDTTSFKKNIEGAYESVKELLNNADNITDNNLMQDKGNVVKIKNLLDAIKDLQRFIKPLLGKGDEADKDGVFYGEFTSLWTKLDAVTPLYNMVRNYLTSKPYSTKKIKLNFENSTLMDGWDLNKEPDNTTVIFRKDGLYYLGIMGKKYNRVFVDREDLPHDGECYDKMEYKLLPGANKMLPKVFFSETGIQRFRPSEELLGKYERGTHKKGAGFDLGDCRALIDFFKKSIERHDDWKKFDFKFSDTSTYQDISEFYREVEQQGYKMSFRKVSVAYIKSLVEEGKLYLFQIYNKDFSAHSKGTPNMHTLYWKMLFDEENLKDVVYKLNGEAEVFFRKSSITVQSPTHPANSPIKNKNKDNQKKESEFKYDLIKDRRYTVDKFLFHVPITMNFKSVGVSNINQLVKRHIRSATDLHIIGIDRGERHLLYLTVIDSRGNIKEQFSLNEIVNEYNGNTYRTDYHELLDTREGERTEARRNWQTIQNIRELKEGYLSQVIHKISELAIKYNAVIVLEDLNFGFMRSRQKVEKQVYQKFEKMLIDKLNYLVDKKKPVAETGGLLRAYQLTGEFESFKTLGKQSGILFYVPAWNTSKIDPVTGFVNLFDTHYENIEKAKGFFDKFKSIRYNSDKDWFEFVVDDYTRFSPKAEGTRRDWTICTQGKRIQICRNPQRNNEWEGREIDLTKAFKEHFEAYGVDISKDLREQINTQNKKEFFEELLRLLRLTLQMRNSMPSSDIDYLISPVADDTGCFFDSRKQAELKENAVLPMNADANGAYNIARKGLLAIRKMKQEENDSAKISLAISNKEWLKFAQTKPYLED

SEQ ID NO: 64 - protein, 1232 aa, unidentified
  REGION 1..1232: note = Description of Unknown:uncultivated organism sequence
  REGION 1..1232: note = Category: MG13 effectors
  REGION 1..1232: note = Description: MG13-30 effector
MQQFTNLYPVSKTLRFELIPDERTRAMLEHSDLIAQDEHRAASYKLVKKIIDRYHMAYIDSVLEALILPSGYLKGMCDLYLKSQKSDADKKALEQLQDKLRKMIAGALTKDNRFKRIDKKELIREDIMSVITPEERALIDEFRDFTTYFTGFHKNRQNMYSAEAQSTAIAYRLIHENLPKFIDNMATFARIAASPVAEKFPQLYQEMSEYLNVREIGDLFKLDYYTELLTQRQIDVYNAVIGGRTQDDGDKKIQGINEYVNLYNQQQATKETRIPKLKPLFKQILSDREAVSWLPEEFASDKDMLEAVRDCCNSLNSHVFGMLRELLTNLSGYRLDGIYIPNDLSISDISQAMFKDWAVIKKGIVEDLKRNYPPKRSEKADNYEERIRKLIKRENSFSIGYLNSCINKDICDYFASLGAIDDGENQAVNLFMRIQNAYTEVQSLLENGYPEDCNLAQDKDNVAKLKTLLDAIKALQHFVKPLLGNGDEPDKDERFYGELAVLWEELDRVTPLYNKVRNRMTRKPYSIEKFKLNFENSTLLDGWDVNKERDNTCVILRREGKYYLGIMRKQFNDIFVNVPNAQGEDNFEKMEYKLLPGANKMLPKVFFSKSRIKEFNPSPTLLEHYHQGTHKKGDNFSLQDCHELIDFFKVSLAKHEDWGKFDFHFSPTESYEDMSGFYREVEQMGYKISYKLIPFSYIDQMVEEGKLFLFQIYNKDFSRFSKGTPNLHTLYWKMVFDERNLADVVYKLNGQAEVFYRKKSLAYKRPTHPAYQAIKNKNSEGKKAESTFDYDIVKDRRFTTDKFQFHVPITINFKATGTGNINVRVNQFIHDHDDLHFIGIDRGERHLLYVTVIDSKGRIKEQFSLNEIVNEYQGTKYKTNYRSLLDKREEERQRERQSWNTIEGIKELKQGYLSQVIHKIVTLMVKYRAVVVLEDLNMGFKRGRQKVESSVYQQFEKALIDKLNLLIDKRIDATAPGGLLHAYQLTNKFTSFREMRRQNGFMFYIPSWNTSKIDPVTGFVDLLHPRYESVEKSRVFFSKFKSIRYNQDNGWYEFSLDYKDFTSKADGSRTEWTLCTHGTRVVTYRNPKKNSSWDSREINLTEEFNALFEAYGIQAQGNLKQAIAEQSEKDFFDKLTHLLSLTLQLRNSITGTEVDYMISPVADEYGHFFDSRTCGKDLPQNADANGAYNIARKGLWVARQIQASAVDEKVDIIMSNKEWLVFAQEKPYLADD

SEQ ID NO: 65 - protein, 1262 aa, unidentified
  REGION 1..1262: note = Description of Unknown:uncultivated organism sequence
  REGION 1..1262: note = Category: MG13 effectors
  REGION 1..1262: note = Description: MG13-31 effector
MRKFDEFVGLYPISKTLRFELKPIGKTLEHIQRNKLLEHDAVRADDYVKVKKIIDKYHKCLIDEALLGFTFETEVDGRSNNSLSEYYLYYNLRKRNEQEQKTFKTIQNNLRKQIVNKLTQSEKYKRIDKKELITTDLPDFLTNESEKKLVEKFKNFTTYFTEFHKNRKNMYSKEEKSTAIAFRLINENLPKFVDNIAAFEKVASSPLAEKINALYEDFKEYLNVEEISRVFRLDYYNELLTQKQIDLYNAIVGGRTEEDNRIQIKGLNQYINEYNQQQTDRSNRLPKLKPLYKQILSDRESVSWLPPKFDSDKDLLIKIKECYDALSEREKVFDKLESILKSLSTYDLSKIYISNDSQLSYISQKMFGRWDIIGKAIREDCAKRNPQKSRESLEKFAERIDKKLKAIDSISIGDVDECLAQLGEPYVKRVEDYFAAMGTSDMGEEQTDTTSFKKNIEGAYKSVKELLNNADNITDNNLMQDKGNVEKIKNLLDAIKDLQRFIKPLLGKGDEADKDGVFYGEFTSLWTKLDQVTPLYNMVRNYLTSKPYSTKKIKLNFENSTLMDGWDLNKEPDNTTVIFCKDGLYYLGIMGKKYNRVFVDREDLPHDGECYDKMEYKLLPGANKMLPKVFFSETGIQRFRPSEELLGKYERGTHKKGAGFDLGDCRALIDFFKKSIERHDDWKKFDFKFSDTSTYQDISEFYREVEQQGYKMSFRKVSVDYIKSLVEEGKLYLFQIYNKDFSAHSKGTPNMHTLYWKMLFDEENLKDVVYKLNGEAEVFFRKSSITVQSPTHPANSPIKNKNKDNQKKESKFEYDLIKDRRYTVDKFLFHVPITMNFKSVGGSNINQLVKRHIRSATDLHIIGIDRGERHLLYLTVIDSRGNIKEQFSLNEIVNEYNGNTYRTDYHELLDTREGERTEARRNWQTIQNIRELKEGYLSQVIHKISELAIKYNAVIVLEDLNFGFMRSRQKVEKQVYQKFEKMLINKLNYLVDKKKPVAETGGLLRAYQLTGEFESFKTLGKQSGILFYVPAWNTSKIDPVTGFVNLFDTHCENIEKAKGFFDKFKSIRYNSDKDWFEFVVDDYTRFSPKAEGTRRDWTICTQGKRIQIYRNPQRNNEWEGREIDLTKAFKEHFEAYGVDISKDLREQINTQNKKEFFEELLRLLRLTLQMRNSMPSSDIDYLISPVADDTGCFFDSRKQAELKENAVLPMNADANGAYNIARKGLLAIRKMKQEENDSAKISLAISNKEWLKFAQTKPYLED

SEQ ID NO: 66 - protein, 1275 aa, unidentified
  REGION 1..1275: note = Description of Unknown:uncultivated organism sequence
  REGION 1..1275: note = Category: MG13 effectors
  REGION 1..1275: note = Description: MG13-32 effector
MNNLNDLTGQYPVSKTIRFDLQPIGKTKENIEKGGILQQDEQRAEDYKTVKGFIDEYHKQFIKDRLWNFRLPLISEGHLDSLEEYQTLYLLAKRNDAQEAEFKEVKDNLRSIIARRLTEKGSAFERIFKKELIREDLIDFVEKPEDKDLVKSFADFTTYFTEFHKNRANMYTAEEKSTAIAYRLIHQNLPKFMDNIKAFAKIAQTSVAGHFVEIYNGSKEYLNVGSLEEVFQLDYFSDTMTQPHIEVYNSIIGKRVLEDGTEIKGINEYVNLYNQQQKDKRQRLPFLVPLYKQILSDREKLSWLAQEFDSDKKMLAAINETFIHLREILMGEDSESLRSILTHLKDFDLTQINITNDLSLTDISQHLFKRFDVFSNGIKAKIRSITPKKKKESDEELEDRVSKIFKTQKSFSIAFLDNLPQPEMEDGKRRSVADYFTALGAVNNEVTQKENLFAQIEIAYEDARDVLQMTETGDTLSQDKPAVAKIKALLDALKDLQHFIKPLRGSGEENEKDELFYGSFLMMWDELDTVTPLYNKVRNWLTRKPYSTEKIKLNFDSPTLLNGWPNPQTNSGAIFRDEEGLYYLAILDAQNRACLNELSSNVNGNEDHIEMMKYLQGGDMGKNVQNLMVIDGEVRKVNGRKETSGEFAGQNLRLENAKHQYLPKNINEIRLKQSYLTSSPTFNKKDLVSFIEYYIPLVEAYYSDYVFHFRKSSEYKSFADFTEHINQQAYQVQFKPVSKTSLYSLVEEGKLYLFRIWNKDFSEFSKGTPNLHTLYWKMLFDERNLADVVYKLNGQAEVFYRKASIKPENKIVHPANRAIANKNELNKKRTSSFDYDIIKDRRYTVDKFQFHVPITINFKATGQTNVNPIVQDTIRRGGFTHIIGIDRGERHLLYVSLIDLKGNIVKQMTLNEILNEYKGLTHKTNYHDLLAKREGERTDARRSWDTIENIKELKEGYLSQVVHIISKMMVEYNAIVVLEDLNPGFMRGRQKIERQVYEKFEKMLIEKLNCYIDKKAEPIEIGGLLHPLQLSCDIKKWKKSHQCGCLFYIPAWNTSKIDPVTGFVNLFDTHYETREKARSFFSKFQRIHFNSEKNWFEFTFDYGNFTTKAEGTRTQWTLCSYGTRIRNFRNPLKNHQWDDEEVELVDEFKHLFDKYSIDIFGNLKESICNQTDAQFYKELMGLMKLLLQMRNSRTNSEVDYLLSPVADEQGHFFDSREGIGSLPDNADANGAFNIARKGLWIIRKVQGTPSDEKMSLAISNKEWLQFAQNRPYLND

SEQ ID NO: 67 - protein, 1249 aa, unidentified
  REGION 1..1249: note = Description of Unknown:uncultivated organism sequence
  REGION 1..1249: note = Category: MG13 effectors
  REGION 1..1249: note = Description: MG13-33 effector
MKEFTNLYPVSKTLRFDLQPIGRTKENIERNGILQRDEKRAEDYKTVKGFIDEYHKQFIKDRLWSYKLPLYSEGHLNSLEEYQALYELSKRDETQEREFAEVKDNLRAFIAKRLTEGGSAYDRIFKKELIREDLVDFLENEDDREIVRQFADFTTYFGGFHENRKNMYSAEEKSTAIAYRLIHQNLPKFMDNMKAFAKIAESSVSEHFEEIYEGWKEYLNVGSLEEIFRLDYFSVTLTQPHIEVYNYIIGKKILEDGTEIKGINEYVNLYNQQQKDKTKRLPFLVPLYKQILSDREKLSWMAEEFDSDDQMLTAINESYSHLHDLLMGDDNESLRSLLEHLKDFNLEQINITNDLSLTDISQHLFGRYDVFTNGIKDELRIITPRKKKEDDESFEDRISKIFKTQKSFSIALLDKLPQPVMEDGKLRTVEDYFLSLGAVNTGLTQKENLFAQIENAYEDARTILQLKNTDDTLSQDKPAVAKIKTLLDALKDLQHFIKPLLGSGEENEKDELFYGSFQMMWDELDTVTTLYNKVRNWLTRKPFSTEKIKLNFDNSQLLGGWDVNKEPDCTGVLLRKDGLYYLGIMDKKSNRIFEADVTPTDGVCYEKFDYKLLPGANKMLPKVFFSKSRIDEFSPSETIIASYKRGAHKKGANFNLAECHRLIDFFKQSISKHEDWSKFGFHFSDTKTYEDISGFYREVEQQGYMLSYHPVSSSYINQLVDEGKLYLFRIWNKDFSEFSKGTSNLHTLYWKMIFDEQNLANVVYKLNGQAEVFYRKASIKSENRIIHKANQPINNKNELNKKDTSTFEYDIIKDRRYTVDKFQFHVPITINFKATGQTNINPIVQDVIRQGGFSHIIGIDRGERHLLYLSLIDLQGNIVKQMTLNDIINEYKGQTYKTNYHDLLAKREGERTDARRSWETIETIKELKEGYLSQVVHIISKMMVEYNAIVVLEDLNTGFMRGRQKIERQVYEKFEKMLIEKLNCYIDKHAEPTEETGLLHPLQLTCDSKKWTRSHQCGCLFYIPAWNTSKIDPVTGFVNLLDTRYDTREKARLFFSKFQRISFNVEMGWFEFAFDYNNFTTKAEGTRTKWNLCTFGERIRSFRNPKKNNQWDDERIVLTDEFKQLFDKYDIDIAGNLKEAISAQSDAQFFKELLGLMKLLLQMRNSVTNSEEDYLLSPVADENGHFFDSREGISSLPIDADANGAYNIARKGLWVIRKIQETQEDEKVSLNITNKEWLQFAQTKPYRND

SEQ ID NO: 68 - protein, 1240 aa, unidentified
  REGION 1..1240: note = Description of Unknown:uncultivated organism sequence
  REGION 1..1240: note = Category: MG13 effectors
  REGION 1..1240: note = Description: MG13-34 effector
MKTFNDLTGLYSLSKTLRFELKPVGKTKDNIETKGIIAQDEKRAEEYKKVKDIIDRYHKSFIDMCLAGLVLKTTSDGNNDSLKDYVALASKSNRDEKEDKDFDDVKTVLRKHIVDAFKKGNSYGDLFKKELIQNHLPDFVTDEQEKLMVENFSKFTTYFTGFNENRKNMYSDEEKSTSIAYRLIHENLPMFIDNIKSFAKITEQEDIDFIADVEHSFKEELKGKSITQMFCLENFTETLTQGHIELYNKIVGGRVEDSGVKKQGINEYVNLYNQQHKDARLPLLKPLYKMILSDRVALSWLPEEFATDEEMLAAINETHGNLKNVMTDVRKLLQNIDSYDTEHIYIANDKGLTDISQQIFGQYDVYTSAIKAELRDSITPSAKERKDPELLEKRINDIFKASKSFSIEYLNSHVDSDKTIQSYYKELGAYDRNGEQRINLLSQIELAYVDAHDVLLGKHTNLNQSEDSIKKIKALLDAYKALQHFIKPLLGNGDEADKDNEFDAKLRAIWDELDIVTPLYDKVRNRLTRKPYSTEKIKLNFDNAQLLNGWDMNKEPDCTSVLLRKDGQYYLAIMDKKSNHAFDIDELPCDGECYEKMEYKLLPGANKMLPKVFFSKSRIKEFAPSKEILDAYQKGTHKKGPNFSIKDCRRLIDFFKDSIAKHEDWSKFPFAFSDTSTYEDISGFYREVEQQGYMLGYRKVSVSFINQLVDEGKLYLFQIWNKDFSEYSKGTPNIHTLYWKMLFDERNLANVVYKLNGQAEVFYRKRSLDLDKTTIHRANQPIANKNKQNEKRESTFSYDIVKNRRYTVDKFQFHVPITINFKATGSDNINASVLDVIRNNGIEHIIGIDRGERHLLYLSLIDMKGNIVKQMTLNDIINEYKGNTYTTNYKELLQAREGDRKEARQNWQKIENIKELKEGYLSQVVHVITKMMVEYKAIVVLEDLNGGFMRGRQKIERQVYEKFEKMLIDKLNYYVDKQKDVNDNGGLLHAYQLASKFDTFKKLGKQSGCLFYIPAWNTSKIDPVTGFVNMFDTRYENADKARKFFNKFKSISYNADKEWFEFVIDDYSKFTDKAKDTRTDWVLCTYGTRIKTFRNPEKLNQWDNKEIVLTDEFKKVFMEAGIDINGNLKEAICTLTEKKHLESLMQLMKLLVQMRNSETNSEVDYLLSPVADTEGHFYDSRNCGDNLPKDADANGAYNIARKGLWAVMKIKASKPQENLKLGISNKEWLQFAQEKPYLND

SEQ ID NO: 69 - protein, 1251 aa, unidentified
  REGION 1..1251: note = Description of Unknown:uncultivated organism sequence
  REGION 1..1251: note = Category: MG13 effectors
  REGION 1..1251: note = Description: MG13-35 effector
MKEFINLYPVSKTLRFELQPIGKTKENIERNGILKRDSKRAEDYKIVKGFIDEYHKQFIKDRLWSFKLPLQSEGHLDSLEEYQTLYELSKRDATQEAEFTEVKDNLRGIIAKRLTQSGSNYERIFKKELIREDLVEFLENEEDKEIVRQFADFTTYFVGFHENRKNMYSAEEKSTAIAYRLIHQNLPKFMDNMKAFAKIAETTVSEHFADIYEGWKEYLNVGSIEEMFRLDYFSETLTQTHIEVYNYIIGKKILEDGTEIKGINEYVNLYNQQQKDKSKRLPFLVPLYKQILSDREKLSWLADEFDSDEKMLAAINELYINLHDLLMGDENESLRSLLTHLTDFDLTQINITNDISLTDISQHLFGRYDVFTNGIKDKLRVITPKKKKESDEDFEDRISKIFKSQKSFSIDFLNKLPQPVMDDGKPRTIEDYFMALGAVSTDAVQKENLFAQIENAYEDARTILQMNDTGDTLSQNKPAVAKIKVLLDTLKDLQRFIKPLLGSGEENEKDELFYGSFQMMWDELDAVTPLYNKVRNWLTRKPYSTEKIKLNFDNSQLLGGWDVNKEPDCTGILLRKNGYYYLGIMDKKSNHAFDVEISPSDGECYDKIDYKLLPGANKMLPKVFFSKSRIDEFAPSETIVSNYKRGTHKKGADFSLSDCHKLIDFFKQSISKHEDWSKFGFHFSDTDTYEDISGFYREVEQQGYMLSSHRVSVAYVNQLVDEGKLYLFRIWNKDFSEYSKGTANLHTLYWKMLFDERNLADVVYKLNGQAEVFYRKASIKSENRIVHKANQPIANKNELNAKRNSTFEYDIVKDRRYTVDKFQFHVPITINFKAAGQTNINPIVQDTIRRGGFTHIIGIDRGERHLLYLSLIDLKGNIIKQMTLNDIVNEYKGQTYKTNYHDLLAKREGDRTEARRSWDTIETIKELKEGYMSQVVHIISKMMVEYNAIVVLEDLNPGFMRGRQKIERQVYEKFEKMLIDKLNCYIDKQASPTSEGGLLHPLQLTNKFESFRKLGKQSGCLFYIPAWNTSKIDPVTGFVNLLDTRYDTREKARVFFSKFQRISFNPNKGWFEFALDYYNDFTAKAEGTRTQWTLCTYGERIRTFRNPQKNHQWDDERIMLTDAFKQLFERYGIDINGNLKEAIGSQTDAQFYKDMMGLMKLLLQMRNSITNSEEDYLLSPVADEKGNFFDSRKGIESLPIDADANGAYNIARKGLWAIRKIQETRDDEKPSLNITNKEWLQFAQTKPYFND

SEQ ID NO: 70 - protein, 1278 aa, unidentified
  REGION 1..1278: note = Description of Unknown:uncultivated organism sequence
  REGION 1..1278: note = Category: MG13 effectors
  REGION 1..1278: note = Description: MG13-36 effector
MKKFTNKFQLSKTLRFELIPQGKTLENIKSKGLIAKDDQRAISYKKMKKSIDEYHKYFIGLALSNVKLSKLQDFADLYFETNPDKKKEDAYKKSLEKIQTDLRKEIVKGFKEGDAKEIFGKLNKKELFTELLEEWKQEKGDFYFDEEFKTFTTYFTGFNKNRANMYSDEAKSTAIAFRLIHENLPKFLDNIKVFEKAKSIPQLQENCKLLYKEIEEYLNISKIDEVFELGYFNEALTQNDIDVYNLIIGGRTAKEGVQKIQGLNEYINLYNQKQDKKNRIPKLKVLYKQILSDRENISFLPEKFNDSNEVLEAIENFYKSNLLEFQTGDMEHSENVLASLKTLVGEIANFDTSKIYLRNDKSITDISQTIFGDWGIIKSALEFSFIQGLIIGKKGISIKQEVEKDKYLSKQSYYSIAEIENALMLYKDQNELLKELKPTDLPVANYFKNHFKIKVKKDDNSEKEFDLITNIEDKYRCIKGILANDYPEDKDLKSTNNPDTLNIKLFLDSLMEFLHFIKPLALPKDTVLEKDEHFYNPFVIGYEQMQLLIPLYNKVRNYATQKPYSEEKFKLNFENSTLLSGWDVNKEETNTSILFIKEGIYYLGVMDKDHNKIFRDIPKARSNSVYQKINYKLLPGASKMLPKVFFSDKNISFFNPSDEIQNIRNHGTHTKGGSPQEGYSKLDFNVNDCRKMIDFFKTSIEKHPEWKNFGFQFSDTTTFDSIDAFYREVEAQGYTISYSNLDKDYIDQLVSEGKLYLFKIYNKDFSSYSKGQPNMHTLYWKALFDKDNLKDVVYKLNGQAELFYRKKSINYDEKTMKEGHHYQELKDKFAYPIIKDKRFTEDKFHFHVPITLNFKASGNDYINADVLTYLKNNPDVNIIGLDRGERHLIYLSLINQKGEVLKDKNGNPIQYSLNEIINEHKGKTYPTNYQTLLDSKEKERDSARKNWGEIENIKELKEGFISQVVHKIAHLMIDFNAIVVMEDLNFGFKRGRFKVEKQVYQKLEKMLIDKLNYLVFKDKEPTEIGGIYNALQLTNKFKSFKEMGKQSGFLFYVPAWNTSKIDPTTGFVNLFNTKYETIEKAQEFFSKFNDIRFNEKENHFEFEVDDYTKFNLKAEGTKTDWVVCTNEDRILTFRNPETNNNWDNKKVVLTDEFVKFFTENQIEYKTNLQTQILEKTEGKFFKDLFHLFKLTLQMRNSITNSEVDYLISPVKNNDSYFYDSRKADNTLPQDADANGAYHIAKKGLWVLEQINQYEKDDNWKKLQLAISNKMWLNFVQKK

SEQ ID NO: 71 - protein, 1253 aa, unidentified
  REGION 1..1253: note = Description of Unknown:uncultivated organism sequence
  REGION 1..1253: note = Category: MG13 effectors
  REGION 1..1253: note = Description: MG13-37 effector
MKNLTEFTGLYPVSKTLRFELKPQGRTLEYIEKNGLLEQDEHRASSYILVKKIIDDYHKAFIANALRDFKLYSLEDYYLYYNIQKRDDEQKKKFEDIQSKLRKQIADRFTKEESFKNLFAKELIKENLIEFVQTVEDRELIKEFESFTTYFTGFHENRKNMYSAEEKSTAIAYRLIHQNLPKFIDNMRVFEKIANSPVKDKFQTILSDNQLGPVIQVMAVEDMFRLDYFNETLTQIGIDKYNSLCGGFSPNEGKEKIQGLNEYINLYNQTAKKEERIPKLKPLFKQILSDRSTASFIPDEFENDSEVLESIELFYQEVNEQVINKNVEGEHSLKELLKSLPEYELTKIYLRNDLSITDISQKIFGDWGVFQKAMNTWFELNYNGKAKFGTEKYEEEQRKYFANLDSFSIGFINECLLQLDTPYHKNIADYFALRGKTDTETQDLFAVLEDKYNAVTDLLNNPYPQDQDLAQDQKQVDKLKELLDAVKAIQWFIKPLLGKGNEADKDERFYGEFTSLWITLDQITPLYNKVRNYMTRKPYSTDKIKLNFENSYFLNGWAQDYESKAGLIFTKDGNYYLGINDKKLSNEDKTLLKSNSELNLAKRIVLDFQKPDNKNIPRLFIRSKGNNFAPAVEKYNLPIHEVIEIYDNGKFKTEYRKINETDYLKSLHLLIDYFKIGFSKHESYKHYPFSWKNTTEYKDIAEFYHDVEVSCYQVFEENVNWDTLMNFVDEGKLYLFQLYNKDFSPNSKGTPNLHTLYWKMLFDADNLKDVVYKLNGQAEVFFRKSSIKPENIVLHKANEAVNNKNEQNTKKQSRFEYDIIKDKRYTVDKFQFHVPITMNFKARGLNNINTEVNQWLQKSDNVHIIGIDRGERHLLYLTLIDSKGNIKQQFSLNEIVNEYEGKTYKTDYHKLLDNREGNRDEARKNWKTIETIKELKEGYLSQVIHKISELMVEYNAIVVLEDLNMGFMRGRQKVEKQVYQKFEKMLIDKLNYLVDKKQNPAEMGGTLHAYQFTNKFESFQKMGKQSGMLFYVPAWNTSKMDPVTGFVNLFDTRYENMEKARSFIGKFDTIRYNPKKEYFEFDFDYNKFTAKAEGTRTRWTLCTNDTRIETFRNPAKNSQWDNREIILSDEFINLFKLYNIDYQNSDLKVQICKQTEKAFFERLLHLLKLTLQMRNSMTGTEVDYLISPVTNSRGEFYDSRTASDILPKNADANGAYNIARKGMWVIEQIRKATDFRKLKLAISNKEWLSFVQH

SEQ ID NO: 72 - protein, 1251 aa, unidentified
  REGION 1..1251: note = Description of Unknown:uncultivated organism sequence
  REGION 1..1251: note = Category: MG13 effectors
  REGION 1..1251: note = Description: MG13-38 effector
MNTFNGFTGLYPLSKTLRFELKPIGKTLQFIINNGILEQDKHRADSYSQVKEIINEYHKAFIERGLTGFELKYNNEGKKNSLLEYFMYYNIKNREERDKNTYKQIQNNLRKQITDRLSKDEAFQRINKKELIQQDLISFVETQPNSAKKRALVEEFRNFTTYFSGFHENRKNMYSAEEKSTSIAYRLINENLPKFVDNIQVFSKVMGTEISKKMPQLYQEFQKFLNVENIEEMFHLKYFSSTLTQSQIDVYNAIIGGITSDDNVRIKGLNEYINLYNQQHKDTKLPKLKLLLKQILSERNPVSWLPEKFDSDEQMLTAIKQCYENLSERVFGNTSLRLQLELLGDFDLNGIFISNDPQLADISQKIFGNWGIIQKAIQTKIANCLPQKRKESFEDYQERITKRFKSFDSFSIGYIEECLSAVGIPSNKIEKYFSDLGVVNNRIEQKENHFVRIANAYEEIRDLLNNPYPMEKRLSQDKAHVEKIKQLLDAIKALQHFIKPLLSGGDEPNKDERFYGEFTALWNELDQITPLYNMVRNYITRKPYSEKKIKLNFENSTLMDGWDLNKEKDNTTIILRKDNLYYLGIMNKKFNKIFDKYPGSTSDEYYEKMEYKLLPGANKMLPKVFLLSKSGLDEFNPSQEIRDNYEKGTHKKGINFKLEDCHALIDFFKTSINKHSDWKKFDFKFSETSTYEDLSGFYKEVEQQGYKVSFRNVSANYIDTLIDEGKLYLFQIYNKDFSPYSKGIPNMHTLYWKMLFDEQNLENVVYKLNGQAEIFYRESSLEYHHPTHPANQPVMNKNQSNVKQESVFPYDLIKNRRYTIDKFQFHVPITMNFKSNGVNNINQQVNECLQHADDTHIIGIDRGERHLLYLVVIDKKGNIKEQCSLNEIMNEYNGNRYSTDYHNLLNRREDERLKARQSWQSIESIKDLKEGYLSQVIHKISELIVKYNAIVVLEDLNLGFIRGRQKIEKQIYQKFEKMLIDKLNYLVDKKKEPNELGGILKAYQLANKFESFQKMGKQSGFLFYIPAWNTSKIDPQTGFVNLLDVHYESTEKAKSFFCKFDSIKYNTSKDWFEFELDYSKFNQKAEGTRIHWTLCSYGTRIETLRYVSKNSQWDSVEVNLTEKFKEHFNKYHIDIHTNLKEAISRQIEKNFFEGLLHLLKLTLQMRNSKIGADIDYLISPVADDNGIFYDSRSCDPSLPANADANGAYNIARKGLWILKQIKETVDLKKLKLTISNKEWLRFAQEKPYLND

SEQ ID NO: 73 - protein, 1249 aa, unidentified
  REGION 1..1249: note = Description of Unknown:uncultivated organism sequence
  REGION 1..1249: note = Category: MG13 effectors
  REGION 1..1249: note = Description: MG13-39 effector
MKNFESFTNLYPLSKTLRFELRPIGRTLENIQANGLLEQDNHRAESYKLVKAIIDRYHKVFIDEALSHCVLPVENSGNKNSLSEVYQYLTTKDHSEKETDDFNKTQDNLRKMIVSALKKDTHFGRIFKKELIREDLLNNDLQGFDLNEEEYDLIKEFRDFTTYFVGFNENRANMYSEEAKSTAIGYRLIHENLPKFIDNMVIFQKVKVSPVSEYFANIETEMEDMLQGIKVEDIFDLNFFNQVLVQRFIDLYNAVIGGQVASEEDHRKGLNQYINEYNQVQKDKKDRLPKFKPLFKQILSDRIHASWQIDNFESDNEVLKAIENAYETLDEEVISRKDSNLPLLFASISDFDLSGIYVSAKAITDFSQQIFKDWNAIDSALEAACRRSNQPKKKETEEKYAERIKKQRSHIDSYSVGEIIESLVAFQPNPEKSILDYLGGMGRREDKPSIIESIKSAYRDVEELLKTEYPANKNLALDKDNISKVKALLDAIKELQFFIKPLLGTGKESGKDERFYGEFVDYWQTLDIITPLYNKVRNYATRKPYSTAKFKLNFENSTLLNGWDVNKEPDNTSVLLRKDGLYYLAIMKKSCNRVFAVDQYDTVGDCYEKIDYKLLPGANKMLPKVFFAKSRIDEFAPSREVLDIYKRGSFKKGEEFCKADLHTLIDFYKASITKHEDWKKFGFEFSPTSSYDDISGFYREVEQQGYQIRFRKVSCTYIDSLVDQGQIYLFQIYNKDFSPFSKGTPNMHTLYWKMIFDERNLKDVVYKLNGQAEIFFRKSSLPVETPTHPANQPIANKNPLNRKKESLFTYDIVKNRRYRYDKFQFHVPITMNFKSIGSEYINDQVQDYIRQSKDLHFIGIDRGERHLLYLTVIDSKGIIEEQFSLNVINNEYNGTTYSTNYHDLLEERGDDRTKARREWLAIESIKELKEGYLSQVVKKITDLMIKYNAIVVLEDLNMGFKRGRQKVESSAYQQFEHKLIDKLNYLAGKTAPIDKVGGLLKAYQLATPYQNEMGFQNGFVFYIPAWNTSKIDPVTGFTNLFDLHIETMEQAKKFFSKFDYIRWNAANNWFEFAFDYKNFTEKADGSRTQWTLCTQGTRIRTFRNPEKNSEWDNVEVDLTDQFLSLFNSKNIDIKSDLKTQILAQNEKDFFMSLLLCLKLTLQMRNSISNSEVDYLISPVADANGDFFDSRKVDLSLPANADANGAYNIARKGLWMARRIKKSRPEDKVSLKITNKEWLNFAQNKPYLTD

SEQ ID NO: 74 - protein, 1249 aa, unidentified
  REGION 1..1249: note = Description of Unknown:uncultivated organism sequence
  REGION 1..1249: note = Category: MG13 effectors
  REGION 1..1249: note = Description: MG13-40 effector
MEQFTNLYPLSKTLRFELIPHEKTKELLERTDYLAQDEKRAESYKIVKGIIDRYHKSFIEDVLSKPIEDQGEKRPILKFAKESTKNCDSLEEFYELYSKSQKSETEKNTLEITQNNLRKQIVYALTQDARFKNLDKKELIYQDIYAIAKPEEIPFIKEFEGFATYFVGFHENRMNMYSSEAKSTAIGNRLINENLPIFTDNMGTFQKLLNSPVSEHFDTICKDMEDILPYDNIEEIFMLHNYNDFLTQKQITVYNAIIGGRVLEDGTKIQGINEYVNLYNQQQPTRETRLPKLKTLFKQILSDKESVSWLAEEFTSDEEMLKSIRDYYTSFKNNASQQMIDILTNIKSYDIDHIFIPNDISLTTISKKVFKDWEAINKSIIKRLKEDNPQKGREKDDNYEERMSKAFKSYDSFSLGLINSCTATDDVCIYFSKIAKTDEETGLSHNLLDNIEEAYDKAKEYLNNGYPSNLNLAQDKSTVQKIKNLLDSIKDLQKFIKPLLGSGTEAVKDERFYGDISLVWEILDQITPLYNKVRNRMTRKAYSIEKIKLNFENSTLLAGWDLNKEKDNTSIILKKDGLYYLAIMRKEFNKVFQNTPQLTSGEDSFEKMEYKLLPGANKMLPKVFFSKSRISEFAPSDVLIEKYKKGTHKKGSNFNIDDCHNLIDFFKSSIQKHDDWSKFNFKFSPTDSYEDMSGFYREVEKMGYKITFKKISADYIEELVTSGKIFLFKIYNKDFSQYSKGTPNLHTLYWKMVFDENNLKDVVFKLNGEAEIFYRKKSLSYKSPTHPAHQPIRNKNPYNAKEESVFAYDLIKDKRYTLDKFHFHIPITINFKSEGVNNINTLVCNYIRNNDDIHFIGIDRGERHLLYVSVIDSKGRIKEQFSLNQIINEYKGNSYSTDYHKLLEERDEKRTKERQSWDSIESIKELKQGYLSQVIHKIASLVVKYNAIVVLEDLNIGFKRGRQKVESSIYQQFEKALIDKFNYLVDKNVAPEQPGGLMKGYQLTNKFSSFRDMGKQNGFLFYIPAWNTSKIDPVTGFVDMLHPKYESVEKAREFFTKFNKISYNQEKGWFEFLFDYNDFTTKAEGTRTVWTLCTFGKRIEKFRNKDKNSMWDNKEIDLTSAFISLCEKYNVPLSCDMKNDIVAQTEKDFYVELIRILRLTLQMRNSITGTDIDHLISPVADENGNFYDSRNADSTLPENADANGAYNIARKGLWAAMQIRSCTDPDLKVNLAISNKEWLTFAQTKPYIK

SEQ ID NO: 75 - protein, 1243 aa, unidentified
  REGION 1..1243: note = Description of Unknown:uncultivated organism sequence
  REGION 1..1243: note = Category: MG13 effectors
  REGION 1..1243: note = Description: MG13-41 effector
MKQFTNLYPVSKTLRFELIPQGETRAHLNDLIAEDEQRAEDYKEVKKYIDRYHKWFIDDCLSKVPNSPLGEEMIRLLNKYIEANDEKDGEGPDKVQDDLRKLIVKALKSGVSLDKDPEQEERFKSLFSEELVKNILPDFVQTEEEKNNVAKFRDMTTYFVGFHKNRENMYSEEAQTTAISYRLIHENLPRFLDNIAVYEKIKPVLSDEIVSLEEQLHQNGYVEACCIDSLFSVDFYLRVLTQRGIEQYNAVIGKIVNDESDEIKGLNERINLYNQVHKKEKLPLFKPMYKQILSDREQLSWLPETFENDASLLDAVKGFHQDLLSNDILSRIDKLLSSLQDFNLNQIWIANDVQLRGLSKDLYGDWSLIDRALGIERSEDVVQGLTAAQKKAASAAKKRSSFSIVELNAAIRSRVPDEKYVPVQNYFSAMGKVCAQGEATRENFVTRICAAYQELEEYIPSIRKSLLQEKRATEFIKNYLDAVNDLLRFIKPLLGRGNETDKDANFYGEFAFLTDCLFAIVPLYNEVRNYLTQKPYSTEKFKLNFRGSTLLNGWDKNKEKDNLGVILRKEGKYFLAIMNKKHNTLFTEGKLQQHTGGECYEKMEYKLIPGSKMLPKVFFSKKGISTFQPSEELLLNYRIGTYKKGEKFNLEHLHKLIDFYKHSMAVHEDWSKFDFHFSDTSSYRDISGFYKEVEQQGYKLTFRNVSVSYINRLVEEGKLYLFQIYNKDFSEYSKGTPNLHTLYWKMLFDPENLKDVVYKLNGEAEVFFRKKSLDVSHPTHTKNEPIEKKNKNNKGEKSLFSYDLIKDRRFTVDKFQFHVPITMNFKGEQGDRVNQMVQSYVRNNKGLNVIGIDRGERNLLYLVVINEHGEILEQFSLNEIRNAYNGKEHKIDYHTLLEERSKKRQDARQSWQTIEGIKDLKTGYLSQVIHVITQLMVKYNAIVVLEDLNFGFKSSRQKFEQSVYQQFERKLIDKLNFLVNKKAAPNEVGGLLNAYQLTAPFESFRKMGKQNGFLFYVPAWHTSKIDPRTGFVNLLDTRYENVANSKEFFAKFASITYNPEKKWFEFAFDYKAFGNRADGSRTKWTICSYGERIETFRNPENNNQWDTKTVPLTERLTELFSKYGIDYTTNLKEQILNQTDKAFFVELLGALRLTLQLRNSRKSTGEDFLFSPVAAENGCFFDSRKANDNEPKDADANGAYHIALKGLWVLDTIRNTEEGKNPKLAITNKEWLSYAQAKPFAHE

SEQ ID NO: 76 - protein, 1249 aa, unidentified
  REGION 1..1249: note = Description of Unknown:uncultivated organism sequence
  REGION 1..1249: note = Category: MG13 effectors
  REGION 1..1249: note = Description: MG13-42 effector
MKQLTNLYPVSKTLRFELQPIGKTRENIEKGGILQQDEERAENYKLVKGFIDEYHKQYIKSRLWNFELPLADEGRHNSLAEYRVLYEMPKRDAEQEALFTEVKDNLRAIIARRLTEKGSAYDRIFKKELIREDLIEFLENEKDKEIVRQFADFTTYFTGFHENRANMYSSEEQSTAIAYRLIHQNLPKFMDNMKSFVKIAETAVAEHFPEIYAGWEEYLNVGSINDMFHLDYFSQTLTQEHIEVYNYIIGKRILDDGTEIKGINEYVNLYNQQQKDKKQRLPLLVPLYKQILSDREKLSWLSEEFDSDERMQHAIKETYDHLYNLLMGDENESLKSLFMHLRDFDLSQINITNDLSLTDISQHLFGKYDVFTNGIKDKLRIITPRKKKETDEVFEERITKLYKTQKSFSIAELNGLPHPVVEGSQPNNIVDYFMALGAVNTDTIQKENLFAQIENAYTDVLPILQMTDTGDKLSQNKPAVAKIKRLLDALKDLQHFVKPLLGSGEEVEKDERFYGQFQTIWDELDYVTPLYNKVRNWLTRKPYSTEKIKLNFDNSQLLGGWDVNKEPDCTGVLLRKGGFYYLGIMNKKNNRIFEKDLTPSDGDCYDKIDYKLLPGANKMLPKVFFSKSRIDEFAPSTSLVEKYKAGTHKKGANFNLKDCHNLIDFFKQSIAKHEDWRKFGFHFSNTDSYEDISGFYREVEQQGYSLTSHKVSTDYIHRMVDEGKLFLFRLWNKDFSEHSKGTPNLHTLYWKMLFDERNLQDVVYKLNGQAEVFYRKASIKEENRIIHPAKKDISNKNALNNKHTSRFDYDIIKDRRYTVDKFQFHVPITINFKAIGQTNINPVVHDIIRQGGIKHIIGIDRGERHLLYLSLIDLKGRIVKQMTLNEIINEYSGRQYKTNYHDLLVKREGERTDARRSWDTIENIKELKEGYLSQVVHVITKMMVEYKAIVVLEDLNMGFMRGRQKIERQVYEKFEHMLIDKLNCYIDKQEDPSKSGGLLHALQLSNKFESFARLGKQSGCLFYIPAWNTSKIDPVTGFVNLLDTHYDTMKAAKSFFSKFERISYNGEKDWFEFTFDYNEFNKKAEGTRTHWTLCTYGARIRNFPNPQKNNQWDDEEVVLTDMFKNFFEDYGIDYRGNLKEAIQQPTEAKFYQELMSLMKLLLQMRNSKINSEVDYLLSPVVDENGQIFDSRLVNTTLPDNADANGAYNIARKGLWVIRKIQESPKDEKMSLAISNKEWLTFAQTKPYLE

SEQ ID NO: 77 - protein, 1249 aa, unidentified
  REGION 1..1249: note = Description of Unknown:uncultivated organism sequence
  REGION 1..1249: note = Category: MG13 effectors
  REGION 1..1249: note = Description: MG13-43 effector
MKQFTNLYPVSKTLRFELQPIGKTKENIEKNGILMRDEKRAKDYKIVKEFIDDYHKQFIKERLWDFKLPLNSEGKLNSLEEYQALYELSKRDEVQEAEFTEVKDNLRSIIAKRLTESGSAYERIFKKELIREDLVDFLENEEDKDIVRQFADFTTYFSGFHENRHNMYVAEEKSTAIAYRLIHQNLPKFMDNMKAFAKIAETSVAEHFADIYDGWKEYLNVESIEEVFRLDFFSETLTQPHIEVYNYIIGKKILEDGTEIKGINEYVNIYNQQQKDKSKRLPFLVPLYKQILSDREKLSWLAEEFDSDEKMLSAINESYSHLHDLLMSNENESLRSLLLHIKEFNLSHINIANDLSLTDISQHLFSRYDVFTNGIKDELRIITPRKKKESDEDFEERITKIFKAIKSFSIDFLDNLPQPVMEDGKRRSIENYFMTLGAVNTETTQKENLFAQIENAYEDARNILQLKDTGDTLSQNKPAVAKIKALLDALKDLQHFIKPLLGSGEENEKDELFYGSFMMMWDELDTITPLYNKVRNWLTRKPFSTEKIKLNFDNAQLLGGWDVNKEPDCTGVLLRKDGFYYLGIMNKKSNRIFESEVTPSDGECYDKIDYKLLPGANKMLPKVFFSKSRIDEFAPSEAVVSSYKRGTHKKGANFNLSECHRLIDFFKQSINKHEDWSKFGFHFSPTDTYEDISGFYREVEQQGYMLSSHPVSSSYINQLVDEGKLYLFRIWNKDFSEFSKGTPNLHTLYWKMLFDERNLADVVYKLNGQAEVFYRKASIKPENRIIHKANQPIANKNELNEKRTSTFEYDIIKDRRYTVDKFQFHVPITINFKAAGQTNINPIVQDVIRQGGFSHIIGIDRGERHLLYLSLIDLKGNIIKQMTLNEIINEYKGQTYKTNYHTLLAKREGDRTDARRSWETIETIKELKEGYLSQVVHIISKMMVEYNAIVVLEDLNTGFMRGRQKIERQVYEKFEKMLIEKLNCYIDKHADPSEDAGLLHPLQLTSDIQKWKRSHQCGCLFYIPAWNTSKIDPVTGFVNLLDTRYDTREKARVFFSKFQRISFNAQKGWFEFAFDYNDFTTKAEGTRTQWTLCTQGERIRTFRNPQKNNQWDDERIVLTDAFKQLFDKYDIDINGNLKEAISAQTDAQFFKELLGLMKLLLQMRNSITNSEEDYLLSPVADNTGNFFDSREGIYSLPIDADANGAYNIARKGLWVIRKIQETPNGEKTSLSITNKEWLQFAQTKPYLND

SEQ ID NO: 78 - protein, 1237 aa, unidentified
  REGION 1..1237: note = Description of Unknown:uncultivated organism sequence
  REGION 1..1237: note = Category: MG13 effectors
  REGION 1..1237: note = Description: MG13-44 effector
MHTMKKINELTALYPLSKTLRFELKPIGKTLDHIEQKGLIVQDEQRAEEYKQVKKIIDSYHKEFITMCLKGLKLNMVYLERYESLAREVHRDEAEFDKVKAALRKQIVEAFKQGGSYNDLFKKELIQKHLPEFVESEEEKKMVANFSKFTTYFTGFYENRKNMYSDEEKSTAIAYRLIHENLPLFLDNMRSFRKIAESEVGEQFANIEVRFEEYLNVEHLAEMFELDYFSDTLTQEQIAVYNSVIGGRTLDDGTKIQGINEYVNLYNQQHKEARLPLLKPLYKMILSDRVALSWLPENPFESDEEMVEAIKEMCQSLKEVLMGNDGLRNLLLNIDLYDIEHIYIANDLGLTDISQQMFGQYDVYASAIKQKLRQGVKQSPKERREPELFEERINRLYKSTKSFSIADLNSHTDANHTIESYFKQLGAYDREGEQRDNLFTQIEMAQIAATDILAGKHGNISQSDKEIAILKGLLDAYKSLQHFVKPLLGHGDEADKDNEFDAKLREAWNALDIVTPLYNKVRNWLTRKPYSVEKIKLNFENAQLLGGWDVNKEPDCTSVLLRKDGFYYLAIMDKKSNHAFDSDELPCDGKCYEKIDYKLLPGANKMLPKVFFSKSRIDEFAPSKEIVEAYKNGTHKKGKDFNLAHCRRLIDFFKRSITKHEDWKNFPFVFSPTESYEDISGFYREVEQQGYMLSFRKVSESFINQLVDEGKLYLFKIWNKDFSEYSKGMPNMHTLYWKMLFNEQNLADTVYKLNGQAEVFYRKRSLDMADTTVHRASQPLVNKNALNKKRHSTFDYDIVKDRRYTVDKFQFHVPMTMNFKAVGRDNINSEVLNIIRNGGIKHIIGIDRGERHLLYLSLIDLKGNIVKQMTLNDIVNEYNGNTYATNYRDLLAEREGNRTEARRNWKKIENIKEIKQGYLSQVVHIISKMMVEYDAIVVLEDLNMGFMRGRQKIERSVYEQFEKMLIDKLNYYVDKQKRIDEAGGLLHALQLTSKFESFKKLGKQSGCLFYIPAWNTSKIDPVTGFVNLFDTRYVNADKAREFFSKFDSIRYNDAKNWFEFAFDYNKFTEKAKGTRTRWTLCTWGTRIRTFRNPAKLNQWDNEEVVLTDVFKKAFDEAGIDIHSNLKEAICTLTEKKHLESLLHLMKLLLQMRNSITNSEIDYLLSPVADENGHFYDSRTCDDTLPKDADANGAYNIARKGLWAIRTIQESSETERPNLALKNQDWLRFAQQKPYLND

SEQ ID NO: 79 - protein, 1274 aa, unidentified
  REGION 1..1274: note = Description of Unknown:uncultivated organism sequence
  REGION 1..1274: note = Category: MG13 effectors
  REGION 1..1274: note = Description: MG13-45 effector
MNVDLLIKKTYNMRDFNEFVGLYPISKTLRFELKPIGKTLEHIQRNKLLEDDAVRADDYVKVKKIIDKYHKCLIDEALSGFTFDTEADGRSNNSLSEYYLYYNLKKRNEQEQKTFKTIQNNLRKQIVNKLTQSEKYKRIDKKELITTDLPDFLTNESEKKLVEKFKNFTTYFTEFHKNRKNMYSKEEKSTAIAFRLINENLPKFVDNIAAFEKVASSPLAEKINALYEDFKEYLNVEEISRVFRLDYYNELLTQKQIDLYNAIVGGRTEEANRIQIKGLNQYINEYNQQQTDRSNRLPKLKPLYKQILSDRESVSWLPPKFDSDKDLLIKIKECYDALSEKEKVFDKLESILKSLSTYDLSKIYISNDSQLSYISQKMFGRWDIIGKAIREDCAKRNPQKSRESLEKFAERIDKKLKAIDSISIGDVDECLAQLGETYVKRVEDYFAAMGESEIDDEQTDTTSFKKNIEGAYESVKELLNNADNITDNNLMQDKGNVEKIKTLLDAIKDLQRFIKPLLGKGDEADKDGVFYGEFTSLWTKLDAVTPLYNMVRNYLTSKPYSTKKIKLNFENSSLMKGWDLNKEPDNTTVIFRKDGLYYLGIMSKKYNRVFVDREDLPHDGECYDKMEYKLLPDANKMLPHVFLSKKGIQRFRPSGELLGKYERGTHTKGADFDLGDCRALIDFFKKSIERHDDWKKFDFKFSDTSTYQDISEFYREVEQQGYKMSFRKVSVDYIKSLVEEGKLYLFQIYNKDFSAHSKGTPNMHTLYWKMLFDEENLKDVVYKLNGEAEVFFRKSSITVQSPTHPANSPIKNKNKDNKKKESEFEYDLIKDRRYTVDKFLFHVPITMNFKSVGGSNINQLVKRHIRSATDLHIIGIDRGERHLLYLTVIDSRGNIKEQFSLNEIVNEYNGNTYRTDYHELLDAREGERTEARRNWQTIQNIRELKEGYLSQVIHKISELAIKYNAVIVLEDLNFGFMRSRQKVEKQVYQKFEKMLIYKLNYLVDKKKPIAETGGLLRAYQLTGELESFKTLGKQSGILFYVPAWNTSKIDPVTGFVNLFDTHYENIEKAKGFFDKFKSIRYNSDKDWFEFVVDDYTRFSPKAEGTRRDWTICTQGKRIQIYRNPQRNNEWEGRKIDLTKAFKEHFEAYGVDISKDLREQINTQNKKEFFEELLRLLRLTLQMRNSMPSSDIDYLISPVADDTGCFFDSRKQAELKENAVLPMNADANGAYNIARKGLLAIRKMKQEENDSAKISLAISNKEWLKFAQTKPYLED

SEQ ID NO: 80 - protein, 1252 aa, unidentified
  REGION 1..1252: note = Description of Unknown:uncultivated organism sequence
  REGION 1..1252: note = Category: MG13 effectors
  REGION 1..1252: note = Description: MG13-46 effector
MKQFTNLYPVSKTLRFEIQPIGKTRENIEKNGILQRDEKRAEDYKIVKGFIDEYHKQFIKDRLWSFKLPLHSEGHLDSLEEYQALYEMSKRNDAQEAEFTEIKDNLRSIIAKRLTESGSAYERIFKKELIREDLIDFLESNEDKDIVRQFADFTTYFSGFHENRRNMYVAEEKSTAIAYRLIHQNLPKFMDNMKAFAKIAGTSVAEHFTDIYEGWKEHLNVGSIEEIFRLDYFSETLTQIHIEVYNYIIGKKILEDGTEIKGINEYVNLYNQQQKDKSKRLPFLVPLYKQILSDRDKLSWLAEEFDSDEKMLAAINESYNHLHDLLMGNENESLRSLLLHIKDFNLSQINITNDFSLTDISQHLFGRYDVFTSGIKDELRIITPRKKKESDEDFEDRISKIFKTQKSFSIDFLDKLPQPVMEDGKPRCIEDYFMTLGAVNTETTQKENLFAQIENAYEDARAILQMKDTGDTLSQNKSAVAKIKALLDALKDLQHFIKPLLGSGEENEKDELFYGSFQMMWDELDTVTPLYNKVRNWLTRKPFSTEKIKLNFDNSQLLGGWDVNKEPDCTGVILRKDSYYYLGIMDKKSNRIFEANATPSDGDCYDKIDYKLLPGANKMLPKVFFSKSRIDEFAPSEAIVSSYKRGTHKKGADFNLAECHRLIDFFKQSINKHEDWSKFNFHFSDTKTYEDISGFYREVEQQGYMLSSHPISSSYVNQLVDEGKLYLFRIWNKDFSESSKGTPNLHTLYWKMLFDERNLADVVCKLNGQAEVFYRKASIKPENRIVHKANQPIANKNELNTKRASTFEYDIIKDKRYTVDKFQFHVPITINFKAAGQTNINPIVQDAIRQGGFSHIIGIDRGERHLLYLSLIDLKGKIIKQMTLNEIINEYKGQTYKTNYHDLLAKREGDRTDARRSWETIETIKELKEGYLSQVVHIISKMMVEYNAIVVLEDLNTGFMRGRQKIERQVYEKFEKMLIEKLNCYIDKQLSPTDEGGLLHPLQLTCDAQKWKRAHQCGCLFYIPAWNTSKIDPVTGFVNLINTSRYDTREKARGFFSKFQRISFNEKKDLFEFTLDYNDFDYIAKAEGTRTQWTLCTQGERIRTFRNPQKNHQWDDERIVLTDAFKQLFDKYDIDINGNLKEAISAQTDAQFFKELLGLTKLMLQMRNSITNSEEDYLLSPVADITGHFFDSREGISSLPIDGDANGAYNIARKGLLVIRKIQETPDGEKPSLTITNKEWLLFAQTKPYLND

SEQ ID NO: 81 - protein, 1249 aa, unidentified
  REGION 1..1249: note = Description of Unknown:uncultivated organism sequence
  REGION 1..1249: note = Category: MG13 effectors
  REGION 1..1249: note = Description: MG13-47 effector
MKQFTNLYPVSKTLRFELQPVGKTKENIEKNGILLRDEQRAEDYKRVKLLIDEYHKQFIKDRLWNFKLPMINNGHHDSLEEYQALYELSKRDDDQEATFTEVKDNLRSIIAKQLTVGSAYERIFKKELIREDLIEFLEDEKDKDIVRQFADFTTYFSGFHENRKNMYSAEEKSTAIAFRLIHQNLPKFMDNMKAFAKIKQTSVAEHFTDIYEGWKEYLNVESIEEIFSLDYFSETLTQPHIEVYNYIIGKKILDDGTEIKGINEYVNLYNQQQKDKNKRLPFLVPLYKQILSDREKLSWIAEEFDSDEKMLSAINESYSHLHDLLMGEENESLRSLLSHIKDYDLTQINITNDLSLTEISQHLFSRYDVFTNGIKDELRVITPRKKKEGDEIFEDRISKIFKTLKSFSIAFLDRLPQPVMEDGKPRSVEDYFMSLGAVNTETTQRENLFVQIENAYEDARAILQMKDTGDTLSQNKSAVAKIKTLLDTLKDLQHFIKPLLGSGEEQEKDELFYGSFQMMWDELDAITPLYNKVRNWLTRKPYSTEKIKLNFDNAQLLGGWDVNKEPDCTGVLLRKDGLYYLGIINKNHNRIFDADVTPTDGDCFIKIDYKLLPGANKMLPKVFFSKSRIDEFAPSKAIVSSYKQGTHKKGTNFNLTDCHRLIDFFKHSINKHPDWSKFGFHFSDTETYEDISGFYREVEQQGYMLSSHSVSVSYINQMVDEGKLYLFRIWNKDFSEFSKGTPNLHTLYWKMLFDERNLADVVYKLNGQAEVFYRKASIKPENRIVHQAHRPITNKNELNEKRTSTFEYDIIKDRRYTVDKFQFHVPITINFKAKGQNNINPIVQETIRQDGFKHIIGIDRGERHLLYLSLIDLNGNIVKQMTLNDIINEYKGQTYKTNYHHLLAKREGERTDARRSWDTIETIKELKEGYLSQVIHIISKMMVEYNAIVVLEDLNIGFMRGRQKIERQVYEKFEKMLIDKLNCYIDKQIAPQEVGGMLHPIQLTNKFESFGKLGKQSGCLFYIPAWNTSKIDPMTGFVNLFDTRYETREKARLFFSKFQRISFNEEKGWFEFAFDYNDFTTKAEGTRTQWTLCTYGERIRTFRNPDNNHQWDDERIELTEEFKLLFEKYNINIRGNLKEAISNQSDAQFYRDLLGLMKLLLQMRNSIINSEEDYLLSPVADENGHFFDSREEIESLPNNADANGAYNIARKGLWIMEQIKKTDNLAKLKLTISNKEWLHFAQNKPYLNE

SEQ ID NO: 82 - protein, 1171 aa, unidentified
  REGION 1..1171: note = Description of Unknown:uncultivated organism sequence
  REGION 1..1171: note = Category: MG13 effectors
  REGION 1..1171: note = Description: MG13-48 effector
MIRLLNKYIEANNEKDGEGPDKVQDDLRKLIVKALKSGVSLDKDPEQEERFKSLFSEKLVKNILPNFVQTEEEKSKVAKFRDMTTYFVGFHKNRENMYSEEAQTTAISYRLIHENLPRFLDNIAVYEKVKPVLSDEIASLEEQLHQNGYVEASCIDSLFSVDFYLRVLTQRGIEQYNAVIGKIVNDESDEIKGLNERINLYNQVHKKEKLPLFKPMYKQILSDREQLSWLPETFENDASLLDAVKGFHQDLLSNDILSRIDKLLSSLQDFNLDQIWIANDVQLRGLSKDLYGDWSLIDRALGIERSEDVVQGLTAAQKKAASAAKKRSSFSIVELNAATRSSVPDEKYVPVQNYFSAMGKVCAQGEATRENFVTRICAAYQELEEYIPSIRKSLLQEKRATELIKNYLDAVNDLLRFIKPLLGRGDETDKDANFYGEFTFLTDCLFAIVPLYNEVRNYLTQKPYSTEKFKLNFRGSTLLNGWDKNKERVNLGVILRKEGKYFLAIMNKKHNTLFTEGKLQQHTGGECYQKMEYKLIPGSKMLPKVFFSKKGISTFQPSEELLLNYRIGTYKKGEKFNLEHLHKLIDFYKHSIAVHEDWSKFDFHFSDTSSYRDISGFYKEVEQQGYKLTFRNVSVSYINRLVEEGKLYLFQIYNKDFSEYSKGTPNLHTLYWKMLFDPENLKDVVYKLSGEAEVFFRKKSLDVSHPTHPKNEPIEKKNKNNKGEKSLFSYDLIKDRRFTVDKFQFHVPITMNFKGEQGDRVNQMVQSYVRNNKGLNVIGIDRGERNLLYLVVINEHGEILEQFSLNEIRNAYNGKEHKIDYHTLLEERSKKRQDARQSWQTIEGIKDLKTGYLSQVIHVITQLMVKYNAIVVLEDLNLGFKSSRQKFEQSVYQQFERKLIDKLNFLVNKKAAPNEMGGLLNAYQLTAPFESFRKMGKQNGFLFYVPAWHTSKIDPRTGFVNLLDTRYENVAKAKEFFAKFESITYNPEKKWFEFAFDYKAFGNRADGSRTKWTICSYGERIETFRNPKNNNQWDTKSVPLTERLTELFSKYGIDYTTNLKEQILNQTDKAFFVELLGALRLTLQLRNSRKSTGEDFLFSPVADENGCFFDSRKANDNEPKDADANGAYHIALKGLWVLDTIRNTEEGKNPKLAITNKEWLSFAQAKPFAHE

SEQ ID NO: 83 - protein, 1243 aa, unidentified
  REGION 1..1243: note = Description of Unknown:uncultivated organism sequence
  REGION 1..1243: note = Category: MG13 effectors
  REGION 1..1243: note = Description: MG13-49 effector
MKTFNDLTGLYSLSKTLRFELKPVGKTKDNIETKGIIAQDEKRAEEYKKVKDIIDRYHKKFIEMCLANLKLKTISDGNNDSLKEYVTLASKANKDEKEDNDFKDVKTALRKQIVDAFKKGGSYSDLFKKELIQVHLPDFVTDEQEKQMVENFGKFTTYFTGFNENRQNMYSDEEKSTSIAYRLIHENLPMFIDNIKSFAKIAEHEDIDFFPDIENGFKEELKRLKAQSISEVFDLANFTNTLTQSQIDSYNAIIGARHDENGDKVQGINQYVNLYNQKNKDARLPLLKPLYKMILSDRVALSWLPEEFATDEEMLNAINEAHENLKSVLEKVRVLLLNIGNYDTEHIYIANDKGLTDISQQIFGQYDVYTSAIKAELRDSITPSAKERKDPELLEKRINDIFKASKSFSIEYLNSHVDSDKTIQSYYKELGAYDRNGEERINLFSQIELAYVDAHDVLLGKHTNLNQSEDSIKKIKALLDAYKELQHFIKPLLGNGDEADKDNEFDAKLRAIWDELDIVTPLYDKVRNRLTRKPYSTEKIKLNFDNAQLLNGWDMNKEPDCTSVLLRKDGQYYLAIMDKKSNHAFDIDELPCDGECYDKMDYKLLPGANKMLPKVFFSKSRIKEFAPSNEICDAYQKGTHKKGANFSIKDCRRLIDFFKDSIAKHEDWSKFPFTFSDTSTYEDISGFYREVEQQGYMLGYRKVSVSFINQLVDEGKLYLFQIWNKDFSEYSKGTPNMHTLYWKMLFDERNLANVVYKLNGQAEVFYRKRSLDLNKTTIHRANQPIANKNIQNEKRESTFCYDIVKNRRYTVDKFQFHVPITINFKATGSDNINASVLDVIRNNGIEHIIGIDRGERHLLYLSLIDMKGNIVKQMTLNDIINEYKGNTYTTNYKELLQAREGDRKEARQNWQKIENIKELKEGYLSQVVHVITKMMVEYKAIVVLEDLNGGFMRGRLKIERQVYEKFEKMLIDKLNYYVDKQKDVNDNGGLLHAYQLASKFDTFKKLGKQSGCLFYIPAWNTSKIDPVTGFVNMLDTRYENADKARKFFSKFKSINYNADKNWFEFVIDDYSKFTDKAKDTRTDWVLCTYGTRIKTFRNPEKLNQWDNKEIVLADEFKKVFMEAGIDINGNLKEAICTLTEKKHLESLMQLMKLLVQMRNSETNSEVDYLLSPVADTEGNFYDSRNCGDNLPKDADANGAYNIARKGLWAVMKIKASKPGENLKLGISNREWLQFAQEKPYLND

SEQ ID NO: 84 - protein, 1171 aa, unidentified
  REGION 1..1171: note = Description of Unknown:uncultivated organism sequence
  REGION 1..1171: note = Category: MG13 effectors
  REGION 1..1171: note = Description: MG13-50 effector
MIRLLNKYIEANDEKDSEGPDKVQDDLRKLIVKALKSGVSLDKDPEQEERFKSLFSEKLVKNILPNFVQTEEEKSKVAKFRDMTTYFVGFHKNRENMYSEEAQTTAISYRLIHENLPRFLDNIAVYEKVKPVLSDEIASLEEQLHQNGYVEACCIDSLFSVDFYLRVLTQRGIEQYNAVIGKIVNDESDEIKGLNERINLYNQVHKKEKLPLFKPMYKQILSDREQLSWLPETFENDASLLDAVKGFHQDLLSNDILSRIDKLLSSLQDFNLDQIWIANDVQLRGLSKDLYGDWSLIDRALGIERSEDVVQGLTAAQKKAASAAKKRSSFSIVELNAATRSSVPDEKYVPVQNYFSAMGKVCSQGEPKRENFVTRICAAYQELEEYIPSIRKSLLQEKRATELIKNYLDAVNDLLRFIKPLLGRGNETDKDANFYGEFAFLTDCLFAIVPLYNEVRNYLMQKPYSTEKFKLNFRGSTLLNGWDKNKERDNLGVILRKEGKYFLAIMNKKHNTLFTEGKLQQHTGGECYQKMEYKLIPGSKMLPKVFFSKKGISTFQPSEELLLNYRIGTYKKGEKFNLEHLHKLIDFYKHSIAVHEDWSKFDFHFSDTSSYRDISGFYKEVEQQGYKLTFRNVSVSYINRLVEEGKLYLFQIYNKDFSEYSKGTPNLHTLYWKMLFDPENLKDVVYKLSGEAEVFFRKKSLDVSHPTHPQNEPIEKKNINNKGEKSLFSYDLIKDRRFTVDKFQFHVPITMNFKGEQGDRVNQMVQSYVRNHKGLNVIGIDRGERNLLYLVVINEHGEILEQFSLNEIRNAYNGKEHKIDYHTLLEERSKKRQDARQSWQTIEGIKDLKTGYLSQVIHVITQLMVKYNAIVVLEDLNFGFKSSRQKFEQSVYQQFERKLIDKLNFLVNKKVAPNEVGGLLNAYQLTAPLGNSRKMGKQNGFLFYVPAWHTSKIDPRTGFVNLLDTRYENVANSKEFFAKFASITYNPEKKWFEFAFDYKAFGNRADGSRTKWTICSYGERIETFRNPKNNNQWDTKTVPLTERLTELFSNYGIDYTTNLKEQILNQTDKAFFVELLGALRLTLQLRNSRKSTGEDFLFSPVADENGCFFDSRKANDNEPKDADANGAYHIALKGLWVLDTIRNTEEGKNPKLAITNKEWLSFAQAKPFAHE

SEQ ID NO: 85 - protein, 1244 aa, unidentified
  REGION 1..1244: note = Description of Unknown:uncultivated organism sequence
  REGION 1..1244: note = Category: MG13 effectors
  REGION 1..1244: note = Description: MG13-51 effector
MKQFTNLYPVSKTLRFELIPQGETRAHLNDLIAEDEQRAEDYKEVKKYIDRYHKWFIDDCLSKVPNSPLGEEMIRLLNKYIEANDEKDGEGPDKVQDDLRKLIVKALKSGVSLDKDPEQEERFKSLFSEDLVKNILPNFVQTEEEKSKVAKFRDMTTYFVGFHENRKNMYSEEAQTTAIGYRVIHENLPRFLDNIAVYEKVKPVLSDEIASLEEQLHQNGYVEASCIDSLFSVDFYLRVLTQRGIEQYNAVIGKIVNDESDEIKGLNERINLYNQVHKKEKLPLFKPMYKQILSDREQLSWLPETFENDASLLDAVKGFHQDLLSNDILSRIDKLLSSLQDFNLDQIWIANDVQLRGLSKDLYGDWSLIDRALGIERSGDVVQGLTAAQKQAAAVAKKRSSFSIVELNVATRSRVPDEKYVPVQNYFSAMGKVCAQGEATRENFVTRICAAYQELEEYIPSIRKSLLQEKRATELIKNYLDAVNDLLRFIKPLLGRGNETDKDANFYGEFAFLTDCLFAIVPLYNEVRNYLTQKPYSTEKFKLNFRGSTLLNGWDKNKERDNLGVILRKEGKYFLAIMNKKHNTLFTESKLQQHTAGECYEKMEYKLLPGPNKMLPKVFFSKKGISTFQPSEELLLNYRIGTHKKGEKFNLEHLHKLIDFYKHSIAVHEDWSKFDFHFSDTSSYRDISGFYKEVEQQGYKLTFRNVSVSYINRLVEEGKLYLFQIYNKDFSEYSKGTPNLHTLYWKMLFDPENLKDVVYKLSGEAEVFFRKKSLDVSHPTHPKNEPIEKKNINNKGGKSLFSYDLIKDRRFTVDKFQFHVPITMNFKGEQGDRVNQMVQSYVRNNKGLNVIGIDRGERNLLYLVVINEHGEILEQFSLNEIRNAYNGKEHKIDYHTLLEERSKKRQDARQSWQTIEGIKDLKTGYLSQVIHVITQLMVKYNAIVVLEDLNFGFKSSRQKFEHSVYQQFERKLIDKLNFLVNKKTAPNEVGGLLNAYQLTAPLGNSRKMGKQNGFLFYVPAWHTSKIDPRTGFVNLLDTRYGNVAKAKEFFAKFESITYNPEKKWFEFAFDYKAFGNRADGSRTKWTICTFGERIETFRNPENNNQWDTKTVPLTERLTELFSNYGINFTTNLKEQILNQTDKAFFVVLLGALRLTLQLRNSRKSTGEDFLFSPVADENGRFFDSRIANDNEPKDADANGAYHIALKGLWVLDTIRNTEEGKNPKLAITNKEWLSFAQAKPFAHE

SEQ ID NO: 86 - protein, 1246 aa, unidentified
  REGION 1..1246: note = Description of Unknown:uncultivated organism sequence
  REGION 1..1246: note = Category: MG13 effectors
  REGION 1..1246: note = Description: MG13-52 effector
MSIYNELTNLYPVQKTLKFELCPIGNTLEHFLTSGILEEDEQRHEEYKSVKKIIDRYHKQFIEKALSNFSFKVQNEEKLNSLEEYIELFIHKKSVENGAEKFKKVQDNLRKQITSHFAKQEAFANLFKKELIQDDLPAFVTSTDEKEMIAHFTRFTTYFVDFHKNRKNMYSDEAKATSIAYRLIHENLPKFLTNALAFERIRNSEVANHFEAIQESLNIENIASLFDPLSYSQVLTQAKIDIYNGVIGGKTLDNLGNRSQGLNEYINLYNQTHNERLPLLKPLYKQILSDRSSLSWLPDTFKDDEQLADTLNDWYNEIENEIISPQDGQISLRELLENISTYNTDTIYIQNDTSITDISTRLFKRYDTITNAVSSEFQRILPRKKNESQEKYDERIKKIIDKKSSFSIGYLNYCLSQVPNLSYQTIDSYFKSLGAYERDGVQKENLLTSIERAHFLAQPYIINAKGDNLIHNSEAIKAIRELLVSVNNLLHFIKPLCIGEEEADADASFYGDFTHIWAILEKTTLLYNMVRNYLTRKPYSTDKFKLNFKNDQLLLGWDQNKEVDRTTVLLRKDGYYYLAIMNKAHNRIFDMEHLPDDGDCYEKMDYKLLPGPNKMLPKVFFSKSRIDEFAPDTTLLENYNKGTHKKGNNFRIEDCHALIDFFKASIDKHEDWKKFGFHFSDTKDYEDLSDFYQEVEKQGYKVSFRNVSVSYIDNLVNEGKLYLFKIYNKDFSSNSKGTPNLHTLYWKMLFDERNLKHVVYKLNGEAEIFYRKASIPEDKRIIHHVNDEKRFRSPWNQQRHEVFKHEIIQDRRYTIDKFQFHVPITINFQSKGIGDINEKVQQLIHDGKIRHIIGLDRGERHLLYLSLIDMKGNIVKQISLNEIANQYNGNIYKTHYQNLLKQREEDRLEARKNWQVINNIKNLKQGYLSQVVHKISEMIVEYDAIVVLEDLNFGFMRGRQKIERSIYQQFEVALIEKLNYLVDKKQSVEKECGLLQALQLTNQFESFQKLGKQTGVLFYIPAWNTSKIDPVTGFTNLFDTRCDTREKIHDFISSFDSIKYNPDKNYFEFSFNYDNFTKKAEGSRTHWTICSYGERIETFHNLEKNNNWDMRVIDLSAQIRSLLEEEKIDINGNLKDAILRIDKTSFLKSIMHYIKLMLQMRNSKTGTEEDYILSPVADENGIFFDSRTQKANLPLDADANGAYNIARKGLWIVRQIQKKQENEKLNLAISNKEWLKFAQEKTYLND

SEQ ID NO: 87 - protein, 1249 aa, unidentified
  REGION 1..1249: note = Description of Unknown:uncultivated organism sequence
  REGION 1..1249: note = Category: MG13 effectors
  REGION 1..1249: note = Description: MG13-53 effector
MKQFTNLYPVSKTLRFELQPIGKTKENIEKNGILMRDEKRAEDYKIVKGFIDDYHKQFIKERLWSFKLPLNSEGHLNSLEEYQALYEVSKRNEVQEAEFSEVKDNLRSIIAKRLTESGSAYERIFKKELIREDLIDFLESKEDKDIVRQFADFTTYFSGFHENRKNMYVAEEKSTAIAYRLIHQNLPKFMDNMKTFAKIAETSVAEHFSDIYEGWKEYLNVGSIEEIFRLDYFSETLTQPHIEVYNYIIGKKILEDGTEIKGINEYVNLYNQQQKDKSKRLPFLIPLYKQILSDREKLSWLVEEFDSDEIMLAAINEAYNHLHDLLMGRENESLRSLLLHIKDFDLSQISITNDLSLTDISQHLFSRYDVFTNGIKDELRIITPRKKKESDEDFEDRISKIFKTQKSFSIDFLDKLPQPVMEDGKTRSIEDYFMTLGAVNTETTQKENLFAQIENAYEDARFVLQLKDTGDTLSQNKSAVAKIKALLDALKDLQHFIKPLLGSGEENEKDDLFYGSFQMMWDELDTITPLYNKVRNWLTRKPFSTEKIKLNFDNSQLLGGWDVNKEPDCTGVLLRKDGLFYLGIMDKKSNHIFETDVIPTDGECFDKIDYKLLPGANKMLPKVFFSKSRIDEFAPSESIITSYKRGTHKKGVGFNLAECHRLIDFFKQSINKHEDWSKFGFHFSDTKTYEDISGFYREVEQQGYMLSSRPVSSSYIDTLVSEGKLYLFRIWNKDFSEFSKGTPNLHTLYWKMLFDERNLSDVVYKLNGQAEVFYRKASIKPENRIVHKANQPVANKNELNTKLASTFEYDIIKDKRYTVDKFQFHVPITINFKAAGQTNINTIVQDAIRQEEFSHIIGIDRGERHLLYLSLIDLKGNIVKQMTLNEIINEYKGQTYKTNYHDLLAKREGDRTNARRSWETIETIKELKEGYLSQVVHIISKMMVEYNAIVVLEDLNTGFMRGRQKIERQVYEKFEKMLIEKLNCYIDKQVSPTAKGGLLNPLQLTCDAQKWKRSHQCGCLFYIPAWNTSKIDPVTGFVNLLDTHYDTREKARVFFSKFQRISYNAQKGWFEFAFDYNDFTSKAEGTRTQWTLCTQGERIRTFRNPQKNHQWDDERIALTDAYKQLFDKYDIDINGNIKEAISAQTDAQFFKELMGLMKLLLQMRNSVTNSEEDYLLSPVADDAGHFFDSREGISNLPIDADANGAYNIARKGLWIIRKIQEAPSGERISLSITNKEWLQFAQTKPYFND

SEQ ID NO: 88 - protein, 1274 aa, unidentified
  REGION 1..1274: note = Description of Unknown:uncultivated organism sequence
  REGION 1..1274: note = Category: MG13 effectors
  REGION 1..1274: note = Description: MG13-54 effector
MNELKQFTNLYQLSKTLRFELQPIGKTKDNIETNGILQRDKKRAEDYIRVKQFIDEYHKQFIKERLWNFTLPMESEGCHDSLEEYQSLYELPKRDTAQEAAFTEVKDNLRGIIAKRLTEKGTAYDRIYKKELIREDLIEFLEKDEEKDIVRQFADFTTYFTGFYENRANMYTAEEKSTAIAYRLIHQNLPKFMDNMKAFAKIAQTSVAEHFADIYDGWKEYMNVGSLEGIFQLDYFSETLTQPHIEVYNYIIGKRILEDGTEIKGINEYVNLYNRQQKDKSLRLPFLVPLYKQILSDREKLTWLSEELDSDEKMLAAIKETYTNLHDLLMGEENESLRSLLQHLKDFNLAQVNITNDISLTDISQHLFGQYDVFTRGLKDELRIITPRKKNESDEAFEERITKIFKTQKSFCIAVLDKLPQPVMEDGKPRCIEDYFMTLGAVNTETNQKVNLFAQIENAHEDARAILQMTDTGDMLSQNKPAVAKIKALLDAFKDLQHFIKPLLGSGEENEKDELFYGVFHLIWDELDTITPLYNKVRNWLTRKPYSTEKIKLNFDSPTLLKNMANPQTSSAAIFRDKEGYYYLGILNPKHRNCLNNMPSAADDKAESIEFLNYRQGGDMGKNVQNLMVIDGETRMVHGRKETSGKFAGQNLRLENAKNEYLPADVNAIRLRQSYLTTSSTFNKDDLATFIAYYIPLVKSYYSDFVFHFKEPHEYISLPDFTDHINQQAYQLYFTSVSKAYIDQMVKEGKIFLFRIWNKDFSEYSKGTPNLHTLYWRMLFDEHNLRDVVYMLNGQGAEVFFRKASIKPENRIVHKANNAIANKNSLNEKRTSTFDYDIIKDRRYTVDKFQFHVPITINFKEPKERNINPIVLDTIRNGGFTHVIGIDRGERHLLYISLIDLQGHIVKQMTLNEIVNEYKGLTHKTNYHDLLAKREGERTTARRSWDTIENIKELKEGYLSQVVHVISKMMVEYNAIIVLEDLNKGFTRGRQKIERQVYDKFERMLMDKLNCYIDKQIEPDATGGLLHSLQLTNEYKLFSKLKQKQSGCLFYIPAWNTSKIDPVTGFVNLFDTRYETREKARLFFLRFQRISFNVDKNWFEFAFDYNDFTTKAEETRTQWTLCTHGTRIRSFRNPNKNYQWDDDEIVLTDEFKRLFEKYGIDIRGNLKEAINSQAEAQFYKDLMSLMKLLLQMRNSRINSEVDYLLSPVADEKGLFFDSREGIDGLPDNADANGAYNIARKGLWMMEQIKQSDESAKPKLSISNKEWLRYTQGME

SEQ ID NO: 89 - protein, 1263 aa, unidentified
  REGION 1..1263: note = Description of Unknown:uncultivated organism sequence
  REGION 1..1263: note = Category: MG13 effectors
  REGION 1..1263: note = Description: MG13-55 effector
MRKFNEFVGLYPISKTLRFELKPIGKTLEYIQRNKLLEHDAVRADDYVKVKKIIDKYHKCLIDEALSGFTFETEADVRSNNSLSEYYLYYNLKKRNEQEQKTFKTIQNNLRKQIVNKLTQSEKYKRIDKKELITTDLPDFLTNESEKELVEKFKNFTTYFTEFHKNRKNMYSKEEKSTAIAFRLINENLPKFVDNISAFEKVASSPLAEKINALYEDFKEYLNVEEISRVFRLDYYNELLTQKQIDLYNAIVGGRTEEDNRIQIKGLNQYINEYNQQQTDRSNRLPKLKPLYKQILSDRESVSWLPPKFDSDKDLLIKIKECYDALSEREKVFDKLESILKSLSTYDLSKIYISNDSQLSYISQKMFGRWDIIIGKAIREDCAKRNPQKSRESLEKFAERIDKKLKAIDSISIGDVDECLAQLGETYVKRVEDYFAAMGESEIDDEQTDTTSFKKNIEGAYESVKELLNNADNITDNNLMQDKGNVEKIKTLLDAIKDLQRFIKPLLGKGDEADKDGVFYGEFTSLWTKLDQVTPLYNMVRNYLTSKPYSTKKIKLNFENSSLMKGWDLNKEPDNTTVIFRKDGLYYLGIMGKKYNRVFVDREDLPHDGECYDKMEYKLLPGANKMLPKVFFSETGIQRFRPSEELLGKYERGTHKKGAGFDLGDCRALIDFFKKSIERHDDWKKFDFKFSDTSTYQDISEFYREVEQQGYKMSFRKVSVDYIKSLVEEGKLYLFQIYNKDFSAHSKGTPNMHTLYWKMLFDEENLKDVVYKLNGEAEVFFRKSSITVQSPTHPANSPIKNKNKDNQKKESEFKYDLIKDRRYTVDKFLFHVPITMNFKSVGVSNINQLVKRHIRSATDLHIIGIDRGERHLLYLTVIDSRGNIKEQFSLNEIVNEYNGNTYRTDYHELLDTREGERTEARRNWQTIQNIRKLKEGYLSQVIHKISELAIKYNAVIVLEDLNFGFMRSRQKVEKQVYQKFEKMLIDKLNYLVDKKKPVAETGGLLRAYQLTGEFESFKTLGKQSGILFYVPAWNTSKIDPVTGFVNLFDTHYENIEKAKGFFDKFKSIRYNSDKDWFEFVVDDYTRFSPKAEGTRRDWTICTQGKRIQIYRNHQRNNEWEGREIDLTKAFKEHFEAYGVDISKDLREQINTQNKKEFFEELLRLLRLTLQMRNSMPSSDIDYLISPVADDTGCFFDSRKQAELKENAVLPMNADANGAYNIARKGLLAIRKMKQEENDSAKISLAISNKEWLKFAQTKPYLED

SEQ ID NO: 90 - protein, 1249 aa, unidentified
  REGION 1..1249: note = Description of Unknown:uncultivated organism sequence
  REGION 1..1249: note = Category: MG13 effectors
  REGION 1..1249: note = Description: MG13-56 effector
MKNFESFTNLYPLSKTLRFELRPIGRTLENIQANGLLEQDNHRAESYKLVKAIIDRYHKVFIDEALSHCVLPVENSGNKNSLSEVYQYLTTKDHSEKETDDFNKTQDNLRKMIVSALKKDTHFGRIFKKELIREDLLNNDLQGFDLNEEEYDLIKEFRDFTTYFVGFNENRANMYSEEAKSTAIGYRLIHENLPKFIDNMVIFQKVKVSPVSEYFANIETEMEDMLQGIKVEDIFDLNFFNQVLVQRFIDLYNAVIGGQVASEEDHRKGLNQYINEYNHVQKDKKDRLPKFKPLFKQILSDRIHASWQIDNFESDNEVLKAIENAYETLDEEVISRKDSNLPLLFASISDFDLSGIYVSAKAITDFSQQIFKDWNAIDSALEAACRRSNQPKKKETEEKYAERIKKQRSHIDSYSVGEIIESLVAFQPNPEKSILDYLGGMGRREDKPSIIESIKSAYRDVEELLKTEYPANKNLALDKDNISKVKALLDAIKELQFFIKPLLGTGKESGKDERFYGEFVDYWQTLDIITPLYNKVRNYATRKPYSTAKFKLNFENSTLLNGWDVNKEPDNTSVLLRKDGLYYLAIMKKSCNRVFAVDQYDTVGDCYEKIDYKLLPGANKMLPKVFFAKSRIDEFAPSREVLDIYKRGSFKKGEEFCKADLHTLIDFYKASITKHEDWKKFGFEFSPTSSYDDISGFYREVEQQGYQIRFRKVSCTYIDSLVDQGQIYLFQIYNKDFSPFSKGTPNMHTLYWKMIFDERNLKDVVYKLNGQAEIFFRKSSLPVETPTHPANQPIANKNPLNRKKESLFTYDIVKNRRYRYDKIQFHVPITMNFKSIDSEYINDQVQDYIRQSKDLHFIGIDRGERHLLYLTVIDSKGIIEEQFSLNVINNEYNGTTYSTNYHDLLEERGDDRTKARREWLAIESIKELKEGYLSQVVKKITDLMIKYNAIVVLEDLNMGFKRGRQKVESSAYQQFEHKLIDKLNYLAGKTAPIDKVGGLLKAYQLATPYQNEMGFQNGFVFYIPAWNTSKIDPVTGFTNLFDLHIETMEQAKKFFSKFDYIRWNAANNWFEFAFDYKNFTEKADGSRTQWTLCTQGTRIRTFRNPEKNSEWDNVEVDLTDLFLSLFKSKNIDIKSDLKTQILAQNEKDFFMSLLLCLKLTLQMRNSISNSEVDYLISPVADANGDFFDSRKVDSSLPANADANGAYNIARKGLWMALRIKKSRPEDKVSLKITNKEWLNFAQNKPYLTD

SEQ ID NO: 91 - protein, 1235 aa, unidentified
  REGION 1..1235: note = Description of Unknown:uncultivated organism sequence
  REGION 1..1235: note = Category: MG13 effectors
  REGION 1..1235: note = Description: MG13-57 effector
MKAFTNFYSLPKTLKFELKPIGKTLEFINTNGLLAQDEHRADNYIKVKKIIDDYHKAFIENSLRNLKLKYEDIEAYYSYYIIKNREENQKKAFVNIQTSLRKQIASRFKDNDLSRLFGKELIKEDLINFVKTNDDRILIEEFKNFTTYFTGFHENRKNMYSEEEKSTSIAYRLINENLPKFIDNISTFEKVRNTSIENDFNTIYSELEEYLNVVSIEEIFNLNYFTEVLTQTQIDVYNAIIGGKSFDDGRKIKGLNEYINLYNQTQKDKTKRLPKLKVLFKQILSDRNAISYIPEEFKNDNEVLNSIEKVYQDLNQEVFNKKKEGEYSLKELLLHIKEFELDKIYLRNDLSLTDISKKHLGDWGIINKAIANQYIKENPKKTKDKQEKYDEKIKKYLNSFDSFSIQFINDCLEDKTKKVEDYFIQCKNKDDKNLFEQIEIYYNGIKDLLNTDYPENKQLSQDKESVEKIKLFLDSIKELQWFIKPFLEKGEVAEKDEKFYGEFSSMWKLLDDSITPLYNKVRNYMTKKPYSQEKIKLNFENSTLLDGWDVNKESDNASIILRKDGLYYLGIMNKKHNRIFDNKNIKTNGVCYEKMDYKLLPGANKMLPKVFFSKSRIDEFSPSEKLLENYKNDTHKKGDTFNINDCRDLIDFYKSSIQKHEDWKKFNFKFSDTKTYNDLSGFYREVEQQGYKITFRNVSEEYINTLVEEGKLYLFQIYNKDFSPNSKGTPNMHTLYWKMLFDEENLKNVVYKLNGQAEVFFRKSSIKDENKIIHKANSPILNKNEKNHKKESLFDYDLIKDKRYTIDKFQFHVPITINFKAIGSENINPNVNQYIKENKVKHIIGIDRGERHLLYLSLIDLKGNIIKQFSLNEIRNEYKGETYKTNYHDLLNKKEVDRDEARKNWQTIENIKELKEGYLSQVIHKISQLMVEYNAIVVLEDLNFGFMRGRQKVEKQVYQKFEKMLIDKLNYLVDKKKDPQEEGGLLNAYQLTSKFESFQKLGKQSGFLFYVPAWNTSKIDPTTGFVNLFDTRYENIDKSIEFFGKFSSIEYNKAKDYFEFEFDYSKYTTKADGTKTSWTICTNSTRIETFRNTEKNSQWDSKEIVLSQAFKDLFDKYKINYSSNLKASILSQDKKEFFEELLHLLKLTLQMRNSKTGTDIDYLISPVANNKGVFYDSRVVNDTLPKDADANGAYNIARKGLWVIDQIKKTEDLKNLKLAISNKEWLSYVQSLVEK

SEQ ID NO: 92 - protein, 1272 aa, unidentified
  REGION 1..1272: note = Description of Unknown:uncultivated organism sequence
  REGION 1..1272: note = Category: MG13 effectors
  REGION 1..1272: note = Description: MG13-58 effector
MKQFTNLYPVSKTLRFELQPIGKTKEHIEKTGILQRDEKRAEDYKIVKGFIDDYHKQFIKDRLWSFKLPLHSEGHLDSLEEYQALYEMSKRNDVQEAEFTEIKDNLRSIIAKRLTESGSAYERIFKKELIREDLIDFLESNEDKDIVRQFADFTTYFSGFHENRRNMYVAEEKSTAIAYRLIHQNLPKFMDNMKAFAKIAGTSVAEHFTDIYEGWKEYLNVGSIEEIFRLDYFSETLTQTHIEVYNYIIGKKILEDGTEIKGINEYVNLYNQQQKDKSKRLPFLVPLYKQILSDRDKLSWLAEEFDSDEKMLAAINESYNHLHDLLMGNENESLRSLLLHIKDFDLSQINITNDLSLTDISQHLFGRYDVFTNGIKDELRNITPRKRKEGEEDFEDRISKIFKTQKSFSIDFLDKLPQPVMDDGKLRSIEDYFITLGAVNTETTQKENLFAQIENAYEDARTILQLKDTGDSLSQNKSAVAKIKALLDALKDLQHFIKPLLGSGEENEKDELFYGSFQMMWDELDTVTPLYNKVRNWLTRKPFSTEKIKLNFESPTLLKNMAVPQTSSAAIFRDRQGYYYLGILDSNSRNCINELLSVSADPSGFDFMQYHQGGDMGKNVQNLMVINGEVCKKNGRKERSGQFVGQNLILEKLKNEYLPKDVNEIRLKQSYLTSSSTFSKKDLVRFVEYYIPLVKAYYSEYSFVFKTPSEYKSFADFTDHINQQAYQLSFTPISKDSIDNLVEEGRLYLFRIWNKDFSKFSKGTPNLHTLYWQMLFDERNLQNVVYMLNGQGAEVFYRKASIKPENRIIHKANQPIANKNELNTKRTSTFEYDIIKDKRYTVDKFQFHVPITINFKAAGQTNINPIVQEAIKQGEFSHIIGIDRGERHLLYLSLTDLKGNIVKQMTLNDIVNEYKGQTYKTNYHDLLAKREGDRTDARRSWEAIETIKELKEGYLSQVVHIISKMMIEYNAIIVLEDLNTGFMRGRQKMERQVYEKFERMLIDKLNCYIDKQLSPTDEGGLLHPLQLTCDAQKWKRSHQCGCLFYIPAWNTSKIDPVTGFVNLLDTHYDTREKARVFFSKFQRISFNVPKGWFEFAFDYNDFTTKAEGTRTQWTLCTQGERIRTFRNPQKNNQWDDERIVLTDAFKQLFDKYDIDINGNIKEAISEQTDAQFFKDLLGLMKLLLQMRNSITNSEEDYLLSPVADDAGHFFDSREGISSLPIDADANGAYNIARKGLWIVRKIKETPNGEKTTLSISNKEWLQFAQTKPYIND

SEQ ID NO: 93 - protein, 1252 aa, unidentified
  REGION 1..1252: note = Description of Unknown:uncultivated organism sequence
  REGION 1..1252: note = Category: MG13 effectors
  REGION 1..1252: note = Description: MG13-59 effector
MNTFDQFTNLYNVQKTLCFELQPLGKTKDYIEKNGILMRDEKRAEDYKVVKRIIDEYHKKFIKDRLWSFKLPLNSEGRHNSLEEYQTLYEMSKRDESQESAFTEVKDNLRTIIAKRLTESGTKYDTIFKKELIREDLIDSLVDEEEKELVRQFADFTTYFTGFHENRKNMYSAEEKSTAIAYRLIHQNLPKFMDNMKAFAKIAETSVAEHFADIYEGSKEMLNVGSIEEIFRLDYFSETMTQPHIEVYNSIIGKRVLEDGTEIKGINEYVNLYNQQQKEKSQRLPLLVPLYKQILSDREKLSWLAEEFDCDEKMLAAVNETYARLHDLLMGNENESLRSLLLHLGDYDLEQINIANDLSLTDISQHLFGRYDVFTNGIREELRVITPRKRKETDEQLEDRISKIFKTQKSFSIAFLNSLPQPAMEDGKPRNIEGYFMALGAVNTETTQKENLFAQIENAYENAKSVLQMKETGDMLSQNKPAVAKIKALLDALKDLQHFIKPLLGSGEENEKDELFYGSFQMMWDELDAVTPLYNKVRNWLTRKPYSTEKIKLNFDNAQLLGGWDVNKEPDCTGVLLRKDGFYYLGIMDKKSNRVFEPEATPNDGDCFDKIDYKLLPGPNKMLPKVFFSKSRIDEFAPSEAIVSGYKRGTHKKGADFSLSDCHRLIDFFKQSINKHEDWKKFGFRFSDTSTYEDISGFYREVERQGYMLSSHRVSASYVERLVDEGKLYLFRIWNKDFSEYSKGTPNLHTLYWKMLFDERNLADVVYKLNGQAEVFYRKSSIQPEHRIVHPAGKPIANKNELNAKRTSTFEYDIVKDRRYTVDKFQFHVPITINFKATGQENINPVVQDTIRKGGFTHIIGIDRGERHLLYLSLIDLQGNIVMQMTLNEIINEYNGLKHKTNYHDLLAKREGERTEARRSWDTIENIKEMKEGYLSQVVHIISKMMVEYNAIVVLEDLNTGFMRSRQKIERQVYEKFEKMLIDKLNCYIDKQTDPTSEGGLLHPLQLACEAKKWKRSHQCGCLFYIPAWNTSKIDPVTGFVNLFDTRYENAAKAKAFFGKFGSIRYNANKDWFEFAFNYKDFTTKAEGTRTQWTLCTYRERIRTFRNPQKNHQWDDEEIVLTDAFKQLFDKYDIDMKGNLKEAICAQNDAQFFKDMMELMKLLLQMRNSITNSETDYLLSPVADEKGQFFDSRRGITTLPDNADANGAYNIARKGLWVIRKIQETAENEKPSLAITNKEWLQFAQTKPYLKD

SEQ ID NO: 94 - protein, 1240 aa, unidentified
  REGION 1..1240: note = Description of Unknown:uncultivated organism sequence
  REGION 1..1240: note = Category: MG13 effectors
  REGION 1..1240: note = Description: MG13-60 effector
MKQFTNLYPVSKTLRFELIPDKRTKEYLEQSDLISKDEKRSENYKIVKKIIDRYHKQFIDEVLSTTKLQYAKEGKLNSLEEFYFLYTNSNKTDADKKALDKVKEQLRKQIADALKKDNRFKRIDKKELIREDILKVATQEERPLIDEFRDFTTYFTGFHENRKNMYSPEAQSTAIAYRLIHENLPKFVDNIATFQKILHSPIAENLPVLYKEMEEFLNVNSIEEMFMLDYYSDVLTQPQIEVYNAIIGGRTLEDGTKIQGLNEYVNLYNQRQTLRENRLPKLKPLFKQILSDKEAVSWLPEEFESDQQLLKSVREFYASFKDNVMQQLKELLLNLPNYNLDKIYIPNDLALTDISQSLYGDWSVIKNRINEDFRNEYPQKKKETAEKYEERITKLVKSMDSFSIGYLNSCLTSQVKNICSHFTSLGAVNTDKKQKENIFIQIENAYIDVCDLLEKEYPQNKNLAQDKVHVNNLKAFLDAIKTLQHFIKPFLNTENEAEKDERFYGDITVLGEELNSITPLYNKVRNRMTRKPYSIAKFKLNFENSTLLDGWDVNKERDNSCVILRKDGFYYLAIMRKDSNRIFADAPKVENNADAYEKMEYKLLPGANKMLPKVFFSKSRIDEFQPSSLLLEHYEKGTHKKGDSFSLKDCHELIDFFKASINKHEDWKNFNFKFSPTETYEDLSGFYREVEQMGYKISFKNIPVSYINVMVSEGKLFLFQIYNKDFSQYSKGTPNLHTLYWKMIFDEQNLANVIYKLNGQAEVFYRKKSLNIVKATHPANQAIINKNPFNKKEKSTFKYDLIKDKRFTVDKFQFHVPITINFKAIGMGNINPLVNQFIKNTSDLHIIGIDRGERHLLYVTVIDSKGNIKEQFSMNQIVNEHKGNTYKTDYHDLLDKREEERLKERQSWSTIEGIKELKQGYLSQVIHKIVTLMVKYNAIVVLEDLNMGFKRGRQKVESSVYQQFEKALIEKLNYLVDKQQNPHEYGGLLKGFQLTNKFTSFRDMGRQNGFLFYIPAWNTSKMDPVTGFVNLLHPKYESVEKARSFICKFKSIRFNEKKGWYEFTFDYNDFTAKAEGTRTEWTLCTYSTRIETFRNKEKNSSWDSREVNLTEEFNKLFSQYGISDDENLKEAIAKQTEKHFFETLMHLLNLTLQMRNSKTGTEIDYLISPVTNEEGYFYDSRNCGSSLPENADANGAYNIARKGLWITRQIQSSENFEKVDITMSNKEWLNFAQTKPYLND

SEQ ID NO: 95 - protein, 1252 aa, unidentified
  REGION 1..1252: note = Description of Unknown:uncultivated organism sequence
  REGION 1..1252: note = Category: MG13 effectors
  REGION 1..1252: note = Description: MG13-61 effector
MKDLKQFTNLYPVSKTLRFELQPIGKTKENIEKNGILARDEQRAKDYMLVKGFIDEYHKQYIKDRLWSFKIPMNDEGHLDSLEEYQMFYEMSKRDDTQEASFTEVKDNLRGIIVNRLTENGSPYERIFKKELIREDLIDFLEDDESREIVRQFADFTTYFSGFHENRRNMYSAEEKSTAIAYRLIHQNLPKFMDNMKAFAKIAETSVAEHFPDIYEGWKEYLNVGSIEEIFRLDYFSETLTQPHIEVYNYIIGKKVLEDGTEIKGINEYVNLYNQQQKDKSKRLPFLVPLYKQILSDREKLSWLAEEFDSDDKMLSAINELYNHLHDLLMGKENESLRLLLSHLKDYNLEQINIANDLSLTDISQQLFGRYDVFTNGIKEELRAITPRKKKESDEEFEDRISKIFKTQKSFSIALLDKLPQPVMEDAKPRRVEDYFMSLGAVNTEKTQKENLFAQIENAYEDVRSILQMKDTSNMLSQNKVAVAKIKTLLDALKDLQHFIKPLLGSSEENEKDELFYGSFQMMWDELDTLTPLYNKVRNWLTRKPYSTEKIKLNFDNAQLLGGWDVNKEPDCTGVLLKKDGLYYLGIMDKKSNRIFDADVTPADGDCYDKIDYKLLPGANKMLPKVFFSKSRIDEFAPSEAIIDKYKRGTHKKGKDFSLTDCHRLIDFFKSSISKHEDWSKFGFRFSDTKTYEDISGFYREVEQQGYMLSSHPVSASYIHQLVDEGKLYLFRIWNKDFSEYSKGTPNLHTLYWKMLFDERNLADVVYKLNGQAEVFYRKASIKAENRIIHPAKHPIANKNVLNENRTSTFEYDIIKDRRYTVDKFQFHVPITIGFKAAGQTNINPVVQETIRSGGFSHIIGIDRGERHLLYFSLIDLKGNIVKQMTLNDIVNEYKGVTYKTNYHDLLAKREGERTDARRSWDTIETIKELKEGYLSQVVHIISKMMVEYNAIIVLEDLNTGFMRGRQKIERQVYEKFERMLIDKLNCYIDKQANPSENGGLLHPLQLTCDAQKWKRSHQCGCLFYIPAWNTSKIDPVTGFVNLFDTRYDTREKARLFFSKFQRISYNAKKDWFEFAFDYNDFTTKAEGTRTEWTLCTYGERIRTFRNPEKNHQWDDERIMLTEEFKQLFDRYDIDIHGNLKEAISAQSDAQFFKELLSLMKLLLQMRNSITNSEEDYLLSPVADENGHFYDSREDNISLPNNADANGAYNIARKGLWLIEQIKHADELSKLKLAISNKEWLQFAQTKPYLND

SEQ ID NO: 96 - protein, 1249 aa, unidentified
  REGION 1..1249: note = Description of Unknown:uncultivated organism sequence
  REGION 1..1249: note = Category: MG13 effectors
  REGION 1..1249: note = Description: MG13-62 effector
MKQFINQYQVAKTLRFDLQPIGKTKDNIEKTSILARDEQRAKDYVIVKGFIDDYHMQFIKDRLWSFKIPLKSEGHLDSLEEYQMLYGLSKRDEAQETAFTEVKDNLRSIIAKRLTGNGSAYDRIFKKELIREDLVDFLEKEEDKEIVRQFADFTTYFTGFHENRRNMYSAEEKSTAIAYRLIHQNLPKFMHNLKAFAKIAETPVAEHFADIYKGWEEHLNVGSIEEIFQLDYFSETLTQPHIEVYNYIIGKKILEDGTEIKGINEYVNLYNQQQKDKSKRLPFLVPLYKQILSDREKLSWMAEEFDSDDKMLSAINESYSHLHDLLMGEENDSLRSLLLHIKDFNLEQINITNDLSLTDISQHLFNRYDVFTNGIKDELRTITPRKKKETDEIFEDRISKIFKTQKSFSIAFLDKLPQPVMEDGKPRRVEEYFLSLGAVNTETTQKENLFARIEHAYEDAQSILQMKDTIDTLSQNKPAVAKIKALLDALKDLQHFIKPLLGSGEENEKDELFYGSFQMMWDELDTVTPLYNKVRNWLTRKPYSTEKIKLNFDNAQLLAGWDVNKEADCTGVLLQRDGFYYLGIMNKKTNRIFDADVTPSHGECYDKIDYKLLPGANKMLPKVFFSKSRIDEFAPSDAIINSYKRGTHKKGTDFSLSDCHRLIDFFKASIRKHEDWSKFGFHFSDTKIYDDISGFYREVEQQGYKLASHPVSVSYVHQLVEEGKLYLFRIWNKDFSQFSKGTPNLHTLYWKMLFDPRNLEDVVYKLNGQAEVFYRKASIKPENRIIHPAHRPITNKNEFNEKRTSTFEYDIIKDRRYTVDKFQFHVPITINFKATGQTNINPIVQEAIRRRGFTHIIGIDRGERHLLYLSMIDLKGNIVKQMTLNDIINEYNGITYRTNYHDLLAKREGERTDARRSWDTIENIKELKEGYLSQVVHIISKMMVEYNAIVVLEDLNTEFMRGRQKIERQVYEKFEKMLIETLNCYIDKHADPLEGGGLLHPLQLTCDVKKWKRSHQCGCLFYIPAWNTSKIDPVTGFVNLFDTRYDTREKARLFFSKFQRISYNSEKDWFEFTFDYSNFTSKAEGTRTKWTLCTYGERIRTFRNPKKNHQWDDEQIVLTKDFKQLFDKYGIDIHGNLKEAISTQSDSQFFRDMLGLMKLLLQMRNSITNSEVDYLLSPVADEAGHFFDSREEIESLPNNADANGAFNIARKGLWVIRKIQETAENDKISLAISNKEWLQFAQTKPYLND

SEQ ID NO: 97 - protein, 1249 aa, unidentified
  REGION 1..1249: note = Description of Unknown:uncultivated organism sequence
  REGION 1..1249: note = Category: MG13 effectors
  REGION 1..1249: note = Description: MG13-63 effector
MKEFTNLYPVSKTLRFELQPIGMTKENIEKNGILQRDEKRAEDYKIVKGFIDEYHKQFIKERLWSFKLPLNCEGHLNSLEEYQALYELPKRNDAQEAEFTEIKDNLRSIIAKRLTESGSAYERIFKKELIREDLIDFLESNEDKEIVRQFADFTTYFSGFHENRRNMYVAEEKSTAIAYRLIHQNLPKFMDNMKAFAKIAETPVAEHFDDIYEGWKEFLNVGSIDEIFRLDYFTETLTQPHIEVYNYIIGKKILEDGTEIKGINEYVNLYNQQQKDKSKRLPFLVPLYKQILSDREKLSWLGEEFDSDEKMLAAINESYTHLHDLLMGDENESLRALLLHIKDFDLTKINITNDLSLTDISQHLFGRYDVFTNGIKDELRNITPRKRKESDEELEDRISKIFKTQKSFSIDFLDKLPQPVMDDEKPRSIEDYFMTLGAVNTETTQKVNLFAQIENAYEDARTILQLTDTGDTLSQNKSAVAKIKALLDALKDLQHFIKPLLGSGEENEKDELFYGSFQMMWDELDTVTPLYNKVRNWLTRKPFSTEKIKLNFDNSQLLGGWDVNKEPDCTGVILRKEGFYYLGIMDKKSNHIFEADITPSVGECYDKIDYKLLPGANKMLPKVFFSKSRIDEFAPSEAIISSYKRGTHKKGADFNLVECHRLIDFLKQSINKHEDWSKFNFHFSDTKSYEDISGFYREVEQQGYMLSSHPVSSSYINQLVDEGKLYLFRIWSKDFSEFSKGTPNLHTLYWKMLFDERNLADVVYKLNGQAEVFYRKASIKPENRIIHKANHSIANKNELNSKRTSTFEYDIIKDRRYTVDKFEFHVPITINFKAAGQTNINPIVQDVIRQGGFSHIIGIDRGERHLLYLSLIDQKGNIIKQMTLNEIINEYKGQTYKTNYHDLLAKREGDRTDARRSWETIETIKELKEGYLSQVVHIISKMMVEYNAIVVLEDLNTGFMRGRQKIERQVYEKFEKMLIEKLNCYIDKHEAPSENTGLLHPLQLTCDAQKWKRSHQCGCLFYIPAWNTSKIDPVTGFTNLLDTRYDTREKARVFFSKFQRISYNAEKGWFEFALDYNDFTAKAEGTRTQWTLCTYGERIRTFRNPKKNHQWDDERIVLTDAFKQLFDTYDIDINGNLKETISAQTDAQFFKELLGLMKLLLQMRNSITNSEEDFLLSPVADDAGHFFDSREGNSSLPIDADANGAYNIARKGLWVIRKIQETANEEKPSLSITNKEWLHFAQTKPYLKD

SEQ ID NO: 98 - protein, 1252 aa, unidentified
  REGION 1..1252: note = Description of Unknown:uncultivated organism sequence
  REGION 1..1252: note = Category: MG13 effectors
  REGION 1..1252: note = Description: MG13-64 effector
MNNLKQFTGLYPVNKTLRFELKPVGKTKENIENKGVLERDSQRAVDYKVVKGFIDEYHKQFIKDRLWSFKLPLFSEGRLDSLEEYMALYELSKRDEAQEAEFSEVKDNLRSIIAKRLTESGSAYERIFKKELIREDLIAFLEKDEDKEIVRQFADFTTYFGGFHENRKNMYSAEEKSTAIAYRLIHQNLPKFMDNMKAFAKIAETSVAEHFADIYMGWKEYLNVGSIEEIFCLDYFSETLTQPHIEVYNYIIGKKILEDGTEIKGINEYVNLYNQQQKDKSKRLPFLVPLYKQILSDREKLSWLTEEFDSDEKMLAAINESYEHLYDLLMGNENESLRSLLIHLKDFNLAQINITNDLSLTDISQHLFSRYDVFTNGIKDKLRIITPRKKKENDEDFEDRISKIFKTQKSFSIDFLDKLPQPVMDDGKPRSVEDYFMSLGTVNTETTQKENLFAKIENAYEDVRPILQMKDTGDALSQNKPAVAKIKSLLDALKDLQHFIKPLLGSGEENGKDELFYGSFQIMWDELDTVTPLYNKVRNWLTRKPYSTEKIKLNFDNAQLLGGWDVNKEPDCTGILLRKDGQYYLGIMDKKSNRIFEADVTPADGDCYDKIDYKLLPGANKMLPKVFFSKSRIDEFAPSEAIVSSYKKGTHKKGAYFNLLECHRLIDFFKQSINKHEDWSKFGFRFSDTETYEDISGFYREVEQQGYMLSSHPVSSLYINQLVDEGKLYLFRIWNKDFSEFSKGTPNLHTLYWKMLFDERNLADVVYKLNGQAEVFYRKASIKPENRVVHQANKPIDNKNGLNKKRTSTFEYDIIKDKRYTVDKFQFHVPITINFKATGQNNINPVVQETIRQGGFSHIIGIDRGERHLLYLSLIDLKGNIVKQMTLNDIVNEYKGQTYKTNYHDLLAKREGERTDARRSWETIETIKELKEGFLSQVVHIISKMMVEYNAIVVLEDLNTGFMRGRQKIERQVYEKFEKMLIEKLNCYIDKHAAPTEDTGLLHPLQLTCDAQKWKRSHQCGCLFYIPAWNTSKIDPVTGFVNLLDTRYDTREKARVFFSKFQRISFNSEKGWFEFVLDYNDFTTKAEGTRTQWTLCTYGERIRTFRNPQKNHQWDDERIMLTEAFKQLFDKYDIEINGNLKEAISAQSDAQFFKGLLSLMKLLLQMRNSITNSEEDFLLSPVSDESGHFFDSREGISCLPIDADANGAYNIARKGLWVIRKIQAVQDGEKLSLAITNKEWLQFAQTKPYLKE

SEQ ID NO: 99 - protein, 1249 aa, unidentified
  REGION 1..1249: note = Description of Unknown:uncultivated organism sequence
  REGION 1..1249: note = Category: MG13 effectors
  REGION 1..1249: note = Description: MG13-65 effector
MKNFESFTNLYPLSKTLRFELRPIGRTLENIQANGLLEQDNHRAESYKLVKAIIDRYHKVFIDEALSHCVLPVENSGNKNSLSEVYQYLTTKDHSEKETDDFNKTQDNLRKMIVSALKKDTHFGRIFKKELIREDLLNNDLQGFDLNEEEYDLIKEFRDFTTYFVGFNENRANMYSEEAKSTAIGYRLIHENLPKFIDNMVIFQKVKVSPVSEYFANIETEMEDMLQGIKVEDIFDLNFFNQVLVQRFIDLYNAVIGGQVASEEDHRKGLNQYINEYNQVQKDKKDRLPKFKPLFKQILSDRIHASWQIDNFESDNEVLKAIENAYETLDEEVISRKDSNLPLLFASISDFDLSGIYVSAKAITDFSQQIFKDWNAIDSALEAACRRSNQPKKKETEEKYAERIKKQRSHIDSYSVGEIIESLVAFQPNPEKSILDYLGGMGRREDKPSIIESIKSAYRDVEELLKTEYPANKNLALDKDNISKVKALLDAIKELQFFIKPLLGTGKESGKDERFYGEFVDYWQTLDIITPLYNKVRNYATRKPYSTAKFKLNFENSTLLNGWDVNKEPDNTSVLLRKDGLYYLAIMKKSCNRVFAVDQYDTVGDCYEKIDYKLLPGANKMLPKVFFAKSRIDEFAPSREVLDIYKRGSFKKGEEFCKADLHTLIDFYKASITKHEDWKKFGFEFSPTSSYDDISGFYREVEQQGYQIRFRKVSCTYIDSLVDQGQIYLFQIYNKDFSPFSKGTPNMHTLYWKMIFDERNLKDVVYKLNGQAEIFFRKSSLPVETPTHPANQPIANKNPLNRKKESLFTYDIVKNRRYRYDKFQFHVPITMNFKSIGSEYINDQVQDYIRQSKDLHFIGIDRGERHLLYLTVIDSKGIIEEQFSLNVINNEYNGTTYSTNYHDLLEERGDDRTKARREWLAIESIKELKEGYLSQVVKKITDLMIKYNAIVVLEDLNMGFKRGRQKVESSAYQQFEHKLIDKLNYLAGKTAPIDKVGGLLKAYQLATPYQNEMGFQNGFVFYIPAWNTSKIDPVTGFTNLFDLHIETMEQAKKFFSKFDYIRWNAANNWFEFAFDYKNFTEKADGSRTQWTLCTQGTRIRTFRNPEKNSEWDNVEVDLTDQFLSLFKSKNIDIKSDLKTQILAQNEKDFFMSLLLCLKLTLQMRNSISNSEVDYLISPVADANGDFFDSRKVDSSLPANADANGAYNIARKGLWMARRIKKSRPEDKVSLKITNKEWLNFAQNKPYLTD

SEQ ID NO: 100 - protein, 1171 aa, unidentified
  REGION 1..1171: note = Description of Unknown:uncultivated organism sequence
  REGION 1..1171: note = Category: MG13 effectors
  REGION 1..1171: note = Description: MG13-66 effector
MIRLLNKYIEANNEKDGEGPDKVQDDLRKLIVKALKSGVSLDKDPEQEERFKSLFSEKLVKNILPNFVQTEEEKSKVAKFRDMTTYFVGFHKNRENMYSEEAQTTAISYRLIHENLPRFLDNIAVYEKVKPVLSDEIASLEEQLHQNGYVEASCIDSLFSVDFYLRVLTQRGIEQYNAVIGKIVNDESDEIKGLNERINLYNQVHKKEKLPLFKPMYKQILSDREQLSWLPETFENDASLLDAVKGFHQDLLSNDILSRIDKLLSSLQDFNLDQIWIANDVQLRGLSKDLYGDWSLIDRALGIERSEDVVQGLTAAQKKAASAAKKRSSFSIVELNAATRSSVPDEKYVPVQNYFSAMGKVCAQGEATRENFVTRICAAYQELEEYIPSIRKSLLQEKRATELIKNYLDAVNDLLRFIKPLLGRGDETDKDANFYGEFTFLTDCLFAIVPLYNEVRNYLTQKPYSTEKFKLNFRGSTLLNGWDKNKERVNLGVILRKEGKYFLAIMNKKHNTLFTEGKLQQHTGGECYQKMEYKLIPGSKMLPKVFFSKKGISTFQPSEELLLNYRIGTYKKGEKFNLEHLHKLIDFYKHSIAVHEDWSKFDFHFSDTSSYRDISGFYKEVEQQGYKLTFRNVSVSYINRLVEEGKLYLFQIYNKDFSEYSKGTPNLHTLYWKMLFDPENLKDVVYKLSGEAEVFFRKKSLDVSHPTHPKNEPIEKKNKNNKGEKSLFSYDLIKDRRFTVDKFQFHVPITMNFKGEQGDRVNQMVQSYVRNNKGLNVIGIDRGERNLLYLVVINEHGEILEQFSLNEIRNAYNGKEHKIDYHTLLEERSKKRQDARQSWQTIEGIKDLKTGYLSQVIHVITQLMVKYNAIVVLEDLNLGFKSSRQKFEQSVYQQFERKLIDKLNFLVNKKAAPNEMGGLLNAYQLTAPFESFRKMGKQNGFLFYVPAWHTSKIDPRTGFVNLLDTRYENVAKAKEFFAKFESITYNPEKKWFEFAFDYKAFGNRADGSRTKWTICSYGERIETFRNPKNNNQWDTKSVPLTERLTELFSKYGIDYTTNLKEQILNQTDKAFFVELLGALRLTLQLRNSRKSTGEDFLFSPVADENGCFFDSRKANDNEPKDADANGAYHIALKGLWALDTIRNTEEGKNPKLAITNKEWLSFAQAKPFAHE

SEQ ID NO: 101 - protein, 1275 aa, unidentified
  REGION 1..1275: note = Description of Unknown:uncultivated organism sequence
  REGION 1..1275: note = Category: MG13 effectors
  REGION 1..1275: note = Description: MG13-67 effector
MNNLNDLTGQYPVSKTIRFDLQPIGKTKENIEKGGILQQDEQRAEDYKTVKGFIDEYHKQFIKDRLWNFRLPLISEGHLDSLEEYQTLYLLAKRNDAQEAEFKEVKDNLRSIIARRLTEKGSAFERIFKKELIREDLIDFVEKPEDKDLVKSFADFTTYFTEFHKNRANMYTAEEKSTAIAYRLIHQNLPKFMDNIKAFAKIAQTSVAGHFVEIYNGSKEYLNVGSLEEVFQLDYFSDTMTQPHIEVYNSIIGKRVLEDGTEIKGINEYVNLYNQQQKDKRQRLPLLVPLYKQILSDREKLSWLAQEFDSDKKMLAAINETFIHLREILMGEDSESLRSILTHLKDFDLTQINITNDLSLTDISQHLFKRFDVFSNGIKAKIRSITPKKKKESDEELEDRVSKIFKTQKSFSIAFLDNLPQPEMEDGKRRSVADYFTALGAVNNEVTQKENLFAQIEIAYEDARDVLQMTETGDTLSQDKPAVAKIKALLDALKDLQHFIKPLRGSGEENEKDELFYGSFLMMWDELDTVTPLYNKVRNWLTRKPYSTEKIKLNFDSPTLLNGWPNPQTNSGAIFRDEEGLYYLAILDAQNRACLNELSSNVNGNEDHIEMMKYLQGGDMGKNVQNLMVIDGEVRKVNGRKETSGEFAGQNLRLENAKHQYLPKNINEIRLKQSYLTSSPTFNKKDLVSFIEYYIPLVEAYYSDYVFHFRKSSEYKSFADFTEHINQQAYQVQFKPVSKTSLYSLVEEGKLYLFRIWNKDFSEFSKGTPNLHTLYWKMLFDERNLADVVYKLNGQAEVFYRKASIKPENKIVHPANRAIANKNELNKKRTSSFDYDIIKDRRYTVDKFQFHVPITINFKATGQTNVNPIVQDTIRRGGFTHIIGIDRGERHLLYVSLIDLKGNIVKQMTLNEILNEYKGLTHKTNYHDLLAKREGERTDARRSWDTIENIKELKEGYLSQVVHIISKMMVEYNAIVVLEDLNPGFMRGRQKIERQVYEKFEKMLIEKLNCYIDKKAEPIEIGGLLHPLQLSCDIKKWKKSHQCGCLFYIPAWNTSKIDPVTGFVNLFDTHYETREKARSFFSKFQRIHFNSEKNWFEFTFDYGNFTTKAEGTRTQWTLCSYGTRIRNFRNPLKNHQWDDEEVELVDEFKHLFDKYSIDIFGNLKESICNQTDAQFYKELMGLMKLLLQMRNSRTNSEVDYLLSPVADEQGHFFDSREGIGSLPDNADANGAFNIARKGLWIIRKVQGTPSDEKMSLAISNKEWLQFAQNRPYLND

SEQ ID NO: 102 - protein, 1249 aa, unidentified
  REGION 1..1249: note = Description of Unknown:uncultivated organism sequence
  REGION 1..1249: note = Category: MG13 effectors
  REGION 1..1249: note = Description: MG13-68 effector
MKNFESFTNLYPLSKTLRFELRPIGRTLENIQANGLLEQDNHRAESYKLVKAIIDRYHKVFIDEALSHCVLPVENSGNKNSLSEVYQYLTTKDHSEKETNDFNKTQDNLRKMIVSALKKDTHFGRIFKKELIREDLLNNDLQGFDLNEEEYDLIKEFRDFTTYFVGFNENRANMYSEEAKSTAIGYRLIHENLPKFIDNMVIFQKVKVSPVSEYFANIETKMEDMLQGIKVEDIFDLNFFNQVLVQRFIDLYNAVIGGQVASEEDHRKGLNQYINEYNQVQKDKKDRLPKFKPLFKQILSDRIHASWQIDNFESDNEVLKAIENAYETLDEEVISRKDSNLPLLFASISDFDLSGIYVSAKAITDFSQQIFKDWNAIDSALEAACRRSNQPKKKETEEKYAERIKKQRSHIDSYSVGEIIESLVAFQPNPEKSILDYLGGMGRREDKPSIIESIKSAYRDVEELLKTEYPANKNLALDKDNISKVKALLDAIKELQFFIKPLLGTGKESGKDERFYGEFVDYWQTLDIITPLYNKVRNYATRKPYSTAKFKLNFENSTLLNGWDVNKEPDNTSVLLRKDGLYYLAIMKKSCNRVFAVDQYDTVGDCYEKIDYKLLPGANKMLPKVFFAKSRIDEFAPSREVLDIYKRGSFKKGEEFCKADLHTLIDFYKASITKHEDWKKFGFEFSPTSSYDDISGFYREVEQQGYQIRFRKVSCTYIDSLVDQGQIYLFQIYNKDFSPFSKGTPNMHTLYWKMIFDERNLKDVVYKLNGQAEIFFRKSSLPVETPTHPANQPIANKNPLNRKKESLFTYDIVKNRRYRYDKFQFHVPITMNFKSIGSEYINDQVQDYIRQSKDLHFIGIDRGERHLLYLTVIDSKGIIEEQFSLNVINNEYNGTTYSTNYHDLLEERGDDRTKARREWLAIESIKELKEGYLSQVVKKITDLMIKYNAIVVLEDLNMGFKRGRQKVESSAYQQFEHKLIDKLNYLAGKTAPIDKVGGLLKAYQLATPYQNEMGFQNGFVFYIPAWNTSKIDPVTGFTNLFDLHIETMEQAKKFFSKFDYIRWNAANNWFEFAFDYKNFTEKADGSRTQWTLCTQGTRIRTFRNPEKNSEWDNVEVDLTDQFLSLFKSKNIDIKSDLKTQILAQNEKDFFMSLLLCLKLTLQMRNSISNSEVDYLISPVADANGDFFDSRKVDSSLPANADANGAYNIARKGLWMARRIKKSRPEDKVSLKITNKEWLNFAQNKPYLTD

SEQ ID NO: 103 - protein, 1249 aa, unidentified
  REGION 1..1249: note = Description of Unknown:uncultivated organism sequence
  REGION 1..1249: note = Category: MG13 effectors
  REGION 1..1249: note = Description: MG13-69 effector
MKQFTNLYPVSKTLRFELQPIGKTKENIEKKGILTRDEKRAKDYQIVKGFIDEYHKQFIKDRLWNFKLPLASEGNLDSLEEYQMFYEMPRRDDAQETDFSEVKDNLRAIIANRLRESGSAYDRIFKKELIREDLVEFLSDEDDKNIVRQFADFTTYFSGFHENRRNMYSAEEKSTAIAYRLIHQNLPKFMDNMKAFTKIAKTSVAEHFADIYAGWKEYLNVGSIEEVFRLDYFSETLTQPHIEVYNYIIGKKVLEDGKEIKGINEYINLYNQQQKDKSKRLPFLVPLYKQILSDREKLSWLAEEFDSDEKMLAAIDKLYTHLHELLMGEENESLRSLLMHMKDYDLSQINITNDLSLTDISQHLFNRYDVYTNGVKEQLKGITPRKKKENDEDFEDRISKIFKTQKSFSISLLNGLPHPEIEDSQPRRIEEYFMAMGAVNTATTQRENLFSKIESAYEDARAFLQMKDTGDSLSQNKPAVAKIKALLDAFKDLQHFIKPLLGSGEELEKDELFYGSFQMIWDELDTVTPLYNKVRNWLTRKPYSTEKIKLNFDNSQLLGGWDVNKEPDCTGVLLRKDGFFYLGIMDKRYNHIFEADLPHSDDDCYDKVDYKLLPGANKMLPKVFFSKSRIDEFAPSAAIVSSYKRGTHKKGKNFDLSDCHRLIDFFKQSIQKHADWCKFGFHFSDTQTYEDISGFYREVEEQGYMLSSHQVPSSYINELVDGGKLYLFRIWNKDFSENSKGTPNLHTLYWKMLFDKRNLSDVVYKLNGQAEVFFRKASIKPENRVVHKANQSITNKNALNKKTTSTFEYDIIKDRRYTVDKFQFHVPITINFKASGQTNINPIVQETIRQGGFKHIIGLDRGERHLLYLSLIDLNGNIVKQMTLNDIVNEYNGQTYKTNYHDLLTKREGERTDARRSWDTIETIKELKEGYLSQVIHIISKMMVEYKAIVVLEDLNTGFMRGRQKIERQVYEKFEKMLIEKLNCYIDKKADATDATGLLHPLQLTCDAKKWNRSHQCGCLFYIPAWNTSKIDPVTGFVNLLDTRYETREKAHLFFSKFQRISFNQKKGWFEFAFDYADFTTKAEGTRTQWTLCTYGERIRTFRNPQKNNQWDNERIVLTDEFKRIFDEKGIDIFGNLKDAICNQRDAKFFKDLLGLMKLLLQMRNSITNSEEDYLLSPVADEKGHFFDSREGISSLPIDADANGAYNIARKGLWVIRKIQETPENERPSLSITNKEWLQFAQTKPYLKE

SEQ ID NO: 104 - protein, 1249 aa, unidentified
  REGION 1..1249: note = Description of Unknown:uncultivated organism sequence
  REGION 1..1249: note = Category: MG13 effectors
  REGION 1..1249: note = Description: MG13-70 effector
MEQFTNLYQVSKTLRFDLQPIGKTQENIEKNGILARDEQRAKDYLLVKGFIDDYHKQFIKERLWDFKLPLESEGRLDSLQEYQELYELSKRDDAQEAAFTEIKDNLRSIIAKRLTESGSAYERIFKKELIREDLVEFLEKEEAKDIVRQFADFTTYFSGFHENRRNMYSAEEKSTAIAYRLIHQNLPKFLDNMKAFAKIAETSVAKHFADIYDGWKEHLNVGSIEEIFRLDYFSETLTQTHIEVYNYIIGKKIFEDGTEIKGINEYVNLYNQQQKDKSQRLPFLVPLYKQILSDREKLSWMAEEFDSDEQMLSAINESYNHLHDLLMGDENDSLRSLLLHIKDFNLSQINITNDLSLTDISQHLFSRYDVFTNGIKDELRIITPRKKKESDEDFEDRISKIFKTQKSFSVAFLDNLPQPVMDDGKSRSVEDYFMSLGAVNTETTQKENLFAQIENAYEDARHILQMIDTGDTLSQNKPAVAKVKALLDSLKDLQHFIKPLLGSGEENEKDELFYGLFQMIWDELNTVTPLYNKVRNWLTRKPYSTEKIKLNFDNAQLLGGWDVNKEPDCTGVLLQHDGFYYLGIMNKKANHIFDADVTPSDGDCYDKIDYKLLPGANKMLPKVFFSRSRIDEFAPSETIVNSYKRGTHKKGTGFSLSDCHRLIDFFKTSISKHEDWSKFGFRFSDTKTYEDISGFYREVEQQGYMLSSHPVSTSYIHQLVEDGKLYLFRIWNKDFSEFSKGTPNMHTLYWKMLFDERNLADVVYKLNGQAEVFYRKASIKLENRIVHPSNRPIANKNELNKKRTSTFEYDIIKDRRYTVDKFQFHVPITINFKAAGQTNINPIVQDAIRRGGFKHIIGIDRGERHLLYLSLIDLKGNIVKQMTLNDIVNEYKGITYRTNYHDLLAKREGDRTEARRSWDTIETIKELKEGYLSQVIHIISKMMVEYNAIVVLEDLNTGFMRGRQKIERQVYEKFEKMLIEKLNCYIDKQADPSEITGLLHPLQLTCDAQKWKRSHQCGCLFYIPAWNTSKIDPVTGFVNLLDTRYDTREKARLFFSKFQRISFNAKKDWFEFAFDYNDFTTKAEGTRTNWTLCTYGERIRTFRNPQKNNQWDDERIVLTDAFKQLFDKYNIDIIGNIKESISAQSDTQFFKELLGLMKLLLQMRNSITNSEEDYLLSPVADQNGHFFDSRESNDSLPNNADANGAYNIARKGLWIIEQIKQTEDLSKLKLAVSNKEWLQFAQNKPYLND

SEQ ID NO: 105 - protein, 1220 aa, unidentified
  REGION 1..1220: note = Description of Unknown:uncultivated organism sequence
  REGION 1..1220: note = Category: MG13 effectors
  REGION 1..1220: note = Description: MG13-71 effector
MNTLKDFTNLYQVSKTLRFELKPVGKTLEHIQNNGILENDEHRAESYILVKKIIDEYHKHFIEDAFQGFKLDSNDLSEYYLYFQIRNREESQQKAFETVQSKLRKQISKSFDTKRLFGKELIREDLPDFVNEETDKQLVQEFKDFTTYFTGFHENRKNMYSHEDKSTAIAYRLIHENLPKFINNMTVFDKIKQPLANNLQTLYVDFKEYLNDREIAELFTLNYFSEVLAQTQIDVYNLMIGGKTLEDGTKIKGLNEYINLYNQQQTNRNARLPKFTPLFKQILSDRETISWLPEMFANDNELLESIEKVYQEIPFGEIKSIIEKLHEYDLSKIYVRNDLGITDISQHLLGNYAAIPNAIKENIKQSNPQKRTENQENYEERINKLFKSRGSFSIELINKVIPEKSLTTYFKDYNKTEENPDLLNRIQNCYLQVKNLLNTDYPADKSLKQDKQNVEKIKQLLDNIKEVQQFIKPLLGKGDEADKDAIFYAEFEKLWHKLDNITPLYNMVRNYITQKPYSTGKIKLNFENSTLLDGWDVNKERNNSSIILRKGGLYYLAIMNKKHNTVFLKENTPSTGSCYEKMEYKLLPGANKMLPKVFFSESRIDEFNPSKQLLDNYNNETHKKGEKFNLQDCRSLIDFFKQSINKHEDWENFGFQFSDTSTYQDLSGFYREVEQQGYKITFRNISEDYINQLVDEGKLYLFQVYNKDFSPFSKGTPNMHTLYWRMLFSPENLQNVVYKLNGQAEVFFRKKSLNYTDETWQKGHHYDKLKNKFAYPIISKRRYALDKFQFHVPVTMNYKAVGNERINELVNQFIKNNGIEHIIGIDRGERHLLYLSLIDLNGKIVKQFSLNEIVNEYKDNIYKINYRDLLDKKETERDDARKSWNEIETIKELKEGYLSQVIHKITQLIIEYKAIVVLEDLNFGFMRGRQKVEKQVYQKFEKMLIDKLNYLVDKKKQVADEGGLLNAYQLTNKFESFKKEGKQNGFLFYVPAWNTSKIDPVTGFVNLFSVKYESVSKAQEFFKKFDCIRFNQIDDNNCRFDFYFDYKNFTDKAEGSQTKWTLCSSNDTRYRWNKSLNQGKGAQEEVKVTEALKLLFSDKDYNIAYGDGKDLRERISNQTSAKFFKELMSLLSTLLSMRHNNGKKCDEEQDFILSPVEPFFNSLHATDEHPKDADANGAYNIARKGLWAIEQIKRANDLKNVSLAISNKQWLQFVQQSFEL

SEQ ID NO: 106 - protein, 1249 aa, unidentified
  REGION 1..1249: note = Description of Unknown:uncultivated organism sequence
  REGION 1..1249: note = Category: MG13 effectors
  REGION 1..1249: note = Description: MG13-72 effector
MEQFTNLYPLSKTLRFELIPHEKTKELLERTDYLAQDEKRAESYKIVKGIIDRYHKSFIEDVLSKPIEDQGEKRPILKYAKESTKNCDSLEEFYELYSKSQKSETEKNTLEIIQNNLRKQIVYALTQDARFKNLDKKELIYQDIYAIAKPEEIPFIKEFEGFATYFVGFHENRMNMYSSEAKSTAIGNRLINENLPIFTDNMGTFQKLLNSPVSEHFDTICKDMEDILPYDNIEEIFMLHNYNDFLTQKQITVYNAIIGGRVLEDGTKIQGINEYVNLYNQQQPTRETRLPKLKTLFKQILSDKESVSWLAEEFTSDAEMLKSIRDYYTSFKNNASQQMIDILTNIKSYDIDHIFIPNDISLTTISKKVFKDWEAINKSIIKRLKEDNPQKGREKDENYEERMSKAFKSYDSFSLGLINSCTATDDVCIYFSKIAKTDEETGLSHNLLDNIEEAYDKAKEYLNNGYPSNLNLAQDKSTVQKIKTLLDSIKDLQKFIKPLLGSGTEAVKDERFYGDISLVWEIIDQITPLYNKVRNRMTRKAYSTEKIKLNFENSTLLAGWDLNKERDNTSIILKKDGLYYLAIMRKEFNKVFQNAPRQTSDEDSFEKMEYKLLPGANKMLPKVFFSKSRIDEFAPSDVLIEKYKKGTHKKGSNFNIDDCHNLIDFFKSSIQKHDDWSKFNFKFSPTNSYEDMSGFYREVEKMGYKITFKKIPADYIEELVTTGKIFLFKIYNKDFSQYSKGTPNLHTLYWKMVFDDNNLKDVVFKLNGEAEIFYRKKSLSYKSPTHPAHQPIRNKNPYNAKEESNFAYDLIKDKRYTLDKFHFHIPITINFKSEGVSNINSLVCKYLRENDDIHFIGIDRGERHLLYVSVIDSRGRIKEQFSLNQIINEYKGNSYSTDYHKLLEERDEKRAKERQSWDSIESIKELKQGYLSQVIHKIASLVVKYNAVVVLEDLNIGFKRGRQKVESSIYQQFEKALIDKFNYLVDKNVAPEQPGGLMKGYQLTNKFSSFRDMGKQNGFLFYIPAWNTSKIDPVTGFVDMLHPKYESVEKAREFFTKFNKISYNQEKGWFEFLFDYNDFTTKAEGTRTVWTLCTFGKRIETFRNKNKNSMWDNKEIDLTSAFISLCEKYNVPLSCDMKNDIVAQTEKDFYVELIRILRLTLQMRNSITGTDVDYLISPVADENGNFYDSRNADSTLPENADANGAYNIARKGLWAAMQIRSCTDPDLKVNLAISNKEWLTFAQTKPYTK

SEQ ID NO: 107 - protein, 1249 aa, unidentified
  REGION 1..1249: note = Description of Unknown:uncultivated organism sequence
  REGION 1..1249: note = Category: MG13 effectors
  REGION 1..1249: note = Description: MG13-73 effector
MKQFTNLYPVSKTLRFELQPIGKTKENIEKNGILMRDEKRAKDYKIVKEFIDDYHKQFIKERLWDFKLPLNSEGKLNSLEEYQALYELSKRDEVQEAEFTEVKDNLRSIIAKRLTESGSAYERIFKKELIREDLVDFLENEEDKDIVRQFADFTTYFSGFHENRHNMYVAEEKSTAIAYRLIHQNLPKFMDNMKAFAKIAETSVAEHFADIYEGWKEHLNVESIEEVFRLDYFSETLTQPHIEVYNYIIGKKILEDGTEIKGINEYVNLYNQQQKDKSKRLPFLVPLYKQILSDREKLSWLAEEFDSDEKMLSAINESYSHLHDLLMSNENESLRSLLLHLKEFNLSHINIANDLSLTDISQHLFSRYDVFTNGIKDELRIITPRKKKESDEDFEERITKIFKTIKSFSIDFLDNLPQPVMEDGKRRSIENYFMTLGAVNTETTQKENLFAQIENAYEDARNILQLKDTGDTLSQNKPAVAKIKALLDALKDLQHFIKPLLGSGEENEKDELFYGSFMMMWDELDTITPLYNKVRNWLTRKPFNTEKIKLNFDNAQLLGGWDVNKEPDCTGVLLRKDGFYYLGIMNKKSNRIFESEVTPSDGECYDKIDYKLLPGANKMLPKVFFSKSRIDEFAPSEAVVSSYKRGTHKKGANFNLSECHRLIDFFKQSINKHEDWSKFGFHFSPTDTYEDISGFYREVEQQGYMLSSHPVSSSYINQLVDEGKLYLFRIWNKDFSEFSKGTPNLHTLYWKMLFDERNLADVVYKLNGQAEVFYRKASIKPENRIIHKANQPIANKNELNEKRTSTFEYDIIKDRRYTVDKFQFHVPITINFKAAGQTNINPIVQDVIRQGGFSHIIGIDRGERHLLYLSLIDLKGNIIKQMTLNEIINEYKGQTYKTNYHTLLAKREGDRTNARRSWETIETIKELKEGYLSQVVHIISKMMVEYNAIVVLEDLNTGFMRGRQKIERQVYEKFEKMLIEKLNCYIDKHADPSEDAGLLHPLQLTSDIQKWKRSHQCGCLFYIPAWNTSKIDPVTGFVNLLDTRYDTREKARVFFSKFQRISFNTQKGWFEFAFDYNDFTTKAEGTRTQWTLCTQGERIRTFRNPQKNNQWDDERIVLTDAYKQLFDKYNIDINGNIKEAISAQTDAQFFKELLGLMKLLLQMRNSITNSEEDYLLSPVADNTGHFFDSREEIYSLPIDADANGAYNIARKGLWVIRKIQETPNGEKTSLSITNKEWLQFAQTKPYLND

SEQ ID NO: 108 - protein, 1249 aa, unidentified
  REGION 1..1249: note = Description of Unknown:uncultivated organism sequence
  REGION 1..1249: note = Category: MG13 effectors
  REGION 1..1249: note = Description: MG13-74 effector
MKQFTNLYPVSKTLRFELQPIGKTKENIEKNGILLRDEKRAEDYKIVKGFIDDYHKQFIKERLWSFKLPLNSEGHLNSLEEYQALYEVSKRNEVQEAEFSEVKDNLRSIIAKRLTESGSAYERIFKKELIREDLIDFLESKEDKDIVRQFADFTTYFSGFHENRKNMYVAEEKSTAIAYRLIHQNLPKFMDNMKTFAKIAETSVAEHFSDIYEGWKEYLNVGSIEEIFRLDYFSETLTQPHIEVYNYIIGKKILEDGTEIKGINEYVNLYNQQQKDKSKRLPFLIPLYKQILSDREKLSWLVEEFDSDEIMLAAINESYNHLHDLLMGRENESLRSLLLHIKDFDLSQISITNDLSLTDISQHLFSRYDVFTNGIKDELRIITPRKKKESDEDFEDRISKIFKTQKSFSIDFLDKLPQPVMEDGKTRSIEDYFMTLGAVNTETTQKENLFAQIENAYEDARFVLQLKDTGDTLSQNKSAVAKIKALLDALKDLQHFIKPLLGSGEENEKDDLFYGSFQMMWDELDTITPLYNKVRNWLTRKPFSTEKIKLNFDNSQLLGGWDVNKEPDCTGVLLRKDGLFYLGIMDKKSNHIFETDVIPTDGECFDKIDYKLLPGANKMLPKVFFSKSRIDEFAPSESIITSYKRGTHKKGVGFNLAECHRLIDFFKQSINKHEDWSKFGFHFSDTKTYEDISGFYREVEQQGYMLSSRPVSSSYIDTLVSEGKLYLFRIWNKDFSEFSKGTPNLHTLYWKMLFDERNLSDVVYKLNGQAEVFYRKASIKPENRIVHKANQPVANKNELNTKIASTFEYDIIKDKRYTVDKFQFHVPITINFKAAGQTNINTIVQDAIRQEEFSHIIGIDRGERHLLYLSLIDLKGNIVKQMTLNEIINEYKGQTYKTNYHDLLAKREGDRTNARRSWETIETIKELKEGYLSQVVHIISKMMVEYNAIVVLEDLNTGFMRGRQKIERQVYEKFEKMLIEKLNCYIDKQVSPTAKGGLLNPLQLTCDAQKWKRSHQCGCLFYIPAWNTSKIDPVTGFVNLLDTHYDTREKARVFFSKFQRISYNAQKGWFEFAFDYNDFTSKAEGTRTQWTLCTQGERIRTFRNPQKNHQWDDERIALTDAYKQLFDKYDIDINGNIKEAISAQTDAQFFKELMGLMKLLLQMRNSITNSEEDYLLSPVADDAGHFFDSREGISNLPIDADANGAYNIARKGLWIIRKIQETPSGERISLSITNKEWLQFAQTKPYFND

SEQ ID NO: 109 - protein, 1249 aa, unidentified
  REGION 1..1249: note = Description of Unknown:uncultivated organism sequence
  REGION 1..1249: note = Category: MG13 effectors
  REGION 1..1249: note = Description: MG13-75 effector
MKNFESFTNLYPLSKTLRFELRPIGRTLENIQANGLLEQDNHRAESYKLVKAIIDRYHKVFIDEALSHCVLPVENSGNKNSLSEVYQYLTTKDHSEKETDDFNKTQDNLRKMIVSALKKDTHFGRIFKKELIREDLLNNDLQGFDLNEEEYDLIKEFRDFTTYFVGFNENRANMYSEEAKSTAIGYRLIHENLPKFIDNMVIFQKVKVSPVSEYFANIETEMEDMLQGIKVEDIFDLNFFNQVLVQRFIDLYNAVIGGQVASEEDHRKGLNQYINEYNQVQKDKKDRLPKFKPLFKQILSDRIHASWQIDNFESDNEVLKAIENAYETLDEEVISRKDSNLPLLFASISDFDLSGIYVSAKAITDFSQQIFKDWNAIDSALEAACRRSNQPKKKETEEKYAERIKKQRSHIDSYSVGEIIESLVAFQPNPEKSILDYLGGMGRREDKPSIIESIKSAYRDVEELLKTEYPANKNLALDKDNISKVKALLDAIKELQFFIKPLLGTGKESGKDERFYGEFVDYWQTLDIITPLYNKVRNYATRKPYSTAKFKLNFENSTLLNGWDVNKEPDNTSVLLRKDGLYYLAIMKKSCNRVFAVDQYDTVGDCYEKIDYKLLPGANKMLPKVFFAKSRIDEFAPSREVLDIYKRGSFKKGEEFCKADLHTLIDFYKASITKHEDWKKFGFEFSPTSSYDDISGFYREVEQQGYQIRFRKVSCTYIDSLVDQGQIYLFQIYNKDFSPFSKGTPNMHTLYWKMIFDERNLKDVVYKLNGQAEIFFRKSSLPVETPTHPANQPIANKNPLNRKKESLFTYDIVKNRRYRYDKFQFHVPITMNFKSIGSEYINDQVQDYIRQSKDLHFIGIDRGERHLLYLTVIDSKGIIEEQFSLNVINNEYNGTTYSTNYHDLLEERGDDRTKARREWLAIESIKELKEGYLSQVVKKITDLMIKYNAIVVLEDLNMGFKRGRQKVESSAYQQFEHKLIDKLNYLAGKTAPIDKVGGLLKAYQLATPYQNEMGFQNGFVFYIPAWNTSKIDPVTGFTNLFDLHIETMEQAKKFFSKFDYIRWNAANNWFEFAFDYKNFTEKADGSRTQWTLCTQGTRIRTFRNPEKNSEWDNVEVDLTDQFLSLFKSKNIDIKSDLKTQILAQNEKDFFMSLLLCLKLTLQMRNSISNSEVDYLISPVADANGDFFDSRKVDSSLPANADANGAYNIARKGLWMARRIKKSRPEDKVSLKITNKEWLTFAQNKPYLTD

SEQ ID NO: 110 - protein, 1249 aa, unidentified
  REGION 1..1249: note = Description of Unknown:uncultivated organism sequence
  REGION 1..1249: note = Category: MG13 effectors
  REGION 1..1249: note = Description: MG13-76 effector
MKEFTNYYPVSKTLRFELQPIGKTKENIEKSGILARDEQRAKDYMIVKGFIDEYHKQFIKERLWNFELPLKSEGHLDSLEEYKTFYDLPKRSEAEEVSFTEIKNNLRSIITKRLTESGVAYDRIFKKELIREDLVDFLKDEEDKKIVRQFADFTTYFSGFHENRRNMYSSEEKSTAIAYRLIHQNLPKFMDNMKAFAKIAESTVSEHFADIYGGWKEYLNVERLEDVFQLDYFSETLTQPHIEVYNYIIGKKILEDGTEIKGINEYVNLYNQQQKDKGERLPLLVPLYKQILSDRDKLSWMAEEFDSDEKMLAAINDSYSHLRDLLMGEENESLRSLLFQIKDFDLDKINITNDISLTGISQHLFGRYDVLTNGIKEQLRVITPRKKKESDEDFEDRISKIFKTLKSFSIAFLNKLPQPVMEDGIPRKVEEYFMSLGAVNTETTQKENLFVQIENAYVDAGSILNTRDTGNKLSQNKQAVAKIKTLLDALKDLQRFIKPLLGSGEENEKDELFYGSFQMMWDELDTVTPLYNKVRNWLTRKPFSTEKIKLNFDNAQLLGGWDVNKEPDCTGVLLQKDGFYYLGIMNKKANRIFDTDVTPSDGDCYDKIDYKLLPGANKMLPKVFFSKTRIEEFAPSEAIVNSYKRGTHKKGADFSLSDCHRLIDFFKASIYKHEDWSKFNFHFSDTQTYEDISGFYREVEQQGYRLTSHPVSTSYINNLVEEGKLYLFRIWNKDFSEYSKGTPNLHTLYWKMLFNERNLADVIYKLNGQAEVFFRKASIKPENRIIHPAHCPIANKNELNEKRTSTFEYDIIKDRRYTVDKFQFHVPITINFKAIGQTNINPIVQDSIRRSGFSHIIGIDRGERHLLYLSLIDLKGNIVKQMTLNDIVNEHNGVTYKTDYHNLLVKREGDRTDARRSWDTIETIKELKEGYISQVIHIISKMMVEYNAIIVLEDLNIGFMRGRQKIERQVYEKFEKMLIEKLNCYIDKHAEPKEAGGLLQPLQLTSEAKNWKRSHQCGCLFYIPAWNTSKIDPVTGFVNLFDTRYDTREKAKLFFSKFQRISFNSKKDWFEFTFDYSDFTTKAEGTRTEWTLCTYGERIRTFRNPQKNHQWDDEHIILTVEFKQLFEKYNIDIRGNLKEAISTQSDAQFFRELLGLMKLLLQMRNSITNSEEDYLLSPVADGNGHFFDSRENIGTLPNNADANGAYNIARKGLLLIRKLQESKEGEKLSLAISNKEWLLFAQTKPYLSD

SEQ ID NO: 111 - protein, 1275 aa, unidentified
  REGION 1..1275: note = Description of Unknown:uncultivated organism sequence
  REGION 1..1275: note = Category: MG13 effectors
  REGION 1..1275: note = Description: MG13-77 effector
MKEFTNLYPVSKTLRFELQPIGKTKEHIEKNGILQRDEKRAEDYKIVKGFIDEYHKQFIKERLWSFKLPLHSEGRLDSLEEYQALYELSKRNDAQEAEFTEIKDNLRSIIAKRLTESGSAYERIFKKELIREDLIDFLESEEDKDIVRQFADFTTYFSGFHENRRNMYVAEEKSTAIAYRLIHQNLPKFMDNMKAFAKIAETSVAEHFKDIYEGWKEYLNVGSIEEIFRLDYFSETLTQIHIEVYNYIIGKKILEDGTEIKGINEYVNLYNQQQKDKSKRLPFLVPLYKQILSDRDKLSWLAEEFDSDEKMLAAINESYNHLHDLLMGNENESLRSLLLHIKDFNLSQINITNDFSLTDISQHLFGRYDVFTSGIKDELRIITPRKKKESDEDFEDRISKIFKTQKSFSIDFLDKLPQPVMEDGKPRRIEDYFTSLGAVNTKTTQKENLFAQIENAYEDARAILQMKDTGDTLSQNKSAVAKIKALLDALKDLQHFIKPLLGSGEENEKDELFYGSFQMMWDELDTVTPLYNKVRNWLTRKPFSTEKIKLNFESPTLLKNMAVPQTSSAAIFRDRQGYYYLGILDSNSRNCLNELLSLSADHSGFDFMQYHQGGDMGKNVQNLMVINGEVCKKNGRKERSGQFVGQNLILEKLKNEYLPKDVNEIRLKQSYLTSSSTFSKKDLVRFVEYYIPLVKAYYSEYSFVFKTPSEYKSFADFTDHINQQAYQLSFTPISKDSIDNLVEEGRLYLFRIWNKDFSKFSKGTPNLHTLYWQMLFDERNLQNVVYMLNGQGAEVFYRKASIKPENRIVHKANQPIANKNELNTKRASTFEYDIIKDKRYTVDKFQFHVPITINFKAAGQTNINPIVQDAIRQGGFSHIIGIDRGERHLLYLSLIDLKGKIIKQMTLNEIINEYKGQTYKTNYHDLLAKREGDRTDARRSWETIETIKELKEGYLSQVVYIISKMMVEYNAIVVLEDLNTGFMRGRQKIERQVYEKFEKMLIEKLNCYIDKQLSPTDEGGLLHPLQLTCDAQKWKRAHQCGCLFYIPAWNTSKIDPVTGFVNLINTSRYDTREKARGFFSKFQRISFNEKKDLFEFTLDYNDFDYIAKAEGTRTQWTLCTQGERIRTFRNPQKNHQWDDERIVLTDAFKQLFDKYDIDINGNLKEAISAQTDAQFFKELLGLTKLMLQMRNSITNSEEDYLLSPVADITGHFFDSREGISSLPIDGDANGAYNIARKGLLVIRKIQETPDGEKPSLTITNKEWLLFAQTKPYLND

SEQ ID NO: 112 - protein, 1252 aa, unidentified
  REGION 1..1252: note = Description of Unknown:uncultivated organism sequence
  REGION 1..1252: note = Category: MG13 effectors
  REGION 1..1252: note = Description: MG13-78 effector
MKQFTNLYQVSKTLRFELQPVGKTKENIEKGGLLEQDETLARNYLIVKGFIDEYHKQYIKDRLWNFELPLKSEGNHDSLEEYKTLYEVSQRNADQEEEFQEVKDNLRAIIAKRLTEKGSQFDRIDKKELIREDLLHFLTNEEDREIVSQFADFTSYFTGFHENRRNMYSSEEKSTAIAYRLIHQNLPKFMENMKAFAKIAQTPVAEHFIDIYTGWEEFLNVRSIEDMFRLEYFSQTLTQPHIEVYNYIIGKKIQEDGSEIKGINEYVNLYNQQQKDKTQRLPLLVPLYKQILSDREKLSWLADEFDSDAKMLTAISEIYAHLYDVLRGEETENLHSLITHLKDYNLSRIYVSNDLSLSDISQHIFGRYDVFSTGIKENLKTAYPQKNKENAEAYEERIGKLFKARKSFSLDELNNLPQPDMGDSKLRRLEDYFRTLGAVNSESVQKENLLAQIEIAYDEVLPVLQQSKNDNNLSQNKDAVAKIKKLLDALKDLQHFIKPLLGSGEENEKDELFYGLFQTIWDELDAVTPLYNKVRNWLTRKPYSTEKIKLNFENAQLLNGWDVNKEPDCTGVLLCKNGFYYLGIMNKKANHIFAYDSLTTNSDDSFEKIEYKLLPGANKMLPKVFFSKSRIDEFAPTPKIIENYKKGTHKKGSSFSLDDCHQLIEFFKDSISKHEDWSKFNFHFSDTDSYNDISEFYHEVEQQGYKLSTRPISATWINQMVEEGKLYLFRIWNKDFSEYSKGTPNLHTLYWKMLFDEKNLADVVYKLNGQAEIFFRKASINPKNRIVHPANQAIKNKNTLNEKQTSTFGYDIIKDRRYTVDKFQFHVPITINFKAAGQSNINPIVHETIRKNGFTHVIGIDRGERHLLYLSLIDLHGNIVKQMTLNEIINEYKGKKYVTNYHDLLAKREGERTDARRSWSTIETIKELKEGYLSQVVHIIARMMVEYNAIIVLEDLNMGFMRGRQKIERQVYEKFEKMLIEKLNCYIDKQADPEVEGGLLHPLQLTNEFKSFRKLGKQSGCLFYIPAWNTSKIDPVTGFVNLFDTRYETIGKSRSFFSSFKRIWFNSDKDWFEFSFDYNDFTAKAEGTRSQWTLCSYGTRIRNFRNPQKNNQWDNEEVVLTEQFKKLFAYYHIDVNSNLKEAIIGQTEAKFFQSLMGLMKLLLQMRNSKINSDVDYLLSPVADEDGRFFDSRSASESLPENADANGAFNIARKGLWVIRKIKNATASDEKLSLAVSNKEWLQFAQTKPYRND

SEQ ID NO: 113 - protein, 1252 aa, unidentified
  REGION 1..1252: note = Description of Unknown:uncultivated organism sequence
  REGION 1..1252: note = Category: MG13 effectors
  REGION 1..1252: note = Description: MG13-79 effector
MKQFTNLYQVSKTLRFELQPVGKTKENIEKGGLLEQDETLARNYLIVKGFIDEYHKQYIKDRLWNFELPLKSEGNHDSLEEYKTLYEVSQRNADQEEEFQEVKDNLRAIIAKRLTEKGSQFDRIDKKELIREDLLHFLTNEEDREIVSQFADFTSYFTGFHENRRNMYSSEEKSTAIAYRLIHQNLPKFMENMKAFAKIAQTPVAEHFIDIYTGWEEFLNVRSIEDMFRLEYFSQTLTQPHIEVYNYIIGKKIQEDGSEIKGINEYVNLYNQQQKDKTQRLPLLVPLYKQILSDREKLSWLADEFDSDAKMLTAISEIYAHLYDVLRGEETENLHSLITHLKDYNLSRIYVSNDLSLSDISQHIFGRYDVFSTGIKENLKTAYPQKNKENAEAYEERIGKLFKARKSFSLDELNNLPQPDMGDSKLRRLEDYFRTLGAVNSESVQKENLLAQIEIAYDEVLPVLQQSKNDNNLSQNKDAVAKIKKLLDALKDLQHFIKPLLGSGEESEKDELFYGLFQTIWDELDAVTPLYNKVRNWLTRKPYSTEKIKLNFENAQLLNGWDVNKEPDCTGVLLCKNGFYYLGIMNKKANHIFAYDSLTTNSDDSFEKIEYKLLPGANKMLPKVFFSKSRIDEFAPTPKIIENYKKGTHKKGSSFSLDDCHQLIEFFKDSISKHEDWSKFNFHFSDTDSYNDISEFYHEVEQQGYKLSTRPISATWINQMVEEGKLYLFRIWNKDFSEYSKGTPNLHTLYWKMLFDEKNLADVVYKLNGQAEIFFRKASINPKNRIVHPANQAIKNKNTLNEKQTSTFGYDIIKDRRYTVDKFQFHVPITINFKAAGQSNINPIVHETIRKNGFTHVIGIDRGERHLLYLSLIDLHGNIVKQMTLNEIINEYKGKKYVTNYHDLLAKREGERTDARRSWSTIETIKELKEGYLSQVVHIIARMMVEYNAIIVLEDLNMGFMRGRQKIERQVYENFEKMLIEKLNCYIDKQADPEVEGGLLHPLQLTNEFKSFRKLGKQSGCLFYIPAWNTSKIDPVTGFVNLFDTRYETIGKSRSFFSSFKRIWFNSDKDWFEFSFDYNDFTAKAEGTRSQWTLCSYGTRIRNFRNPQKNNQWDNEEVVLTEQFKKLFAYYHIDVNSNLKEAIIGQTEAKFFQSLMGLMKLLLQMRNSKINSDVDYLLSPVADEDGRFFDSRSASESLPENADANGAFNIARKGLWVIRKIKNATASDEKLSLAVSNKEWLQFAQTKPYRND

SEQ ID NO: 114 - protein, 1252 aa, unidentified
  REGION 1..1252: note = Description of Unknown:uncultivated organism sequence
  REGION 1..1252: note = Category: MG13 effectors
  REGION 1..1252: note = Description: MG13-80 effector
MKQFTNLYQVSKTLRFELQPVGKTKENIEKGGLLEQDETLARNYLIVKGFIDEYHKQYIKDRLWNFELPLKSEGNHDSLEEYKTLYEVSQRNADQEEEFQEVKDNLRAIIAKRLTEKGSQFDRIDKKELIREDLLHFLTNEEDREIVSQFADFTSYFTGFHENRRNMYSSEEKSTAIAYRLIHQNLPKFMENMKAFAKIAQTPVAEHFIDIYTGWEEFLNVRSIEDMFRLEYFSQTLTQPHIEVYNYIIGKKIQEDGSEIKGINEYVNLYNQQQKDKTQRLPLLVPLYKQILSDREKLSWLADEFDSDAKMLTAISEIYAHLYDVLRGEETENLHSLITHLKDYNLSRIYVSNDLSLSDISQHIFGRYDVFSTGIKENLKTAYPQKNKENAEAYEERIGKLFKARKSFSLDELNNLPQPDMGDSKLRRLEDYFRTLGAVNSESVQKENLLAQIEIAYDEVLPVLQQSKNDNNLSQNKDAVAKIKKLLDALKDLQHFIKPLLGSGEENEKDELFYGLFQTIWDELDAVTPLYNKVRNWLTRKPYSTEKIKLNFENAQLLNGWDVNKEPDCTGVLLCKNGFYYLGIMNKKANHIFAYDSLTTNSDDSFEKIEYKLLPGANKMLPKVFFSKSRIDEFAPTPKIIENYKKGTHKKGSSFSLDDCHQLIEFFKDSISKHEDWSKFNFHFSDTDSYNDISEFYHEVEQQGYKLSTRPISATWINQMVEEGKLYLFRIWNKDFSEYSKGTPNLHTLYWKMLFDEKNLADVVYKLNGQAEIFFRKASINPKNRIVHPANQAIKNKNTLNEKQTSTFGYDIIKDRRYTVDKFQFHVPITINFKAAGQSNINPIVHETIRKNGFTHVIGIDRGERHLLYLSLIDLHGNIVKQMTLNEIINEYKGKKYVTNYHDLLAKREGERTDARRSWSTIETIKELKEGYLSQVVHIIARMMVEYNAIIVLEDLNMGFMRGRQKIERQVYENFEKMLIEKLNCYIDKQADPEVEGGLLHPLQLTNEFKSFRKLGKQSGCLFYIPAWNTSKIDPVTGFVNLFDTRYETIGKSRSFFSSFKRIWFNSDKDWFEFSFDYNDFTAKAEGTRSQWTLCSYGTRIRNFRNPQKNNQWDNEEVVLTEQFKKLFAYYHIDVNSNLKEAIIGQTEAKFFQSLMGLMKLLLQMRNSKINSDVDYLLSPVADEDGRFFDSRSASESLPENADANGAFNIARKGLWVIRKIKNATASDEKLSLAVSNKEWLQFAQTKPYRND

SEQ ID NO: 115 - protein, 1202 aa, unidentified
  REGION 1..1202: note = Description of Unknown:uncultivated organism sequence
  REGION 1..1202: note = Category: MG13 effectors
  REGION 1..1202: note = Description: MG13-81 effector
MRQKYDGFESCYGISKVIRTGLIPQGATLEHIEKKGLLLLEAKRAEDYTKVKKIIDRYHRKYIDNQLKDAELSGVEESYSLYCKTNRTEKENTDLKKDLEKLRKQVSNFLTLSAEFKRIDKKELIEKDLLNFVQGDEEEEELVKSFKGFTTYFKGFHKNRKNMYSHEEKSTAIAYRVINQNMFRYFDNIRSISKFILANSENNIAELESIYSDKLNGKTLEEFFSVDNYSFFISQSGIDTYNMIIGGYSVDEKTKVKGINEYINLFNQENHEKFGTLKPLYKQILAERTTESFLPEKFENDKEVIESLAVFNHNISDTLSELMQIFSKMGEYDASGIYLKYDSLKDISTCVFSDWSAITNALWEQYDVQYTGKKKKETKAYFEEKRKYFKNLKSISASEINTAMGENVLIPYSDAAKSLFEKICVAEENIRELINLDYPDDKELSKDKAAVKDIKAYLDSVKALQHHMKPLLGNQDESGKNEFFYGNFSGLWDELDALTPLYNKVRNYVTKKPYSTEKIKLNFDNSTLLNGWDLNKEEANTAILMQREGFLYLGIMDKKHNKLFRNIANTDCEDCYQKMEYRQLPGAYKMLPKVFFSKKGIDTFKPPLKILEIYRSETFKKGTNFNIDDCHKIIDFYKKAINEHESWKRFKFKFSETKDYRDISEFYQEVDVQGYNISFKAIPKKIIDEYVEKGWLYLFKIWNKDFSEYSKGTPNLHTLYLKMLFDPRNLENAVYKLNGEAEIFYRKASIQPKDIIKHPANEAIKNKNPLNQKQSSTFKYDLIKDRRYTADKFEFHVPITLNFKARGKENINTEVREYIKRSKNLYVIGIDRGERNLLYVSVVDADGSIVEQYSLNDIVNEYKGVQYRTDYHALLDTKEKNRDKARKEWTEIQNIKELKEGYISQVVHKICELMMKYEAIIALEDLNGGFKNSRKKVEKQVYQKFEKMLIEKLNYLVDKKADINEPTGLLHALQLTSKFEGFNKLFGQSGFVFYVPAWNTSNIDPCTGFTNLFFSKDLRYSGVENSLEFWKRFDSVAYDDRKDMFAFAFDYNNFNQRAEGSKSKWTVYSYGDRLETFRNPDLNQQYDSREVKLTEAFKELFKKYGISYKSCEIKENILNCKERGFHEKLLHLFKLTLQLRNSKTGTMIDYMTSSVISVDGNFFDSRTASSKLPQDADANGAYNIARKGLWLIEKLQRCTKGT

SEQ ID NO: 116 - protein, 1278 aa, unidentified
  REGION 1..1278: note = Description of Unknown:uncultivated organism sequence
  REGION 1..1278: note = Category: MG13 effectors
  REGION 1..1278: note = Description: MG13-82 effector
MKKFTNKFQLSKTLRFELIPQGKTLENIKSKGLIAKDDQRAISYKKMKKSIDEYHKYFIGLALSNVKLSKLQDFADLYFETNADKKKEDAYKKSLEKIQTDLRKEIVKGFKEGDAKEIFGKLNKKELFTELLEEWKQEKGDFYFDEEFKTFTTYFTGFNKNRANMYSDEAKSTAIAFRLIHENLPKFLDNIKVFEKAKSIPQLQENCKLLYKEIEEYLNISKIDEVFELGYFNEALTQNDIDVYNLIIGGRTAKEGVQKIQGLNEYINLYNQKQDKKNRIPKLKVLYKQILSDRENISFLPEKFNDSNEVLEAIENFYKSNLLEFQTGDMEHSENVLASLKTLVGEIANFDTSKIYLRNDKSITDISQTIFGDWGIIKSALEFSFIQGLIIGKKGISIKQEVEKDKYLSKQSYYSIAEIENALMLYKDQNELLKELKPTDLPVANYFKNHFKIKVKKDDNSEKEFDLITNIEDKYRCIKGILANDYPEDKDLKSTNNPDTLNIKLFLDSLMEFLHFIKPLALPKDTVLEKDEHFYNPFVIGYEQMQLLIPLYNKVRNYATQKPYSEEKFKLNFENSTLLSGWDVNKEETNTSILFIKEGIYYLGVMDKDHNKIFRDIPKARSNSVYQKINYKLLPGASKMLPKVFFSDKNISFFNPSDEIQNIRNHGTHTKGGSPQEGYSKLDFNVNDCRKMIDFFKTSIEKHPEWKNFGFQFSDTSTFDSIDAFYREVEAQGYTISYSNLDKDYIDQLVSEGKLYLFKIYNKDFSSYSKGQPNMHTMYWKALFDKDNLKDVVYKLNGQAELFYRKKSINYDEKTMKQGHHYNELKDKFSYPIIKDKRFTEDKFHFHVPITLNFKASGNDYINADVLTYLKNNPDVNIIGLDRGERHLIYLSLINQKGEVLKDKNGNPIQYSLNEIINEHKGKTYPTNYQTLLDSKEKERDSARKNWGEIENIKELKEGFISQVVHKIAQLMIDFNAIVVMEDLNFGFKRGRFKVEKQVYQKLEKMLIDKLNYLVFKDKEPTEIGGIYNALQLTNKFKSFKEMGKQSGFLFYVPAWNTSKIDPTTGFVNLFNTKYETIEKAQEFFSKFNDIRFNEMENYFEFVVDDYTKFNLKAEGTRLDWTVYTNEDRILTFRNPETNNNWDNKKVVLTDEFVKFFTENQIEYKTNLQTQILEKTEGKFFKDLFHLYKLTLQKRNSITNSEVDYLISPVKNNDSYFYDSRKADNTLPQDADANGAYHIAKKGLWVLEQINQYEKDDNWKKLQLAISNKKWLNFVQKK

SEQ ID NO: 117 - protein, 1251 aa, unidentified
  REGION 1..1251: note = Description of Unknown:uncultivated organism sequence
  REGION 1..1251: note = Category: MG13 effectors
  REGION 1..1251: note = Description: MG13-83 effector
MKQFTNLFQVSKTLRFELQPVGKTKEHIEQGGILTRDEQRAENYKKVKGFIDEYHKQFIKDRLWTFQLPLSDEGRHDSLEEYQALYELSKRDEAQEAAFTEVKDNLRHIIAKRLTEKDSAYDRIFKKELIREDIVEFLDNEEDKDIVRQFADFTTYFTGFHENRKNMYSPDEKSTAIAYRLIHQNLPKFMDNMKSFAKIAQTAVAEHFIDIYEGWKEYLNVESLEAIFRLDYFSETLTQPHIEVYNYIIGKKILEDGTEIKGINEYVNLYNQQQKDKSQRLPLLVPLYKQILSDREKLSWLAEEFDSDEKMLAAINETYNHLHDLLMGEENESLRTLLAHLKDFDLTQINITNDQSLTDISQGMFGQYDVFTRGIKDELRQITPRKKKESDEDFEARISKIFKTQKSFSIDVLDRLPQPVMEDGKQRFIADYFMTLGAVNTDTIQKENLFAQIENAYEDVRPILQMSDTGGDTLSQNKSAVAKIKTLLDVFKDLQHFIKPLLGSGEENEKDELFYGGFQMIWDELDTVTPLYNKVRNWLTRKPYSTEKIKLNFDNAQLLGGWDVNKEPDCTGVLLRKDGFYYLGIMNKKANRIFDADITPSDGICYEKIDYKLLPGANKMLPKVFFSKSRIGEFAPSDAIVSSYKRGTHKKGADFSLSDCHRLIDFFKASINKHEDWSKFGFHFSDTQTYEDISGFYREVEQQGYRLTSHYVSQSYVDQMVDEGKLFLFRIWNKDFSEFSKGTPNLHTLYWRMLFDERNLADVVYKLNGQAEVFYRKASIKQENRIVHPAHQAIANKNELNPKDKSTFGYDIIKDRRYTIDKFQFHVPITINFKATGRDNINPIVHETIRQGGFTHIIGIDRGERHLLYLSLIDLQGNIIKQMTLNEIINEYNGLTHKTNYHDLLVKREGERTAARRSWDTIENIKELKEGYLSQVIHIISKMMVDYNAIVVLEDLNMGFMRGRQKIERQVYEKFEKMLIDKLNCYIDKQANPESVGGMLHPIQLANKFESFRKLGKQSGCLFYIPAWNTSKIDPVTGFVNLFDTRYETREKARLFFSRFQRIGYNAGNDWFEFSFDYDDFTTKAEGTRTQWTLCSYGTRIRNFRNPLLNHQWDDEEIVLTEEFKKLFCKYDVDFQGNLKEAINAQTDAQFFKDLMGLMKLLLQMRNSRSNSEVDYLLSPVADERGQFFDSRKGIASLPDNADANGAYNIARKGLWAIRKVQETPDGEKLSLAITNKEWLQFAQTKPYLND

SEQ ID NO: 118 - protein, 1063 aa, unidentified
  REGION 1..1063: note = Description of Unknown:uncultivated organism sequence
  REGION 1..1063: note = Category: MG13 effectors
  REGION 1..1063: note = Description: MG13-84 effector
MRDFNEFVGLYPISKTLRFELKPIGKTLEHIQRNELLEDDAVRADDYVKVKKIIDKYHKCLIDEALSGFTFDTEADGRSNNSLSEYYLYYNLKKRNEQEQKTFKTIQNNLRKQIVNKLTQSEKYKRIDKKELITTDLPDFLTNESEKKLVEKFKNFTTYFTEFHKNRKNMYSKEEKSTAIAFRLINENLPKFVDNIAAFEKVASSPLAEKINALYEDFKEYLNVEEISRVFRLDYYDELLTQKQIDLYNAIVGGRTEEDNRTQIKGLNQYINEYNQQQTDRSNRLPKLKPLYKQILSDRESVSWLPPKFESDKDLLIKIKECYDALSEREKVFDKLESILKSLSTYDLSKIYISNDSQLSYISQKMFGRWDIIGKAIREDCAKRNPQKSRESLEKFAERIDKKLKAIDSISIGDVDECLAQLGEPYVKRVEDYFAAMGASDMVEGQTDATSFKKNIEGAYKSVKELLNNADNITDNNLMQDKGNVEKIKTLLDAIKDLQRFIKPLLGKGDEADKDGVFYGEFTSLWTKLDQVTPLYNMVRNYLTSKPYSTKKIKLNFENSTLMDGWDLNKEPDNTTVIFCKDGLYYLGIMGKKYNRVFVDREDLPHDGECYDKMEYKLLPGANKMLPKVFFSETGIQRFRPSEELLGKYERGTHKKGAGFDLGDCRALIDFFKKSIERHDDWKKFDFKFSDTSTYQDISEFYREVEQQGYKMSFRKVSVDYIKSLVEEGKLYLFQIYNKDFSAHSKGTPNMHTLYWKMLFDEENLKDVVYKLNGEAEVFFRKSSITVRTPTHPANSPIKNKNKDNQKKESKFKYDLIKDRRYTVDKFLFHVPITMNFKSVGGSNINQLVKQHIRSATDLHIIGIDRGERHLLYLTVIDSRGNIKEQFSLNEIVNEYNGNTYRTDYHELLDTREGELTEARRNWQTIQNIRELKEGYLSQVIHKISELAIKYNAVIVLEDLNFGFMRSRQKVEKQVYQKIEKMLINKLNYLVDKKKPVAETGGLLRAYQLTGEFESFKTLGKQSGILFYVPAWNTSKIDPVTGIIVKTKSTSFQNEKYKKIPFS

SEQ ID NO: 119 - protein, 1205 aa, unidentified
  REGION 1..1205: note = Description of Unknown:uncultivated organism sequence
  REGION 1..1205: note = Category: MG19 active effectors
  REGION 1..1205: note = Description: MG19-2 active effector
MKGYKIHIKRINQSNGEIIRTIKYLLTPINQNNSQEIFFSNFIFDDLKVRGISSITDFIKHNSNYDLFDFWIDTLKAGVIFQPTKKSLEYFIKVIKNEKNDAELIFDKSSEIIKKYFKKEDFIQIIILSNAKRTRSKKSAFLNELFKMIKDEFKDNKNKIIVDKQLNDTVNFIINSFYNEDGDLKLEGEEKQIQFWKTNFAIDKTLLNKNKFKENSVGDITNFILPEIIKINESISIEELINIRINLAEKYLSLINRKTDKFNIVESFLGLGNDFNSLSNYLNNFYNYLLSKKIDEIIKSYKKIINLNEPEIAMIKEALKYLSDKAQLLEKPRFINKSWQEYRKVFGGKIQSWYSNYVNRLSKSSENYKKIIGNIDQIISIINKYKTTENENYLNKIIEKTLQLKDIMTKNTDILQVPYKFDIFSDLLADLKIDLNYFYQTYIKKNDDDQINKDPIFKFLFDEIEKPINFYGHSKKQILNKIVNQTAIRINEGFKIIRFLLEEYKNLRRSDFKKSFPELLENYFDKLAKKTVYSKFFYSKYKDILKNYILSTENINDIFNNPEKYTFFKNNFERQKSILIKTINIENNDYLILDLHEKFYNFLINIDQNLLINNPDTSIEYLETAKTFISFCIENNNKKEFQLESNLYNNFEGIKNYIKLFKQDKLNNKDYSKILNQYFFSELKGDLTLSSKKNYIAKYTLQIMNSDKVFPLIIKFKNNQISKNQLLTNSKEIINYPHQYFIVFDLGLKFKKINSEVEKTDTFLINKNGITPIKNLGFTNNLLYKISSSRYQIQFLDRLIYKPRNWQQIAIKIREPSFILEVNNNIKFDIINNKISLSEKSKKFYASIPFEIKSINNTSINANKNNKLYLGIDAGEYGVAYSLVDFENEKNPRIINSFYIKSKNIRRIKDHYQKIQEKSKKGVFLSSSNLLNKIRENSINEIRNNIHDIFLKYSPKMIVYEYSISNFETGSGRVTKIYDSIKKSDVHPDNEADKSIIKHIWGRDYNYIRIGTNASAYASSYTCTHCGRSIFSIIENINNNQIFITQRLTENGLKNIVEISTPYGKLYGYTSEKKYINGYLFKNTQESKKELKKILQNFARPPLDKSEVLLTFKKLDKNILRKIKIKRGNSSIFVCPFSDCLHVFDADLQASFIMAVRGYIKDINQNNKNLNIFEETLKYLKKIEDLNYKMLEIPDLASLPQSKNQ

SEQ ID NO: 120 - protein, 1240 aa, unidentified
  REGION 1..1240: note = Description of Unknown:uncultivated organism sequence
  REGION 1..1240: note = Category: MG19 active effectors
  REGION 1..1240: note = Description: MG19-3 active effector
MKIKGYRLHKERIKFTSGTTIRSIKLPIKEFSLNEDKKELILKIKKQVKNDDLLLKGDVNLNDYAQKGFRGNPSYNFFDFWVDSLRAGVIWKKTTNELIDFVNGKLSKKDIIGEILIKASDKFLKYFDIANQDLKNFFKLSEVRANKNKQSLSRSLVSYLKQDYKKKKDKYDYEIINSDAQNLINFIVNSFFDNQSLLKLKGPQKQNQFWLKNFGIDKTKLKQFRPQGELGNISFVIVPQLISIDKDINIVDLIEKRIHFLERLNLNNDNEIKSILGLENNFSALSNYLGIIFKKLYQGEIEEIFQALVFIYKDLEDYKNVAFKSLNFLKEKAKLLSPEPSLEFISNWADYRSLLGGKIESWLSNYLRRKKEINQQINDFFNGLDLTKKFLIENKNYKKELKDNDLDSILKIIKEINQFGNKDLNNKKNYEIFDSFLSILKSDLNLFYQKYLIDEKNEIKVDEFSPFEAIYKKIYKPVSFYGEIKRENNDKNLRLVLPIIKTGLEFSKLMINELTENFSFNDDDDAEIFFRKLLNFYHQKILTKSINSNDFKNFFIDILVHYISEEDKKNIFKKNRVFYKSDYSKGTQSLFKLINTEFSQEFKKLIFKIKDFLASFENDYILINKDLLLDWIETFKNLSSILIKFSINNDFDSKIFEPLLKNYLKIKIYYDVFNPPDFDKNLFTKLWQQFFLSEFKGAAILYSKKTYLARYVSQFIGSENKIKIFFYSSNQDLLEKINDFENIDNDVSKNLVNKRKYLISFDENLKLSTKRKLETDVCLIKLSKNLNQFKKVYIKKESFDNLFEITSSYYQLQFLDRLFYKPKDWRNVDIKLSEWNLILEQDYEINWKLEANKAEFIKKENSKKNKLYINIPFEISSKNLVIKFKQLDNNRFAYPICGIDVGEYGLAYCLIKVGGNQTNIIDKGFFEDKNIANIKDKFAKIQERSRKGIFNETDSTIVQVRENAIGALRNQIHDLVVKYNASPVYEYSISNFETGSGRTTKIYNSVKRSDVFEEGSEVSVFLKTQIWGIKKTIGRNVSSYASSYTCINCKRSLYELNFQKKHLENGEVIIVVQKRQGNIIYFQINNNLIICGYSDKNKFVNNYQLKTRQDLDDFNKALKDFTRPPVKSNSEVLVKFANDLTMKKLKKEDKELSFIDVFRKRRGNSSIFVCPFDDCHFVADADIQAAFIMAIRGYIKFLKGANNNNQNNDKNRQKIDYFKETLIFLKKLQLQEDIFYPSID

SEQ ID NO: 121 - protein, 1256 aa, unidentified
  REGION 1..1256: note = Description of Unknown:uncultivated organism sequence
  REGION 1..1256: note = Category: MG19 active effectors
  REGION 1..1256: note = Description: MG19-4 active effector
MTKRKSSLAGYRLHRERILFSGGQVIRTIKFPLTPLNPSKETALFLKDFEKAIIADDLKIRGDLNINDYFVYTAKWKPPYTLFDFWVDSLRAGVIWMPKVTKLIDFLTSQYNITSPFDMVWEKASHRIAVIFQKDKFKDIFLSAPIRNTSTRNSFYERILKSLKDDLVRKNDIISTDAKKEVDLIVNSFFNDDGKLILKGKDQLDFWKREYNLDRSTIESLKPKGAYTDITFVNIPELMHNLDAKQSFEELINKREIWISDKKLLSSILGLSDNFNGFSNYLGVVLKGLQKKDGDIEALYEAQKTIFPRLGNYEDEILNALDFLSQKAKLLGETSLPLVNGWHDYRSVFGGKLQSWFTNSQNRKKELNGQISQFREGLSQVKNYLQKGNFGEEADKEKKDILSFLSLLENFFTDEQKSIKVEVNYQLFESLLALIRRRLNFFYQKYIQKEGNETKVNKYKEFEGLYKTIYKPVAFYGYTAKRANEKFVNKTIPILEDGVENTIKLISYLRDSFSVQKTFESVKQEKEKVDDLYRKFLQFFWNKYVDASINSRLFLEKYEKIIKENIEDSKWKEISDKNRKGRYVFYKSPYAKGSLEKIQIKTNDYLQQLQASVLELAEFILSFKKDTLLSDAILLLDWIELSKNTISLLIRFNTKETYKLDGLLLDIFSQAKRYKELFRRENYPRNEFSFIIQSLILSEIRGAATLYSKKEYIASYSVQVIGADDRYKLYYIPKKEISINADTIKSKPSSIERKQLMKSHNFAIALDKVYEKNKNKTFNAILLSKSGITAVYLPSESLQKLFRLSSSPYQLQFLDKYIYLPDGWENIDISLSEWSFIVEKRYKIDWDLQTKKPTLLPITGSEQAKKNKIYLAIPFNLIPNKQAVQSAPLKVIAKGKETIEKDFSRLNFPILGIDVGEYGIAYCLVRFIFDKNTYKITGVELGSYKEEILGFIEDKNIGNIKDKFAEIQQKARQGAFDEEDNVVARIRENAIGHLRNKIHVIVTQEKSSSVYEDSITNFETGSGRTTKIYNSVKRADTESNTEADKQIHNHVWGEKTKWIGRNIGAYASSYTCLSCLKSLYQIKKEDLAKMIINQKEGRVVTISSRHGNIKGYVSKEEKYDMGYQFKGTDEDLKKIRKIVQDFARPPVTNHSEVLEKYAKKILETGRIEEWRKSRGNSSIFVCPFCQYVADADKQAAFMMAVRGYLRFSGIVPSQSSKKKQGQEEEKTTGESFLEQTQKQLKDIDRSGIKNAFSVRI

SEQ ID NO: 122 - protein, 1222 aa, unidentified
  REGION 1..1222: note = Description of Unknown:uncultivated organism sequence
  REGION 1..1222: note = Category: MG19 active effectors
  REGION 1..1222: note = Description: MG19-5 active effector
MKKVRGYRLHLKRILFSGGEIVRTIKFPIVARNLSKNDNDYLEIFKKNLIEDDIKIRGDLNLNDYLLYTSSNKHIYTLLNFWIDSLKSGIIWADKAASLIDFINDLYQFEDSPVDIIWNNASEDIKKFFDKDKFKEIIISDPLRATTKKESFKKRLISYLNNIYLEKNHEIKSKEAELLIEKIINNFFDEKGNLILDGKGQNDFWLRNFNLDKSIIDNAKPKGELADITFIIIPELIEDLNCYYTVEYLVKKRIDFLSEKINTSKKLEFILGLSNNFNGYSNFFGKGLRLFQERKINIIFDSMAKVNPFLNRSEYKDKVINSLKFLSDKSKNIPNEPSVPNIGNWANYRSFFGGKIQSWYTNGQKRKTELRQQLYNLEYSLNKAFDFIEKNFSSKEKDEEKEYFFESIKQSIERLKQIIVKFINFLDKGKSQEDIYSLFYDVFSSFKLDLNLYFHKYLKSEENETIDKNQYFSGIFKKIYKPVNFFGESKKEYNKKIIEKTIVTIEHGIDIVFNLLKKLKDSFVPKEKIGEKENSEIIFRDFLDFYWNKLKNKMINSSYFIDLITKIINESLINCNLEKINQKRNWNRYTFKINEYQKGTLVVFELKKINYLDVFEDKVFEIIDFLISFEKNRLLSDKNILIDWIEVSKNIISKLIKFNRSETFDLDQFNFNLENFPKAANYISIFQLKKLNKKDFLFFIQSLIFSEFKGAAVVFSKEKYLAKYTIQVIDTDEKFKLLYKPKDNKIDKNVDRKGLLKLHEYFICLDEVKNINKKNHQFNFIILEKNNFKPTFIDDNYLSKIYKIESSKYQIQFLDKFLSMPDKYKNIGVKLSEWGFILEQEYKIIWDLEKKRPKFQLIENSRRNKLYLSIPFIFYFKGEKSKVLLHSVLNNSTKYPVLGIDVGEYGLAYALVDFSQKNIIKILKIGFIEDRNIANIKDKFTQIQLKSRRGIFNEADNIVSQVKENAIGNLRNQVHFVLTDGMGASLIYEHSISNFETGSGRVTKIYNSVKRADTKFESKADEQIHNHVWGKNTKYIGKELSAYASSYTCVSCYNSIYQFKKEDLNDINIVKREGNIIFFSSSSYKKTFCGYSKEKKYQPGFKFENKEKNFNTFLKICKDFARPPIGKDKSEVLEKYFIFNQERRNKIEDFRKKRGNSAIFVCPFCQFVADADIQAAFIMAIRGFLKFSEKENLKEKKELIFEKTIKFLKATGFRPQEQFSPF

SEQ ID NO: 123 - protein, 1264 aa, unidentified
  REGION 1..1264: note = Description of Unknown:uncultivated organism sequence
  REGION 1..1264: note = Category: MG19 effectors
  REGION 1..1264: note = Description: MG19-6 effector
MAKRKNRLAGYRLHKERVLFSGGKVIRTIKYPLVPLGPSEETAQFLKDFERAIIADDLKIRGDLNINDYLACTVEGKSLYTLFDFWVDSLQAGIIWMPKGTKLIDFLASQYNTASPFDGVWKKASPRITAIFKKDKFKGIFLSDPIRNTSTKNSFYKRILESLKDDLVKENIIISTDAKEEVELIVNSFFNNDGQLILDGESQFDFWEKEYNLDKGIIESAKPKGKYTDITFVIIPELISNLNTKQTLEDLINKRATWLSNRELDEDNKLLASILGFSDNANGFSNYLGVVLRGLQEEDGDKEALYEAQKTIFPRLENYRDKVLESLDFLSQKAKLLGETSLPLVNCWHDYRSVFGGKLQSWFTNFQKRKEELDGQISQFKESLFKAKSYLQKENFGEEADKEKEDILSFLSLLGNFFTDEQKSIKIEENYQLFEPLIALIRRRLNFFYQKYIQKEGDETKVNKFKEFEGLYKTIYKPVAFYGYSAKRANEKFVNKTVPILEDGIENIKKIIFYLQDSFSVQKTFEDVKQEREEIDDPYRKFLQFFWNKYLDASINSYLFLGKYEEIIKENVEDNKWKEISDKNKKGRYVFYKSPYTKGTLEKIPIKANSYLDKLQVSVLELVEFILSFKKDTLLSDSALLLDWVELSKNIISLLLKFNTKETYKLDGLLLENFSQAKKYQELFKREDYPKNEFSFIIQSLVLSEIRGAATLYSKREYIASYSVQVVNSDEKFKLYYIPKEEIPITPDTIKSKPDSIERKQLMKPHCFVVALDKVSEEKKNQNFNAILLSKSNTTAVFLPDESLQKLCKLSSSPYQLQFLDKYLFRPAGWENIDISLGEWNFVVEKGYKINWDLQTKKPKLLPITDSEQAKKNKIYLAIPFNLSPNNQIKQSAPLKSIAKGNEKKEKDLSRLNYPILGVDVGEYGLAYCLVKFDFDKNTYKITGIKLGSDEKETFGFIEDKNIGNIKDKFSEIQQKARQGAFDEEDTIVARVRENAIGHLRNRIHIVVTQEKSSSVYEDSITNFETGSGRTTKIYNSVKRSDTESGTKADEQIHNHILGEKTKLVGRNVSAYASSYICVNCLKSLYQIKKEDLTKMTITQKDGRSRVVTISSPYGDIKGYVSKEEKYDVGYQFRGNDEDLKKLRKIVQDFARPPVSNRSEVLEKYAKPILETGRIEEWRKRRGNSSIFVCPFCQYVADADIQAAFMMAVRGYLRFSGIVPSLSNKNKQDQEKEKTAGESFLEQTQKQLKNIDINKIKSAFSIRI

SEQ ID NO: 124 - protein, 1194 aa, unidentified
  REGION 1..1194: note = Description of Unknown:uncultivated organism sequence
  REGION 1..1194: note = Category: MG19 effectors
  REGION 1..1194: note = Description: MG19-7 effector
MKSYKIHIKRLKTTKGETTRSIKFLLKPVNQTDAYEKIIENFVNDDHKVRGIANLIDIKSENQYSLLDFWVDTLKCGIVFQSKGKKIRYFIQSIRGKKTMEEIIFDQADEKIKNYFKKVDFIKNIIISDAKRSSSTKKSFFNTLFDILNNEFKNEKEKIIINSDANKLVNFITNSFYDEEGKLILDSEEKQNQFWKNNFNIDKNLLNGKTNNELGELTSFILPELIRLNGDIKLEELINLRFDLVKKYLKINSIEPNEKIINEQTASLLGLSDNFNAFSNYFNNFFNVLLEGNIEVIINYYKTIIDLSNQEEEKIKESLIYLAEKSRLLGKPKFISYSWQEYRSVFGGKLESWFSNYLNRLTKSQENYNKIKGEISKIIAYFDRLQILDKKFSEDNDFQKSKLKIKNQLVNLKNLLEQNPDLLNIPGKYSIFSDYLAEIKTDLNFFYQKYLKISEDDMINNDKNFKFLYEKFEKPINFYGQSKKESLLKIIEKSKLKVIDGFKIIRILLDESKSLKDNDFKKTLSEILNVFFEKLSKKILSNQSIFFNDYKKIIDYYISEENNKKEIYNQPQKYAFYISKFSNNNSLKIIKIKNFDNQDSQITNLIRSLYSFLKNINHNLLLKDVQSAIEYLEITKSFLSFVIENNKKNEFIVDKNLFSNFEGVLNFINLHKSNCLINQEFNRLLNQYFFADLKGTLNILSKKYDLAKYTLQILKSDERFPILINFKDIKVSLKQLLTESKKIINYSHRYLIVIGDKINDYFEFKKLNQEDQTDYFIITKQGIRPILITNLNKNHVFQIHSSRHQLQFLDRLIYKPYYWQNISISISEPSFILEIKHQIDLEKFVFKKESQNLYLSLPFQINSEEPQKKLNEKIYLGIDAGEYGVAYCLTDFTEDIPKIIESSYIKNKNVRKIRDKFEIIKQRARGGVFIQSENVVRKVRENAINEIRNQIHKVFLKYKVPIIYEYSISNFETGSGRITKIYNSIKKSDVDSKANKPIIKHIWGSNSINIGLNLSAYASSYTCSVCGRSIFEVVNDFDTSQATVVSRLKTDGLKNVIEIKTTHGNLYGYTQNKKFIENYRFQNTKQEKEEFLKIIKNFARPPLEKSEVLLTLKKLDPLKLKEIKKQRGNCAVFICPFVDCGKIFDADLQAAFNMSVRGYVKNNLKNNQEVNIFEETIRYLKNHKPINYKMLEIV

SEQ ID NO: 125 - protein, 1069 aa, unidentified
  REGION 1..1069: note = Description of Unknown:uncultivated organism sequence
  REGION 1..1069: note = Category: MG20 active effectors
  REGION 1..1069: note = Description: MG20-1 active effector
MANISLKKALQQFPQTTLSKVTNPKTGKVQTRNVLKTMQCGLAISLTPKQRKVELEELSPDKKKLLDEYIDTFENKKQLILEDFYHYYEKSIWDFLIYCSRIKDTTETTYIVIPELPEITTKIKKSDGTYLKVKAYKGISNTTGNIHKTLYWFADDIDTKDGCTKVQFQYTEQRKEYITTDNYEKYNFDPALFELQPDTQQISNRISFFYMTNAQKKDKNGIYHETPKYQEYKKKGISIKGIVDDIEIDIKEPLRTKTAAVLKAFVDKLQESIKEIESVISEKNERIALLNKEDPKNNFPEFFVTNLKEDDKKLLSELTQLQIEDRDVKKFSELYNTLAKSFNQILNNAIQTYISIKLKESKIKQSDKEQEGKRLWDTYHLNHLKGIPSFPQMKNESQGKITAEMIYHFIQEQLQQYKNFSAFDHLLLDKNDFIFTDQKRKLSEDTVEQEQEWKEQWKTIKEKENNSFILTLRKILWRKNNIPGKKLMHYAHYLVQQGKITTNSAIVKALIEYALQELLKKQEHLSCEQFSSDQKAKREFCDYARIIISFIAYQLKKEEKRKEARNLELQIDDMSGNYKGTAFDLLKKGESNILPLSGFDFDNHGTKKGACLVFRNTTDHGNIRTHWYFALNLYNKIHFEEFDQQYDHPLEYPVDQYFVLASKGNDKTVSHHIYQLSPKEFDPGSKTMLIPLLLGTRQLREYITNFEISPFKNLLYFNSAEIQRIRNHKEEQYFLNLVTTRPEVEAYELTQEKKKGLIGIDRGENTVAWAALVNTQGNPLFEGKDERNFIELAPKFGKKFREEYKEISKRQSHGSVKKLNIQGRVKKVIEGVGAKIISNALEYGLQIVLENLDRGFGRHGKNTFVGVRQFTHLQKFIESKLKQNNISFKKDSILQTVPAAYTSKMCSNCGVINSLTGKEDFIAAVIEQFKDHPQQKDPKISCNKLCINLDQEITSWDRNKKREVVENSFEKIKAIFSNTKIQKHEAYVEIILKKLLNPRKEKADLFKCNFCGHTCHADKQAALNIARFSLLPYRSESEKKKGITAISKLEEEYQQRLNDGIFQRGSLIL

SEQ ID NO: 126 - protein, 845 aa, unidentified
  REGION 1..845: note = Description of Unknown:uncultivated organism sequence
  REGION 1..845: note = Category: MG26 effectors
  REGION 1..845: note = Description: MG26-2 effector
ENKKDITLQKKYWDFIIDEETWRYKKQNKNYMTMWTLWNKNFIRPYFEELLTNNLNSNKKLENLNRQENLLARKSDISFEIQKINSKDFLWNLYILLEWWYLDHKNDVNVIKELKKQLSKIKELINDLLLLLKPSQSFWIVVDNISLNYYTRKKTPKDYDEEIRKKEVWLKNKYNWKLWKLYWINENQWIKELYEEMKTFKANQKSVFLQLLQDKSSYIDFTKLFLEKEDKNKKYFTFKDNKEIEHKNFELKLFDDISKENYDKMLNLTNQIEKESDKQKRTKLKEKRGRHFMSKSSCAKYINFCNEYKKVAMEYGKRKALVLSLQREQIESQKERWWGIISTDWKNHFLNTISIKNTEIAKNIFQKEIYRKQDEIKYYTFSSITLRALEKLCFKKESKFISNIINSLNTEFKVFVDFWKEKKDILNFDFINESEKNKIDFLNNILENQNTLWIIYRDLEKSKDILKKSKTIDEFEINLKKETYVLDTYFMSKIDFEENIKKIDWKVYEITSWDLIEKRNNSEFQTKTWFEFWSKENKENKFPIRINPEINIWYIEKNETWQKEEKNKNQTNNRRNRNRFLMMSTVSYKADKKYINNAFIKDEERIDNIQKFNEIFNENNKYDYFYWLDKWVLELVTLWIYKKVKDKIEPIKLDKINIYKITERWFNFEKNITNKNWDIKTHYLKNNPSIFIEEYINDNAIFEKLNITSCIWDLSCAKVIKWNIILNADINTYNKLQEINIKRLLYKAITEWKCISDNINYDKEKNIFSYTFENRWKNEERIISCYWKNINIEIFEKDLNNYMQFVRNKNSDTDVSITKINNLKNAICANIVWVIIELQKNILDL

SEQ ID NO: 127 - protein, 1086 aa, unidentified
  REGION 1..1086: note = Description of Unknown:uncultivated organism sequence
  REGION 1..1086: note = Category: MG26 effectors
  REGION 1..1086: note = Description: MG26-3 effector
HSIPDYELELSELLDSYKGLIENLINFFYSEKEVVESKKSKFSNLKWFKEAFANFDFDEAEEKVFDLKNKEFSKMPRFKHMFFKENFKEDWYAIKDRLIKKNKTKNYEILDSLPFFQKVLKDFFEKSEQLYKELDEIISSPDNASKRKSDLRFVLQKISWNEVFKKIIKLFSLWFVDHKNDVEIVWKISEELWEFSEKIQNAIELLRVNDSFWFPVEYLSLNYYTINKTPKEYDKEITEKQNNLEKLYEWGLSELYWIDKNQTIEQLRNDMKMFKARQKSAFLQQLQNWVPFEEFQKLDFTDNKWELHKDYEILLFNDIGNDKYGEMLEITEKIAKEQDKDKRKGLKEKRWKYFIHHCKKYNKFCDEFKKVAIQYMKLKAEKLSLEREREQARFERWLAILSKDLDWNYYINSFSNNDSKNAFEKLKNINSTSGDYSYFIMKSITLRALQKLCWKENFKKTVVNKISEKFTKVNENDTGRQVRKFKSFEEIGNNIVEFYVDILDKQRTLDVSYRSWYEEWLKKLKWAKDLDELEILLKQETYTLEEHKISKNDFEEILEDYNWNSYKITSEDLEKNIETNNFTKWWNIFWTTENKEHKYISRLNPELVISLRAWEKVFKDRKKHRKSDKSFLLTMSYSHYTDKSYIDDAFIKDEERKSSLEQFNKHYNENHKFDYIYWLDKWTNELVTLWIFKKVWDKLEKVNISEKIPVYRITEKWLKYSKKYSTIVEWLNWEREIFLYKNPSLFIDEIDNEELFEKVDIDSCIWNLNCAKLIKWNIILNWDINWFLSLSKIAAKRKLYLAITEWKIRWDTVVFGYENGNKYIWYKYENRWKIDENPVFFLESFTDIVSEREFEIEFNEYIKLVKNHNSKEDVSISWINKKRVAISWNIVWIMMKLQEFFPWYIAWEAITIKTNEEDSKKNHSFLWNMVNDKIYQKLMLSLDVPPILKKYRSEIKDKEYLQHGKIFYVNKESTSSACPNCNNTLTITNNWWQFEDKTEEYVSKLFWHISQYENEMHHINDKSDQNYEKKWESWILEDGSICDYNMKHNPKWFDFIRSWDDLATYNIAKKAKEYLEFLEKQKNNNS

SEQ ID NO: 128 - protein, 996 aa, unidentified
  REGION 1..996: note = Description of Unknown:uncultivated organism sequence
  REGION 1..996: note = Category: MG26 effectors
  REGION 1..996: note = Description: MG26-4 effector
LRFVLQKISWNEVFKKIIKLFSLWFVDHKNDVEIVWKISEELWEFSEKIQNAIELLRVNDSFWFPVEYLSLNYYTINKTPKEYDKEITEKQNNLEKLYEWGLSELYWIDKNQTIEQLRNDMKMFKARQKSAFLEFLQMKNEFSELEELKTYLNDIEKKYKQKKWSKYNFYEELQNNTFELDSSDVDTDIDKVFKAFSLILFLETEKDDYEKLLNLTKKIEKSSTLSERTSYKIERWEFFKGKNENWIFSEDRDTSYDWFCSEFKKVAISYWRLKAEKLSLEREREQARFERWLAILSKDLDWNYYINSFSNNDSKKAFEKLKNINSTSGDYSYFIMKSITLRALQKLCWKENFKKTVVNKISEKFTKVNENDTGRQVRKFKSFEEIGDNIVEFYVDILDKQRTLDVSYRSWYEEWLKKLKWAKDLDELEILLKQETYTLEEHKISKDDFEGILEDYKWNSYKITSEDLEKNIETNNFTKWWNIFWTIENKEHKYISRLNPELVISLRAWEKVFKDRKKHRKSDKSFLLTMSYSHYTDKSYIDDAFIKDEERKSSLEQFNKHYNENHKFDYIYWLDKWTNELVTLWIFKKVWDKLEKVNISEKIPVYRITEKWLKYSKKYSTRVDWLGWEREIFLYKNPSLFIDEIDNEELFEKVNIDSCIWNLNCAKLIKWNIILNWDINWFLSLNKIAAKRHLYDAITKGFMLKDKITFDEVKNNFYYEHTLAWKKFNKVVFYLDSFESITTKDEIEKELNNYIKLVIEHKSEEDVSIDWINKKRVAISWNIVWIILKLQEKFPWYIVWEALNLDQNNKNISSNHAFLWNLINDKIYQKLMISLDVPPILKKYRSELTKDTLTQHGKVFYINENLTSKACPSCNDTLTIEVNWTLKEKDPNKHKVKVYQLFWHLTEYENEMHHLTDEEYDNLYDNDKNFKKFHSNDKWNKKQNSYLAWENCDYNMKHNPKWFDFIRSWDDLATYNIAKKAKEYLEFLEKQKNNNS

SEQ ID NO: 129 - protein, 1187 aa, unidentified
  REGION 1..1187: note = Description of Unknown:uncultivated organism sequence
  REGION 1..1187: note = Category: MG26 effectors
  REGION 1..1187: note = Description: MG26-5 effector
MEKFKNLYEVRKTIRFNLLPVKHNYKKITDGQFKSDLKSFLKKYKQVVDNLSELVFIQNEDDDQILNENTRVSIAWLKEYEKQEFHKNKEKLVKRNKRGNKTGNYVSLRDTDFLLEKFQLWILRNWQEKNEEGKKIGILNNLEILSGQPLESQERNADFAYHIHQIYRRTNFEFIYEFFKNAQGAKSDALIIEIIPVLEDCKNLLKNLENYLRPKQSFGHVIEQSSLNYYTVNKKPKDYPREIKKWEEKKDEKYLSLSFYDSNVGKKKNFFFPDDFQSHLENLIESLNEEKNDEKKIKKEFGDISEINNWKLEQTYKNFKLYKAKQKSQFYEYVYQILEKYDADSEYVFFESHLQDIPTPLFANITDDKFKNLVEESKIIRDKSTKYNNSKDKKLKEAIISLKKKRGDTYFNVQNKPCPFSRYETFCGLFKEIAMTYGKIKAEVRSLEKEQIEAERLQSWAILLEKENQHYVMTIPRDRKILINNKNEYQLPSVYKKIKQLKDTTYSEYWTLFLFESLTLRALEKLCFGMDKNTFITDTNLINELKKKFKNFFITNKRGRQNLKRKDQFLEDGKELIKFYQAVLSLEETKKMILVEEYLPNEITKENICDGEFESLRDFQIALEKTCYIRQEIKISDHKKEELENKYGANVYQITSYDLFEKRKSEKEHTKIWKKFWKQDKNSGYTTRLNPQFSISYVEKREDSIKDKSGNEVERNRRKQAEYILSTTISENNDKPKFDMAFADKDRIKQNIEDFNKEFNKKAKSDPYSLYYYGIDRGQEELLTLGLFKFENQDITFTHPSDSSKSGTYKKPLPVDLEVWELPKGKLLEVVPYETKNGTKFTEAYKSISYAEKAGILEKKIISSCIDLTSAKLVNGKIVLNGDVSTLINLKLENAKRKILEIVNSLALVKKNKKGIMPAKIIFREKNKSNPERFVVNINVDGETIEKNIYFPSSNFFDFEKGQVEDGLNKILNESLQKIKEQGYCSINIPITKINHLRDAICANAVGILNFLQQKYFGIISFEDLPIDGGGSKNEHFSQNNANLGSRIEFMLLNKFKTLGLVPPNYKMVMSMQSKKEIEQLGIITYIKTEGTSSNCPHCSQGIDKKTQREHKWKHHKFKCCNNGKSCGFNTYSQEEIDKNKSSDKWNFTADKKGLDFLNSSDDVATYNIAKRGLQFIKSSNSKDKTS

SEQ ID NO: 130 - protein, 882 aa, unidentified
  REGION 1..882: note = Description of Unknown:uncultivated organism sequence
  REGION 1..882: note = Category: MG26 effectors
  REGION 1..882: note = Description: MG26-6 effector
MLENFKDLYEVRKNASFRLEPQENAVTNENLYNQDVDLSEILNKYKNFVYDLKNLLYIEGEKVTEEESDEEPSFTSKPFSRIFANLDLWVLQSNTENKEKDNDLSVDKLDSSNVVHINHKYLSKYFSKEFFENYDRIVKRNKHWAKTKNWTTIGNNDFLEVFFRSFFNDAFENINKLQELIDTKENEQKRKADIAFEVRRLLSRNHLWKIFPLFKGGYLTHKNDIKTIPELTDQAKELKELLDNAKIYFLEDSNFWVQVEHISLNYYTRNKTQKEYDELIKGKKKLLDSPYNKDISKLYWIDRNLPIKQLYEEMKMFKARQKSAFFQQLQNKTPFEKFKEPFTFIDNEWIKHKEFRTELFFDVEEKYYNEMLSLTKKIEKSGSKELKKERWNFLMFQDKWIKSFKWWSWFCSEYKKVAMEYWKRKAESLSLEREKILAEQERWWWVFSKVNNEFYINTFPIDKVKDAYQSLSKKQNDWELSYFILSSITLRALNKLCFSKDSKFINKEILIKLDNEFLKEKEYNNKTKEIVLRKKSDLTELELIKLYYNVLELQDSLWISYINKDSLSKLKSSKNLEEFELNLKNETYKLEEIKTTEDEFNKILKSNEWKSYKIINKEKWNFEKWWKNFWNSSKDWEIRINPELNISLRKWNEDYNDKISFHRKKDDVYLLNVNFSHFANRSYIDSSFIEDDHRKENLKKFNNLYNENIILNYFYWLDKWTNELITLGLFKKEWGKINSVNISKEIPVYRITKKWLLHSKITLKKAPKEWQNPETIHTLYKNPSLFIDELDNEEIFEKVNIESCLWNLNSAKLIKWNIILNWDILTNLNLHKLSAKRQLYIAITEWKTIIENIWFDEKEQENWAFFYEYINKGKTEKNMFFI

SEQ ID NO: 131 - protein, 1151 aa, unidentified
  REGION 1..1151: note = Description of Unknown:uncultivated organism sequence
  REGION 1..1151: note = Category: MG26 effectors
  REGION 1..1151: note = Description: MG26-7 effector
MLENFKDLYEVRKNASFRLEPQENAVTNENLYNQDVDLSEILNKYKNFVYDLKNLLYIEGEKVTEEESDEEPSFTSKPFSRIFANLDLWVLQSNTENKEKDNDLSVDKLDSSNVVHINHKYLSKYFSKEFFENYDRIVKRNKHWAKTKNWTTIGNNDFLEVFFRSFFNDAFENINKLQELIDTKENEQKRKADIAFEVRRLLSRNHLWKIFPLFKGGYLTHKNDIKTIPELTDQAKELKELLDNAKIYFLEDSNFWVQVEHISLNYYTRNKTQKEYDELIKGKKKLLDSPYNKDISKLYWIDRNLPIKQLYEEMKMFKARQKSAFFQQLQNKTPFEKFKEPFTFIDNEWIKHKEFRTELFFDVEEKYYNEMLSLTKKIEKSGSKELKKERWNFLMFQDKWIKSFKWWSWFCSEYKKVAMEYWKRKAESLSLEREKILAEQERWWWVFSKVNNEFYINTFPIDKVKDAYQSLSKKQNDWELSYFILSSITLRALNKLCFSKDSKFINKEILIKLDNEFLKEKEYNNKTKEIVLRKKSDLTELELIKLYYNVLELQDSLWISYKNKDSLSKLKSSKNLEEFELNLKNETYKLEEFKTTEDEFNKILKSNEWKSYKIINKEKWNFEKWWKNFWNSSKDWEIRINPELNISLRKWNEDYNDKISFHRKKDDVYLLNVNFSHFANRSYIDSSFIEDDHRKENLKKFNNLYNENIILNYFYWLDKWTNELITLGLFKKEWGKINSVNISKEIPVYRITKKWLLHSKITLKKAPKEWQNPETIHTLYKNPSLFIDELDNEEIFEKVNIESCLWNLNSAKLIKWNIILNWDILTNLNLHKLSAKRQLYIAITEWKTIIENIWFDEKEQENWAFFYEYINKGKTEKKHVFYINEEFLTIISLDELKNELNEYIKYIKNEPNEYKKYMWNNALDTDISILAINKIKNALCANIIGIIMKLQEKFPGYVCFESLSNDNNNRDMEKEHSFLWNLINDKLYSKLNINVSVPPILKKFRSELKNSYYQYGQVIYVNEDSTSSACPVCNDKFIKWINKKWNLEEYEKNKLYGHLTESESSMHHLTDDEYNKKYDNNEKFREKHTNDKGKKKDNIYGSWNWCNYHMKDNPKWFDFIKSWDDLATYNIAKKALEYLEYLKSLNSDETK

SEQ ID NO: 132 - protein, 906 aa, unidentified
  REGION 1..906: note = Description of Unknown:uncultivated organism sequence
  REGION 1..906: note = Category: MG26 effectors
  REGION 1..906: note = Description: MG26-8 effector
MLENFKDLYEVRKNASFRLEPQENAVTNENLYNQDVDLSEILNKYKNFVYDLKNLLYIEGEKVTEEESDEEPSFTSKPFSRIFANLDLWVLQSNTENKEKDNDLSVDKLDSSNVVHINHKYLSKYFSKEFFENYDRIVKRNKHWAKTKNWTTIGNNDFLEVFFRSFFNDAFENINKLQELIDTKENEQKRKADIAFEVRRLLSRNHLWKIFPLFKGGYLTHKNDIKTIPELTDQAKELKELLDNAKIYFLEDSNFWVQVEHISLNYYTRNKTQKEYDELIKGKKKLLDSPYNKDISKLYWIDRNLPIKQLYEEMKMFKARQKSAFFQQLQNKTPFEKFKEPFTFIDNEWIKHKEFRTELFFDVEEKYYNEMLSLTKKIEKSGSKELKKERWNFLMFQDKWIKSFKWWSWFCSEYKKVAMEYWKRKAESLSLEREKILAEQERWWWVFSKVNNEFYINTFPIDKVKDAYQSLSKKQNDWELSYFILSSITLRALNKLCFSKDSKFINKEILIKLDNEFLKEKEYNNKTKEIVLRKKSDLTELELIKLYYNVLELQDSLWISYKNKDSLSKLKSSKNLEEFELNLKNETYKLEEFKTTEDEFNKILKSNEWKSYKIISKEKWNFAKWWKNFWNSSKDWEIRINPELNISLRKWNEDYNDKISFHRKKDDVYLLNVNFSHFANRSYIDSSFIEDDHRKENLKKFNNLYNENIILNYFYWLDKWTNELITLGLFKKEWGKINSVNISKEIPVYRITKKWLLHSKITLKKAPKEWQNPETIHTLYKNPSLFIDELDNEEIFEKVNIESCLWNLNSAKLIKWNIILNWDILTNLNLHKLSAKRQLYIAITEWKTIIENIWFDEKEQENWAFFYEYINKGKTEKKHVFYINEEFLTIISLDELKNELNEYKIY

SEQ ID NO: 133 - protein, 1119 aa, unidentified
  REGION 1..1119: note = Description of Unknown:uncultivated organism sequence
  REGION 1..1119: note = Category: MG26 effectors
  REGION 1..1119: note = Description: MG26-9 effector
MLESFKDLYEVRKNASFRLEPQENAATNENLYNQDVDLSEILSKYKNFVYDLKNLLYIEGEKVTEKEKDNDLSVDKLDSSNVVHINHKYLSKYFSKEFFENYDRIIKRNKHWAKTKNWTTIGNNDFLEVFFRSFFNNAFENINKLQELIDTKENEQKRKADIAFEIRRLLSRNHLWKIFPLFKGGYLTHKNDIKTIPELTNQAKELKELLDNAKIYFLEDSNFWVQVEHISLNYYTRNKTQKEYDELIKGKKKLLDSPYNKDISELYWIDRNLPIKQLYEEMKMFKARQKSAFFQQLQSKTPFKKFKEPFTFTDNEWIKHKEFRTELFFDVEEEYYNKMLDLTKKIEKSGSNKFKKERWDFLLFQDKWTKSFKWWSWFCSEYKKVAMEYWKRKAESLSLEREKILAEQERWWWVFSKVNNEFYINTFPIDKVKDAYQSLSKKKNDWELSYFILSSITLRALNKLCFSKDSKFINKEILIKLDNEFLKEKEYNNKTKEIVLRKKSDLTELKLIKLYYNVLELQNSLRISYKNSDSFDKLKSSKNLEEFELNLKNETYKLEEFKTTEDEFNKILKSNEWKSYKIINKEKWNFEKWWKNFWNSSKDWEIRINPELNISLRKWNEDYNDKISFHRKKDDVYLLNVNFSHFANRSYIDSSFIEDDKRKENLKKFNDLYNKNIKLNYFYWLDKWTNELITLGLFKKEWGKIKSVNISKEIPVYRITRKWLLHSKVTFKKAPKEWQNPKTIHTLYKNPSLFIDELDNEEIFEKVNIESCLWNLNSAKLIKWNIILNWDILTNLNLHKLSAKRKLYIAITEWKTIIKNIWFDEKEQENWAFFYEYINKGKTEKEPVFYINEEFLTIVSLDELKNELNEYIKYIKNEPNEYKKYMWNNALDTDISMLAINKIKNALCANIIGIIMKLQEKFPGYVCFESLSNDNNNRDMEKEHSFLWNLINDKLYSKLNINASVPPILKKFRSELKNSYYQYGQVIYVNEDSTSSACPVCNDKFIKWINKKWNLEEYKKNKLYGHLTESESSMHHLTDDEYNKKYDNNDKFREKHTNDKGKKKDNIYRSWNWCNYHMKDNPKWFDFIKSWDDLATYNIAKKALEYLEYLESQNNDETK

SEQ ID NO: 134 - protein, 1151 aa, unidentified
  REGION 1..1151: note = Description of Unknown:uncultivated organism sequence
  REGION 1..1151: note = Category: MG26 effectors
  REGION 1..1151: note = Description: MG26-10 effector
MLESFKDLYEVRKNASFRLEPQENAVTNENLYNQDVDLSEILSKYKNFVYDLKNLLYIEGEKVTEEESDEEPSFTSKPFSRIFANLDLWVLQSNTENKEKDNDLSVDKLDSSNVVHINHKYLSKYFSKEFFENYDRIIKRNKHWAKTKNWTTIGNNNFLEVFFRSFFNDAFENINKLQELIDTKENEQKRKADIAFEIRRLLSRNHLWKIFPLFKGGYLTHKNDIKTIPELTNQAKELKELLDNAKIYFLEDSNFWVQVEHISLNYYTRNKTQKEYDELIKGKKKLLDSPYNKDISELYWIDRNLPIKQLYEEMKMFKARQKSAFFQQLQNKTPFEKFKEPFTFIDNEWIKHKEFRTELFFDVEEKYYNEMLILTKKIEKSGSKELKKERGNFLMFQDKWTKSFKWWSWFCSEYKKVAMEYWKRKAESLSLEREKILTEQERWWWVFSKVNNEFYINTFPIDKVKGAYQSLSEKQNDWELSYFILSSITLRALNKLCFSKDSKFINKEILIKLDNEFLKEKEYNNKTKEIVLRKKSDLTELVLIKLYYNVLELQNSLRISYKNSDSFDKLKSSKNLEEFEINLKNETYKLEEFKTTEDEFNKILKSNEWKSYKIINKEKWNFEKWWKNFWNSSKDWEIRINPELNISLRKWNEDYNDKISFHRKKYDVYLLNVNFSHFANRSYIDSSFIEDDKRKENLKKFNDLYNKNIKLNYFYWLDKWTNELITLGLFKKEWGKIKSVNISKEIPVYRITRKWLLHSKVTFKKAPKEWQNPKTIHTLYKNPSLFIDELDNEEIFEKVNTESCLWNLNSAKLIKWNIILNWDILTNLNLHKLSAKRKLYIAITEWKTIIKNIWFDEKEQENWAFFYEYINKGKTEKEPVFYINEEFLTIVSLDELKNELNEYIKYIKNEPNEYKKYMWNNALDTDISMLAINKIKNALCANIIGIIMKLQEKFPGYVCFESLSNDNNNRDMEKEHSFLWNLINDKLYSKLNINASVPPILKKFRSELKNSYYQYGQVIYVNEDSTSSACPVCNDKFIKWINKKWNLEEYKKNKLYGHLTESESSMHHLTDDEYNKKYDNNDKFREKHTNDKGKKKDNIYRSWNWCNYHMKDNPKWFDFIKSWDDLATYNIAKKALEYLEYLESQNNDETK

SEQ ID NO: 135 - protein, 1112 aa, unidentified
  REGION 1..1112: note = Description of Unknown:uncultivated organism sequence
  REGION 1..1112: note = Category: MG26 effectors
  REGION 1..1112: note = Description: MG26-11 effector
MNKFTKPYEVRKSIKFKLIPEIQKRPHSIPDYELELSELLDSYKGLIENLINFFYSEKEVVESKKSKFSNLKWFKEAFANFDFDEAEEKVFDLKNKEFSKMPRFKHMFFKENFKEDWYAIKDRLIKKNKTKNYEILDSLPFFQKVLKDFFEKLEQLYKELDEIISSPDNASKRKSDLRFVLQKISWNEVFKKIIKLFSLWFVDHKNDVEIVWKISEELWEFSEKIQNAIELLRVNDSFWFPVEYLSLNYYTINKTPKEYDKEITEKQNNLEKLYEWGLSELYWIDKNQTIEQLRNDMKMFKARQKSAFLQQLQNWVPFEEFQKLDFTDNKWELHKDYEILLFNDIGNDKYGEMLEITEKIAKEQDKDKRKGLKEKRWKYFIHHCKKYNKFCDEFKKVAIQYWKLKAEKLSLEREREQARFERWLAILSKDLDWNYYINSFSNNDSKNAFEKLKNINSTSGDYSYFIMKSITLRALQKLCWKENFKKTVVNKISEKFTKVNENDTGRQVRKFKSFEEIGNNIVEFYVDILDKQRTLDVSYRSWYEEWLKKLKWAKDLDELEILLKQETYTLEEHKISKNDFEEILEDYNWNSYKITSEDLEKNIETNNFTKWWNIFWTTENKEHKYISRLNPELVISLRAWEKVFKDRKKHRKSDKSFLLTMSYSHYTDKSYIDDAFIKDEERKSSLEQFNKHYNENHKFDYIYWLDKWTNELVTLWIFKKVWDKLEKVNISEKIPVYRITEKWLKYSKKYSTIVEWLNWEREIFLYKNPSLFIDEIDNEELFEKVDIDSCIWNLNCAKLIKWNIILNWDINWFLSLSKIAAKRKLYLAITEWKIRWDTVVFGYENGNKYIWYKYENRWKIDENPVFFLESFTDIVSEREFEIEFNEYIKLVKNHNSKEDVSISWINKKRVAISWNIVWIMMKLQEFFPWYIAWEAITIKTNEEDSKKNHSFLWNMVNDKIYQKLMLSLDVPPILKKYRSEIKDKEYLQHGKIFYVNKESTSSACPNCNNTLTITNNWWQFEDKTEEYVSKLFWHISQYENEMHHINDKSDQNYEKKWESWILEDGSICDYNMKHNPKWFDFIRSWDDLATYNIAKKAKEYLEFLEKQKNNNS

SEQ ID NO: 136 - protein, 1112 aa, unidentified
  REGION 1..1112: note = Description of Unknown:uncultivated organism sequence
  REGION 1..1112: note = Category: MG26 effectors
  REGION 1..1112: note = Description: MG26-12 effector
MNKFTKPYEVRKSIKFKLIPEIQKRPHSIPDYELELSELLDSYKGLIENLINFFYSEKEVVESKKSKFSNLKWFKEAFANFDFDEAEEKVFDLKNKEFSKMPRFKHMFFKENFKEDWYAIKDRLIKKNKTKNYEILDSLPFFQKVLKDFFEKSEQLYKELDEIISSPDNASKRKSDLRFVLQKISWNEVFKKIIKLFSLWFVDHKNDVEIVWKISEELWEFSEKIQNAIELLRVNDSFWFPVEYLSLNYYTINKTPKEYDKEITEKQNNLEKLYEWGLSELYWIDKNQTIEQLRNDMKMFKARQKSAFLQQLQNWVPFEEFQKLDFTDNKWELHKDYEILLFNDIGNDKYGEMLEITEKIAKEQDKDKRKGLKEKRWKYFIHHCKKYNKFCDEFKKVAIQYWKLKAEKLSLEREREQARFERWLAILSKDLDWNYYINSFSNNDSKNAFEKLKNINSTSGDYSYFIMKSITLRALQKLCWKENFKKTVVNKISEKFTKVNENDTGRQVRKFKSFEEIGNNIVEFYVDILDKQRTLDVSYRSWYEEWLKKLKWAKDLDELEILLKQETYTLEEHKISKNDFEEILEDYNWNSYKITSEDLEKNIETNNFTKWWNIFWTTENKEHKYISRLNPELVISLRAWEKVFKDRKKHRKSDKSFLLTMSYSHYTDKSYIDDAFIKDEERKSSLEQFNKHYNENHKFDYIYWLDKWTNELVTLWIFKKVWDKLEKVNISEKIPVYRITEKWLKYSKKYSTIVEWLNWEREIFLYKNPSLFIDEIDNEELFEKVDIDSCIWNLNCAKLIKWNIILNWDINWFLSLSKIAAKRKLYLAITEWKIRWDTVVFGYENGNKYIWYKYENRWKIDENPVFFLESFTDIVSEREFEIEFNEYIKLVKNHNSKEDVSISWINKKRVAISWNIVWIMMKLQEFFPWYIAWEAITIKTNEEDSKKNHSFLWNMVNDKIYQKLMLSLDVPPILKKYRSEIKDKEYLQHGKIFYVNKESTSSACPNCNNTLTITNNWWQFEDKTEEYVSKLFWHISQYENEMHHINDKSDQNYEKKWESWILEDGSICDYNMKHNPKWFDFIRSWDDLATYNIAKKAKEYLEFLEKQKNNNS

SEQ ID NO: 137 - protein, 1112 aa, unidentified
  REGION 1..1112: note = Description of Unknown:uncultivated organism sequence
  REGION 1..1112: note = Category: MG26 effectors
  REGION 1..1112: note = Description: MG26-13 effector
MNKFTKPYEVRKSIKFKLIPEIQKRPHSIPDYELELSELLDSYKGLIENLINFFYSEKEVVESKKSKFSNLKWFKEAFANFDFDEAEEKVFDLKNKEFSKMPRFKHMFFKENFKEDWYAIKDRLIKKNKTKNYEILDSLPFFQKVLKDFFERSEQLYKELDEIISSPDNASKRKSDLRFVLQKISWNEVFKKIIKLFSLWFVDHKNDVEIVWKISEELWEFSEKIQNAIELLRVNDSFWFPVEYLSLNYYTINKTPKEYDKEITEKQNNLEKLYEWGLSELYWIDKNQTIEQLRNDMKMFKARQKSAFLQQLQNWVPFEEFQKLDFTDNKWELHKDYEILLFNDIGNDKYGEMLEITEKIAKEQDKDKRKGLKEKRWKYFIHHCKKYNKFCDEFKKVAIQYWKLKAEKLSLEREREQARFERWLAILSKDLDWNYYINSFSNNDSKNAFEKLKNINSTSGDYSYFIMKSITLRALQKLCWKENFKKTVVNKISEKFTKVNENDTGRQVRKFKSFEEIGNNIVEFYVDILDKQRTLDVSYRSWYEEWLKKLKWAKDLDELEILLKQETYTLEEHKISKNDFEEILEDYNWNSYKITSEDLEKNIETNNFTKWWNIFWTTENKEHKYISRLNPELVISLRAWEKVFKDRKKHRKSDKSFLLTMSYSHYTDKSYIDDAFIKDEERKSSLEQFNKHYNENHKFDYIYWLDKWTNELVTLWIFKKVWDKLEKVNISEKIPVYRITEKWLKYSKKYSTIVEWLNWEREIFLYKNPSLFIDEIDNEELFEKVDIDSCIWNLNCAKLIKWNIILNWDINWFLSLSKIAAKRKLYLAITEWKIRWDTVVFGYENGNKYIWYKYENRWKIDENPVFFLESFTDIVSEREFEIEFNEYIKLVKNHNSKEDVSISWINKKRVAISWNIVWIMMKLQEFFPWYIAWEAITIKTNEEDSKKNHSFLWNMVNDKIYQKLMLSLDVPPILKKYRSEIKDKEYLQHGKIFYVNKESTSSACPNCNNTLTITNNWWQFEDKTEEYVSKLFWHISQYENEMHHINDKSDQNYEKKWESWILEDGSICDYNMKHNPKWFDFIRSWDDLATYNIAKKAKEYLEFLEKQKNNNS

SEQ ID NO: 138 - protein, 752 aa, unidentified
  REGION 1..752: note = Description of Unknown:uncultivated organism sequence
  REGION 1..752: note = Category: MG26 effectors
  REGION 1..752: note = Description: MG26-14 effector
NIMEKMQNLYEVRKSLRFELKPISDNIKFLESNKSIVLDNFGTLILEHKKFINLLSETLFYKEVENLIEKEEKIQNVFWKFFSENNFEINKEIEENKQEDFSEYEIYKTVYFKYQWVQKIFKSEWIENKKDITLQKKYWDFIIDEETWRYKKQNKNYMTMWTLWNKNFIRPYFEELLTNNLNSNKKLENLNRQENLLARKSDISFEIQKINSKDFLWNLYILLEWWYLDHKNDVNVIKELKKQLSKIKELINDLLLLLKPSQSFWIVVDNISLNYYTRKKTPKDYDEEIRKKEVWLKNKYNWKLWKLYWINENQWIKELYEEMKTFKANQKSAFLQLLQDKSSYIDFTKLFLEKEDKNKKYFTFKDNKEIEHKNFELKLFDDISKENYDKMLNLTNQIEKESDKQKRTKLKEKRGRHFMSKSSCAKYINFCNEYKKVAMEYGKRKALVLSLQREQIESQKERWWGIISTDWKNHFLNTISIKNTEIAKNIFQKEIYRKQDEIKYYTFSSITLRALEKLCFKKESKFISNIINSLNTEFKVFVDFWKEKKDILNFELINESEKNKIDFLNNILENQNTLWIIYRDLEKSKDILKKSKTIDEFEINLKKETYVLDTYFMSKIDFEENIKKIDWKVYEITSWDLIEKRNNSEFQTKTWFEFWSKENKENKFPIRINPEINIWYIEKNETWQKEEKNKNQTNNRRNRNRFLMMSTVSYKADKKYINNAFIKDEERIDNIQKFNEIFNENNKYDYFY

SEQ ID NO: 139 - protein, 1283 aa, unidentified
  REGION 1..1283: note = Description of Unknown:uncultivated organism sequence
  REGION 1..1283: note = Category: MG26 effectors
  REGION 1..1283: note = Description: MG26-18 effector
MSHLFNRFTNLYSLSKTLRFELKPVGETQKMLEDAKIFEIDKVRKEKYEATKPYFDRLHREFVEKALENAEISNLSGYFEIFKKWKKDKKAHEKELQNKEKTLRKEVVSLFDAQAKSWTEKYPGLKKKDIGILDEEGVFEQILKVRYGSEDESFLREADGNFILDDEGEKISIFDEWKGFTGYFKKFFETRKNFYKSDGTSTALATRIIDQNLKRFCDNMENFEKIKKKIDFSEVEKDFGESMNEVFSVSFYNSCLLQEGIDFYNKVLGGETLKNGEKLKGLNELINKYRQDHKGEKIPFFKLLDKQILSEKEKFIDEIERDDQLLEVLKDFYQSAEQRTKVLKALFKDLVSHEKNYDLSQVYLSKEALNTISHKWTGETELFEGQLYEVLRKSKEDSVKPKKKDRGYSFPDFIPLCYIQEALQKISAKKFWKERYYNEISGFSEENIWKQFLAILDFEFSSLFKRKVTNSETGEVMQLGYDVFKNDFKPLLQNFKNDQKAKVIIKNFADEVLRIYQMAKYFALEKKRKWERKWVGDDHKPGNFYDDPDFGFKINFYDNAYEEIVQPYNKLRNYVTKKPYSEEKWKLNFENPTLADGWDKNKESDNSAVILKKGEKYFLGLMAKGYNKIFDDRFSEEFSENITQEKYEKMNYKLLPGANKMLPKVFFGKSNIDFYNPSEKVLEIRNHSSHTKSGAPQKGFEKKEFNLNDCHILIDFFKKSIAKHPDWKVFDFHFSETSKYSDISDFYREVEEGGYKISFQDISGAYINQKNEAGELYLFQIKNKDWNEGSTGRKNLHTLYFESLFSKENIQQNFPFKLNGQAEIFYRPKTDVQKLGTKKDKRGKEVINHKRYNENKIFFHVPLTLNRTQGDARQFNSKINQFLANNPQINIIGVDRGEKHLAYYSVINQKGGILDSGSLNKITGVNYAEKLEEKAKSREQARKDWQTVEGIKDLKKGYISQVVRKLADLAIEHNAIIVFEDLNMRFKQIRGGIEKSVYQQLEKALIEKLNFLVNKGEKDPNQAGHLLKAYQLAAPFTTFKEMGKQTGILFYTQAAYTSKIDPITGWRPHLYLKYASAEKAKKDIDKFSKIEFKQGRFEFTYDIKKFRELKKSPKNTIWTVCSNVERFRWNRHLNNNKGDYDHFKGVTDKLMKLFNEYKIDFQRGDILGQVDSLETKGNEKFFKDFIFLFNLICQIRNTDDSEKAKREGKDDFILSPVEPFFDSRKENGANLPKNGDDNGAYNIARKGVILLNKLSEHLKKDPDFKKYPELYISNTEWDDFARK

SEQ ID NO: 140 - protein, 1302 aa, unidentified
  REGION 1..1302: note = Description of Unknown:uncultivated organism sequence
  REGION 1..1302: note = Category: MG26 effectors
  REGION 1..1302: note = Description: MG26-19 effector
MKKEKQFSPFEKFTNLYSLSKTLRFELRPTEETKTMLEEAQVFAKDEVIQKKYEATKPYFNRLHREFVDEALLNVKINGLSYYFQTLQEWQKDKKNKDSKKIYEKKTQELRKQIVKFFDDKANEWASYYDKRQIEYADKKAIKIKFVDDSGKKISGTKIFSSKGVLGILLDKFPEAKNDLYVFCDGFFGYYDKFKKTRENFYKDDGTSTALATRMIDQNLKRFCDNLALFENIKEKVDFSEVEQNFGVVLTQVFSLEYYNQCLLQNGIDGYNDILGGKPLKNGKKKKGLNECINLYKQKTGEKLSFFKTLDKQILSEKERFLDEIKSDEKLLEVLKNFEKTAEEKIPLLKNLFADFVENNENYDLSQIYIEKKQFDPNSCKWIDKSSIDNFQQSLYEVMKKEKLAKYDKKEESYKFPDFIALSYIKTALENGKSEGNFWKEKYYEISGFSEKTFWEQFLAIFSFEFSSLLGREITNQETGEKKMTGYNPFKRTFEALLQNFKVDQNAKIVIKDFADSVLTVYQMAKYFAVEKKRAWLAEYDLDSFYTHPEMGHLKFYDNAYEDIVQVYNDLRNYLTKKPYSEEKWKLNFENPTLANGWDKNKESDNSAIILRKNGEYYWGLMVKGYNKIFDDRYQEKFTDGLNEGKYEKIVYKFFPDQAKMFPKVCFSAKGLEFFKPSEEIWNIYQNDEFKNGDTFSVQSMQKFIDFYKDCLAKYEGWECYDFCHLKSTKSYQDNIGEFFRDVAEDGYKITFQDISEKYINEKNQKGELYLFEIRNKDWNLDKAREGKIKTTQKNLHTLYFESLFSAENIARNFPMKLNGQAEIFYRPKTEQGKLGIKKDKQGKEVTNHKRYNENKIFFHIPLTFNRTKNDPYRFNAQVNNFLAQNPSINIIGVDRGEKHLAYYSVITQNGEILDSGSLNSIGGVNYAEKLEEKAKNQEQAQKDWQAVEGIKDLKKGYISQVVRKLADLAIKHNAIIVFEDLNMRFKQIRGGIEKSVYQQLEKALIEKLSFLVNKGETNATKAGHLLKAYQLSAPFTTFQDVGKQTGIIFYTQAAYTSRIDPISGWRPHLYLKYSSADKAKEDILKFSKIEFINNRFEFTYDIKKFQQAKEYPKNTVWTVCSNIERFRWDKNLNNNKGGYTHYPNITDGKSENRNPKSTKPNNFKELFEKYVIDIARDIKEQIRLLEPKGNEKFFEHFIFFFNLICQIRNTDDSEQAKKTGKDDFIFSPIVPFFDSRKENEKNLPKNGDDNGAYNIARKGILILQKISEFYKEKGGCEKMNWGNLYVSNNDWDDFIKIKPHN

SEQ ID NO: 141 - protein, 1293 aa, unidentified
  REGION 1..1293: note = Description of Unknown:uncultivated organism sequence
  REGION 1..1293: note = Category: MG28 effectors
  REGION 1..1293: note = Description: MG28-1 effector
MKAFENFTGLYSLTKTLRFELKPIGKTLEYIEKNGLLDRDRHRANSYVEVKKIIDRYHKQFIEDSLRNFKLTYENEGKKDSLEEYFYHYKLRNRDDKQKKDFDEIQKNLRKQIASQFKKQDRFKRIDKKELIKEDLLEFVDNNEKKFIDEFRDFTTYFTGFHENRQNMYSEEEKSTAIAYRLIHENLPKFIDNISVFERVAVTDVANCFVQIYSDFEEYLNVNDISEIFRLDYYTEILTQAQIDVYNLIIGGCSQGDVKIKGLNEYINLYNQQQKDKSQRLPKLKPLFKQILSDRNAISWLPESFKSDNELLENLENCYQSYNEANVDKKSIFLRLKELLVSMSNYEIDKIFVRNDSQLTDISQKMFGNYNVISKSLLEDLKRSEPRKSKKETDESFEERLRNIIKNEESFKIERINSSLQKMDIDEYKKSVCDYYAGLAVDDKGNDIFDRIEKAYSEVKDLLNSPYPSDKNLIQEDKDIDKIKNLMESIKELHRFVKPLCGKGNEPDKDDRFYGEFTILYEELDKITPLYNMVRNYLTRKPYSTEKVKLFFENNGAMLNGWVDSKTENSDNGTQYGGYLFRRKNGIEEYDYYLGISSDVKLFRKDTIIAEHDKSDFERLDYYQLKSQTFYGSAYKGDYELETQNVIKAIDNFISKNGETDISEKIISDRANKNSKTGTAKGYLNFIKNTSIYDDLLNDDIFKNANDQLINSLKKTLMSFERLSTARKIANDNFNLFSDLMDAVDVLMQEKVFTYNAVSINEFESTINRDKKPLLLFKITNKDLSFADTFLSGKRKSRGVENLHTLYFKALMSGKQNVFDIGTGSVYFREKSIRYSEEKMKYGHHYDMLKDKFQYPIISNKRYVYDKFQFHLSMVQNYNGNKNLDINTIANDYIKKSDDLHVIGIDRGERHLLYLTVIDMKGNIKKQFSLNEIVNNYNGNTYRTNYRDLLDDREKKRDEERKSWRTIETIKELKEGYLSQVIHKISELMIEYNAIIVLEDLNLEFMRGRQKVEKSVYQKFEKMLIEKLNYLADKKKDPEDLGGILKAYQLTNELKKDGKQSGFLFYTQAWNTSKIDPVTGFVNLFDTRYENIAKSKTFFEKFDSIRFNTEKNWFEFSFDYNEFTTKAEGTKTKWTICTYGKRIESYRNPDKNLQWDGKEINLTEEFKLFFEKYGININSNLQSEIVKQDKKDFFEGLLHLLKLTLQMRNSKTGTDIDYMQSPVADENGIFYNSDECGKSMPENADANGAYNIARKGLMIIDKIKKSKDIKKIDLKISNKEWLSFAQNKPYLND

SEQ ID NO: 142 - protein, 846 aa, unidentified
  REGION 1..846: note = Description of Unknown:uncultivated organism sequence
  REGION 1..846: note = Category: MG28 effectors
  REGION 1..846: note = Description: MG28-2 effector
DSFSMAQINNWLTDYMGDTYKSIESYFIALGAEDDGNTQKPNLFIRIENAYTEAKSLLTKVYPKDRKLSQDKINVEKIKNLLDAIKNLQHFVKPLLGRGTESEKDSRFYGDFTPLWETLEQITPLYNMVRNRMTEKPYSDEKIKLYFDNNGSFLNGWVDSKTESDNATQYGGYLFRKLNSIGEYDYYLGVSAATKLFRSFNPVADNDKSCFERLDYYQLKGKTFYGALYKGDYETESANIRHSIDDVVCRSGSTLIKEKINIERQKKQPKISTAIGYLKFIRQQDGELYSTLLKDDIFEEANQAIMVSMKATLSSLDRIPFAKEYALRHYILFADMMDDIEVLLQGKVFSYFPISQNELDEAVTRISKPLYLFKITNKDLSFAETHEKGLRKSRGIENLHTMYFKALMSGCQDVFDIGSGSVFFREHKISYTDEQMKRGHHYEMLKDKFNYPIISNKRYAIDKFQFHISITMNYNADKSKDINYITNAYLKKSNDTHIIGIDRGERHLLYLSLIDLQGNIIDQFSLNEIVKEYNGKTYCTNYHALLDAKENQRDEARRSWQTIENIKELKEGYMSQVIHKIVDLMIKYNAIVVLEDLNLGFKRGRQKVEKQVYQKFEKMLIDKLNYLVDKKLDANEAGGVLRAFQLTNKFESFQKLGKQSGFLFYIPAWNTSKMDPTTGFVNLLDTRYENMAKAKAFFGKFKSIRFNNSKNWFEFSFDYNDFTTKAEGTKTQWTICTYGTRIENKRDPMQNNNFVSEEFELTNRFKDLFANTKYNIDLNGNLIEQICSQSDASFFKELLHLMNLTLQMRNSVVGTLIDYMISPVSNANGEFYDSRKCGKNLPENAD

SEQ ID NO: 143 - protein, 898 aa, unidentified
  REGION 1..898: note = Description of Unknown:uncultivated organism sequence
  REGION 1..898: note = Category: MG28 effectors
  REGION 1..898: note = Description: MG28-3 effector
LKSRIFEGDDSLRNLLKNLGEYDLEHVFIPVDIHLTEISQKYYGNWSLIKKAMEDDVKAKNPQKRNETTEKYEERIEKLLKTNESCSLAQINRLMKFYLGDEFKPIELYFVGLGAEDNENGQKPNVFVLIENAYAEASSLLTSPYPTDRKLSQDKISVDKIKTLLDAIKDLQHFVKPLLGKGGESEKDNRFYGEFTPLWEILDQITPLYNMVRNRMTQKPYSEEKVKLNFDNSTLLAGWDLNKEADNTCTILRKDGNYYLAIMDKKYNKVFRQECLVASGDCYEKMEYKLLPGANKMLPKVFFSKSRINEFNPSDKLMQNYEKETHKKGENFNVDDCRALIDFFKKSIDKHEDWSKFDFHFSDTKKYDDLSGFYREVEQQGYKISFRNVSVAYINRLVDEGKIYLFQIYNKDFSTYSKGTPNLHTMYWKMLFDERNLADVVYKLNGEAEVFFRKHSIDVDKPTHPANVPIDNKNKLNAKKSSVFEYDLIKDRRYTVDKFQFHVPITLNHKAAGYSSINSLVNTYLKESKATHIIGIDRGERHLLYLSLIDMNGNILEQYSLNEIVNEYKGNTYRTNYHDLLDAKEKQRDEARRSWQTIENIKELKEGYMSQVIHKVAELMVKYNAIVVLENLNTGFMRGRQKVEKQVYQKFEKMLIDKLNYLVDKKCDPNELGGVLNAYQLTNKFESFQKVGKQSGFLYYIPAWNTSKMDPTTGFVNLLDTRYENLPKAKSFMGKFKSIRFNPTKNWFEFAFDYNDFTTKAAGTRTQWTLCTYGTRIETKRDPKQNNMFVSEEFDLTNRFKQLFADMDLNGNLMEQISSQNDVAFYKELLHLLHLTLQMRNSITGTEVDYMISPVMNDQGEFYDSRNCGKSLPENADANGAYNIARKGLWIIDQIKRA

SEQ ID NO: 144 - protein, 779 aa, unidentified
  REGION 1..779: note = Description of Unknown:uncultivated organism sequence
  REGION 1..779: note = Category: MG28 effectors
  REGION 1..779: note = Description: MG28-4 effector
LWETLEQITPLYNMVRNRMTEKPYSDEKIRLYFDNNGSFLNGWVDSKTDSDNANQYGGFLFRKLNSIGEYDYYLGVSAATKLFRSFNPIDDSDKSCFERLDYYQLKGKTFYGALYKGDYETESANIRHSIDDVVCRSGSTLIKEKINIERQKKQPKISTAIGYLKFIRQQDDELYNILLKDDIFEEANQAIMVSMKATLSSLDRIPFAKEYALRHYILFADMMDDIEVLLQGKVFSYFPISQNELDEAVTRISKPLYLFKITNKDLSFAETHEKGLRKSRGIENLHTMYFKALMSGCQDVFDIGSGSVFFREHKISYTDEQMKRGHHYEMLKDKFNYPIISNKRYAFDKFQFHISITMNYNADKSKDINYITNAYLKESNATHIIGIDRGERHLLYLSLIDLQGNIVEQFSLNEIVKEYNGNTYCTNYHALLEAKENQRDYARRSWQTIENIKELKEGYMSQVIHKIVDLMIKYNAIVVLEDLNLGFKRGRQKVEKQVYQKFEKMLIDKLNYLVDKKLDANEAGGVLRAFQLTNKFESFQKLGKQSGFLFYIPAWNTSKMDPTTGFVNLLDTRYENMAKAKAFFGKFKSIRFNNSKNWFEFAFDYNDFTTKAEGTKTQWTICTYGTRIENKRDPMQNNNFVSEEFELTNRFKDLFANTKYNIDLNGNLIEQICSQSDASFFKELLHLMNLTLQMRNSVVGTTIDYIISPVANANGEFYDSRNCGKNLPENADANGAYNIARKGLWIINQIKQTEDLTKVKLSISNKEWLQYAQKQINNT

SEQ ID NO: 145 - protein, 1303 aa, unidentified
  REGION 1..1303: note = Description of Unknown:uncultivated organism sequence
  REGION 1..1303: note = Category: MG28 effectors
  REGION 1..1303: note = Description: MG28-5 effector
MHTYSEFTGLYQLSKTLRFELKPIGKTKENIERNGILERDKERDVAYKKVKKVIDEYHKAFIEQMLDDFELNLKNEGNMDSLEEFYFLYHLPTTDPKRKDDLNNVQEALRKQISERFTKSEQYKRLFGKELIREDLINEFVNTTKGSAYIRAQNGNETLGDDEVLQKQEELATEVARFKDFTGYFDGLKKNRENMYVADDETTSIAHRMITENLPKFIDNMDVFEKIVASEVATHFDEVYKVFEPYMNVYSINEMFRLDYFSMVLTQKQIDVYNAIIGELNKHTNLYNQQQKNNNLPKLKPLFKQILSERNAISWLPDEFGSDNEMLQSIGKCYQDLKERVFGSLKTLLENIKDYELEQIYLPNDLQLTDIAQKHFGSWEVIKNAVREETKKLNPQKNRESTEKYEERIGKLLKANESYSIGFINSLLKNRIDDFKPLEEYFTEMGAEDNGNEQKLNHFSRIENAYTEVKTLLNVDYPEGKTLSQDKANVEKIKNLLDAIKDLQHFVKPLLGKGTESEKDPLFYGEFVPLWESLDQITPLYNMVRNRMTQKPYSDEKIRLYFDNNGYFLRGWVDSKTESDKATQYGGYLFRRRNSIGEYDYYLGVSSATKLFRSFNLVTEEDKSSFERLDYYQLKGNTFYGSLYKGNYEQESSNIKHALDVFVSKHGCAFVKQKINVEKGKKQPKVSTASGYLKFIEQLDIELYDSLLKDEVFKKSNQEIMSSLRATLLSLDRIPSAKEYAHKKFTVFSEMMDDIDIMLRGKVFSYFPISRKELDEAVNRKTKPLYLFKITNKDLSFAETYEKGLRKSRGAENLHTMYFKALMSGNQNVFDIGSGSVYFREHKIDYSEEQLKKGHHYEMLKDKFAYPIISNKRYAYDKFQFHLSVTMNYNADKNKDINPLVNAYLKESKATHIIGIDRGERHLLYLSLIDLKGNIVEQYSLNEIVNEYNGGFYRTNYHDLLDSKEKQRDEARRSWQTIENIKELKEGYMSQVIHKIAQLMVKYNAIVVLEDLNPGFMRGRQKVEKQVYQKFEKMLIDKLNFLVDKKLDAEEIGGVLNAYQLTNKFESFQKQGKQSGFLFYIPAWNTSKMDPTTGFVNLLDTRYENMEKTKVFFGKFDSIKYNSAKDWFEFAFDYDNFTTKAEGTKTKWTLCTYGTRIETKRDPKQNNSFVSKELDLTSRFKELFADNHIDLNSNLKEHICSQSDAAFFKGLLNLVHLTLQMRNSITGTETDFLISPVMNAKGEFYDSRKCGKNLPENADANGAYNIARKGLWIIEQIKQTEDLSKLKLAISNKEWMRYTQGLE

SEQ ID NO: 146 - protein, 780 aa, unidentified
  REGION 1..780: note = Description of Unknown:uncultivated organism sequence
  REGION 1..780: note = Category: MG28 effectors
  REGION 1..780: note = Description: MG28-6 effector
MKEFTKLYPLSKTLRFELKPIGKTKDNIEKNGILERDSERAVAYKAVKKVIDEYHKSFIELKLADFELMQSQLEEFYLLYLLPTSEQKRKTDLPKVQESLRKQISDRFTKDDYYKRLFGKELIREDLTEFVNTPYYENIIRSIPGNEQLTDEEVKEIQENTQREISQFNDFTTYFVGFYDNRRNMYVAEDKATSIAHRMIDENLPKFVDNMDVFEKIAASDVAQHFGELYKAMEPYLNVCEIADLFKLNYFSMVLTQTQIDVYNAIIGGKTLDDGTKIQGLNEYVNLFNQQQKDKANRLPKLKPLFKQILSERNAISWLPDEFENDNEMLQSIEKCYQDLKAQVFEGEHSLKILLGSIGDYDLEHIYLPNDLQLTDISQKHFGSWSAIKNAVVEDIQSANPKKKTESGEKYDERISKLLKENDSFSIAYINRLMHSALDDSKPIESYFAQMGAEDNENCQKLNHFARIENAYTEIKSLLNTEYPSGKSLSQDKANVEKIKNLLDAIKDLQHFVKPLLGSGRESEKDNRFYGEFVPLWETLDQITPLYNMVRNRMTKKPYSEEKIKINFDNSTLLAGWDLNKESDNTCTLLRKDGNYYLAIIDKRHNKVLKPENLISDGECYEKMEYKLLPGANKMLPKVFFSKSRIAEFNPSETLVKNYENETHKKGDKFNLDDCHALIDFFKESIKKHEDWSKFGFKFSDTSSYEDLSGFYREVEQQGYKITFRNVSARYIDQLVDEGKIYLFQIYNKDFSPFSKGTPNMHTLYWKALFDERNLTDVVY

SEQ ID NO: 147 - protein, 1339 aa, unidentified
  REGION 1..1339: note = Description of Unknown:uncultivated organism sequence
  REGION 1..1339: note = Category: MG28 effectors
  REGION 1..1339: note = Description: MG28-7 effector
MKNLKQFVGLYPVSKTLRFELKPVGNTKENIERNGILEKDNQRAVGYKAIKKVIDEYHKAFIEQMLNEFELNLSNDGNLDSLEEFFLLYHLSSNDPTRDNITKVQESLRKKISERFTKSEQYKRLFGKELIREDLAQFVETPRYESFIRSQKGNENLSDDEVRQIQNEIIQEIGQFRDFTTYFSGFYENRKNLYVADDKATSIANRMINENLPKFIDNMDVFEKIAASEVAIHFDTLYKEMEAYLNVKSIEEMFQLDYFSIVLTQKQIDVYNSIIGGKTLEDGTKILGLNEYVNLYNQQQNNKDNRLPKLKPLFKQILSERNAISWLPDEFASDNEMLESIERCYQDLRKQVFEGENSLKELLKGIVDYDLEHIYLPDDLQLTNISQKHYGNWSVIKKAHEEYLRKEMQENLMVNKPQRRNESDENYQERIQELLKTKKYEESIEKQLKVNDSFSLAQINRLMSIYQGEDSKPIELYFATMGAEEIGNEKKPNLFIRIENAYTEVKTLLTTAYPKDRKLSQDKANVEKIKNLLDAIKNLQHFVKPLLGKGTEGEKDNHFYGEFTPLWEALDQITPLYNMVRNRMTQKPYSDEKIKLYFDNNGSFLNGWVDSKTESDNATQYGGYLFRKRNSIGEYDYFLGVSAATKLFRSFNSVEASDRSSYERLDYYQLKGKTFYGTLYKGNYETESANIRHAIDNLVYHAGSISIKEKINAERMKKQPKVSTAIGYLKYIMQQDCELYDILLKDDTFEKSNQAIMASMKATLLSLDRIPSAKEYAQRNYKLFSEMMDDIDMLLQGKVFSYFPVSQRELDETVNRTTKPLYLFKITNKDLSYAETHEKGLRKSRGSDNLHTMYFKALMSGCQDVFDIGSGSMFFREHKLVYTEDQLKKGHHYDMLKDKFNYPIVSKKRYAFDKFQFHLSVTMNYNSNKSKDINPMVNDYLKESNATHIIGIDRGERHLLYLSLIDLNGNIIEQYSLNKIANEYKGNIYRTDYHELLDAKEKQRDEARRSWMSIENIKELKEGYMSQVIHKIAELMVKYNAIVVLEDLNLGFMRGRQKVEKQVYQKFEKMLIDKLNYLVDKKIDANVLGGVQKAYQLANKFESFQKLGKQSGFLFYIPAWNTSKMDPTTGFVNLLDTRYENMAKAKAFFAKFKSIQFNAIKGWFEFAFDYDDFTTKAVGTKTQWTLCTYGTRVETKRDAKQNNMFVSEEFNLTSKFKELFVLYKIDLNENLREQICSQSEAIFFQKLLHLLRLTLQMRNSITGTEVDYLISPVMNASGGFYDSRKCGKNLPENADANGAYNIARKGLWIIEQIKQSNDLSKLKLAISNKEWLRYAQGVD

SEQ ID NO: 148 - protein, 1339 aa, unidentified
  REGION 1..1339: note = Description of Unknown:uncultivated organism sequence
  REGION 1..1339: note = Category: MG28 effectors
  REGION 1..1339: note = Description: MG28-8 effector
MKNLKQFVGLYPVSKTLRFELKPVGNTKENIERNGILEKDNQRAVGYKAIKKVIDEYHKAFIEQMLNEFELNLSNDGNLDSLEEFFLLYHLSSNDPTRDNITKVQESLRKKISERFTKSEQYKRLFGKELIREDLAQFVETPRYESFIRSQKGNENLSDDEVRQIQNEIIQEIGQFRDFTTYFSGFYENRKNLYVADDKATSIANRMINENLPKFIDNMDVFEKIAASEVAIHFDTLYKEMEAYLNVKSIEEMFQLDYFSIVLTQKQIDVYNSIIGGKTLEDGTKILGLNEYVNLYNQQQNNKDNRLPKLKPLFKQILSERNAISWLPDEFASDNEMLESIERCYQDLRKQVFEGENSLKELLKGIVDYDLEHIYLPDDLQLTNISQKHYGNWSVIKKAHEEYLRKEMQENLMVNKPQRRNESDENYQERIQELLKTKKYEESIEKQLKVNDSFSLAQINRLMSIYQGEDSKPIELYFATMGAEEIGNEKKPNLFIRIENAYTEVKTLLTTAYPKDRKLSQDKANVEKIKNLLDAIKNLQHFVKPLLGKGTEGEKDNHFYGEFTPLWEALDQITPLYNMVRNRMTQKPYSDEKIKLYFDNNGSFLYGWVDSKTESDNATQYGGYLFRKRNSIGEYDYFLGVSAATKLFRSFNSVEASDRSSYERLDYYQLKGKTFYGTLYKGNYETESANIRHAIDNLVYHAGSISIKEKINAERMKKQPKVSTAIGYLKYIMQQDCELYDILLKDDTFEKSNQAIMASMKATLLSLDRIPSAKEYAQRNYKLFSEMMDDIDMLLQGKVFSYFPVSQRELDETVNRTTKPLYLFKITNKDLSYAETHEKGLRKSRGSDNLHTMYFKALMSGCQDVFDIGSGSMFFREHKLVYTEDQLKKGHHYDMLKDKFNYPIVSKKRYAFDKFQFHLSVTMNYNSNKSKDINPMVNDYLKESNATHIIGIDRGERHLLYLSLIDLNGNIIEQYSLNKIANEYKGNIYRTDYHELLDAKEKQRDEARRSWMSIENIKELKEGYMSQVIHKIAELMVKYNAIVVLEDLNLGFMRGRQKVEKQVYQKFEKMLIDKLNYLVDKKIDANVLGGVQKAYQLANKFESFQKLGKQSGFLFYIPAWNTSKMDPTTGFVNLLDTRYENMAKAKAFFAKFKSIQFNAIKGWFEFAFDYDDFTTKAVGTKTQWTLCTYGTRVETKRDAKQNNMFVSEEFNLTSKFKELFVLYKIDLNENLREQICSQSEAIFFQKLLHLLRLTLQMRNSITGTEVDYLISPVMNASGGFYDSRKCGKNLPENADANGAYNIARKGLWIIEQIKQSNDLSKLKLAISNKEWLRYAQGVD

SEQ ID NO: 149 - protein, 756 aa, unidentified
  REGION 1..756: note = Description of Unknown:uncultivated organism sequence
  REGION 1..756: note = Category: MG28 effectors
  REGION 1..756: note = Description: MG28-9 effector
MKQFTNLYQVQKTLRFELRPVGRTKENIEKNGILERDNLRAIGYKSIKKVIDEYHKAFIEMMLNDFKLNMADSGQFNSLEELYMLYHLPSNDPARKEKMVKVQEALRKSISDLFTKSEQYKRLFGKELIREDLEPFVRTLQFEEYIRSQKGNENLSDEEVHQIQDEVVQDIAQFRDFTTYFAGFYENRKNMYVADDKATSIANRMINENLPKFIDNMDIFEKIAASDVAKNFDVLYKEMEAYLNVNSIAEMFRLDYFSMVLTQRQIDVYNAIIGGKTEKDGRKIQGLNEYINLYNQQQKDKANRLPKLKPLFKQILSERNAISWLPDEFSSDNEMLESIGKCYQDLKAQVFDGESSLKALLKKINEYDLEHIYLPNDLQLTNVAQRWYGSWSVIQNAYTESLKTANPPKRNETTEKYEARIEKLQKAIDSLSLAQINRLMNGYLGEEYKPVEQYFSTMGAEDDGDVQKPNLFIRIENAYTEVQSLLRTSYPEGRSLSQDKANVEKIKNLLDAIKDLQRFVKPLMGRGTESEKDNRFYGDFAPLWETLDQITPLYNMVRNRMTQKPYSDEKIKLNFDNSTLLAGWDLNKETDNTCTLLRKDGLYYLVIINKQHNRVLMAENLSADGDCYEKMVYKQLGQISQQLPRIAFSNSWQQRISIPADVLRIKKTESFKTNNEDLQKLIAFYKYFISQHEEWNTFFKIKFTDKADYKNLPEFYSEVDSLFYSLNFSKVSVAYINQLVDEGKIYLFQIYNKDFS

SEQ ID NO: 150 - protein, 1271 aa, unidentified
  REGION 1..1271: note = Description of Unknown:uncultivated organism sequence
  REGION 1..1271: note = Category: MG28 effectors
  REGION 1..1271: note = Description: MG28-10 effector
MKSYSDFTGLYLLSKTLRFELKPIGKTKENIERNGILERDNQRAVGYKAIKKVIDEYHKTFIEQMFDSFELKLEDEGRMNSLEEFYFLYHLPITDTKRKDNLSKVQEALRKQISERFTKSEQYKRLFGKELIREDLAEFVKTPKYEEIIRSQQGNENLTEEEIRKIQEEVEKTIDQFYDFTTYFVGFYDNRKNMYVADDKATSIAHRMIGENLPKFIDNMDVFEKIAASDVATHFEALYKAMEPYLNVNSISEMFQLGYFSMVLTQKQIDVYNAIIGGMVLDDGAKIQGLNEYVNLYNQQQKDKSNRLPKLKPLFKQILSECNAISWLPDEFESDNNMLESIEKCYQDLKNQVFEGENSLKNLLKNIGEYDLEHIYLPDDLQLTDIAQKHYGNWSMIKKALEEDVKAKNPQKRNETVEKYEERIEKLLKANECYSLAQINRLMKVYLGDEYKPIETYFAALGAEDNENGQKPNLSIRIENAHTEASNLLISTYPVDRKLSQDKANVERIKNLLDAIKDLQHFVKPLLGKGTESEKDNRFYGEFVPLWERLDQITPLYNMVRNRMTQKPYSEEKIKINFDNSTLLAGWDLNKEADNTCIILRKDGNYYLAIMDKRNNKVFETKNLVSEGDCYEKMEYKLLPGANKMLPKVFFSKSRMDEFKPSAQLLRNYERGTHKKGDNFSLDDCHALIDFFKESIEKHEDWSKFGFKFSDTKTYEDLSGFYREVEQQGYKISFRNVSVEYINRLVDEGKIYLFQIYNKDFSTYSKGTPNLHTLYWKMLFDERNLADVVYKLNGEAEVFFRKHSIEAEKPTHLANKPIENKNKLNEKKTSVFEYDLVKDRRYTVDKFQFHVPITMNFKAAGLNNINPLVNVYLKESNVTHIIGIDRGERHLLYLSLIDLQGNIVEQYSLNEIVNEYKGNTYRTNYHDLLDAKERQRDEARRSWQTIENIKELKEGYMSQVIHKIAELMVKYNAIVVLEDLNFGFMRGRQKVEKQVYQKFEKMLIDKLNYLVDKKCEADEMGGVFNAYQLTNKFESFQKLGKQSGFLFYIPAWNTSKMDPTTGFVNLLDTRYENMAKAKAFFGKFRSIRYNAAKGWFEFAFDNDDFNTKATGTRTQWTLCTYGTRIETKRDPKQNSNFVSEEFDLASRFKDLFDQYDIDLKGNLMEQICSQNDAAFFKELLHLLHLTLQMRNSITGTEVDYLISPVMNDNGEFYDSRKCGKNLPLNADANGAYNIARKGLWIIEQIKQTEDLSKLKLAISNKEWMRYAQGLE

SEQ ID NO: 151 - protein, 1271 aa, unidentified
  REGION 1..1271: note = Description of Unknown:uncultivated organism sequence
  REGION 1..1271: note = Category: MG28 effectors
  REGION 1..1271: note = Description: MG28-11 effector
MKSYSDFTGLYLLSKTLRFELKPIGKTKENIERNGILERDNQRAVGYKAIKKVIDEYHKTFIEQMFDSFELKLEDEGRMNSLEEFYFLYHLPITDTKRKDNLSKVQEALRKQISERFTKSEQYKRLFGKELIREDLAEFVKTPKYEEIIRSQQGNENLTEEEIRKIQEEVEKTIDQFYDFTTYFVGFYDNRKNMYVADDKATSIAHRMIGENLPKFIDNMDVFEKIAASDVATHFEALYKAMEPYLNVNSISEMFQLGYFSMVLTQKQIDVYNAIIGGMVLDDGAKIQGLNEYVNLYNQQQKDKSNRLPKLKPLFKQILSECNAISWLPDEFESDNNMLESIEKCYQDLKNQVFEGENSLKNLLKNIGEYDLEHIYLPDDLQLTDIAQKHYGNWSMIKKALEEDVKAKNPQKRNETVEKYEERIEKLLKANECYSLAQINRLMKVYLGDEYKPIETYFAALGAEDNENGQKPNLSIRIENAHTEASNLLISTYPVDRKLSQDKANVERIKNLLDAIKDLQHFVKPLLGKGTESEKDNRFYGEFVPMWETLDQITPLYNMVRNRMTQKPYSEEKIKINFDNSTLLAGWDLNKEADNTCIILRKDGNYYLAIMDKRNNKVFETKNLVSEGDCYEKMEYKLLPGANKMLPKVFFSKSRMDEFKPSAQLLRNYERGTHKKGDNFSLDDCHALIDFFKESIEKHEDWSKFGFKFSDTKTYEDLSGFYREVEQQGYKISFRNVSVEYINRLVDEGKIYLFQIYNKDFSTYSKGTPNLHTLYWKMLFDERNLADVVYKLNGEAEVFFRKHSIEAEKPTHLANKPIENKNKLNEKKTSVFEYDLVKDRRYTVDKFQFHVPITMNFKAAGLNNINPLVNVYLKESNVTHIIGIDRGERHLLYLSLIDLQGNIVEQYSLNEIVNEYKGNTYRTNYHDLLDAKERQRDEARRSWQTIENIKELKEGYMSQVIHKIAELMVKYNAIVVLEDLNFGFMRGRQKVEKQVYQKFEKMLIDKLNYLVDKKCEADEMGGVFNAYQLTNKFESFQKLGKQSGFLFYIPAWNTSKMDPTTGFVNLLDTRYENMAKAKAFFGKFRSIRYNAAKGWFEFAFDNDDFNTKATGTRTQWTLCTYGTRIETKRDPKQNSNFVSEEFDLASRFKDLFDQYDIDLKGNLMEQICSQNDAAFFKELLHLLHLTLQMRNSITGTEVDYLISPVMNDNGEFYDSRKCGKNLPLNADANGAYNIARKGLWIIEQIKQTEDLSKLKLAISNKEWMRYAQGLE

SEQ ID NO: 152 - protein, 1270 aa, unidentified
  REGION 1..1270: note = Description of Unknown:uncultivated organism sequence
  REGION 1..1270: note = Category: MG28 effectors
  REGION 1..1270: note = Description: MG28-12 effector
MNDLTQFTNLYSLSKTLRFELKPVGKTQENIEKNGILERDNQRAVGYKSVKKVIDEYHKAFIERILNDYERKLDDLQRSVWEDSLNEFYRLYHLPTSTPKRKDDLSKVQETLRKQISDCFKKDRQYGRLFGKELIREDLAEFVTTPLFEDYIISQKDNENLSADEIRKIQEGIIQDLSQFNDFTVYFSGFHENRRNMYVPDSKTTSIAHRMIDENLPKFIDNMDVFEKIAASEVAQHFGVLYKEMEPYLNVNEIPELFKLPYFSMVLTQNQIDVYNAIIGGMVLDDGTKIQGLNEYVNLYNQQQKDKTKRLPKLKPLFKQILSERNAISWLPDEFNSDNEMLQGIEKCYQDLREHVFEGDHSLKALLHNIGDYDLAHIYIPNDLQLTDISQKHFGSWSLIKAAIEEDLKSRTPVKRNESGEKYDERVAKTLKGIDSFSIADINRMMQAKVDDFKPVEAYFAQMGAEDNGNGQKLNHFARIENAYTDVKALLNTEYPKGKALSQDKKNVEKIKNLLDAIKDLQHFVKPLLGSGSESEKDSQFYGEFTPLWEMLNDITPLYNMVRNRMTSKPYSEEKIKVNFDNSTLLAGWDLNKEVDNTCTLLRKEGNYYLAIINKRHSRVLLPEYLVAEGDCYEKMVYKQLGQISQQLPRIAFSNSWQQKIKIPEEILKIKKTESFKTDKDDLQKLIAFYKFFLSQHEEWNSFFNIHFSNKTYYNNLAEFYSEVDSLFYSLSFTNVSVSYINQLVEEGKLYLFQIYNKDFSPYSKGTPNMHTLYWKMLFDERNLADVVYKLNGGAEVFFRKHSIKVDKPTHPANHPIANKNTQNKKKESVFAYDLIKDRRYTVDKFQLHVPITVNYKAIGLNNINPVVNAYLKDSKATHIIGIDRGERHLLYLSLIDLKGNIVEQYSLNEIVNEYNGNTYRTNYHDLLDAKEGKREEARRSWMEIENIKELKEGYMSQVIHKIAQLMVKYNAIVVLEDLNMGFMRGRQKVEKQVYQKFEKMLIDKLNYLVDKQCDAAELGGVLNAYQFTNKFESFQKMGKQSGFLFYIPAWNTSKMDPTTGFVNLLDTRYENMAKAKAFFGKFKSIRYNAKKVLFEFTFDYDDFTTKAADTRTQWTLCTYGTRIETKRDPKQNNNFVSEEFDLTDKFKELLAKHNIGIDGNLLEKICSQSDAAFFKELLHLLHLTLQMRNSITGTDTDYLISPVMNANGEFFDSRKCGKNLPENADANGAYNIARKGLWIIDQIKHSDDLSRLKLAISNKEWLQYAQKMV

SEQ ID NO: 153 - protein, 1280 aa, unidentified
  REGION 1..1280: note = Description of Unknown:uncultivated organism sequence
  REGION 1..1280: note = Category: MG28 effectors
  REGION 1..1280: note = Description: MG28-13 effector
MNNFTNLYPVDLTLRNSLIPIGETFKNMTMHSYIEHDEQRAEAYKLVKGIIDDYHRAFIDSRLASFEFRIESHGTLDSIEEFTTLYNIKRDEKRDKEFTTVKQNLRKAISQRLTKCDAFARINKRELIREDLPYFIDSLDISEEEKAEKKKLVEQFAKFATYFSNFHTNRANMYVADEKSTSIAYRLINQNLPVFLDNMKVFAMLKALGFEDALSIIYSDMKEKLNVLSLDELFQQDYYSMLLTQRQITVYNEVIGGRSTKDGEKIKGLNEYINQYNQEHPIARIPFLRPLYKQILSDRVSMSWLPDSFINDEEMIRAINIFYQNIHPLLWGPMEDAGEPLKNILSQIDTFDTEHIFITNDSALTNISQRLFGQYNVITDALLSRLSQEMPRKRGRKPESDEAYNERLRKTFKAIKSFSISEINESLKSYMDEGTYIDISSYFRAMDERNDEYIQQANMFIRIENAYTEAKPFLNELRASNSSYNQDDDAIKYIKVLLDAYKSLQRFINPLVGSGEESSKDDMFYGEFMPIVEELKNLTPLYNKVRNWLTRKPYSDEKFKVNFDNSSFLSGWPQDYETKGGYIVEHNGLYYLFINEVKLDEAQVKFLCDHPDADNATRILLDFQKPDNKNIPRLFIRSKGENFAPAVEKYALPIASVLDIYDQGKFKTEYRSVNPDDYYRSLHKLIDYFKLGFTRHESYKHYSFQWKPTNEYKDISQFYHDVEVSCYQLKRVPINWNHLQELVIQGSVYLFQIYNKDFSTRSKGKGTPNLHTLYWRMLFDERNTKDLVYKLNGQAEIFFRRASIKPENQVIHQANQPIENKNPLRKAIKPNSTFSYKITKNRRFTLDHFEFHAPITMNFKAPGITNINPLVIDKIRKSEITHVIGIDRGERHLLYLSLIDLKGNIIKQMTLNTITNKWAGGEIATDYQALLDQKEGDRLEARRNWKTIENIKELKEGYLSQAIHLIAQLIVENKAILVLEDLNTHFMHGRQKVEKQVYQRFERQLITKLNYYVDKKKDADAAGGLLHALQLTNKFESFEKLGKQSGFLFYVPAWNTSKIDPVTGFVNLLNLHYETREKASLFFSKFKCISFNTEKNWFEFVMDYNEFTKKADGTRTNWTLCTFGERIETFRNPQANLQWDNRTINLTQAFKDLFQDYGIDIYGNLKNQICSQQKAKFFEQLLHLMKLMLQMRNSKKNSTSAEDDYILSPVADDNGVFYDSRFCSESLPRDADANGAYNIARKGLWIIKKIQASSADERLNLTITNKEWLNFVQIKQYLND

SEQ ID NO: 154 - protein, 1280 aa, unidentified
  REGION 1..1280: note = Description of Unknown:uncultivated organism sequence
  REGION 1..1280: note = Category: MG28 effectors
  REGION 1..1280: note = Description: MG28-14 effector
MNNFTNLYPVDLTLRNSLIPIGETLKNMTMHSYIEHDEQRAEAYKLVKGIIDDYHRAFIDSRLASFEFRIESHGTLDSIEEFTTLYNIKRDEKRDKEFTTVKQNLRKAISQRLTKCDAFARINKRELIREDLPYFIDSLDISEEEKAEKKKLVEQFAKFATYFSNFHTNRANMYVADEKSTSIAYRLINQNLPVFLDNMKVFAMLKALGFEDALSVIYSDMKEKLNVLSLDELFQQDYYSMLLTQRQITVYNEVIGGRSTKDGEKIKGLNEYINQHNQEHPTARIPFLRPLFKQILSDRVSMSWLPDSFINDEEMIRAINIFHQNIYPLLWGPMEDAGEPLKNILSQIDTFDTEHIFITNDSALTNISQRLFGQYNVITDALLSRLSQEMPRKRGRKPESDEAYNERLRKSFKAIKSFSISEINESLKSYMNEGTYIDISSYFRAMDERNDEYIQQANMFIRIENAYTEAKPFLNELRASNSSYNQDDDAIKYIKVLLDAYKSLQRFINPLVGSGEESSKDDMFYGEFMPIVEELKNLTPLYNKVRNWLTRKPYSDEKFKVNFDNSSFLSGWPQDYETKGGYIVEHNGLYYLFINEVKLDEAQVKFLCDHPDADNATRILLDFQKPDNKNIPRLFIRSKGENFAPAVEKYALPIASVLDIYDQGKFKTEYRSVNPDDYYRSLHKLIDYFKLGFTRHESYKHYSFQWKPTNEYKDISQFYHDVEVSCYQLKRVPINWNHLQELVRQGSVYLFQIYNKDFSTRSKGKGTPNLHTLYWRMLFDERNTKDLVYKLNGQAEIFFRRASIKTENQVIHQANQPIENKNPLRKAIKPNSTFSYKITKNRRFTLDHFEFHAPITMNFKAPGITNINPLVIDKIRKSEITHVIGIDRGERHLLYLSLIDLKGNIIKQMTLNTITDKWAGGEIATDYQALLDQKEGDRLEARRNWKTIENIKELKEGYLSQAIHLIAQLIVENKAILVLEDLNTHFMHGRQKVEKQVYQQFEKQLITKLNYYVDKKKDADTAGGLLHALQLTNKFESFEKLGKQSGFLFYVPAWNTSKIDPVTGFVNLLNLHYETREKASLFFSKFKCISFNTEKNWFEFVMDYNEFTKKADGTRTNWTLCTFGERIETFRNPQANLQWDNRTINLTQAFNDLFQDYGIDIYGNLKNQICSQQKAKFFEQLLHLMKLMLQMRNSKKNSTSAEDDYILSPVADDNGVFYDSRSCSESLPRDADANGAYNIARKGLWIIKKIQASSADERLNLTITNKEWLNFVQTKQYLND

SEQ ID NO: 155 - protein, 1280 aa, unidentified
  REGION 1..1280: note = Description of Unknown:uncultivated organism sequence
  REGION 1..1280: note = Category: MG28 effectors
  REGION 1..1280: note = Description: MG28-15 effector
MNNFTNLYPVDLTLRNSLIPIGETLKNMTMHSYIEHDEQRAEAYKLVKGIIDDYHRAFIDSRLASFEFRIESHGTLDSIEEFTTLYNIKRDEKRDKEFTTVKQNLRKAISQRLTKCDAFARINKRELIREDLPYFIDSLDISEEEKAEKKKLVEQFAKFATYFSNFHTNRANMYVADEKSTSIAYRLINQNLPVFLDNMKVFAMLKALGFEDALSVIYSDMKEKLNVLSLDELFQQDYYSMLLTQRQITVYNEVIGGRSTKDGEKIKGLNEYINQHNQEHPTARIPFLRPLYKQILSDRVSMSWLPDSFINDEEMIRAINIFHQNIHPLLWGPMEDAGEPLKNILSQIDTFDTEHIFITNDSALTNISQRLFGQYNVITDALLSRLSQEMPRKRGRKPESDEAYNERLRKTFKAIKSFSISEINESLKSYMDEGTYIDISSYFRAMDERNDEYIQQANLFIRIENAYTEAKPFLNELRASNSSYNQDDDAIKYIKVLLDAYKSLQRFINPLVGSGEESSKDDMFYGEFMPIVEELKNLTPLYNKVRNWLTRKPYSDEKFKVNFDNSSFLSGWPQDYETKGGYIVEHNGLYYLFINEVKLDEAQVKFLCDHPDADNATRILLDFQKPDNKNIPRLFIRSKGENFAPAVEKYALPIASVLDIYDQGKFKTEYRSVNPDDYYRSLHKLIDYFKLGFTRHESYKHYSFQWKPTNEYKDISQFYHDVEVSCYQLKRVPINWNHLQELVIQGSVYLFQIYNKDFSTRSKGKGTPNLHTLYWRMLFDERNTKDLVYKLNGQAEIFFRRASIKPENQVIHQANQPIENKNPLRKAIKPNSTFSYKITKNRRFTLDHFEFHAPITMNFKAPGITNINPLVIDKIRKSEITHVIGIDRGERHLLYLSLIDLKGNIIKQMTLNTITDKWAGGEIATDYQTLLDQKEGDRLEARRNWKTIENIKELKEGYLSQAIHLIAQLIVENKAILVLEDLNTHFMHGRQKVEKQVYQQFEKQLITKLNYYVDKKKDADTAGGLLHALQLTNKFESFEKLGKQSGFLFYVPAWNTSKIDPVTGFVNLLNLHYETREKASLFFSKFKCISFNTEKNWFEFVMDYNEFTKKADGTRTNWTLCTFGERIETFRNPQANLQWDNRTINLTQAFNDLFQDYGIDIYGNLKNQICSQQKAKFFEQLLHLMKLMLQMRNSKKNSTSAEDDYILSPVADDNGVFYDSRSCSESLPRDADANGAYNIARKGLWIIKTIQASSADERLNLTITNKEWLNFVQTKQYLND

SEQ ID NO: 156 - protein, 1259 aa, unidentified
  REGION 1..1259: note = Description of Unknown:uncultivated organism sequence
  REGION 1..1259: note = Category: MG28 effectors
  REGION 1..1259: note = Description: MG28-16 effector
MNYSDFTGLYPLSKTLRFELKPIGKTKENIEKHGILERDSERAIAYKAVKKVMDEYHKVFIDSMLNDFELDMSTLDEFYYLYHLPSADQKRKTDLSKIQETLRKQISERFTKSEQYKRLFGKELIREDLAEFVKTPQYENVIREMPGNENLTDEAVKRFQESLQKDIAQFDDFTTYFVGFYDNRKNMYVADDKATSIAHRMIDENLPKFVDNMDVFDKIAASDVAMHFEELYKAMEPYLNVNEIAEMFRLDYFSTVLTQKQIDVYNAIIGGKVLNDGTKVQGLNEYVNLFNQSQKDKSKRLPKLKPLFKQILSERNAISWLPDEFESDNEMLHSIEKCYQDLKEHVFDLLKTLLGSVKDYNLEHIYLPNDLQLTDIAQKHFGSWSVIRNAVVEDLKANNPQKRKEDVEEYEKRMAKLHDSYSIAYLNGIMQGKVEDFKPIEDYFEGMGAEDNDNGQKLNHFARIWNAYTEIKSLLNTDYPKDKNLSQDKANVEKIKNLLDAIKDLQHFVKPLLGSGTESEKDSQFYGEFVPLWETLDQITPLYNMVRNRMTQKPYSNEKIKLNFDNSTLLAGWDLNKEADNTCTLLRKDDNYYLVIIDKRNNKVLKPENLVSEGDCYEKMEYKLLPGANKMLSKVFFSKSRIDEFKPSESVLRNYKNETHKKGDNFNLDDCHALIDFFKKSINKHEDWSKFGFRFSDTSSYEDLSGFYREVEHQGYKISFCNVSVDYINHLVEEGKIYLFQIYNKDFSPYSKGTPNMHTLYWRMLFDERNLADVVYKLNGKAEVFFRKRSIKVDQPTHPANKPIANKNFQNEKKESVFSYDLVKDRRYSVDKFQFHVPITMNFKAVGLNSINPLVNDYLKGSNATHIIGIDRGERHLLYLSLIDMKGNIVEQYSLNEIVNEYKGNTYRTNYHDLLDAKEKQRDEARRSWQTIENIKELKEGYMSQVIHKIAELMVRYNAIVVLEDLNMGFMRGRQKVEKQVYQKFEKMLIDKLNYLVDKKLDADEMGGVLNAYQLTNKFESFQKLGKQSGFLFYIPAWNTSKMDPTTGFVNLLDTRYENMEKSRVFFGKFDSIQYNSVKGWFEFVLDYNRFTTKAEGTRTRWTLCTYGTRIETRRNSEKNNEFDSVEFDLTTRFKELFSKYQIDLNGNLKEHICNQRDAAFFKEMLHLLHLTLQMRNSRINSDVDYLLSPVMNASGEFYDSRTCGKNLPENADANGAFNIARKGLWIIEQIKKTRDVDLAKIKLAISNKEWLRYAQGQD

SEQ ID NO: 157 - protein, 1256 aa, unidentified
  REGION 1..1256: note = Description of Unknown:uncultivated organism sequence
  REGION 1..1256: note = Category: MG28 effectors
  REGION 1..1256: note = Description: MG28-17 effector
MSDFKEFIGLYPLSKTLRFELIPQGKTLQNFKASGILERDEHRAESYKKMKDIIDEYHRFVIDESMNCFKLKLDNVGKYDSLEDYYTYYVIGKKSETEKKKFTDIQSNLRKQIVDQLKSNPHFGNLFKKELIKNDLIEYLGEDNENLPTVKEFADFTTYFSGFNQNRANMYSSEEKSTSIAYRLINQNLPRFVDNIGVYDRIKTTSIAEELNKVYSSFVEYLNVNKLDELFQLSYYNTLLTQRQIDVYNAVVGGRVTQDGEKILGLNELINLYNQKKEKKDRVPKFKILYKQILSEREAISFLPQVFSSDQETLAAVKDFYNAVKVVVIDKIKDMLSNIDSYDMSHVFIKNDNMFLSEISQKLYSDWGYINKSIIAYYKSVNAQKGKESFEKYESRISKLIKVRDSFSLRELDEYIHKLNPSYPKVESYFSSLGAINNVEQQKEDIFLQIENAYSESETLLNNPYPAENNLASDKKNVELLKDLLDRIKALQWFVKPLLGNGDEFGKDATFYGEFDPLYKELNDITPVYDKVRNRMTRKPYSDEKIKLNFDNSMLLGGWDQNKEKDYMSIILEKDGLFYLGIMNKIHNKVFLQSEIKTEGPCYKKMVYKLIPGPNKELPHVFLSAKGINIYKPSQEMLENYEKGTHKKNSDNFNINDCRKLIDYFKASIEKNNDWNKFEFCFSDTSSYKDISEFYKEVHDQAYKMSFCDVAVSYVDKLVNEGKLFLFKIYNKDFSTYSKGTPNMHTLYWKSVFSPDNLKSIVYQLNGQAELFYRKSSIKGNDMIIHPSGKGIANKNISNEKRESKFNYDIIKDKRYTVDKFQFHVPITINYKGRDQLINESANQYIKDNNIKHIIGIDRGERNLLYLSLIDMNGHIVKQFSLNEIINDYADNKYIVDYHNLLDVKEGDREEARRNWQTIEGIKELKEGYLSQVIHRICNLMIDYNAIVVLENLNIGFMRGRQKVEKQVYEKFEKMLIDKLNYLVDKKVSPISDGGVLKGYQLTNKFVSFKAMGDQNGFLFYIPAWNTSKMDPVTGFVNLFDTHYENIDKTRSFFSKFDVILYNKEKNYFEFKFDYKNFTDRAEGTKSNWTLCTQGKRVETFRNPEKNSKWDSKNVNLTEQFKTLFGQYKIDYTGNLKESISLQSEKLFFEELLHLFRLTVQMRNSVSNSDIDYLISPVTNSNGNFFNSEVERKKGKDSKGDWISKLPVDADANGAYNIARKGLWVINQIKQANSGDKIKLAISNKEWLSFAQHFNG

SEQ ID NO: 158 - protein, 1256 aa, unidentified
  REGION 1..1256: note = Description of Unknown:uncultivated organism sequence
  REGION 1..1256: note = Category: MG28 effectors
  REGION 1..1256: note = Description: MG28-18 effector
MSNFKEFIGLYPLSKTLRFELIPQGKTLQNFKASGILERDEHRAESYKKMKDIIDEYHRFVIDESMNCFKLKLDNVGKYDSLEDYYTYYVIGKKSETEKKKFTDIQSNLRKQIVDQLKSNPHFGNLFKKELIKNDLIEYLGEDNENLPTVKEFADFTTYFSGFNQNRANMYSSEEKSTSIAYRLINQNLPRFVDNIGVYDRIKTTSIAEELNKVYSSFVEYLNVNKLDELFQLSYYNTLLTQRQIDVYNAVVGGRVTQDGEKILGLNELINLYNQKKEKKDRVPKFKILYKQILSEREAISFLPQVFSSDQETLAAVKDFYNAVKVVVIDKIKDMLSNIDSYDMSHVFIKNDNMFLSEISQKLYSDWGYINKSIIAYYKSVNAQKGKESFEKYESRISKLIKVRDSFSLRELDEYIHKLNPSYPKVESYFSSLGAINNVEQQKEDIFLQIENAYSESETLLNNPYPAENNLASDKKNVELLKDLLDRIKALQWFVKPLLGNGDEFGKDATFYGEFDPLYKELNDITPVYDKVRNRMTRKPYSDEKIKLNFDNSMLLGGWDQNKEKDYMSIILEKDGLFYLGIMNKIHNKVFLQSEIKTEGPCYKKMVYKLIPGPNKELPHVFLSAKGINIYKPSQEMLENYEKGTHKKNSDNFNINDCRKLIDYFKASIEKNNDWNKFEFCFSDTSSYKDISEFYKEVHDQAYKMSFCDVAVSYVDKLVNEGKLFLFKIYNKDFSTYSKGTPNMHTLYWKSVFSPDNLKSIVYQLNGQAELFYRKSSIKGNDMIIHPSGKGIANKNISNEKRESKFNYDIIKDKRYTVDKFQFHVPITINYKGRDQLINESANQYIKDNNIKHIIGIDRGERNLLYLSLIDMNGHIVKQFSLNEIINDYADNKYIVDYHNLLDVKEGDREEARRNWQTIEGIKELKEGYLSQVIHRICNLMIDYNAIVVLENLNIGFMRGRQKVEKQVYEKFEKMLIDKLNYLVDKKVSPISDGGVLKGYQLTNKFVSFKAMGDQNGFLFYIPAWNTSKMDPVTGFVNLFDTHYENIDKTRSFFSKFDVILYNKEKNYFEFKFDYKNFTDRAEGTKSNWTLCTQGKRVETFRNPEKNSKWDSKNVNLTEQFKTLFGQYKIDYTGNLKESISLQSEKLFFEELLHLFRLTVQMRNSVSNSDIDYLISPVTNSNGNFFNSEVERKKGKDSKGDWISKLPVDADANGAYNIARKGLWVINQIKQANSGDKIKLAISNKEWLSFAQHFNG

SEQ ID NO: 159 - protein, 1261 aa, unidentified
  REGION 1..1261: note = Description of Unknown:uncultivated organism sequence
  REGION 1..1261: note = Category: MG28 effectors
  REGION 1..1261: note = Description: MG28-19 effector
MSNLGQFTGLYPLSKTLRFELKPIGKTQENIEKHGVLERDNERAIAYESVKKVIDEFHKSYIETKLSRLQLELSLLEEFYELYHHQIFDQNRKNKILNVQDSLRKQISDCFTKDDYYKRLFGKELIREDLTEFVNTPYYENVIRSVPGNEHLTDKEIKQIQENKQKEIDQFGAFTTYFVGYYDNRKNMYVPEDKATSIAHRMINENLPKFVDNMDVFEKISKSEVAANFETLYKAMESYLNVNSIEEMFKLDYYSMVLTQKQIDVYNSIIGGMVLEDGTKIKGLNEYVNLFNQQQKDKTRRLPKLKPLFKQILSERNAISWLPEEFENDNEMLQSIEKCYRELKTKVFDGENSLKTLLNNLEDYDLRHIYLPYDLQLTDIAQKHYGNWSLIKKALEDNLKKENPIKRLESNENYEERIARLLKANESVSLAQINSMMGDGNKSIESYFTTMGAEDNEDGKKPNLFVRIETAYLEAEKLLNSTYPIDKSLSQDKDNVDKIKNLLDAIKDLQHFVKPLLGQGTESEKDPRFYGEFVPLWETLDQITPLYNMVRNRMTKKPYSEKKIKINFDNSTLLAGWDLNKEADNTCSILRKEGLYYLVIMDKQHNRVLKPENLPADGECYEKMEYKLLPGANKMLPKVFFSKSRIGEFKPSERIVRNYKNDTHKKGSNFNLDDCHALIDFFKESINKHEDWSKFGFKFSDTETYKDLSDFYHEVEQQGYKISFRKVSVDYINQLVEEGKIYLFQIYNKDFSPYSKGTPNLHTLYWRALFDEKNLADVVYKLNGEAEVFFRKHSLVAKKPTHPANQPIANKNAKNEKKESTFAYDIIKDRRYTVDKFQFHVPITMNFKAAGISNINPLVNAYLKESDAIHIIGIDRGERHLLYLSIIDLEGNIVDQFSLNEIVNEYKGNAYRTNYHDLLDTKEKQRDEARKSWQTIESIKELKEGYVSQVIHKIAELMVKYNAIVVLEDLNFGFIRGRQKVEKQVYQKFENMLIDKLNYLVDKKLDVTEAGGVLNAYQLTNKFESFQKLGKQSGFLFYIPAWNTSKMDPTTGFVNFFDTRYENVEKARLFFGKFKDICYNAKDNWFEFAFDYEDFTTKAAGTKTQWTLCTQGTRVETRRDPTQNNKFVSKELDLTSKFNELFAKYNIDFNGDLKGQICSQNEAQFFRDLLHLLHLTLQMRNSIAGTEEDYLISPVKNANGEFYDSRKCCDNLPINADANGAYNIARKGLWIVDQIKQSDDITKIRLAISNKEWLRYVQGVK

SEQ ID NO: 160 - protein, 1309 aa, unidentified
  REGION 1..1309: note = Description of Unknown:uncultivated organism sequence
  REGION 1..1309: note = Category: MG28 effectors
  REGION 1..1309: note = Description: MG28-20 effector
MSNLNQFIGLYPLSKTLRFELKPIGKTKENIEKNGILERDTQRAVGYKVVKKVIDEYHKAFIERILNDFENKLGDDERNDWKNSLQEFYSLYLSPVSDNGRKDKLAKTQERLWKQIANAFKKDWQYNKLFADELIRKDLAEFVSTPFFENYIRSQKGNEDIPDSEVRAIQETITQDINCFRDFTTYFTGFNKNRENMYMADGKATSIAHRMINENLPKFIDNVEVFKKIADCDEIKIHFATLYKAMEQYLNVLTINEMFLLEYFPMVLTQKQIDVYNAVIGGLNEYINLYNQQQKDKSKRLPKLKPLFKQILSERNAISWLPDEFESDNEMLESIEKCYQDLTIQVFCGENSLKSLLINIRDYDLDHIYLPNDSSISTISQKLYGGWSIVGNAITEDIKVSNPQKKKESDEEYEERISKIRKGIECYSVGYLNGVLRDKIKIDNFKPIEDYFLLMGATDDKSDQKPNLFVRIEDAYAEARAILTSPYPEERNLSQDEESIEKIKNLLDTIKELQHFIKPLLGSGSESDRDNNFYGEFIPLWESLDQITALYNMVRNRMTQKPYTDEKIKLYFDNNATFLRGWVDSKTESSDNGTQYGGYLFRRQNAIGEYDYYLGVSKDIKLFRRFKEVEESDKSTYERLDYYQLKSKTFYGTLYKGNYEIESANIKRAIDNVVYLIGSAATKEKVNNEKGKRQPKINTAIGYLKFLQQQDKELYNILLKDKSFQECNKAIIASMKSTLLSLNRIPSAKDYAQKNYVLFSVMMDDIDTLLQEKIFTYFSVSKCELDNAVGRDLRPLYLFKITNKDLSFAETYENGLRKNRGTENLHTMYFKALMSGTQNVFDIGSGAIYFREHKISYTEEQLKRGHHYEMLKGKFSYPIISNKRYAFDKFQFHLSVNLNYNADKNVNINTLVNSYLKESNSTHIIGIDRGERNLLYLSLIDLHGNIVEQYSLNEIGDEYNRTNYHELLDKKENQRKEARLSWQTIESIKELKEGYMSQVIHKIVELMVKYNAIVVLEDLNGGFKRGRQKVEKQVYQKFEKMLIDKLNYLVDKKLAVTEPGGVLKAYQLANKFESSQKRDKQNGFLFYVPAWNTSKMDPTTGFVDLFDTRYVNIAKAKAFFGKFKSIRYDAEKGWIEFAFDYNDFTTKASGTRTQWTLCTQGTRIETKRDPSQNNQFISEEFDLTSRFIELFSQFKIDPDGNLMEQICSQTEATFYKSILHLLHVTLQMRNSKTGTDVDYLISPVMNSHGEFYDSRHCGKDLPNNADANGAYNIARKGLWIIEQIKQSEDFAHLKLAISNKEWLQYAQKE

SEQ ID NO: 161 - protein, 886 aa, unidentified
  REGION 1..886: note = Description of Unknown:uncultivated organism sequence
  REGION 1..886: note = Category: MG28 effectors
  REGION 1..886: note = Description: MG28-21 effector
MSNLNQFIGLYPLSKTLSFELKPIGKTKENIEKNGILERDTQRAVGYKVVKKVIDEYHKAFIERILNDFENKLGDDERNDWKNSLQEFYSLYLSPVSDNGRKDKLAKTQERLWKQIANAFKKDWQYNKLFADELIRIDLAEFVSTPFFENYIRSQKGNEDIPDSEVRAIQETITQDINCFRDFTTYFTGFNKNRENMYMADGKATSIAHRMINENLPKFIDNVEVFKKIADCDEIKIYFVTLYKAMEQYLNVLTINEMFLLEYFPMVLTQKQIDVYNAVIGGLNEYINLYNQQQKDKSKRLPKLKPLFKQILSERNAISWLPDEFESDNEMLESIEKCYQDLRSTVFDGNHSLQSLLSSINDYDLNHIYISNDSSISLISQKQYGGWGVIGNAIMENAKAANPQKRNESNEKYEERISKIQKGIDSYSIGYLNDVLRNKLDDFKPIEDYFLKMGGAVDNETEQKPTFFTRIENAYTEAHTLLTSPYPESRQLSQDKKNVEKIKNLLDAIKELQHFVKPLLGQGAESEKDNNFYGEFIPFWELLDQITVLYNMVRNRMTQKPYTDEKIKLYFDNNATFLRGWVDSKTESSDNGTQYGGYLFRRQNAIGEYDYYLGVSKDIKLFRRFKEVEESDKSTYERLDYYQLKSKTFYGTLYKGNYEIESSNIKRAIDNVVNSVGSTSIKGKLYNEKSKRQPKTATAIGYLKFIKQQDEELYNILLKDKSFQECNKAIIASMKSTLLSLNRIPSAKDYAQKNYVLFSAMMDDIDILLQEKIFSYFPVSQRELDEVVERNLRPLYLFKITNKDLSFAENYENGLRKNRGTDNLHTMYFKALMSGAQSVFDIGSGAIYFREHKISYTEEQLKRGHHYEILKDRFSYPIISNKRYAF

SEQ ID NO: 162 - protein, 1261 aa, unidentified
  REGION 1..1261: note = Description of Unknown:uncultivated organism sequence
  REGION 1..1261: note = Category: MG28 effectors
  REGION 1..1261: note = Description: MG28-22 effector
MSNLVQFTGLYPLSKTLRFELKPIGKTQENIEKHGVLERDNERAIAYESVKKVIDEFHKSYIETKLSRLQLDLSLLEEFYELYHHQIFDQNRKNKILNVQDSLRKQISDCFTKDDYYKRLFGKELIREDLTEFVNTPYYENVIRSVPGNEHLTDKEIKQIQENKQKEIDQFRDFTTYFVGYYDNRKNMYVPEDKATSIAHRMINENLPKFVDNMDVFEKISKSEVAANFETVYKAMESYLNVNSIEEMFKLDYYSMVLTQKQIDVNNSIIGGMVLEDGTKIKGLNEYVNHFNQQQKDKTCRLPKLKPLFKQILSERNAISWLPEEFENDNEMLQSIEKCYRELKTKVFDGENSLMTLLNNLEDYDLRHIYLPYDLQLTDIAQKHYGNWSLIKKALEDNLKKENPIKRFESNEKYEERIAILLKANESVSLAQINSMMGDGNKPIESYFTTMGAEDNEDGKKPNLFVRIETAYLEAEKLLNSTYPIDKSLSQDKDNVDKIKNLLDAIKDLQHFVKPLLGQGTESEKDPRFYGEFVPLWETLDQITPLYNMVRNRMTKKPYSEKKIKINFDNSTLLAGWDLNKEADNTCSILRKDGLYYLVIMDKQHNRVLKPENLPADGECYEKMEYKLLPGANKMLPKVFFSKSRIGEFKPSERIVRNYKNDTHKKGSNFNLDDCHALIDFFKESINKHEDWSKFGFKFSDTETYKDLSDFYREVEQQGYKISFRKVSVDYINQLVEEGKIYLFQIYNKDFSPYSKGTPNLHTLYWRALFDEKNLADVVYKLNGEAEVFFRKHSLVAKKPTHPANQPIANKNAKNEKKESTFAYDIIKDRRYTVDKFQFHVPITMNFKAAGISNINPLVNAYLKESDAIHIIGIDRGERHLLYLSIIDLEGNIVDQFSLNEIVNEYKGNAYRTNYHDLLDTKEKQRDEARKSWQTIESIKELKEGYVSQVIHKIAKLMVKYNAIVVLEDLNFGFIRGRQKVEKQVYQKFENMLIDKLNYLVDKKLDVTEAGGVLNAYQLTNKFESFQKQGKQSGFLFYIPAWNTSKMDPTTGFVNFFDTRYENVEKARSFFGKFKDICYNAKDNWFEFAFDYEDFTTKAAGTKTQWTLCTQGTRIETRRDPTQNNKFVSEELDLTSKFNELFAKFNIDFNGDLKGQICSQNEAQFFRDLLHLLHLTLQMRNSITGTEEDYLISPVKNANGEFYDSRKCCDNLPINADANGAYNIARKGLWIVEQIKQSDDITKIRLAISNKEWLRYVQGVK

SEQ ID NO: 163 - protein, 1265 aa, unidentified
  REGION 1..1265: note = Description of Unknown:uncultivated organism sequence
  REGION 1..1265: note = Category: MG28 effectors
  REGION 1..1265: note = Description: MG28-23 effector
MTMYTNFTRLYSLSKTLRFELKPIGKTKENIEKNGILKRDNERAVAYKAVKKVIDEYHKAFIEMMLNDFELQYEMLEEYNRLYQISNSSEPKKKEKLQKIQENLRKQISDRFTTSEQYKRLFGQELIKEDLSEFVNTSQFEHYIRTQKGNDLSDEEVRQIQKRTLEDIDQFKDFTTYFSGFHQNRKNMYVADDKATAIAHRVVMENLPKFIDNMNTFAEIAESDVAGHFADLYKEMEAYLNVNDIQEMFQLDYFSMVLTQKQIDVYNAIIGGKTLDDGTKIKGLNEYVNLYNQQQTRKEDRLPKLKPLFKQILSERNAISWLPEEFENDNEMLQSIEKCYQDLNAQVFGPLKDLLKNIKDSDLEHIYLPNDLQLTDISQKHFGSWAVINKAVEEDLKTANPQKNRESGEKYEERIAKLLKNTDSYSIGYINGLLKDRIEDFEPLEVYFSNIGAEDDGKQQKLNHFSRIENAYTEAKSLLTAEYPDDKRLSQDKGNVEKIKNLLDAIKDLQHFVKPLLGSGSESDKDSQFYGEFTSLWETLDQITPLYNMVRNRMTQKPYSIEKVKLNFDNSTLLSGWDLNKETDNTCTLLRKGGNYYLAIIDKRNNKVLKPENLVSSGDCFEKMEYKQIALPMGVGAFVRKCYGTAQNYGWRCPKNCLNKEGKIIIKDAEAQPNLIDIIDCYKDFFEKYEKDGFKYKDFRFKFSESSKYERLSDFFGDVESQGYIIRFKNVSVDYINQLVEEGKIYLFQIYNKDFSPYSKGTPNMHTLYWKMLFDEKNLADVVYKLNGEAEVFFRKSSVKENRPTHPANKPIANKNKQNEKKESTFAYDLIKDRRYTVDKFQFHVPITMNFKAKGMNDINLLVNQCLKESVETHIIGIDRGERHLLYLSLIDLQGNIVEQYSLNEIVNEYNGNIYRTNYHDLLDAKEKQRDEARSSWQTIENIKELKEGYMSQVIHKIAQLMLKYNAIVVLEDLNFGFMRGRQKVEKQVYQKFEKMLIDKLNYLVDKKRATNELGGVLNALQLTNKFESFQKLGKQSGFLFYIPAWNTSKMDPTTGFVNLLDTRYENMEKAKAFFGKFDSIRYNPQQDWFEFAFDYNSFHNKAEGTRTQWTLCTYGTRIETKRDAAQNNNFVSTEVDLTQKFKELFTEHQIDINGNLKDQICSQTDVAFFKSLLNLLRLTLQMRNSITGTETDYLISPVQNAKGEFYDSRKCGKNLPENADANGAYNIARKGLWVIEQIKQADDLSNIKLAITNKEWLWFAQRLK

SEQ ID NO: 164 - protein, 1266 aa, unidentified
  REGION 1..1266: note = Description of Unknown:uncultivated organism sequence
  REGION 1..1266: note = Category: MG28 effectors
  REGION 1..1266: note = Description: MG28-24 effector
MTSFSKFCGLYPLSKTLRFELKPIGKTKENIEKNGILERDSERATAYKAVKKVIDEFHKSFIELQLNDFELEQSKLEEFYHLYHLPTSDQKRKNDLPKVQESLRKLISERFTKNDYYKRLFGKELIREDLTDFVNTPYYENIIRNVPGNEQLSDEKVKQIQENTIREISQFNDFTTYFVGFYDNRKNMYVAEDKATAIAYRMINENLPKFIDNMDVFEKIAASDVAQHFGELYKEMEPYLNVSEIAEMFHLNYFSTVLTQTQIDVYNAIIGGKTLDDGTKIQGLNEYVNLYNQQQKDKSKRLPKLKPLFKQILSERNAISWLPDEFKNDNEMLQSIEKCYQDLKEQVFGALKQLLTTIKDYNLQHIYLPNDLQLTDISQKQYGSWSVIKNAIIEDLKKTNQPKKKEDAEDFENRLSKLADSYSIAYINQVTGSNIENFKPIEDYFAKMGAEDNENGQKLNHFARIENAYTEIKQLLNSEYPTGKSLSQDKANVEKIKNLLDAIKDLQHFVKPLLGSGTESEKDNSFYGEFTPLWENLDQITPLYNMVRNRMTKKPYSEEKIKINFDNSTLLAGWDLNKEADNTCTLLRKDGNYYLAIIDKRHNKVLKAENLSSDGECYEKMEYKLLPGANKMLPKVFFSKSRIAEFKPSEKIIRNYENETHKKGDKFNLADCHALIDFFKESIKKHEDWSKFGFNFSPTNSYEDLSGFYREVEQQGYKISFRNISVNYINKLVDEGKIYLFQIYNKDFSPFSKGTPNMHTLYWKALFDEKNLADVVYKLNGEAEVFFRKHSLNGAKPTHPANQPIANKNAQNEKKQSTFAYDLIKDRRYTVDKFQFHVPITMNFKAAGINNINPLVNEYLKESNATHIIGIDRGERHLLYLSLIDLKGNIVEQYSLNEIVNEYNGNTYRTNYHNLLDAKEKQRDEARRSWQTIENIKELKEGYMSQVIHKIAELMVKYNAIVVLEDLNLGFMRGRQKVEKQVYQKFEKMLIDKLNYLVDKKLDADATGGVLNAYQLTNTYKVFHDQYKKQQNTIGKQCGFLFYIPAWNTSKMDPTTGFVNLFDTRYENMEKAKAFFGKFDSIRFNSVKGWFEWAFDYDKFTTKAEGTQTKWTLCTYGTRIETKRNPEKNNEFDSVEFDLTERIKELFAKYQIDANGNLKEQICSQTDATFFKELLHLLHLTLQMRNSITGTETDYLISPVMNAKGEFYDSRVCGKDLPENADANGAYNIARKGLWVIEQIKHADDLTKPKLAISNKEWMRYAQGLK

SEQ ID NO: 165 - protein, 1262 aa, unidentified
  REGION 1..1262: note = Description of Unknown:uncultivated organism sequence
  REGION 1..1262: note = Category: MG28 effectors
  REGION 1..1262: note = Description: MG28-25 effector
MVKYSDFTGLYPLSKTLRFELKPIGKTKENIERNGILERDNKRAVGYKAVKKVIDEYHKAFIDMMLDDFKLNLTDKGKLDSLEEFYAIYHLSSNDTLRKVNITKVQDSLRKQISDRFTKSEQYKRLFGKELIREDLIEFVQTPQYNAFIRAQQGNDNLSDNDIQQIKEEIIQDISRFKDFTTYFIGFYENRRNMYVADDKATSIGHRMITENLPKFVDNIDVFEKIAASDVASSFKVLYKDMEPYLNVNSLDEMFRLDYYSMVLTQKQIDVYNAIIGGMVLDDGTKIKGLNEYVNLYNQQQKDKANKLPKLKLLFKQILSERNAISWLPEEFESDNDMLKSISQCYQDLKSQVFEGEGSLRVLLQNLNDYDLEHIYLPDDLKLTDIAQKLYGNWSVVKRALEEDFKTKNPQKKNETNEKFEERIDKLLKSNESFSIAQINNLVRASLGEDYKPLESYFMSLGEPNLFVRIQDAYTEVKSLLKTSYPEDKKLSQDKANVERIKNLLDAIKDLQHFVKPLLGKGNESEKDNRFYGEFTPLWEALDQITPLYNMVRNRMTQKPYSEEKVKLNFDNSTLLAGWDLNKEADNTCTILRKDDNYYLAIMDKKNNKVFMQENIVATGDCYEKMEYKLLPGANKMLPKVFFSKSRIGEFKPSDVLMQNYKKETHKKGENFNIDDCHALIDFFKKSIDIHEDWSKFDFHFSDTKKYEDLSGFYREVEQQGYKITFRNVSVDYVNSLVDEGKIYLFQIYNKDFSTYSKGTPNLHTMYWKMLFDERNLADVVYKLNGEAEVFFRKHSIEAVKPTHPANKPIENKNKLNAKKTSVFDYDLIKDRRYTVDKFQFHVPITMNFKASGLNNINPLVNAYLKESNVTHIIGIDRGERHLLYLSLIDMKGNIVEQYSLNEIVNEYKGNTYRTNYHDLLDAKERQRDEARRSWQTIENIKELKEGYMSQVIHKIAELMVKYNAIVVLEDLNLGFMRGRQKVEKQVYQKFEKMLIDKLNYLVDKKRDARETGGVLKAYQLTNKFESFQKLGKQSGCLFYIPAWNTSKMDPTTGFVNLFDTRYENMAKAKAFFSKFKSIRYNAAKDWFEFAFDYDDFTTKAAGTKTKWTLCTYGTRIETKRDPKQNNMFVSEEFKLTDRFKDLFAQYRIDLNENMMEQISLQNDATFFKELLHLLHLTLQMRNSITSTEIDYLVSPVMNAAGEFYDSRRCGKNLPENADANGAYNIARKGLWIIDQIKQADDLSKLKLAISNKEWMRYAQGV

SEQ ID NO: 166 - protein, 957 aa, unidentified
  REGION 1..957: note = Description of Unknown:uncultivated organism sequence
  REGION 1..957: note = Category: MG28 effectors
  REGION 1..957: note = Description: MG28-26 effector
NMDVFEKIAASEVAIHFDTLYKEMEAYLNVKSIEEMFQLDYFSIVLTQKQIDVYNSIIGGKTLEDGTKILGLNEYVNLYNQQQNNKDNRLPKLKPLFKQILSERNAISWLPDEFASDNEMLESIERCYQDLRKQVFEGENSLKELLKGIVDYDLEHIYLPDDLQLTNISQKHYGNWSVIKKAHEEYLRKEMQENLMVNKPQRRNESDENYQERIQELLKTKKYEESIEKQLKVNDSFSLAQINRLMSIYQGEDSKPIELYFATMGAEEIGNEKKPNLFIRIENAYTEVKTLLTTAYPKDRKLSQDKANVEKIKNLLDAIKNLQHFVKPLLGKGTEGEKDNHFYGEFTPLWEALDQITPLYNMVRNRMTQKPYSDEKIKLYFDNNGSFLNGWVDSKTESDNATQYGGYLFRKRNSIGEYDYFLGVSAATKLFRSFNSVEASDRSSYERLDYYQLKGKTFYGTLYKGNYETESANIRHAIDNLVYHAGSISIKEKINAERMKKQPKVSTAIGYLKYIMQQDCELYDILLKDDTFEKSNQAIMASMKATLLSLDRIPSAKEYAQRNYKLFSEMMDDIDMLLQGKVFSYFPVSQRELDETVNRTTKPLYLFKITNKDLSYAETHEKGLRKSRGSDNLHTMYFKALMSGCQDVFDIGSGSMFFREHKLVYTEDQLKKGHHYDMLKDKFNYPIVSKKRYAFDKFQFHLSVTMNYNSNKSKDINPMVNDYLKESNATHIIGIDRGERHLLYLSLIDLNGNIIEQYSLNKIANEYKGNIYRTDYHELLDAKEKQRDEARRSWMSIENIKELKEGYMSQVIHKIAELMVKYNAIVVLEDLNLGFMRGRQKVEKQVYQKFEKMLIDKLNYLVDKKIDANVLGGVQKAYQLANKFESFQKLGKQSGFLFYIPAWNTSKMDPTTGFVNLLDTRYENMAKAKAFFAKFKSIQFNAIKGWFEFAFDYDDFT

SEQ ID NO: 167 - protein, 1102 aa, unidentified
  REGION 1..1102: note = Description of Unknown:uncultivated organism sequence
  REGION 1..1102: note = Category: MG28 effectors
  REGION 1..1102: note = Description: MG28-27 effector
QYKILFRKQLIRQDLAEFLKTPRCDAYIRSKNSKEILSEDEMKQIQDNIIQEIAQFRDFTTYFSGFYENRRNMYVPDAKATSIANRMINENLPKFVDNIDEFEKIASSEVATHFDTLYKEMEAYLNVNSIAEMFQLDYFSMVLTQKQIDVYNAIIGGKTLEDGTKIQGLNEYVNLFNQQQNEKANRLPKLKLLFKQILSERSAISWLPDVFESDTQMLDSIKKCYQDLRENVFEGRNSLKELLRGISDYDLEHIYLPNDVQLTNIAQKQYGDWSVIKRAFEKITKAQNPQRRNESNEKYEARIVKLQKTYDSFSMAQINNWLTDYMGDTYKSIESYFIALGAEDDGNTQKPNLFIRIENAYTEAKSLLTKVYPKDRKLSQDKINVEKIKNLLDAIKNLQHFVKPLLGRGTESEKDSRFYGDFTPLWETLEQITPLYNMVRNRMTEKPYSDEKIKLYFDNNGSFLNGWVDSKTESDNATQYGGYLFRKLNSIGEYDYYLGVSAATKLFRSFNPVADNDKSCFERLDYYQLKGKTFYGALYKGDYETESANIRHSIDDVVCRSGSALIKEKINFERQKKQPKISTAIGYLKFIRQQDGELYSTLLKDDIFEEANQAIMVSMKATLSSLDRIPFAKEYALRHYILFADMMDDIEVLLQGKVFSYFPISQNELDEAVTRISKPLYLFKITNKDLSFAETHEKGLRKSRGIENLHTMYFKALMSGCQDVFDIGSGSVFFREHKISYTDEQMKRGHHYEMLKDKFNYPIISNKRYAFDKFQFHISITMNYNADKSKDINYITNAYLKESNATHIIGIDRGERHLLYLSLIDLQGNIVDQFSLNEIVKEYNGNTYCTNYHALLEAKENQRDEARRSWQTIENIKELKEGYMSQVIHKIVDLMIKYNAIVVLEDLNLGFKRGRQKVEKQVYQKFEKMLIDKLNYLVDKKLDVKEAGGVLRAFQLTNKFESFQKLGKQSGFLFYIPAWNTSKMDPTTGFVNLLDTRYENMAKAKAFFGKFKSIRFNNSKNWFEFAFDYNDFTTKAEGTKTQWTLCTYSTRIETKRDPMQNNKYVSEEFELTNRFKDLFANTKYNIDLNGNLIEQICSQSDA

SEQ ID NO: 168 - protein, 829 aa, unidentified
  REGION 1..829: note = Description of Unknown:uncultivated organism sequence
  REGION 1..829: note = Category: MG28 effectors
  REGION 1..829: note = Description: MG28-28 effector
SFYHLPSSDLTRKANLTKIQDALRKEISDHFIKSEQYKRLFGKDLIREDLAEFVLTPRFEAYIRSKKSKEILSKDEVKRIQDNFIQEIAQFRDFTTYFSGFYENRRNMYVPDAKATSIANRMINENLPKFVDNIDVFERIASSEVATHFDTLYKEMEAYLNVNSIAEMFQLDYFSMVLTQKQIDVYNAIIGGKTLEDGTKIQGLNEYVNLFNQQQNEKTNRLPKLKILFKQILSERSAISWLPDVFESDTQMLESIKMCYQDLKENVLEGRNSLKELLSGISEYDLEHIYLPNDVQLTNIAQNQYGDWSVIKKAFENITKAQNPQRRNESNEKYETRIEKLQKTHDSFSMAQINNWLIDYMGDTYKSIESYFIALGAEDDGNTQKPNLFIRIENAYTEAESLLTKVYPKDRKLSQDKVNVEKIKNLLDAIKNLQHFVKPLLGRGTESEKDSRFYGDFTPLWETLEQITPLYNMVRNRMTEKPYSDEKIRLYFDNNGSFLNGWVDSKTDSDNATQYGGYLFRKLNSIGEYDYYLGVSAATKLFRSFNPVADNDKSCFERLDYYQLKGKTFYGALYKGDYETESANIRHTIDNVVRHSGSALIKEKINFERQKKQPKISTAIGYLKFIRQQDGELYSTLLKDDIFEEANQAIMVSMKATLSSLDRIPFAKEYALRHYILFADMMDDIEVLLQGKVFSYFPISQSELDEAVTRISKPLYLFKITNKDLSFAETHEKGLRKSRGIENLHTMYFKALMSGCQDVYDIGSGSVFFREHKISYTDEQMKRGHHYEMLKDKFNYPIISNKRYAFDKFQFHISITMNYNADKSKDINY

SEQ ID NO: 169 - protein, 881 aa, unidentified
  REGION 1..881: note = Description of Unknown:uncultivated organism sequence
  REGION 1..881: note = Category: MG28 effectors
  REGION 1..881: note = Description: MG28-29 effector
TDYMGDTYKSIESYFIALGAEDDGNTQKPNLFIRIENAYIEAKSLLTKVYPKDRKLSQDKINVEKIKNLLDAIKNLQHFVKPLLGRGTESEKDSRFYGDFTPLWETLEQITPLYNMVRNRMTEKPYSDEKIKLYFDNNGSFLNGWVDSKTESDNATQYGGYLFRKLNSIGEYDYYLGVSAATKLFRSFNPIADSDKSCFERLDYYQLKGKTFYGALYKGDYETESANIRHTIDNVVRHTGSTLNKEKIKIERQKKQPKISTAIGYLKFIRQQDDELYNILLKDDIFEEANQTIMVSMKATLSSLDRIPLAKEYAIRQYTLFADMMDDIEVLLQGKVFSYFPISQSELDEAVTRISKPLYLFKITNKDLSFAETHEKGLRKSRGIENLHTMYFKALMSGCQEVFDIGSGSVFFREHKISYTDEQMKRGHHYEMLKDKFNYPIISNKRYAFDKFQFHISITMNYNADKSKDINYITNAYLKESNATHIIGIDRGERHLLYLSLIDLQGNIVDQFSLNEIVKEYNGNTYCTNYHALLEAKENQRDEARRSWQTIENIKELKEGYMSQVIHKIVDLMIKYNAIVVLEDLNLGFKRGRQKVEKQVYQKFEKMLIDKLNYLVDKKLDANEAGGVLRAFQLTNKFESFQKLGKQSGFLFYIPAWNTSKMDPTTGFVNLLDTRYENMAKAKAFFGKFKSIRFNNSKNWFEFSFDYNDFTTKAEGTKTQWTLCTYSTRIETKRDPMQNNKYVSEEFELTNRFKDLFANTKYNIDLNGNLIEQICSQSDASFFKELLHLMHLTLQMRNSVVGTLIDYMISPVANANGEFYDSRNCGKNLPENADANGAYNIARKGLWIINQIKQTEDLTKVKLSISNKEWLQYAQKQINNT

SEQ ID NO: 170 - protein, 1060 aa, unidentified
  REGION 1..1060: note = Description of Unknown:uncultivated organism sequence
  REGION 1..1060: note = Category: MG28 effectors
  REGION 1..1060: note = Description: MG28-30 effector
VIDEYHKAFIELMLDNFELELKDSGKLDSLEEFYMLYHLPSNDSTRKDRITKVQDALRKKISECFTKTEQYKRLFGKELIREDLEPFVGTLQFEEYIRSQKGNENLNDDELRQIQVEVVQEIAQFRDFTTYFSGFYENRKNMYVADNKATSIANRMINENLPKFIDNMDVFDRIAVSGVSKHFDTLYKEMEPYLNVNSIAEMFRLDYFSTVLTQKQIDVYNTIIGGRTEKDGRKIQGLNEYINLFNQQQKDKENRLPKLKPLFKQILSDRNAISWLPDEFASDNEMLESIEKCYQDLREHVFEGENNLKVLLKGIGEYDLEHIYLCDDAQLTNIAQKQFGNWNVIKNAFEESIKAENPARGNESIEKYEARIEKLMKTNDSFSLAQINRLMSAYLGDEYKPIESYFTAMGAEDDGAVQKPNLFIRIENAYTEVKNLLRTSYPNDRKLSQDKVNVEKIKNLLDAIKDIQHFVKPLMGKFTESVKDNRFYGEFTPLWETLDQITPLYNMVRNHMTQKPYSDEKIKLNFDNSTLLAGWDLNKEVDNTCTLLRKDGLYYLVIINKQYNRILTAENISNDGECYEKMVYKQLGQISQQLPRIAFSNSWQQRISIPAEVLRIKKTESFKTNNEDLLKLIAFYKYFISQHEEWNTFFNIKFTDKSDYKNLPEFYSEVDSLFYSLSFSKVSVANINQLVDEGKIYLFQIYNKDFSTYSKGTPNLHTMYWKMLFDERNLADVVYKLNGEAEVFFRKHSIEAGKPTHPANKPVVNKNKLNENRTSVFEYDLIKDRRYTVDKFQFHVPITMNYKAEGLNNINPMVNAYLKESNATHIIGIDRGERHLLYLSLIDLKGNIVEQCSLNEIVNEYKGKTYRINYHDLLDTKEKQRDEARRSWQAIENIKELKEGYMSQVIHKIAELIVKYNAIVVLEDLNLGFMRGRQKVEKQVYQKFEKMLIDKLNYLVDKKLDATEQGGVLKAYQLANKFESFQKMGKQSGILFYIPAWNTSKMDPTTGFVNLFDTRYKNIAKAKAFFAKFKSIRYNATKDWMEFAFDYDDFTTKALGTKTQ

SEQ ID NO: 171 - protein, 872 aa, unidentified
  REGION 1..872: note = Description of Unknown:uncultivated organism sequence
  REGION 1..872: note = Category: MG28 effectors
  REGION 1..872: note = Description: MG28-31 effector
VIRNAVVEDLKVGNPQKKKEDAEEYEKRLAKLHDSYSIAYLNGIMQGKTEDFKPIEDYFAGMGAEDNEKGQKVNHFARIENAYTEIKALLNTDYHKGKNLSQDKVNVEKIKDLLDAIKDLQHFVKPLLGNGTESEKDSQFYGEFTPLWEALDQITPLYNMVRNRMTQKPYSNEKIKLNFDNSTLLAGWDLNKEADNTCTLLRKDGNYYLVIIDKRNNKVLKPENLVSKGDCYEKMEYKLLPGANKMLPKVFFSKSRIDEFKPSESVLKNYKNETHKKGGNFNLDDCHALIDFFKKSINKHEDWSKFGFHFSDTNSYEDLSGFYREVEQQGYKITFRNVSVDYINQLVDEGKIYLFQIYNKDFSPFSKGTPNMHTLYWRMLFDERNLADVVYKLNGEAEVFFRKHSIRVDKPTHPANQPIANKNAQNEKKESTFAYDLIKERRYTVDKFQFHVPITMNFKAAGLNNINPLVNAYLKESNDTHIIGIDRGERHLLYLSLIDMKGNIVEQYSLNEIVNEYNGNTYRTNYHDLLDAKEKQRDEARRSWQTIENIKELKEGYMSQVIHKIAELMVKYNAIVVLEDLNMGFMRGRQKVEKQVYQKFEKMLIDKLNYLVDKKLDAEKMGGVLNAYQLTNKFESFQKLGKQSGFMFYIPAWNTSKMDPTTGFVNLFDTRYENMEKSKVFFGKFDSIRYNAAKGWLEFAFDYDNFTAKAEGTRTRWTLCSYGARIETKRNPEKNNEFDSVEIELTERFKALFAKHQIDLNGNLKEQICNQSDASFFKEMLHLLHLMLQMRNSVTNSEIDYLLSPVMNASGEFYDSRTCGKNLPENADANGAYNIARKGLWIIEQIKQSDDLSRPKLAISNKQWLRYAQGLD

SEQ ID NO: 172 - protein, 944 aa, unidentified
  REGION 1..944: note = Description of Unknown:uncultivated organism sequence
  REGION 1..944: note = Category: MG28 effectors
  REGION 1..944: note = Description: MG28-32 effector
VQLTNIAQKQYGDWSVIKKAFDNITKAQNPQRRNESNEKYEARILKLQKTYDSFSMAQINNWLTDYMGDTYKSIESYFTALGAEDDGNTQKPNLFIRIENAYTEAKSLLTKVYPKDRKLSQDKINVEKIKNLLDAIKNLQHFVKPLLGRGTESEKDSRFYGDFTPLWETLEQITPLYNMVRNRMTEKPYSDEKIKLYFDNNGSFLNGWVDSKTESDNATQYGGYLFRKLNSIGEYDYYLGVSAATKLFRSFNPVADNDKSCFERLDYYQLKGKTFYGALYKGDYETESANIRHSIDDVVCRSGSTLIKEKINFERQKKQPKISTAIGYLKFIRQQDDELYNILLKDDIFEEANQAIMVSMKATLSSLDRIPFAKEYALRHYTLFADMMDDIEVLLQGKVFSYFPISQSELDEAVTRISKPLYLFKITNKDLSFAETHEKGLRKSRGIENLHTMYFKALMSGCQDVYDIGSGSVFFREHKISYTDEQMKRGHHYEMLKDKFNYPIISNKRYAFDKFQFHISITMNYNADKSKDINYITNAYLKESNATHIIGIDRGERHLLYLSLIDLQGNIVDQFSLNEIVKEYNGKTYCTNYHALLDAKENQRDEARRSWQTIENIKELKEGYMSQVIHKIVDLMIKYNAIVVLEDLNLGFKRGRQKVEKQVYQKFEKMLIDKLNYLVDKKLDANEAGGVLRAFQLTNKFESFQKLGKQSGFLFYIPAWNTSKMDPVTGFVNLLDTRYENMAKAKAFFGKFKSIRFNNSKNWFEFSFDYNDFTTKAEGTKTQWTLCTYSTRIETKRDPMQNNKYVSEEFELTNRFKDLFANTKYNIDLNGNLIEQICSQSDASFFKELLHLMNLTLQMRNSVVGTTIDYMISPVANANGEFYDSRNCGKNLPENADANGAYNIARKGLWIINQIKQTEDLTKVKLSISNKEWLQYAQKQIKNT

SEQ ID NO: 173 - protein, 1280 aa, unidentified
  REGION 1..1280: note = Description of Unknown:uncultivated organism sequence
  REGION 1..1280: note = Category: MG28 effectors
  REGION 1..1280: note = Description: MG28-33 effector
MKAFTNLYQVAKTLRFELIPDERTKEFLEHSKLIDKDEHRAESYVAVKGIIDRYHKAFIERVLSELKLQYAKEDKLNSLEELYSLYMKTQKSDADKKMLEQVQSNLRKQIANALTKDSQYKRMSGKELIREDLFKITTPEERTLVEEFADFTTYFSGFYENRKNMYSAEAQSTAISYRLINENLPKFIDNIATFHKILNSPVAEQLPTLYKEMKEYLNVNSIEEMFMLDYYDVVLTQTQIEVYNGVIGGRTTDDGQKIQGINEYVNLFNQKQSSRETRLPKLKPLFKQILSDRQTVSWLTEEFKTDRDMLDAIKERYDSLSSDVFPLLKELLQNLFSYNLNQIFIPNNLALTDISQSLYGDWGVIKREIMIRLKHDFPQTKKEKAEKYEERIEKTYKSFDSFSIAYLNEVLSEKSLDVCSYFATLGAVNNKDRQTENLFLQIKNAYHNAAELFEKDYPETKNLAQDKQSVDKLKVLMDALKALQHFVKPLMETGEEPEKDERFYGDLSVLMEELNLVTPLYNKVRNRMTRKPYSNEKFKLTFNIKGNFLGGWVDSKTEKSDNGTQYGGYLFRKKNSIGEYDYYLGVSANTKLFRKVEGASGQYERLDYYQPKSQTVYGNSYVGKDGYESDKQTLMHSIISYVGTTNDMNVKQQVESKDTPSSMITVIKDASPLLYQGLLDDPYFSDVNRRVTNNFHQTILSMTRIPRSKDYQGAKFTLFTEPQQVIEDICKEKVFGYFAVDDQEIADAMADTSKPFLLFKISNKDLSFAEKFEKGMRHSRGTDNLHTMYFKALMNGEQSVLDIGSGEVFFRRASIKANITHPARIAIKNKNNANEKKESCFDYDLIKDKRYTVDKFGFHLSIIQNYQSPNRYDVNALTREYIRNNPDVHFIGIDRGERHLLYVSVINSRGQIVEQFSMNKIENEYNQTDYHQLLEQRSDIRQKERQSWRTIEGIKELKQGYLSQVVHRIATLMVKYKAVVVLEDLNMGFKRGRQMVESSVYQQFEKALIDKLNYLVDKQVDANEPGGLLRGLQLTNKFTSFREMGKQNGFLFYIPAWNTSKMDPVTGFVDLLHPRYENVDKARAFFCKFKSIQYNDEKGWYEFRLDYNDFNAKAEGTKTLWSVCSNGTRIETFRNVEKNSSWDNREVCLTEEFDKLFADYHISRTGNLKEQIAQQTEKSFFERLTHLLNLTLQMRNSMTGTTIDYLVSPVADEDGVFYDSRTCSKELPENADANGAYNIARKGLWVACQIREAQDANKVKLNISNKQWLLFAQTKPYLSD

SEQ ID NO: 174 - protein, 1280 aa, unidentified
  REGION 1..1280: note = Description of Unknown:uncultivated organism sequence
  REGION 1..1280: note = Category: MG28 effectors
  REGION 1..1280: note = Description: MG28-34 effector
MKAFTNLYQVAKTLRFELIPDERTKEFLEHSKLIDKDEHRAESYVAVKGIIDRYHKAFIERVLSELKLQYAKEDKLNSLEELYSLYMKTQKSDADKKMFEQVQSNLRKQIANALTKDSQYKRMSGKELIREDLFKITTPEERTLVEEFADFTTYFSGFYENRKNMYSAEAQSTAISYRLINENLPKFIDNIATFHKILNSPVAEQLPTLYKEMEEYLNVNSIEEMFMLDYYDVVLTQTQIEVYNGVIGGRTTDDGQKIQGINEYVNLFNQKQSSRETRLPKLKPLFKQILSDRQTVSWLTEEFKTDREMLAAIKERYDLLSSDVFPLLTELLQNLSSYDLNQIFIPNNLALTDISQSLYGDWGVIKREIMIRLKHDFPQTKKEKAEKYEERIEKTYKSFDSFSIAYLNEVLSEKSLDVCSYFATLGAVNNKDRQTENLFLQIKNAYYDAAGLFEKDYPETKNLAQDKQSVDKLKVLMDALKALQHFVKPLMETGEEPEKDERFYGDLSVLMEELNLVTPLYNKVRNRMTRKPYSNEKFKLTFNIKGNFLGGWVDSKTEKSDNGTQYGGYLFRKKNSIGEYDYYLGVSANTKLFRKVEGASGQYERLDYYQPKSQTVYGNSYVGKDGYESDKQTLMHSIISYVGTTNDMNVKQQVESKDTPSAMITVIKDASPLLYQGLLDDPYFSDVNRRVTNNLHQTILSMTRIPRSKDYQDAKFTLFTEPQQVIEDICKEKVFGYFAVDDQEIADAMADTSKPFLLFKISNKDLSFAEKFEKGMRHSRGTDNLHTMYFKALMNGEQSVLDIGSGEVFFRRASIKANITHPARIVIKNKNNANEKKESCFDYDLIKDKRYTVDKFGFHLSIIQNYQSPNRYDVNALTREYIRNNPDVHFIGIDRGERHLLYVSVINRRGQIVEQFSMNKIENEYNQTDYHQLLEQRSDIRQKERQSWRTIEGIKELKQGYLSQVVHRIATLMVKYKAVVVLEDLNMGFKRGRQMVESSVYQQFEKALIDKLNYLVDKQVDANEPGGLLRGLQFTNKFTSFREMGKQNGFLFYIPAWNTSKMDPVTGFVDLLHPRYENVDKARAFFCKFKSIQYNDEKGWYEFHLDYNDFNAKAEGTKTLWSVCSNGTRIETFRNVEKNSSWDNREVCLTEEFDKLFADYHISRTGNLKEQIAQQTEKSFFERLTHLLNLTLQMRNSMTGTTIDYLVSPVADEDGVFYDSRTCSKELPENADANGAYNIARKGLWVARQIREAQDANKVKLNISNKQWLLFAQTKPYLSD

SEQ ID NO: 175 - protein, 1277 aa, unidentified
  REGION 1..1277: note = Description of Unknown:uncultivated organism sequence
  REGION 1..1277: note = Category: MG28 effectors
  REGION 1..1277: note = Description: MG28-35 effector
MDRFTNLYPVSKTLRFELIPDKRTKAILEKTDLISQDEHRAKSYKLVKKIIDRYHKAFIESVLGSFKLPNDDVNLLHELYSKSQKSDADKKAMEKVQDKLRKVIADALTKDDRFKRIDKKELIREDILSVITPDERALIDEFRDFTTYFTGFHENRRNMYSAEAQSTAIAYRLIHENLPKFIDNMATFEKIAASPVADHFPQLYQEMSECRLNVRDIQEMFSLDYYTELLTQSQIEVYNAVIGGRTVEDGGKKIQGINEYVNLYNQQQPSRDTRLPKLKPLFKQILSDREAVSWLDEEFDSDKSMLEAVRDIYHALDDHVFDPLRELLTNLPSYNLDGIFIPNDLAITDISQAMFKDWSVIKRAIADDVKAHCPLKRKETAENYEERISKLIKREGSFSIGYLNACMPGKDICEHFAGLGAVDDGEEQTENIFLQIRNAYADAQSLIENDYPESRNLAQDKEYVAKLKALLDAVKALQRFVKPLLGNGDEPDKDERFYGELAVLWEELDRVTPLYNKVRNRMNRKPYSIEKFKLNFNIKGNFLGGWVDSKTEKSDNGTQYGGYLFRKKNVIGEYDYYLGVSAKTKLFRRKEGAEGQYERLDYYQPKSQTVYGNSYVGPDGYDHDKRELMDAIVSFVGALGESELYQSLVSMGTPSAMLKALREQPLIYQQLLADRRFASINSKVTKYLHETILSLVRIPRSQDYVNAEFSLFTEPQEVIDNLCKEKVFTYFVVDDAEIEQAMNDENKPFLLFKISNKDLSYADTYSKGLRKSRGTDNLHTMYFKALMSGNQSVIDIGTGEMFYRKASISVDKPTHKANVPIKKKNPNNQGTESSFSYDLYKDRRFTVDKFGFHLSFIYNYLAKEQDMNKMAREYIHDHDDLHFIGIDRGERHLLYVTVIDSRGRIKEQFSLNEIVNEYQGNKYKTNYRGLLDKREEERQRERQSWNTIEGIKELKQGYLSQVIHKIVTLMVKYHAVVVLEDLNMGFKRGRQKVESSVYQQFEKALIDKLNLLIDKKADADQPGGLLHAYQLTNMFTSFREMGRQNGFLFYIPAWNTSKIDPVTGFVDLLHPRYESVEKSRSFFCKFKSVRYNQEKGWYEFSLDYNAFTTKAEGTRTCWTLCSHGTRVETYRNPDKNSSWDSREIDLTAELNALFEAYGINRQGNLKEAIAERDEKDFFERLMRLMALTLQMRNSITGTEVDYMISPVADENGNFYDSRSCGRELPENADANGAYNIARKGLWVARQIQASPVDERINMAVSNKEWLNFAQSKPYLDD

SEQ ID NO: 176 - protein, 1284 aa, unidentified
  REGION 1..1284: note = Description of Unknown:uncultivated organism sequence
  REGION 1..1284: note = Category: MG28 effectors
  REGION 1..1284: note = Description: MG28-36 effector
MKQFTNLYPVTKTLRFELIPDSRTKKYLENSDFINRDEHRAEYYKIVKKIIDRYHKVFIEEVLSSTKLQYAKTGRLDSLEELYSLLVKSQKTESDKKSIAKVQDKLRKQIVDAFKNDSRFKRIDKKELIREDIFKLVELTPEERALVEEFRDFTTYFNGFHENRKNMYSSEAQSTAIAFRLIHENLPKFIDNIAIFHRILRSPVAENFQQLYKDMEEYLNVNSLEEMFMLDYYNDVLTQTQIDVYNAIIGGRTLEDGKKIQGINEYVNLFNQQQSSRETCLPKLKPLYKQILSDKVAVSWLPEEFATDNELLEAVRDCYTSLSNNVFVKLEEMLTNLSEYNLNGVFIPNDLSLTNISQWLYGDWSFIKKAITKDLMENCPSKKNEKPEKYEERLEKHVKSEGYFSIAYLNSCLNNVQKNVCSYFNELGAVNTESKQIENLFSKIQNAYTDAKDLLESDYPKNKNLAQEKSEVAKIKLLLDALKELQHFVKPLTNAGDKAEKDEQFYSEMTIIWDELSRVTPLYNKVRNRMTRKPYSLEKFKLTFNIKGNFLGGWVDSKTEKSDNGTQYGGYLFRRKNAINEYDYYLGVSANTKLFRRQSGVVGEYERLDYYQPKSQTIYGNSYVGNNSYETDKEELKIAILEFVSKLGNDELLQQVGAKDTPSAMLTVIKESSNVIFNQLLIDEEFAKKNREVTDNLHQTILGMSRIPRAKEYRDASFTIFTEPQQVIDDICKDKVFSYFPVSDVEMNNAISDINKPFLLFKISNKDLSFAEMYSKGLRKSRGIENLHTMYFKALMEGNQSVLDIGTGEMFYRRASIKVAKPTHPSNQPIQKKSQSGESMFAYDLIKDRRFTVDKFGFHLSIIQNYQAAGKVDVNSMVRSYIHDNPDMHFIGIDRGERHLLYVSVIDSKGNIKEQFSMNQITKDYNGVEYKTNYRNLLDIRDDVRKQERQSWRTIEGIKELKQGYLSQVIHKIVTLMVKYRAIVVLEDLNMGFKRGRQKVESSVYQQFEKALIDKLSYLVDKQQDANKCGGLLKGFQLTNKFTSFRDMKKQNGFLFYISAWNTSKIDPVTGFVDLLHPKYENVDKARSFFCKFKSIRYNKQKGWYEFTFDYNDFTTQAEGTRTLWTICTRGSRIETFRNKDKNSEWDSHEINLTDEFNSLFCQYNISSNDNLKEVIARQTDKKFFESLIHLLCLTLQMRNSKTGTDIDYLISPVANEHGLFYDSRNCDSSLPENADANGAYNIARKGLWMARQIQGAERNEKIDFVITNKEWLNFAQTKPYLTD

SEQ ID NO: 177 - protein, 1276 aa, unidentified
  REGION 1..1276: note = Description of Unknown:uncultivated organism sequence
  REGION 1..1276: note = Category: MG28 effectors
  REGION 1..1276: note = Description: MG28-37 effector
MDRFTNLYPVSKTLRFELIPDKRTKAILEKTDLISQDEHRAESYKLVKKIIDRYHKAFIESVLGSFKLPNDDVNLLHELYSKSQKSDADKKAMEKVQDKLRKVIADALTKDDRFKRIDKKELIREDILRVITPDERALIDEFRDFTTYFTGFHENRRNMYSAEAQSTAIAYRLIHENLPKFIDNMATFEKIAASPVADHFPQLYQEMSECLNVRDIQEMFSLDYYTELLTQSQIEVYNAVIGGRTVENGGKKIQGINEYVNLYNQQQPSRDTRLPKLKPLFKQILSDREAVSWLDEEFDSDKSMLEAVRDCYHALDDRVFDPLRELLTNLPSYNLDGIFIPNDLAITDISQAMFKDWSVIKRTIADDVKAHCPLKRKETAENYEERISKLIKREGSFSIGYLNACMPGKDICEHFAGLGAVDDDEEQTENIFLQIRNAYADAQSLIENAYPEGRNLAQDKENVAKLKALLDAVKALQRFVKPLLGNGDEPDKDERFYGELAVMWEELDRVTPLYNKVRNRMTRKPYSIEKFKLNFNIKGNFLGGWVDSKTEKSDNGTQYGGYLFRKKNEIGEYDYYLGVSAKTKLFRRKEGAKGQYERLDYYQPKSQTVYGNSYVGPDGYDHDKRELMDAIVSFVGALGESELYQSLVSMGTPSAMLKALREQPLIYQQLLADRRFASINSKVTKYLHETILSLVRIPRSQDYVNAEFSLFTEPQEVIDNLCKEKVFTYFVVDDAEIEQAMNAENKPFLLFKISNKDLSYADTYSKGLRKSRGTDNLHTMYFKALMSGNQSVIDIGTGEMFYRKSSISVDKPTHKANVPIKKKNPNNQGTLSSFCYDLYKDRRFTVDKFGFHLSFIYNYLAKEQDMNKMAREYIHDHDDLHFIGIDRGERHLLYVTVIDSRGRIKEQFSLNEIVNEYQGNKYKTNYRGLLDKREEERQRERQSWNTIEGIKELKQGYLSQVIHKIVTLMVKYHAVVVLEDLNMGFKRGRQKVESSVYQQFEKALIDKLNLLIDKKADADQPGGLLHAYQLTNKFTSFREIGRQNGFLFYIPAWNTSKIDPVTGFVDLLHPRYESVEKSRSFFCKFKSIRYNQEKGWYEFSLDYNAFTTKAEGTRTCWTLCSHGTRVETYRNPEKNSSWDNREIDLTAELNALFEAYGINRQGNLKEAIAERDEKDFFERLMRLMALTLQMRNSITGTEVDYMISPVADENGNFYDSRSCGRELPENADANGAYNIARKGLWVARQIQASPVDERINMAVSNKEWLNFAQSKPYLDD

SEQ ID NO: 178 - protein, 1280 aa, unidentified
  REGION 1..1280: note = Description of Unknown:uncultivated organism sequence
  REGION 1..1280: note = Category: MG28 effectors
  REGION 1..1280: note = Description: MG28-38 effector
MKAFTNLYQVAKTLRFELIPDERTKEFLEHSKLIDKDEHRAESYVAVKGIIDRYHKAFIERVLSELKLQYAKEDKLNSLEELYSLYMKTQKSDADKKMLEQVQSNLRKQIANALTKDNQYKRMSGKELIREDLFKITTPEERTLVEEFADFTTYFSGFYENRKNMYSAEAQSTAISYRLINENLPKFIDNIATFHKILNSPVAEQLPTLYKEMEEYLNVNSIEEMFMLDYYDVVLTQTQIEVYNGVIGGRTTDDGQKIQGINEYVNLFNQKQSSRETRLPKLKPLFKQILSDRQTVSWLTEEFKTDRDMLDAIKERYDSLSSDVFPLLKELLQNLFSYNLNQIFIPNNLALTDISQSLYGDWGVIKREIMIRLKHDFPQTKKEKAEKYEERIEKTYKSFDSFSIAYLNEVLSEKSLDVCSYFATLGAVNNKDRQTENLFLQIKNAYHDAAGLFEKDYPETKNLAQDKQSVDKLKVLMDALKALQHFVKPLMETGEEPEKDERFYGDLSVLMEELNLVTPLYNKVRNRMTRKPYSNEKFKLTFNIKGNFLGGWVDSKTEKSDNGTQYGGYLFRKKNSIGEYDYYLGVSANTKLFRKVEGASGQYERLDYYQPKSQTVYGNSYVGKDGYESDKQTLMHSIISYVGTTNDMNVKQQVESKDTPSSMITVIKDASPLLYQGLLDDPYFSDVNRRVTNNLHQTILSMTRIPRSKDYQDAKFTLFTEPQQVIEDICKEKVFGYFAVDDQEIADAMADTSKPFLLFKISNKDLSFAEKFEKGMRNSRGTDNLHTMYFKALMNGEQSVLDIGSGEVFFRRASIKANITHPARIVIKNKNNANEKKESCFDYDLIKDKRYTVDKFGFHLSIIQNYQSPNRYDVNALTREYIRNNPDVHFIGIDRGERHLLYVSVINRRGQIVEQFSMNKIENEYNQTDYHQLLEQRSDIRQKERQSWRTIEGIKELKQGYLSQVVHRIATLMVKYKAVVVLEDLNMGFKRGRQMVESSVYQQFEKALIDKLNYLVDKQVDANEPGGLLRGLQFTNKFTSFREMGKQNGFLFYIPAWNTSKMDPVTGFVDLLHPRYENVDKARAFFCKFKSIQYNDEKGWYEFHLDYNDFNAKAEGTKTLWSVCSNGTRIETFRNVEKNSSWDNREVCLTEEFDKLFADYHISRTGNLKEQIAQQTEKSFFERLTHLLNLTLQMRNSMTGTTIDYLVSPVADEDGVFYDSRTCSKELPENADANGAYNIARKGLWVACQIREAQDANKVKLNISNKQWLLFAQTKPYLSD

SEQ ID NO: 179 - protein, 1277 aa, unidentified
  REGION 1..1277: note = Description of Unknown:uncultivated organism sequence
  REGION 1..1277: note = Category: MG28 effectors
  REGION 1..1277: note = Description: MG28-39 effector
MERFTNLYQVSKTLRFELIPDKRTKEILEHTDLIAQDEHRAESYKTVKKIIDRYHKNYIDSVLGTLKLPESDIDELYELYNKQQKTDAEKNALEKVQGKLRKLIADALSKDSRFKRIDKKELIREDILDIIIPEERSLIDEFRDFTTYFTGFHENRRNMYSAKAQSTAIAYRLIHENLPKFIDNMATFCKIAASPVAERFNDLYQEMAEYLNVREIGEMFKLDYFTEILTQKQIEIYNAVIGGRTLDDGTKIQGLNEYVNLYNQQQTTRETRLPKLKPLFKQILSDREGVSRLPEEFATDQEMLNAVKEYYKVLNDHVLSPLKELLVNLSSYNPNGVYITNDLSLSNISQSLYGDWSLIKKSMTEDIKRQCPRKKKETAENYDERIHQLIKREKSFSIDYLNDCIKSLGKDICTHFAALGATDDGDTQTVNLISQIRNAYTDAQSLLESNYPANRNLAQEKDNVDKLKGLLDAIKALQHFVKPLLGNGDEPKKDERFYGELAVLWEELDRITPLYNKVRNRMTRKPYSTEKFKLNFNIKGNFLGGWVDSKTEKSDNGTQYGGYLFRKKNSLNEYDYYLGVSANKKLFRRKNGAVGQYERLEYYQPKSQTVYGNSYVGPDGYDHDKKELMEAIVSFVGSLGDRELYEELTSKDTPSAMLMILKETPSFYQQLLVDQKFASINSKVTKYLHDTILSLYRIPRSQDYVNAVFTLFTEPQKVIDDLCQEKVFTYFVVDDAEIEQAMKDEVKPFLLFKISNKDLSFADTYCKGLRKSRGTENLHTMYFKALMSGNQATIDIGTGEMFYRKSSISYDKPTHTANVPIKKKNPTNQAAESIFCYDLFKNRRFSVDKFGFHLSIIYNYLCQDKDVNKMMREYIHDHNDLHFIGIDRGERHLLYVTVIDSHGRIKEQFSLNEIKNEYKGNTYSTDYRGLLSKREADRQHERQSWNTIESIKELKQGYLSQVIHKIVTLMVKYNAVVVLEDLNMGFKRGRQKVESSVYQQFEKALIDKLNLLVDKKTDPEQLGGLLHAYQLTNKFTSFRDMRLQNGFLFYIPAWNTSKIDPVTGFVDLLHPRYESVEKAQAFLCKFKSIRYNQDKGWYEFTLNYNDFTTKAEGTRTEWTLCTHGTRVETFRNADKNSSWDSREVDLTKAYHELFEEFAISSNGNLKEAITQQDSKAFFERLMYLLNLTLQMRNSIIGTEVDYMISPVADENGNFYDSRTCGDELPQNADANGAYNIARKGLWVARQIQAAPVDAKVDLAITNKEWLNFAQSKPYLDD

SEQ ID NO: 180 - protein, 1296 aa, unidentified
  REGION 1..1296: note = Description of Unknown:uncultivated organism sequence
  REGION 1..1296: note = Category: MG28 effectors
  REGION 1..1296: note = Description: MG28-40 effector
MKAFENFTGLYPLSKTLRFELKPIGKTLEYIEKNGLLDRDRHRANSYVEVKKIIDRYHKQFIEDSLSDSEFELKYEDKGKKDSLEEYFYYYKLRNRDEKQKKDFDEIQKNLRKQIASQFKKQDRFKRIDKKELIKEDLLEFVDNNEKKLIDEFRDFTTYFTGFHENRQNMYSDEAKSTAIAYRLIHENLPKFIDNISVFERVAATDIADCFAQIYSDFEEYLNVNNISEIFRLDYYTEILTQTQIDVYNLIIGGRSEGDVKIKGLNEYINLYNQQQKDKSQRLPKLKPLFKQILSDRNAISWLPESFENDNALLESLENCYRSYNETSADKKSIFARFKELLLAMSDYETDKIFVRNDLQLTDISQKMFGNYNVISKALYEDLKSNTHRKSNKETDESFEERLRDIAKKQDSFSIGKIDSSLKEMYVEECKKSVCDYFANLSVDDKGHDIFDRIEKAYSEVKDLLNSPYPLDKNLAQEDTDIDKIKNLLESIKDLQKFVKPLCGKGNESGKDENFYGEFTVLYEELDKITPLYNMVRNYLTRKPYSTEKVKLFFENNGAVLNGWVDSKTENSDNGTQYGGYLFRRKNGIGEYDYYLGISSDVKLFRKDSVIAECDKSEFERLDYYQLKSQTFYGSAYKGNYELETQNVIKAIDNFISKNGDADISEKIISDRANKNSKTGTAKGYLNFIKNTSIYDDLLNDDIFKKANDQLINSLKKTLISFERLSTARKIANYNYYLFSDLMDAVDVLMQEKVFTYNAVSINEFENTINRDKKPLLLFKITNKDLSFADTFLSGKRKSRGVENLHTLYFKALMSGKQNVFDIGTGSVYFREKSIRYSEEKMKYGHHYDMLKDKFQYPIISNKRYVYDKFQFHLSMVQNYNGNKNLDINPLANDYIKKSDDLHVIGIDRGERHLLYLTVIDMKGNIKKQFSLNEIVNEYKGNTYRTNYHDLLDAREKKRDVERKSWKTIETIKELKEGYLSQVIHKITELMVEYNAIIVLEDLNLGFMRGRQKVEKSVYQKFEKMLIDKLNYLADKKKDPEELGGVLKAYQLSNNPKYKVIKQSAFLFYTQAWNTSKIDPVTGFVNLFDTHYENILKSKNFFSKFDLIKYNSDKDWFEFSFDYNNFTTKAEGTKTKWTLCTFGNRIISFRNPDNNMQWDGKEINLTEEFKLFFEKFGININSDLHTEILKQDKKDFFEGLLHLLKLTLQMRNSKTRTDIDYMQSPVADENGAFYNSDECGESLPENADANGAYNIARKGLMIIDKIKKSDNLNKIDLTISNKEWLVFAQNKPYLKN

SEQ ID NO: 181 - protein, 1303 aa, unidentified
  REGION 1..1303: note = Description of Unknown:uncultivated organism sequence
  REGION 1..1303: note = Category: MG28 effectors
  REGION 1..1303: note = Description: MG28-41 effector
MGKLKDFKRIYTLSKTLRFELRPIGKTLEHIEKSGILSQDQHRAESYVEVKKIIDEYHKAFIENVLKDFRFSENRGEKNSLEEFLVYYMCKSKDETQKRQFADIQDKLRKQITQRFSDDDRFKRIDKKELIKEDLLSFVEDVEKRQLIEEFKDFTTYFTGFHENRKNMYTDEAQSTAIAYRLIHENLPKFIDNIMVFDKVAASPIAEHFAKLYSDFEEYLNVSELGEMFRLDYYNIVLTQTQIDVYNAIVGGKTLEDGRKIQGLNEYINLYNQQQKDKSARLPKLKPLYKQILSDRNAISWLPEQFQSDEKVLEAIQKAYQDLEEQVFNRKKEGEHSLKDLLLSLSDYDLSKIYIRNDAQMNDLSQKAFGHWDVIHKALLEQLKEYVQKKPKKESDEAYEERLNKIIKSQGSIPIALINQGVQKQNSEEQNTLQTYFATLGAAETESVKKENLFTQIENAYAEVKDLLNTPYSGMNLAQDEESVKKIKSLLDAIKALQHFVKPLLGDGTESEKDEKFYGEFSMLWEELDKITPLYNMVRNYMTRKPYSTEKFKLHFENNGSLLNGWVDSKTEKSDNGTQYGGYLFRKQNIIGEYDYYLGISSDTNLFRRDAVINDTDKSEFERLDYYQLKSQTVYGKSYQGDYNQESAQIISAIDSFVERTTNTNLKEKINQDRETKNPKTSTAKGYLNFLRKNSEIYDSIINDSAFVKANLQLIKSIKKTLCAFKRIPQAQKLAQKEFVLFVDLMNEIDEMVKEKVFTYVPISLKEFENSMERDKKPLFLFKISNKDISFAESYEKGLIKSRGTDNLHTMYFKALMNGNQNVFDIGTGVVYFRKHSIQYSDEKMKTGHHHNVLKDKFKYPIISNKRYVYDQFQFHLSIEQNYLAGKIGDFEMNRRVNEYIRQSDDLHIIGIDRGERHLLYLTVIDLQGRIKEQYSLNEIVNTYNGNEYRTNYHDLLSKREDERMKARQSWQTIENIKELKEGYLSQVIHKISELIVKYNAIVVLEDLNMGFMRGRQKVESSVYQKFEKMLIDKLNYLVDKKKNPEEDGGVLNAYQLTNKFESFQKLGKQSGFLFYTQAWNTSKIDPVTGFVNLFDTRYETREKAKTFFGKFDAIRYNTAKDWFEFAFDYSEFTSKAEGSRTNWTLCTYGERIETFRDEKQNSNWATRKINLTDKFKELFEKHKIDIQADLKEAISQQDSADFFKGLLYLLKLTLQMRNSEIGTEIDYMQSPVADANGNFYNSDTCDDSLPKNADANGAYNIARKGLWIVQQIKAADDLKNVKLSISNKEWLKFAQEKPYLNE

SEQ ID NO: 182 - protein, 1261 aa, unidentified
  REGION 1..1261: note = Description of Unknown:uncultivated organism sequence
  REGION 1..1261: note = Category: MG28 effectors
  REGION 1..1261: note = Description: MG28-42 effector
MSNFNEFTHLYQLSKTLRFELKPIGETLKHFNESGILDQDEHRAESYKKVKKLIDRYHKEFMEEALRDFVFQMDDEGKNNSLSEYFFLYSLGKRTEAQDNDFKEIKKNLREQIAKYFKASPKYKNLFKQELIKEDLCNNMQCNEEEQKLVEEFHNFTTYFTGFHENRKNMYSNEEKSTAIAFRLVHQNLPKFIDNIGAFDRARNIDEIKAGIKNLQKHFETKGLLKQGEKIEDFFALDYYSRLAVQSRIDIYNAILGGRATEKGEKIQGLNEYINLYNQQHKEARLPKMKALFKQILSDRQAISWIEESFKSDNEVLSSVNDFYENLKQNEIFDRTKELLTSVGSYDLSKVYITNDQQLTSISQQLYGSWAVIENAILADMQKDIPRKKKEDSEKYNERLKKAYSNKGSFSIAYIDQCLEAVFGEKHIPVEQHFTKRGEAEIETEAECGKIKIPDVFTQIEQTYSAAKTLLCNPYPKGKHLSQSDEDIEKVKNLLDALKRFQHFIKPLTGSGDEAEKDEMFYSDLTELWAEIDQLNSLYNRVRNHLTGKPYSEEKLKLNFENASLLTGWDKNMERANTAVILRKGKLYYLAIMKKEHNSIFASDNLPDKGECYEKMVYKQIALPLGFGGFARKCFGSATKLGWTYPTNLLNKEGKIIIKDEEAKDVLPELIDCYKDFLNIYEKDGFKYSSYNFKFKPSNQYEKLSQFFAEIQQQGYKITFQNISSDYIDQLVNEGKLYLFQIYNKDFSPSSKGTPNMHTLYWQMLFDERNLNDGVYQLNGQAEVFFRKKSLNYTKPTHPANQAIANKNPFKKKDKSEFTYDLIKDKRFTMDKFLFHVPITINFKSSKTYDIDAKVRQWLQKADDVHIIGIDRGERHLLYLTVIDCKGNIKEQMSLNTIENEYKGNTYAFDYHKRLDEKEKERDEARKNWKTVENIKELKEGYLSQAIHKITQLMLKYNAIIVLEDLNMGFMSGRQKVEKQVYQKFEKMLIDKLNYLADKKKDPSEVGGVLNAYQLTSKFESFTKLGRQSGFLFYIPAWNTSKIDPVTGFVNLFDTRYKNIDEAKKFFGSFKSISYNKDKNWFEFSFDYNDFTNKAEGTKTQWTVCTNGERIENFRSGENLNQWSGRKIVLSQEFKTLFDRYGIDFTKDLQNDICSQSDTGFFEQLLRLFKLTLQMRNSISNTETDYLISPVYDRNGNFYDSRNNRKDLPNNADANGAYNIARKGLMILNQIKQTSDLKKPKYDLTNKAWLNFIQKGYANKD

SEQ ID NO: 183 - protein, 1244 aa, unidentified
  REGION 1..1244: note = Description of Unknown:uncultivated organism sequence
  REGION 1..1244: note = Category: MG28 effectors
  REGION 1..1244: note = Description: MG28-43 effector
MKTFNDLTGLYSLSKTLRFELKPVGKTKDNIETKGIIAQDEKRAEEYKKVKDIIDRYHKSFIDMCLAGLVLKTTSDGNNDSLKDYVALASKSNRDEKEDKDFDDVKTVLRKHIVDAFKKGNSYGDLFKKELIQNHLPDFVTDEQEKLMVENFSKFTTYFTGFNENRKNMYSDEKKSTAIAYRLIHENLPMFIDNIKSFAKITEQEDIDFIADVEHSFKEELKGKSITQMFCLENFTETLTQGQIELYNKIVGGRVEDSGVKKQGINEYVNLYNQQHKDARLPLLKPLYKMILSDRVALSWLPEEFATDEEMLAAINETHGNLKDVLADVRELLQNINNYDTKHIYIANDKGLTDISQQIFGQYDVYTSAIKAELRNNTNHSAKEKKNPELLEKRINDIFKASKSFSIEYLNSHVDSDKTIQSYYKELGAYDRNGEQRINLLSQIELAYVDAHDVLLGKHTNLNQSEDSIKKIKALLDAYKALQHFIKPLLGNGDEADKDNEFDAKLRAIWDELDIVTPLYDKVRNRLTRKPYSTEKIKLNFDNAQLLNGWDMNKEPDCTSVLLRKDGQYYLAIMDKKSNHAFDADELPCDGECYEKMEYKQMALPMGMGAFVRKCFGTAKALGWQCPRHLMTSDGKIIIKDEEAQKVLPELIDCYKSFLDIYEKDGFKYKTFNFKFKPSSEYEKLSHFFAEVPSQGYKCSFRNVSVSFINQLVDEGKLYLFQIWNKDFSEYSKGTPNMHTLYWKMLFDERNLANVVYKLNGQAEVFYRKRSLDLDKTTIHRANQPIANKNMQNEKRESTFCYDIVKNRRYTVDKFQFHVPITINFKATGSDNINASVLDVIRNNGIEHIIGIDRGERHLLYLSLIDMKGNIVKQMTLNDIINEYKGNTYTTNYKELLQAREGDRKEARQNWQKIENIKELKEGYLSQVVHVITKMMVEYKAIVVLEDLNGGFMRGRQKIERQVYEKFEKMLIDKLNYYVDKQKDVNDNGGLLHAYQLASKFDTFKKLGKQSGCLFYIPAWNSSKIDPVTGFVNMLDTRYENADKARNFFSKFKSISYNADKDWFEFVIDDYSKFTDKAKDTRTDWVLCTYGTRIKTFRNPEKLNQWDNKEIVLTDEFKKVFMEAGIDINGNLKEAICTLTEKKHLESLMQLMKLLVQMRNSETNSEVDYLLSPVADTEGHFYDSRNCDDNLPKDADANGAYNIARKGLWAVMKIKASKPQENLKLGISNKEWLQFAQEKPYLND

SEQ ID NO: 184 - protein, 1264 aa, unidentified
  REGION 1..1264: note = Description of Unknown:uncultivated organism sequence
  REGION 1..1264: note = Category: MG28 effectors
  REGION 1..1264: note = Description: MG28-44 effector
MFKLLPDITGIVFFYRDSWRGYEEVITVDVVFYIGGNVMANSLSGFTGLYSLSKTLRFELRPVGKTKENMKIKGLLSEDEHRAKSYKQVKKIADDYHRKFIENALKNVHLEGVEEYAELYCKRNKTEKERKEIDKAADNLRKQVIKLMTTRDEFKKLGKKDFIEEMLPEFVDSEEKKKLIKEFKGFTTYFGGFFENRNNMYSAEKKSTSIGYRVIDQNLPKYIDNVNALKKILEVNPGNMIENIENDFMDMLEGKALNEFISLDNYSYFITQSGIDKYNTVIGGKSCDERTRIKGINEYVNLYNQKADKKIGILKPLYKQILSDKDSKSFLPESFERDNELLNAIELFNAGQKENIESIKGLFEQLSEYEADHIYVKDIFLSEISNELFSEWGYIKGRLEDKYDEEYTGKKKANTEKYIEERKKYFKNKRSYSLSELDAVLENNAVTSYFSGEQLKQAIINMADSYKDIEDLVNTDYPSDRKLQKDKESTKLIKGYLDACKDFGRFIQPLLGDGKESEKDAAFYGKFTPAWEAFDSITPLYNKVRNYMTKKPYSTEKVKLNFENQTLLAGWDLNKEEGNKSLIFIKDNNYYLGIMDKQHNKIFRDVEEAKSEPYYRKMEYKLLPGANKMLPKVFFAKSNIDFFNPSNKILEDYNAGRHKKGDNFDIKACHALIDFFKEAIEKHQEWRQFEFEFSPTETYKDISDFYREVEAQGYKISFKNISEKYIDELVDEGKLYLFKIWNKDFSPHSKGTPNLHTLYWKMIFDEKNLQDVVYKLNGEAEVFFRKASIDEKDIIKHEANKPIENKNKLNDKKKSVFNYDLIKDRRYTVDKFQFHVPITLNFKALGRDNIDRYAREYIKEAKDLHIIGIDRGERHLLYLTVIDMDGNIKEQYSLNEIVNEYNGKEHHINYHDLLDKREKEMERAKKEWQTIESIKELKEGYISQVIYKISQLMIKYNAILVLENLNEGFINGRKKVGKQVYQKFEKMMIDKLNYLVDKNLEEGEAGGLLKAYQLASKFESFKKLGKQSGMMFYIPAWNTSNIDPCTGFVNLFERKHLKYSSVNAAVDFWSKFESIAYDDKGEYFKFSFDYSRFTGRAEGTKTDWTVCSVGERIVNFRNPDNNSQWDSKTVDPTAEIIELCRGYDIDYKSEDLKTEFVSVKDRRFHEELLRLFRLVLQMRNSVTGTEIDYMISPVANAEGVFYDSRNCKKNLPENADANGAYNIARKGLWIINRIKETKEAELNKVNLNISNKEWLNFAQKNILR

SEQ ID NO: 185 - protein, 1228 aa, unidentified
  REGION 1..1228: note = Description of Unknown:uncultivated organism sequence
  REGION 1..1228: note = Category: MG28 effectors
  REGION 1..1228: note = Description: MG28-45 effector
MRQKYDGFESCYGISKVIRTGLIPQGATLEHIEKKGLLLLEAKRAEDYTKVKKIIDRYHRKYIDNQLKDAELSGVEESYSLYCKTNRTEKENTDLKKDLEKLRKQVSNFLTSSAEFKRIDKKELIEKDLLNFVQGDEEEEELVKSFKGFTTYFKGFHENRKNMYSHEEKSTAIAYRVINQNMFRYFDNIRSISKFILANSEKNIAELESIYSDKLNGKTLKEFFSVDNYSFFISQSGIDTYNMIIGGYSVDERTKVKGINEYINLFNQENHEKFGTLKPLYKQILAERTTESFLPEKFENDKEVIESLAAFSHNMSDTLLEIMEVFGKIGEYDASGIYLKYDSLKDISTCVFSDWSAITNALWERYDVQYIGKKKKETKAYIEEKRKHFKNLKSVSADEINTAMGENVLIPYSDAAKSLFEKICVAEENIRELINLDYPDDKELSKDKAAVKDIKAYLDSVKALQHHMKPLLGNQDESGKNEFFYGDFSGLWDELDALTPLYNKVRNYVTKKPYSTEKIKLNFDNSTLLNGWDLNKEEANTAILMQREGFLYLGIMDKKHNKIFRNIENTGCEDCYQKMEYKLLPGANKMLPKVFFSKKGIESFKPPLEILEIYKNETFKKGDAFNIDDCHTIIDFYKKALNEHEDWKKFEFKFSKTKDYRDISEFYREVEAQGYKISFKAIPKKIIDEYVEKGWLYLFKIWNKDFSEYSKGTPNLHTLYLKMLFDPRNLENVVYKLNGEAEIFYRKASIQPKDIIKHPANEAIKNKNPLNKKQSSIFKYDLIKDRRYTVDKFEFHVPITLNFKARGKENINTEVREYIKRSKNLYVIGVDRGERNLLYVSVVDADGSIVEQYSLNDIVNEYKGVQYRTDYHALLDTKEKNRDKARKEWTEIQNIKELKEGYISQVVHKICELMMKYEAIIALEDLNGGFKNSRKKVEKQVYQKFEKMLIEKLNYLVDKKADVNEPSGLLHALQLTSKFEGFNKLFGQSGFVFYVPAWNTSNIDPCTGFTNLFFSKDLRYASVENSLEFWKKFDSVAYDDTKDIFSFTFDYNNFNQRAEEIKSKSKWTVYSYGDRLETFRNADLNQQYDSREVKLTEAFKELFKKYEIPHENCEIKENILNCKERDFHDKLLHLFKLTLQLRNSKTGTMIDYMTSPVMDIDGNFFDSRTASSSLPQDADANGAYNIARKGLWLIEKLKNTKDADLPKAKLAIKNAEWLAYAQRNENNG

SEQ ID NO: 186 - protein, 1242 aa, unidentified
  REGION 1..1242: note = Description of Unknown:uncultivated organism sequence
  REGION 1..1242: note = Category: MG28 effectors
  REGION 1..1242: note = Description: MG28-46 effector
MNTYEELTGSYSLTKTISLALNPIGETLRHIEEKGFIAQDEQRAEDYKKVKDIIDRYHKYFITMCLDGFKFSTDKLMKYVALAENAKRDEDAFDEVKTQLRKEIVAAFEKGETYKDLFKKELILEHLPNFVTDENEKRLVASFNKFTTYFTGFHENRENMYSDEAKSTAIAHRLIHENLPMFYDNMKSFKKIAACEDCIDFAEFEAAFSEEFKEFKVEHLTDIFQLEYFNNTLTQRKIDFYKLVIGGKVLEDGTKLKGVNEYVNLYNQQHKDARLPLLKPLYKMILSDKVALSWLPEEFKSDEEMVEAIQEMHKNLKGALTDNAENNLRDLLLNMDKYDLAHIYIANDLGLTDISQNIFGQYDVYTSALKQALRNEYAPTPKERRNPELYDERINKLFKSRTSFSIAELNSLADSDHTIENHFKQLGAAERNGKQEIDLFSQIETAYAKASDILSGKHGNIGQSEAETALVKNLLDAYKSLQHFIKPLLGHGDEAEKDNEFDAKLRAAWDALDIINPLYNKVRNWLTRKPYSTEKIKLNFENAQLLNGWDKNKETDCTSVLLRKDGMYYLAIMNKKANHAFACDELPADGDCYEKIDYKQIALPMGLGAFVRKCGKTAEKLGWSCPEKLKNKDKKIITNDAEAEGVLPDLIDCYKAFLNTYEKDGFKYKDFNFKFKPSSEYSSLVEFFAEVPSQGYKIAFRKVSVAYINQLVESGKLYLFQIWNKDFSKFSKGTPNMHTLYWKQLFDERNLADVVYKLNGQAEVFYRKRSLKLEETTVHQAHQPIPNKNKQNEKRQSQFNYDIVKNRRFTVDKFQFHVPITLNFKATGRGNINDKVLEIIRNNGIKHVIGIDRGERHLLYLSLIDLKGNIIKQMTLNDIVNEYRGHTYATNYKDLLAEREDNRTEARRNWKKIDNIKEIKQGYLAQVVHIISKMMVEYKAIVILEDLNMGFMRGRQKIERSVYEQFEKSLIEKLNYYVDKQKDEEEVGGLLHALQLTSKFKSFKELGKQSGCLFYVPAWNTSKIDPVTGFVNLFDTKYVNVEKARAFFSNFDAIRYNAEKDWFEFAFNYSNFTDKAKDTREKWTLCTHGTSIRTFRNPSKLNQWDSEEVVLTDEFKKVFEKAGIDICGNLKNAICALKEKAHLEKLMQLMKLLLQMRNSKPNTEVDYMISPVADEQGNFYDSRCGNSALPDNADANGAYNIARKGLWVIKQIRETPAGKRPKLAIKNKEWLKFAQQKPYLDD

SEQ ID NO: 187 - protein, 1242 aa, unidentified
  REGION 1..1242: note = Description of Unknown:uncultivated organism sequence
  REGION 1..1242: note = Category: MG28 effectors
  REGION 1..1242: note = Description: MG28-47 effector
MNTYEELTGSYPLIKTINFALNPIGETLRHIEEKGFIAQDEQRAEDYKKVKDIIDRYHKYFITMCLDGFKFSTDNLMKYVALAEDAKRDKKAFDEVKAQLRKEIVGAFSKNKIYGDLFGEKLIKQHLPNFVTDENEKRLVASFNKFTTYFTGFHENRENMYSDEAKSTAIAYRLIHENLPMFYDNMKSFKKIAACEDCIDFAEFEAAFSEEFKAFKVEHLADIFQLEYFNNTLTQRKIDFYKLVIGGKVLEDGTKLKGVNEYVNLYNQQHKDARLPLLKPLYKMILSDKVALSWLPEEFESDEEMVEAIQEMHKNLKGALTDNAENNLRDLLLNMDKYDLAHIYIANDLGLTDISQNIFGQYDVYTSALKQALRNEYAPTPKERRNPELYDERINKLFKSRTSFSIAELNSLADCDHTIENHFKQLGAAERNGKQEIDLFSQIETAYAKASDILSGKYGNIGQSEAETALVKNLLDAYKSLQHFIKPLLGHGDEAEKDNEFDAKLRAAWDALDIINPLYNKVRNWLTRKPYSTEKIKLNFENAQLLNGWDKNKETDCTSVLLRKDGMYYLAIMNKKANHAFACDELPSDGDCYEKIDYKQIALRMGLGAFVRRCGKTAEKLGWSCPERLKNKDKKIITNDAEAEGVLPDLIDCYKAFLNTYEKDGFKYKDFNFKFKPSSEYSSLVEFFAEVPSQGYKIAFRKVSVAYINQLVESGKLYLFQIWNKDFSKFSKGTPNMHTLYWKQLFDERNLADVVYKLNGKAEVFYRKRSLKLEETTVHQAHQPISNKNKQNEKRQSQFNYDIVKNRRFTVDKFQFHVPITLNFKATGRGDINDKVLEIIRNNGIKHVIGIDRGERHLLYLSLIDLKGNIIKQMTLNDIVNEYRGHTYTTNYKDLLAEREDNRTEARRNWKKIDNIKEIKQGYLAQVVHIISKMMVEYKAIVILEDLNMGFMRRWQKIERSVYEQFEKSLIEKLNYYVDKQKDENEVGGLLHAFQLTSKFKSFKELGKQSGCLFYVPAWNTSKIDPVTGFVNLFDTKNVKGEKVRAFFSNFDAIRYNAERDWFEFAFNYSNFTNKARDTREEWTLCTHGTSIRTFRNPSKINHRDSEEVVLTDEFKKVFEKAGIDICGNLKNAICALKEKAHLEKLMQLMKLLLQMRNSKPNTEVDYMISPVADEQGNFYDSRCGNSALPDNADANGAYNIARKGLWVIKQIRETPAGKRPDWAIKNKEWLKFAQQKPYLDD

SEQ ID NO: 188 - protein, 1242 aa, unidentified
  REGION 1..1242: note = Description of Unknown:uncultivated organism sequence
  REGION 1..1242: note = Category: MG28 effectors
  REGION 1..1242: note = Description: MG28-48 effector
MNTYEELTGSYPLIKTINLALNPIGETLRHIEEKGFIAQDEQRAEDYKKVKDIIDRYHKYFITMCLDGFKFSTDKLMKYVALAENAKRDEDAFDEVKPQLRKEIVAAFEKGETYKDLFKKELILEHLPNFVTDENEKRLVASFNKFTTYFMGLHENRENMYSDEAKSTAIAHRLIHENLPMFYDNMKSFKKIAACEDCIDLAEFEAAFSEEFKEFKVEHLADIFQLEYFNNTLTQRKIDFYKLVIGGKVLEDGTKLKGVNEYVNLYNQQHKDARLPLLKPLYKMILSDKVALSWLPEEFKSDEEMMEAILEMHKNLKGALTDNAENNLRDLLLNMDKYDLAHIYIANDLGLTDISQNIFGQYDFYTSALKQALRNEYAPIPKERRNPELYDERINKLFKSRTSFSIAELNSLADCDHTIENHFKQLGAAERNGKQKIDLFSQIETAYAKASDILSGKHGNIGQSEAETALVKNLLDAYKSLQHFIKPLLGHGDEAEKDNEFDAKLRAAWDALDIINPLYNKVRNWLTRKPYSTEKIKLNFENAELLKGWDKNKETVNTSVLLRKDGMYYLAIMNEKAKNAFACDELPSDGDCYEKIDYKQIALRMGLGAFVRRCGKTAEKLGWSCPENLKNKDKKIITNDAEAEGVLPDLIDCYKAFLNTYEKDGFKYKDFNFKFKPSSEYSSLVEFFAEVPSQGYKIAFRKVSIAYINQLVESGNLYLFQIWNKDFSKFSKGTPNMHTLYWKQLFDERNLADVVYKLNGKAEVFYRKRSLKLEETTVHQAHQPISNKNKQNEKRQSQFNYDIVKNRRFTVDKFQFHVPITLNFKATGRGDINDKVLEIIRNNGIKHVIGIDRGERHLLYLSLIDLKGNIIKQMTLNDIVNEYRGHTYTTNYKDLLAEREDNRTEARRNWKKIDNIKEIKQGYLAQVVHIISKMMVEYKAIVILEDLNMGFMRRWQKIERSVYEQFEKSLIEKLNYYVDKQKDENEVGGLLHAFQLTSKFKSFKELGKQSGCLFYVPAWNTSKIDPVTGFVNLFDTKNVKGEKVRAFFSNFDAIRYNAERDWFEFAFNYSNFTNKARDTREEWTLCTHGTSIRTFRNPSKINHRDSEEVVLTDEFKKVFEKAGIDICGNLKNAICALKEKAHLEKLMQLMKLLLQMRNSKPNTEVDYMISPVADEQGNFYDSRCGNSALPDNADANGAYNIARKGLWVIKQIRETPAGKRPDWAIKNKEWLKFAQQKPYLDD

SEQ ID NO: 189 - protein, 1242 aa, unidentified
  REGION 1..1242: note = Description of Unknown:uncultivated organism sequence
  REGION 1..1242: note = Category: MG28 effectors
  REGION 1..1242: note = Description: MG28-49 effector
MNTYEELTGLYSFKKTISLALNPIGETLRHIEEKGFIAQDEQRAEDYKKVKDIIDRYHKYFITMCLDVFKFSTDKLMKYVALAENAKRDEDAFDEVKTQLRKEIVGAFSKNKTYGDLFGEKLIKQHLPNFVTDENEKRLVASFNEFTTYFEKFHKCRENMYSDEAKSTAIAHRLIHENLPMFYDNMKSFKKIAACEDCIDFAEFEAAFSEEFKEFKVEHLADIFQLEYFNNTLTQRKIDFYKLVIGGKVLEDGTKLKGVNEYVNLYNQQHKDARLPLLKPLYKMILSDKVALSWLPEKFESDEEMVEAIQEMHKNLKGTLIDNAENNLRDLLLNMGKYDLAHIYIANDLGLRDISQSIFGQYDVYTSAIKQALRNEYAPIPKERRNPELYDERINKLFKLRTSFSIAELNSLADSDHTIENHFKQLGAAERNGKQEIDLFSQIETAYAKASDILSGKHGNIGQSEAETALVKNLLDAYKSLQHFIKPLLGHGDEAEKDNEFDAKLRAAWDALDIINPLYNKVRNWLTRKPYSTEKIKLNFENAQLLNGWDKNKETDCTSVLLRKDGMYYLAIMNKKANHAFACDELPADGDCYEKIDYKQIALPMGLGAFVRKCGKTAEKLGWSCPEKLKNKDKKIITNDAEAEGVLPDLIDCYKAFLNTYEKDGFKYKDFNFKFKPSSEYSSLVEFFAEVPSQGYKIAFRKVSLAYINQLVESGKLYLFQIWNKDFSKFSKGTPNMHTLYWKQLFDERNLADVVYKLNGQAEVFYRKRSLKLEETTVHQAHQPILNKNKQNEKRQSQFNYDIVKNRRFTVDKFQFHVPITLNFKATGRGNINDKVLEIIRNNGIKHVIGIDRGERHLLYLSLIDLKGNIIKQMTLNDIVNEYRGHTYATNYKDLLAEREDNRTEARRNWKKIDNIKEIKQGYLAQVVHIISKMMVEYKAIVILEDLNMGFMRGRQKIERSVYEQFEKSLIEKLNYYVDKQKDEEEVGGLLHALQLTSKFKSFKELGKQSGCLFYVPAWNTSKIDPVTGFVNLFDTKYVNVEKARAFFSNFDAIRYNAEKDWFEFAFNYSNFTDKAKDTREEWTLCTHGTSIRTFRNPSKLNQWDSEEVVLTDEFKKVFEKAGIDICGNLKNAICALKEKAHLEKLMQLMKLLLQMRNSKPNTEVDYMISPVADEQGNFYDSRCGNSALPDNADANGAYNIARKGLWVIKQIRETPAGKRPKLAIKNKEWLKFAQQKPYLDD

SEQ ID NO: 190 - protein, 1244 aa, unidentified
  REGION 1..1244: note = Description of Unknown:uncultivated organism sequence
  REGION 1..1244: note = Category: MG28 effectors
  REGION 1..1244: note = Description: MG28-50 effector
MKTFNDLTGLYSLSKTLRFELKPVGKTKDNIETKGIIAQDEKRAEEYKKVKDIIDRYHKSFIDMCLAGLVLKTTSDGNNDSLKDYVALASKSNRDEKEDKDFDDVKTVLRKHIVDAFKKGNSYGDLFKKELIQNHLPDFVTDEQEKLMVENFSKFTTYFTGFNENRKNMYSDEKKSTAIAYRLIHENLPMFIDNIKSFAKITEQEDIDFIADVEHSFKEELKGKSITQMFCLENFTETLTQGQIELYNKIVGGRVEDSGVKKQGINEYVNLYNQQHKDARLPLLKPLYKMILSDRVALSWLPEELATDEEMLAAINETHGNLKDVLADVRELLQNINNYDTKHIYIANDKGLTDISQQIFGQYDVYTSAIKAELRNNTNHSAKEKKNPELLEKRINDIFKASKSFSIEYLNSHVDSDKTIQSYYKELGAYDRNGEQRINLLSQIELAYVDAHDVLLGKHTNLNQSEDSIKKIKALLDAYKALQHFIKPLLGNGDEADKDNEFDAKLRAIWDDLDIVTPLYDKVRNRLTRKPYSTEKIKLNFDNAQLLNGWDMNKEPDCTSVLLRKDGQYYLAIMDKKSNHAFDADELPCDGECYEKMEYKQMALPMGMGAFVRKCFGTAKALGWQCPRHLMTSDGKIIIKDEEAQKVLPELIDCYKSFLDIYEKDGFKYKTFNFKFKPSSEYEKLSHFFAEVPSQGYKCSFRNVSVSFINQLVDEGKLYLFQIWNKDFSEYSKGTPNMHTLYWKMLFDERNLANVVYKLNGQAEVFYRKRSLDLDKTTIHRANQPIANKNMQNEKRESTFCYDIVKNRRYTVDKFQFHVPITINFKATGSDNINASVLDVIRNNGIEHIIGIDRGERHLLYLSLIDMKGNIVKQMTLNDIINEYKGNTYTTNYKELLQAREGDRKEARQNWQKIENIKELKEGYLSQVVHVITKMMVEYKAIVVLEDLNGGFMRGRQKIERQVYEKFEKMLIDKLNYYVDKQRDANENGGLLHAYQLASKFDTFKKLGKQSGCLFYIPAWNTSKIDPVTGFVNMFDTRYENADKTRNFFSKFKSISYNADKDWFEFVIGDYSKFTDKAKDTRTDWVLCTYGTRIKTFRNPEKLNQWDNKEIVLTDEFKKVFMEAGIDINGNLKEAICTLTEKKHLESLMQLMKLLVQMRNSETNSEVDYLLSPVADTEGHFYDSRNCGDNLPKDADANGAYNIARKGLWAVMKIKASKPQENLKLGISNKEWLQFAQEKPYLND

SEQ ID NO: 191 - protein, 1226 aa, unidentified
  REGION 1..1226: note = Description of Unknown:uncultivated organism sequence
  REGION 1..1226: note = Category: MG28 effectors
  REGION 1..1226: note = Description: MG28-51 effector
MRQKYDGFESCYGISKVIRTGLIPQGATLEHIEKKGLLLSEEKRAEDYTKVKKIIDRYHRKYIDNQLKDAELSGVEESYSLYCKTNRTEKENTDLKKFLEKLRKQVSNFLTSSDEFKRIDKKELIEKDLLNFVQGDEEEEELVKSFKGFTTYFKGFHENRKNMYSHEEKSTAIAYRVINQNMFRYFDNIRSISKFILANSENNIAELESIYSDKLKGKTLEEFFSVDNYSFFISQSGIDTYNMIIGGYSVDERTKVKGINEYINLFNQENHEKFGTLKPLYKQILAERTTESFLPEKFENDKEVIESLAAFSHNMSDTLLEIMEVFGKIGEYDASGIYLKYDSLKDISTCVFSDWSAITNALWERYDVQYIGKKKKETKAYIEEKRKHFKNLKSVSADEINTAMGENVLIPYSDAAKSLFEKICVAEENIRELINLDYPDDKELSKDKAAVKDIKAYLDSVKALQHHMKPLLGNQDESGKNEFFYGDFSGLWDELDALTPLYNKVRNYVTKKPYSTEKIKLNFDNSTLLNGWDLNKEEANTAILMQREGFLYLGIMDKKHNKIFRNIENTGCEDCYQKMEYKLLPGANKMLPKVFFSKKGIESFKPPLEILEIYKNETFKKGDAFNIDDCHTIIDFYKKALNEHEDWKKFEFKFSKTKDYRDISEFYREVEAQGYKISFKAIPKKIIDEYVEKGWLYLFKIWNKDFSEYSKGTPNLHTLYLKMLFDPRNLENVVYKLNGEAEIFYRKASIQPKDIIKHPANEAIKNKNPLNKKQSSIFKYDLIKDRRYTVDKFEFHVPITLNFKARGKENINTEVREYIKRSKNLYVIGVDRGERNLLYVSVVDADGSIVEQYSLNDIVNEYKGVQYRTDYHALLDTKEKNRDKARKEWTEIQNIKELKEGYISQVVHKICELMMKYEAIIALEDLNGGFKNSRKKVEKQVYQKFEKMLIEKLNYLVDKKADVNEPSGLLHALQLTSKFEGFNKLFGQSGFVFYVPAWNTSNIDPCTGFTNLFFSKDLRYSGVENSLEFWKRFDSVAYDDRKDMFAFAFDYNNFNQRAEGSKSKWTVYSYGDRLETFRNPDLNQQYDSREVKLTEAFKELFKKYGISYKSCEIKENILNCKERGFHEKLLHLFKLTLQLRNSKTGTMIDYMTSSVMSVDGNFFDSRTASSKLPQDADANGAYNIARKGLWLIEKLKNTKDADLPKAKLAIKNAEWLAYAQRNENNG

SEQ ID NO: 192 - protein, 1242 aa, unidentified
  REGION 1..1242: note = Description of Unknown:uncultivated organism sequence
  REGION 1..1242: note = Category: MG28 effectors
  REGION 1..1242: note = Description: MG28-52 effector
MNTYEELTGSYSLIKTINFALNPIGETLRHIEEKGFIAQDEQRAEDYKKVKDIIDRYHKYFITMCLDGFKFSTDNLMKYVALAENAKRDEGAFNEVKTQLRKEIVAAFEKGETYKDLFKKELILEHLPNFVTDENEKRLVASFNKFTTYFMGLHENRENMYSDEAKSTAIAHRLIHENLPMFYDNMKSFKKIAACEDCIDLAEFEAAFSEEFKEFKVEHLADIFQLEYFNNTLTQRKIDFYKLVIGGKVLEDGTKLKGVNEYVNLYNQQHKDARLPLLKPLYKMILSDKVALSWLPEEFKSDEEMVEAILEMHKNLKGALTDNAENNLRDLLLNMDKYDLAHIYIANDLGLTDISQNIFGQYDFYTSALKQALRNEYAPIPKERRNPELYDERINKLFKSRTSFSIAELNSLADCDHTIENHFKQLGAAERNGKQEIDLFSQIETAYAKASDILSGKHGNIGQSEAETALVKNLLDAYKSLQHFIKPLLGHGDEAEKDNEFDAKLRAAWDALDIINPLYNKVRNWLTRKPYSTEKIKLNFENAELLKGWDKNKETVNTSVLLRKDGMYYLAIMNEKAKNAFACDELPSDGDCYEKIDYKQIALRMGLGAFVRRCGKTAEKLGWSCPENLKNKDKKIITNDAEAEGVLPDLIDCYKAFLNTYEKDGFKYKDFNFKFKPSSEYSSLVEFFAEVPSQGYKIAFRKVSVAYINQLVESGNLYLFQIWNKDFSKFSKGTPNMHTLYWKQLFDERNLADVVYKLNGKAEVFYRKRSLKLEETTVHQAHQPISNKNKQNEKRQSQFNYDIVKNRRFTVDKFQFHVPITLNFKATGRGDINDKVLEIIRNNGIKHVIGIDRGERHLLYLSLIDLKGNIIKQMTLNDIVNEYRGHTYTTNYKDLLAEREDNRTEARRNWKKIDNIKEIKQGYLAQVVHIISKMMVEYKAIVILEDLNMGFMRRWQKIERSVYEQFEKSLIEKLNYYVDKQKDENEVGGLLHAFQLTSKFKSFKELGKQSGCLFYVPAWNTSKIDPVTGFVNLFDTKNVKGEKVRAFFSNFDAIRYNAEKDWFEFAFNYSNFTDKAKDTREEWTLCTHGTSIRTFRNPSKLDHWDSEEVVLTDEFKKVFEKAGIDICGNLKNAICALKEKAHLEKLMQLMKLLLQMRNSKPKTEVDYMISPVADEQGNFYDSRCGNSALPDNADANGAYNIARKGLWVIKQIRETPAGKRPDWAIKNKEWLKFAQQKPYLDD

SEQ ID NO: 193 - protein, 1275 aa, unidentified
  REGION 1..1275: note = Description of Unknown:uncultivated organism sequence
  REGION 1..1275: note = Category: MG28 effectors
  REGION 1..1275: note = Description: MG28-53 effector
MEQFTNLYPVSKTLRFELIPDERTKDFLEHSDLINQDEHRAESYKAVKKIIDRYHKAFIDDVLSSLKLQYAKTGHLDSLEELYSLYISSQKIEKVQEQLRKQIVKALTQDSRFKRMGKKELIREDIFKAISLTSEEQKLVEEFHDFTTYFNGFHENRKNMYSAEAQSTAIAYRLIHENLPKFIDNIAIFQKILHSPVAENFPQLYKEMEEHLNVNSIEEMFMLDYYNEVLTQTQIEVYNAIIGGRTMQDGSKIQGINEYVNLYNQKQSARENRLPKLKPLFKQILSDRETMSWLPEEFSSDAELLEAVNDCYASLNDHVFTPLQDMLSCLSDFSLEGVFVPNDLSITDISQKLYGDWSVIKQTVISDLKTKNPPKRNEKPEKYEERISKLLKSTDSFSVAYLNGCLADKKGDICSYFCNLGAVNTTTEQKENLFLQIQNAYAEASELLSKEYPREKNLSQDKPNVEKLKALLDAIKSLQHFVKPLLGAGDEAGKDERFYGEMAILWEELSKVTQLYNKVRNRMTRKPYSTEKFKLTFNIKGNFLGGWVDSKTDRSDNGTQYGGYLFRRKNAINEYDYYLGMSANTKLFRRQANVEGTYERLDYYQPKSQTVYGNSYVGKNGYEADKQALLKSILTFVANTGNEELMQQVNSKDTPSAMLTVMKEASETFYEQLLEDTDFSAINKEVTDNLHKTILSMNRIPRVNDYKDVEFEVFTEPQQVIDDICKDKVFSYFPVSDDEMNQAMADANRPLLLFKISNKDLSYAEKHSKGLRQSRGAENLHTMYFKALMSGSQSVFDIGTGEVFFRRSSLNVSKPTHPQSTPIQNKNLEGCSSFNYDLIKDKRYTVDKFVFHLSMIQNYQTSGKADVNAMTRDFIHDHFDEMHFIGIDRGERHLLYVSVIDSKGNIKEQFSLNQIANEYRGNSYKTDYHSLLGKREETRQRERQSWRTIEGIKELKQGYLSQVVHKIVTLMVKYQAIVVLEDLNMGFKRGRQKVESSVYQQFEKALIDKLNYLVDKQQAPNDYGGLLKGYQLTNKFTSFRDMKRQNGFLFYIPAWNTSKIDPVTGFVDLLHPKYENVEKARTFFCKFKSIRYNSEKDRYEFTFDYNDFTTQADGTRTLWTICTHGERIETYRNPEKNSQWDSREVDLTESMTLLFSKYNISQHENLKEAIARQTEKQFFEKLIHLLRLMLQMRNSKTGTDVDYLISPVADENGCFFDSRSCDKTLPENADANGAYNIARKGLWIARQIQRTGVDAKSDLSITNKEWLKFAQFKDV

SEQ ID NO: 194 - protein, 1242 aa, unidentified
  REGION 1..1242: note = Description of Unknown:uncultivated organism sequence
  REGION 1..1242: note = Category: MG28 effectors
  REGION 1..1242: note = Description: MG28-54 effector
MNTYEELTGSYSLIKTINFALNPIGETLRHIEEKGFIAQDEQRAEDYKKVKDIIDRYHKYFITMCLDGFKFSTDKLMKYVALAENAKRDEGAFNEVKTQLRKEIVAAFEKGETYKDLFKKELILEHLPNFVTDENEKRLVASFNKFTTYFTGFHENRENMYSDEAKSTAIAYRLIHENLPMFYDNMKSFKKIAACEDCIDFAEFEAAFSEEFKEFKVEHLADIFQLEYFNNTLTQRKIDFYKLVIGGKVLEDGTKLKGVNEYVNLYNQQHKDARLPLLKPLYKMILSDKVALSWLPEEFKSDEEMVEAIQEMHKNLKGALTDNAENNLRDLLLNMDKYDLAHIYIANDLGLTDISQNIFGQYDVYTSAIKQALRNEYAPTPKERRNLELYDERINKLFKSRTSFSIAELNSLADCDHTIENHFKQLGAAERNGKQEIDLFSQIETAYAKASDILSGKHGNIGQSEAETALVKNLLDAYKSLQQFIKPLLGHGDEAEKDNEFDAKLRAAWDALDIINPLYNKVRNWLTRKPYSTEKIKLNFENAQLLNGWDKNKETDCTSVLLRKDGMYYLAIMNKKANHAFACDELPADGDCYEKIDYKQIALPMGLGAFVRKCGKTAEKLGWSCPEKLKNKDKKIITNDAEAEGVLPDLIDCYKAFLNTYEKDGFKYKDFNFKFKPSSEYSSLVEFFAEVPSQGYKIAFRKVSVAYINQLVESGKLYLFQIWNKDFSKFSKGTPNMHTLYWKQLFDERNLADVVCKLNGQAEVFYRKRSLKLEETTVHQAHQPIPNKNKQNEKRQSQFNYDIVKNRRFTVDKFQFHVPITLNFKATGRGNINDKVLEIIRNNGIKHVIGIDRGERHLLYLSLIDLKGNIIKQMTLNDIVNEYRGHTYATNYKDLLAEREDNRTEARRNWKKIDNIKEIKQGYLAQVVHIISKMMVEYKAIVILEDLNMGFMRGRQKIERSVYEQFEKSLIEKLNYYVDKQKDEEEVGGLLHALQLTSKFKSFKELGKQSGCLFYVPAWNTSKIDPVTGFVNLFDTKYVNVEKARAFFSNFDAIRYNAEKDWFEFAFNYSNFTDKAKDTREKWTLCTHGTSIRTFRNPSKLNQWDSEEVVLTDKFKKVFEKAGIDICGNLKNAICALKEKAHLEKLMQLMKLLLQMRNSKPNTEVDYMISPVADEQGNFYDSRCGNSALPDNADANGAYNIARKGLWVIKQIRETPAGKRPKLAIKNKEWLKFAQQKPYLDD

SEQ ID NO: 195 - protein, 1242 aa, unidentified
  REGION 1..1242: note = Description of Unknown:uncultivated organism sequence
  REGION 1..1242: note = Category: MG28 effectors
  REGION 1..1242: note = Description: MG28-55 effector
MNTYEELTGSYSLTKTISLALNPIGETLRHIEEKGFIAQDEQRAEDYKKVKDIIDRYHKYFITMCLDGFKFSTDKLMKYVALAENAKRDEDAFDEVKTQLRKEIVAAFEKGETYKDLFKKELILEHLPNFVTDENEKRLVASFNKFTTYFTGFHENRENMYSDEAKSTAIAHRLIHENLPMFYDNMKSFKKIAACEDCIDFAEFEAAFSEEFKEFKVEHLTDIFQLEYFNNTLTQRKIDFYKLVIGGKVLEDGTKLKGVNEYVNLYNQQHKDARLPLLKPLYKMILSDKVALSWLPEEFKSDEEMVEAIQEMHKNLKGALTDNAENNLRDLLLNMDKYDLAHIYIANDLGLTDISQNIFGQYDVYTSALKQALRNEYAPIPKERRNPELYDERINKLFKSRTSFSIAELNSLADCDHTIENHFKQLGAAERNGKQEIDLFSQIETAYAKASDILSGKHGNIGQSEAETALVKNLLDAYKSLQHFIKPLLGHGDEAEKDNEFDAKLRAAWDALDIINPLYNKVRNWLTRKPYSTEKIKLNFENAQLLNGWDKNKETDCTSVLLRKDGMYYLAIMNKKANHAFACDELPADGDCYEKIDYKQIALPMGLGAFVRKCGKTAEKLGWSCPERLKNKDKKIITNDAEAEGVLPDLIDCYKAFLNTYEKDGFKYKDFNFKFKPSSEYSSLVEFFAEVPSQGYKIAFRKVSVAYINQLVESGKLYLFQIWNKDFSKFSKGTPNMHTLYWKQLFDERNLADVVYKLNGQAEVFYRKRSLKLEETTVHQAHQPIPNKNKQNEKRQSQFNYDIVKNRRFTVDKFQFHVPITLNFKATGRGNINDKVLEIIRNNGIKHVIGIDRGERHLLYLSLIDLKGNIIKQMTLNDIVNEYRGHTYATNYKDLLAEREDNRTEARRNWKKIDNIKEIKQGYLAQVVHIISKMMVEYKAIVILEDLNMGFMRGRQKIERSVYEQFEKSLIEKLNYYVDKQKDEEEVGGLLHALQLTSKFKSFKELGKQSGCLFYVPVWNTSKIDPVTGFVNLFDTKYVNVEKARAFFSNFDAIRYNAEKDWFEFAFNYSNFTDKAKDTREKWTLCTHGTSIRTFRNPSKLNQWDSEEVVLTDEFKKVFEKAGIDICGNLKNAICALKEKAHLEKLMQLMKLLLQMRNSKPNTEVDYMISPVADEQGNFYDSRCGNSALPDNADANGAYNIARKGLWVIKQIRETPAGKRPKLAIKNKEWLKFAQQKPYLDD

SEQ ID NO: 196 - protein, 1240 aa, unidentified
  REGION 1..1240: note = Description of Unknown:uncultivated organism sequence
  REGION 1..1240: note = Category: MG28 effectors
  REGION 1..1240: note = Description: MG28-56 effector
MNTYEELTGSYSLTKTISLALNPIGETLRHIEEKGFIAQDEQRAEDYKKVKDIIDRYHKYFITMCLDRFKFSTDKLMKYVALAENAKRDEDAFDEVKTQLRKEIVVAFEKGETYKDLFKKELILEHLPNFVTDENEKRLVASFNKFTTYFTGFYENRENMYSDEVKSTAIAHRLIHENLPMFYDNMKSFKKIAACEDCIDFTEFEAAFSEEFKEFKVEHLADIFQLEYFNNTLTQRKIDFYKLVIGGKVLEDGTKLKGVNEYVNLYNQQHKDARLPLLKPLYKMILSDKVALSWLPEEFKSDEEMVEAIQEMHKNLKGALTDNAENNLRDLLLNMDKYDLAHIYIANDLDLTDISQNIFGQYDVYTSALKQALRNEYAPTPKERRNPELYDERINKLFKSRTSFSIAELNSLADSDHTIENHFKQLGAAERNGKQEIDLFSQIETAYAKASDILSGKHGNIGQSEAETALVKNLLDAYKSLQHFIKPLLGHGDEAEKDNEFDAKLRAAWDALDIINPLYNKVRNWLTRKPYSTEKIKLNFENAQLLNGWDKNKETDCTSVLLRKDGMYYLAIMNKKANHAFACDELPADGDCYEKIDYKQIALPMGLGAFVRKCGKTAEKLGWSCPEKLKNKDKKIITNDAEAEGVLPDLIDCYKAFLNTYEKDGFKYKDFKFKPSSEYSSLVEFFAEVPSQGYKIAFRKVSVAYINQLVESGKLYLFQIWNKDFSKFSKGTPNMHTLYWKQLFDERNLADVVYKLNGQAEVFYRKRSLKLEETTVHQAHQPIPNKNKQNEKRQSQFNYDIVKNRRFTVDKFQFHVPITLNFKATGRGNINDKVLEIIRNNGIKHVIGIDRGERHLLYLSLIDLKGNIIKQMTLNDIVNEYRGHTYATNYKDLLAEREDNRTEARRNWKKIDNIKEIKQGYLAQVVHIISKMMVEYKAIVILEDLNMGFMRGRQKIERSVYEQFEKSLIEKLNYYVDKQKDEEEVGGLLHALQLTSKFKSFKELGKQSGCLFYVPAWNTSKIDPVTGFVNLFDTKYVNVEKARAFFSNFDAIRYNAEKDWFEFAFNYSNFTDKAKDTREKWTLCTHGTSIRTFRNPSKLNQWDSEEVVLTDEFKKVFEKAGIDICGNLKNAICALKEKAHLEKLMQLMKLLLQMRNSKPNTEVDYMISPVADEQGNFYDSRCGNSALPDNADANGAYNIARKGLWVIKQIRETPAGKRPKLAIKNKEWLKFAQQKPYLDD

SEQ ID NO: 197 - protein, 1271 aa, unidentified
  REGION 1..1271: note = Description of Unknown:uncultivated organism sequence
  REGION 1..1271: note = Category: MG28 effectors
  REGION 1..1271: note = Description: MG28-57 effector
MEQFTNLYPVSKTLRFELIPDERTKDFLEHSDLINQDEHRAESYKAVKKIIDRYHKAFIDDVLSSLKLQYAKTGHLDSLEELYSLYISSQKIEKVQEQLRKQIVKALTQDSRFKRMGKKELIREDIFKAISLTSEEQKLVEEFHDFTTYFNGFHENRKNMYSADAQSTAIAYRLIHENLPKFIDNIAIFQKILHSPVAENLPQLYKEMEEYLNVNSIEEMFMLDYYNEVLTQAQIEVYNAIIGGRTLEDGTKIQGINEYVQKQTSRGNRLPKLKPLFKQILSDREAVSWLPEEFSSDAELLEAVNDCYASLNDHVFTPLQDMLSCLSDFSLEGVFVPNDLSITDISQKLYGDWSVIKQTVISDLKTKNPPKRNEKPEKYEERISKLLKSTDSFSVAYLNGCLADKKGDICSYFCNLGAVNTTTEQKENLFLQIQNAYAEASELLSKEYPREKNLSQDKPNVEKLKALLDAIKSLQHFVKPLLGAGDEAGKDERFYGEMAILWEELSKVTQLYNKVRNRMTRKPYSTEKFKLTFNIKGNFLGGWVDSKTDRSDNGTQYGGYLFRRKNAINEYDYYLGMSANTKLFRRQANVEGTYERLDYYQPKSQTVYGNSYVGKNGYEADKQALLKSILTFVANTGNEELMQQVNSKDTPSAMLTVMKEASETFYEQLLEDTDFSAINKEVTDNLHKTILSMNRIPKVNDYKDVEFKVFTEPQQVIDDICKDKVFSYFPVSDDEMNQAMADANRPLLLFKISNKDLSYAEKHSKGLRQSRGTENLHTMYFKALMSGSQSVFDIGTGEVFFRRSSLNVSKPTHPQNTPIQNKNLEGCSSFNYDLIKDKRYTVDKFGFHLSMIQNYQASGKADVNAMTREFIHDHFDEMHFIGIDRGERHLLYVSVIDSKGNIKEQFSLNQIDNEYRGNSYKTDYHSLLGKREETRQRERQSWRTIEGIKELKQGYLSQVVHKIVTLMVKYQAIVVLEDLNMGFKRGRQKVESSVYQQFEKALIDKLNYLVDKQQAPNDYGGLLKGYQLTNKFTSFRDMKRQNGFLFYIPAWNTSKIDPVTGFVDLLHPKYENVEKARAFFCKFKSIRYNSEKDRYEFTFDYNDFTTQADGTRTLWTICTHGERIETYRNPEKNSQWDSREVDLTESMTLLFSKYNISQHENLKEAIARQTEKQFFEKLIHLLRLMLQMRNSKTGTDVDYLISPIADENGCFFDSRSCDKILPENADANGAYNIARKGLWIARQIQKTGVDAKADISITNKEWLKFAQFKDV

SEQ ID NO: 198 - protein, 1625 aa, unidentified
  REGION 1..1625: note = Description of Unknown:uncultivated organism sequence
  REGION 1..1625: note = Category: MG28 effectors
  REGION 1..1625: note = Description: MG28-58 effector
MSTEFSPDRLKTARTTLKLSMEDLSILTDRIVSRQSIHGYETERMKPKAAVLNKLAQVLGVSPHYLEGKGVMIDIPALRYTGSKALTREEIHEIENILAFRAERYIDLEEKNGMLKQFSNPLKSFIISNQKEADDASKFLREQWGMGTASITSVYRLLERKGIKLIETTLPQGVLGLSTWCEKKYPLIVMNADKSDTTTERTRFTAIHELGHLLLNIATECDKERICNQFAGCFLLPKEVMYEELGSKRDFITLEEVLDFHLEYGVSVAAIIHQAWDLRIITSEHYNHWFDNIISKNRTEKGWGSYSIKETLGREKRMQTISERANNNKTSSNNTKSIKYSNNKIVSNMSNFKDFTHLYQLSKTLRFELRPIGETLKHFNESGILDHDETRAESYKKVKKLIDRYHKEFMEEALRNFEFQMDDEKQKNSLSEYFFLYSLGKRTEAQDNDFKEIKKNLREQIAKYFKASPKYKNLFKQELIKEDLCNNMQCNEEEQKLVEEFHNFTTYFTGFHENRKNMYSNEEKSTAIAFRLVHQNLPKFIDNIGAFDRARNIDEIKAGIKNLQKHFETKGLLNQGEKIEDFFALDYYSRLAVQSRIDIYNAILGGRTTEKGEKIQGLNEYINLYNQQHKEARLPKMKALFKQILSDRQAISWIEESFKSDNEVLSSVNDFYENLKQNEIFDRTKELLTSVGSYDLSKVYITNDQQLTSISQQLYGSWAVIENAILAEMQNETPRKKKEDAEKYNERLKKAYSNRSSFSIAYIDQCLEAVFDENLIPVEQHFTKLGEAEIETEAECGKIKIPDVFTQIEQTYSAAKSLLCNPYPKDKHLSQSDEDIEKVKNLLDALKRFQHFIKPLTGCGDEAEKDEMFYSDLTELLAEIDQLNSLYNRVRNHLTGKPYSEEKLKLNFENASLLTGWDKNMERANTAVILRKGKLYYLAIMKKEHNSIFASDNLPDKGECYEKMVYKQIALPLGFGGFARKCFGSATKLGWTYPTNLLNKEGKIIIKDEEAKDVLPELIDCYKDFLNIYEKDGFKYSSYNFKFKPSNQYEKLSQFFAEIQQQGYKITFQNISSDYIDQLVNEGKLYLFQIYNKDFSPSSKGTPNMHTLYWQMLFDERNLNDGVYQLNGQAEVFFRKKSLNYTKPTHPANQPIAKKNPHSKNETSQFTYDLIKDKRFTMDKFLFHVPITINFKSSGMDNIDLKVRQWLQKADDVHIIGIDRGERHLLYLTVIDCKGNIKEQMSLNTIENEYKGNTYAFDYHKRLDEKEKERGKAKKNWKTIENIKELKEGYLSQAIHKITQIMLKYNAIIVLEDLNMGFMRGRQKVEKQVYQKFEKMLIDKLNYLADKKKDPSEVGGVLNAYQLTSKFESFTKLGRQSGFLFYIPAWNTSKIDPVTGFVNLFDTQYKSDDKAKMFFSKFKSISYNKDKNWFEFSFDYNDFTNKAEGTKTQWTVCTNGERIENFRSGQKPNQWDGRTINLSQKFKSLFDEYGIDFTKDLQNSICSQSKKGFFKQLLHLFKLTVQMRNSNTETEEEKGKKDFIISPVCVDDKYYNSDIEAEKGKDEEGNWKSELPVNADANGAYNIARKGLMILNHIKQSSDPSKKQEYDLTNKAWLNFVQKGSVEGK

SEQ ID NO: 199 - protein, 1246 aa, unidentified
  REGION 1..1246: note = Description of Unknown:uncultivated organism sequence
  REGION 1..1246: note = Category: MG28 effectors
  REGION 1..1246: note = Description: MG28-59 effector
MEQFTNLFNVQKTICFELQPIGKTKENIEINGILTQDEKRAKDYQTVKGFIDEYHKQFIKDRLWNFKLPLVSKGNLDSLEEYQTLYELPKRNDAQEADFSELKDNLRSIIAKRLTESGSAFDRIFKKELIREDLVEFLSNEEDKDLVRQFADFTTYFSGFHENRKNMYSAEEKSTAIAYRLIHQNLPKFMDNMKAFAKIANTSVAEYFADIYAGWKEYLNVNSVEELFSLDYFSETLTQPHIEVYNYIIGKKVLEDGTEIKGINEFVNLYNQQQKDKSKRLPFLVPLYKQILSDREKLSWMAEEFDSDEKMLAAINELYTHLHELLMGEENESLRSLLLNMKDYDLSQINITNDLSLTDISQHLFNRYDVYTNGVKEQLKGITPRKKKESDEDFEDRISKIFKTQKSFSISQLNSLPHPEIDGNKPRSIEEYFMAMGAVNTETTQRESFFSKIETAYEDARAILQMKDTDDSLSQNKPAVSKIKALLDAFKDLQHFIKPLLGSGEEVEKDELFYGSFQLIWDELDSVTPLYNKVRNWLTRKPYSTEKIKLNFDNSQLLGGWDVNKEPDCTGVLLRKDGYYYLGIMDKKFNRVFEENVIHTDGDCYEKMVYKQLGQISQQLPRIAFSKTWQQKLSIPEEIISIKKSESFKKNCGDLQKLISYYKSFISQHEEWNSYFDINFTDRCDYKNLPDFYSEVDSQFYALSFSKVSSSYINVLVDEGKLYLFRIWNKDFSEYSKGTPNLHTLYWKMLFDERNLSDVVYKLNGQAEVFYRKASIKPDNRVVHKANESITNKNALNKKTTSTFKYDIIKDRRYTVDKFQFHVPITINFKASGQTNINPIVQETIRQGGFKHIIGLDRGERHLLYLSLIDLKGKIVKQMTLNEIVNEYNGKPYKTNYHDLLAKREGERTDARRSWDTIETIKELKEGYLSQVVHIISNMMVKYNAIVVLEDLNTGFMRGRQKIERQVYEKFEKMLIVKLNCYIDKKADVMETTGLLHPLQLTCEAKKWKRSHQCGCLFYIPAWNTSKIDPVTGFVNLLDTRYETCEKAHLFFSKFQRISFNQKKGWFEFAFDYNDFTTKAEGTRTQWTLCTYGERIRTFRNPQKNNQWDNERIVLTDEFKKIFDEKGIDIYGNLKDAICNQRDAKFFKDLLGLMKLLLQMRNSITNSEEDYILSPVADEKGHFFDSREGKCNLPIDADANGAYNIARKGLWVICKIKKSLKGEKPTLSITNKEWLKFAQDKPYLND

SEQ ID NO: 200 - protein, 1249 aa, unidentified
  REGION 1..1249: note = Description of Unknown:uncultivated organism sequence
  REGION 1..1249: note = Category: MG28 effectors
  REGION 1..1249: note = Description: MG28-60 effector
MERLTNLYPVSKTLRFELQPIGKTRENIEKGGILQQDEERAENYKLVKSFIDEYHKQYIKSRLWNFELPLADEGRHNSLAEYRALYELPKRDAEQEAAFTEVKDNLRAIIARRLTEKGSAYDRIFKKELIREDLIEFLEDAKDKEIVRQFADFTTYFTGFHENRANMYSSEEQSTAIAYRLIHQNLPKFMDNMKSFAKIAETSVADHFADIYAGWEEYLNVGSINDMFRLDYFSQTLTQEHIEVYNYIIGKRILDDGTEIKGINEYVNLYNQQQKDKKQRLPLLVPLYKQILSDREKLSWLSEEFDSDQKMQQAIKETYDQLYDLLMGDENESLKSLLMHLSDFDLSQINITNDLSLTDISQHLFGKYDVFTNGIKDKLRIITPRKKKDTDEDFEERITKLFKSQKSFSIAELNSLPHPVVEGNQPNSIEDYYMTLGAVNTETVQKENLFAQIENAYTDALPILLLTDTDDKLSQNKAAVAKIKKLLDAFKDLQHFVKPLLGSGEEVEKDERFYGTFQTIWDELDTVTPLYNKVRNWLTRKPYSTEKIKLNFDNSQLLGGWDVNKEPDCTGVLLRKGNYYYLGIMNKKNNRIFEKDLTPSDGDCYDKIDYKLLPGANKMLPKVFFSKSRIDEFSPSASLVEKYKAGTHKKGANFSLKDCHNLIDFFKQSIAKHEDWSKFGFHFSDTKTYEDISGFYREVEHQGYSLSSHKVSAEYIHRMVDEGKLFLFRLWNKDFSEFSKGTPNLHTLYWKMLFDERNLQDVVYKLNGQAEVFYRKASIKEENRIIHPAKKDISNKNALNDKHTSRFDYDIIKDRRFTVDKFQFHVPITINFKATGQTNINPVVHDIIRQGGIKHIIGIDRGERHLLYLSLIDLQGRIVKQMTLNEIINEYAGRQYKTNYHDLLAKREGERTDARRSWDTIENIKELKEGYLSQVVHVITKMMVEYKAIIVLEDLNMGFMRGRQKIERQVYEKFEHMLIDKLNCYIDKLEDPSKPGGMLQALQLSNKFESFARLGKQSGCLFYIPAWNTSKIDPVTGFVNLLDTHYDTMKAAKSFFSKFERISYNGEKNWFEFTFDYNEFNKKAEGTRTHWTLCTYGTRIRNFRNPQKNNQWDDEEIVLTDMFKRLFDNYGIDYRGNLKEALQQPTEAKFYQELMSLMKLLLQMRNSKINSEVDYLLSPVADENGYFFDSRQGDTTLPDNADANGAYNIARKGLWVIHKIQETPDGEKASLAISNKEWLHFAQTKPYLE

SEQ ID NO: 201 - protein, 1242 aa, unidentified
  REGION 1..1242: note = Description of Unknown:uncultivated organism sequence
  REGION 1..1242: note = Category: MG28 effectors
  REGION 1..1242: note = Description: MG28-61 effector
MNTYEELTGLYSFKKTISLALNPIGETLRHIEEKGFIAQDEQRAEDYKKVKDIIDRYHKYFITMCLDGFKFSTDKLMKYVALAENAKRDEDAFDEVKTQLRKEIVGAFSKNKTYGDLFGEKLIKQHLPNFVTDENEKRLVASFNEFTTYFEKFHKCRENMYSDEAKSTAIAHRLIHENLPMFYDNMKSFKKIAACEDCIDFTEFEAAFSEEFKEFKVEHLADIFQLEYFNNTLTQRKIDFYKLVIGGKVLEDGTKLKGVNEYVNLYNQQHKDARLPLLKPLYKMILSDKVALSWLPEEFKSDEEMVEAIQEMHKNLKGALTDNAENNLRDLLLNMDKYDLAHIYIANDLGLTDISQNIFGQYDVYTSAIKQALRNEYAPIPKERRNPELYDERINKLFKSRTSFSIAELNSLADSDHTIENHFKQLGAAERNGKQEIDLFSQIETAYAKASDILSGKHGNIGQSEAETALVKNLLDAYKSLQHFIKPLLGHGDEAEKDNEFDAKLRAAWDALDIINPLYNKVRNWLTRKPYSTEKIKLNFENAQLLNGWDKNKETDCTSVLLRKDGMYYLAIMNKKANHAFACDELPADGDCYEKIDYKQIALPMGLGAFVRKCGKTAEKLGWSCPERLKNKDKKIITNDAEAEGVLPDLIDCYKAFLNTYEKDGFKYKDFNFKFKPSSEYSSLVEFFAEVPSQGYKIAFRKVSVAYINQLVESGKLYLFQIWNKDFSKFSKGTPNMHTLYWKQLFDERNLADVVYKLNGQAEVFYRKRSLKLEETTVHQAHQPIPNKNKQNEKRQSQFNYDIVKNRRFTVDKFQFHVPITLNFKATGRGNINDKVLEIIRNNGIKHVIGIDRGERHLLYLSLIDLKGNIIKQMTLNDIVNEYRGHTYATNYKDLLAEREDNRTEARRNWKKIDNIKEIKQGYLAQVVHIISKMMVEYKAIVILEDLNMGFMRGRQKIERSVYEQFEKSLIEKLNYYVDKQKDEEEVGGLLHALQLTSKFKSFKELGKQSGCLFYVPAWNTSKIDPVTGFVNLFDTKSVKGEKVRAFFSNFDAIRYNAEKDWFEFAFNYSNFTDKAKDTREKWTLCTHGTSIRTFRNPSKLNQWDSEEVVLTDEFKKVFEKAGIDICGNLKNAICALKEKAHLEKLMQLMKLLLQMRNSKPNTEVDYMISPVADEQGNFYDSRCGNSALPDNADANGAYNIARKGLWVIKQIRETPAGKRPKLAIKNKEWLKFAQQKPYLDD

SEQ ID NO: 202 - protein, 1252 aa, unidentified
  REGION 1..1252: note = Description of Unknown:uncultivated organism sequence
  REGION 1..1252: note = Category: MG28 effectors
  REGION 1..1252: note = Description: MG28-62 effector
MKDLKQFTNQYSVSKTLRFELQPIGKTKENIEKNGILQRDEKRAEDYKIVKEFIDEYHKQFIKERLWDFKLPLHSKGRLDTLEEYQALYELSKRDDAQEAEFSEVKDNLRSIIAKRLTESGSAYERIFKKELIREDLIDFLESEEDKDIVRQFADFTTYFSGFHENRRNMYVADEKSTAIAYRLIHQNLPKFMDNMKAFAKIAETPVAEHFADIYEGWKECLNVGSIEEIFRLDYFSETLTQTHIEVYNYIIGKKILEDGTEIKGINEYVNLYNQQQKDKSKRLPFLVPLYKQILSDREKLSWLAEEFDSDEKMLAAINESYNHLHDLLMGNENESLRSLLLHIKDFNLSQINITNDLSLTDISQHLFGRYDVFANGIKDELRNITPRKKKEGEEDFEDRISKIFKTQKSFSIDFLDKLPQPVMDDGKPRSIEDYFMTLGAVNTETTQKENLFAQIENAYADAHAILQMKDTGDTLSQNKPAVAKIKALLDVLKDLQRFIKPLLGSGEENEKDELFYGSFQMMWDELDTVTPLYNKVRNWLTRKPFSTEKIKLNFDNSQLLGGWDVNKEPDCTGVILRKDGYYYLGIMDKKSNRIFEADVTPSDGDCYDKIDYKLLPGANKMLPKVFFSKSRIDEFAPSEAIVSSYKRGTHKKGADFNLAECHRLIDFFKQSINKHEDWSKFNFHFSDTKTYEDISGFYREVEQQGYMLSSHPVSSSYINQLVDEGKLYLFRIWNKDFSEFSKGTPNLHTLYWRMLFDERNLADVVYKLNGQAEVFYRKASIKPENRIIHKANLPIANKNELNEKRASVFEYDIIKDKRYTVDKFQFHVPITINFKATGQTNINPIVQDVIKQGGFSHIIGIDRGERHLLYLSLIDLKGNIVKQMTLNDIVNEYKGQAYKTNYHDLLAKREGDRTDARRSWEAIETIKELKEGYLSQVVHIISKMMVKYNAIVVLEDLNTGFMRGRQKIERQVYEKFEKMLIEKLNCYIDKQLSPTDEGGLLHPLQLTCDAQKWKRSHQCGCLFYIPAWNTSKIDPVTGFVNLLDTHYDTREKARVFFSKFQRISFNAQKNWFEFALDYNDFTAKAEGTRTQWTLCTQGERIRTFRNPQKNHQWDDERIVLTDAFKQLFDKYDIDINGNLKEAISAQTDAQFFKELLGLMKLLLQMRNSITNSEEDYLLSPVADDAGHFFDSREGISSLPIDADANGAYNIARKGLWVIRKIQETPEGEKPSLTITNREWLQFAQTKPYLND

SEQ ID NO: 203 - protein, 1246 aa, unidentified
  REGION 1..1246: note = Description of Unknown:uncultivated organism sequence
  REGION 1..1246: note = Category: MG28 effectors
  REGION 1..1246: note = Description: MG28-63 effector
MKEFANLFPVSKTLRFELQPIGKTKENIEKNGILQRDEKRAEDYKIVKGFIDEYHKQFIKDRLWSFKLPLHSEGHLDSLEEYQELYELSKRNDAQEAEFTEVKDNLRSIIAKRLTESGTKYDTIFKKELIREDLIDSLENNEDKDIVRQFADFTTYFSGFHENRRNMYVADEKSTAIAYRLIHQNLPKFMDNMKAFAKIAETSVAEHFSDIYEGWKEYLNVGSIEEIFRLDYFSETLTQPHIEVYNYIIGKKILEDGTEIKGINEYVNLYNQQQKDKSKRLPFLVPLYKQILSDREKLSWLAEEFDSDEKMLAAINESYEHLHDLLMGNENESLRSLLLHIKDFNLSQINITNNLSLTDISQHLFSRYDVFTNGIKDELRLITPRKKKESEEDFEDRISKIFKTQKSFSIDFLDKLPQPVMEDEKHRAIEDYFMTLGAVNTETTQKENLFAQIENAYEDARTILQLKDTGDMLLQNKPAVAKIKALLDALKDLQHFIKPLLGSGEENEKDELFYGSFQMMWDELDTVTPLYNKVRNWLKRKPFSTEKIKLNFDNSQLLGGWDVNKEPDCTGVILRKDGFYYLGIMDKKSNHIFEADVTPSDGECYEKMVYKQLGQISQQLPRIAFSKSWQQKITIPEDVIIIKKTESFKKNNEDLQKLISYYKSFISQHEEWNSYFNISFSNRNNYKNLPDFYSEVDTQFYNLSISKVSVSYIDQLVNEGKLYLFRIWNKDFSEFSKGIPNLHTLYWKMLFDERNLADVVYKLNGQAEVFYRKASIKPENRIIHKANQPIANKNELNKKRTSAFEYDIIKDRRYTVDKFQFHVPITINFKAAGQTNINPIVQDTIRQGGFSHIIGIDRGERHLLYLSLIDLKGNIVKQMTLNDIINEYKGQTYKTNYHDLLAKREGDRTDARRSWEIIETIKELKEGYLSQVVHIISKMMVEYNAIVVLEDLNTGFMRGRQKIERQVYEKFEKMLIEKLNCYIDKQAEPSDNTGLLHPLQLTCDAQKWKRSHQCGCLFYIPAWNTSKIDPVTGFVNLLDTRYETREKARVFFSKFQRISFNAQKGWFEFSFDYNDFTSKAEGTRTQWTLCTQGERIRTFRNPQKNHQWDDEKIMLTDAYKQLFDKYDIDINSNIKEAISAQTDAQFFKELLGLMKLLLQMRNSITNSEEDYLLSPVADDAGHFFDSREGISSLPIDADANGAYNIARKGLWIIRKIQETASGEKASLSITNKEWLQFAQTKPYLND

SEQ ID NO: 204 - protein, 1249 aa, unidentified
  REGION 1..1249: note = Description of Unknown:uncultivated organism sequence
  REGION 1..1249: note = Category: MG28 effectors
  REGION 1..1249: note = Description: MG28-64 effector
MKQFTNLYPVSKTLRFELQPIGKTKENIEKNGILMRDEKRAKDYKIVKEFIDDYHKQFIKERLWDFKLPLNSEGKLNSLEEYQALYELSKRDEVQEAGFTEVKDNLRSIIAKRLTESGSAYERIFKKELIREDLVDFLENEEDKDIVRQFADFTTYFSGFHENRHNMYVAEEKSTAIAYRLIHQNLPKFMDNMKAFAKIAETSVAEHFADIYEGWKEYLNIESIEEVFRLDYFSETLTQPHIEVYNYIIGKKILEDGTEIKGINEYVNLYNQQQKDKSKRLPFLVPLYKQILSDREKLSWLAEEFDSDEKMLSAINESYSHLHDLLMSNENESLRSLLLHIKEFNLSHINIANDLSLTDISQHLFSRYDVFTNGIKDELRIITPRKKKESDEDFEERITKIFKTIKSFSIDFLDNLPQPIMEDGKRRSIEDYFMTLGAVNTETTQKENLFAQIENAYEDARNILQLKDTGDTLSQNKPAVAKIKALLDALKDLQHFIKPLLGSGEENEKDELFYGSFMMMWDELDTITPLYNKVRNWLTRKPFSTEKIKLNFDNAQLLGGWDVNKEPDCTGVLLRKDGFYYLGIMNKKSNRIFESEVTPSDGECYDKIDYKLLPGANKMLPKVFFSKSRIDEFAPSEAVVSSYKRGTHKKGANFNLSECHRLIDFFKQSINKHEDWSKFGFHFSPTDTYEDISGFYREVELQGYMLSSHPVSSSYINQLVDEGKLYLFRIWNKDFSEFSKGTPNLHTLYWKMLFDERNLADVVYKLNGQAEVFYRKASIKPENRIIHKANQPIANKNELNEKRTSTFEYDIIKDRRYTVDKFQFHVPITINFKAAGQTNINPIVQDVIRQGGFSHIIGIDRGERHLLYLSLIDLKGNIIKQMTLNEIINEYKGQTYKTNYHTLLAKREGDRTDARRSWETIETIKELKEGYLSQVVHIISKMMVEYNAIVVLEDLNPGFMRGRQKIERQVYEKFEKMLIEKLNCYIDKHADPSENAGLLHPLQLTSDIQKWKRSHQCGCLFYIPAWNTSKIDPVTGFVNLLDTRYDTREKARVFFSKFQRISFNAQKGWFEFAFDYNDFTTKAEGTRTQWTLCTQGERIRTFRNPQKNNQWDDERIVLTDAYKQLFDKYNIDINGNIKEAISAQTDAQFFKELLGLMKLLLQMRNSITNSEEDYLLSPVADNTGHFFDSREGIYSLPIDADANGAYNIARKGLWVIRKIQETPNGEKTSLSITNKEWLQFAQTKPYLND

SEQ ID NO: 205 - protein, 1249 aa, unidentified
  REGION 1..1249: note = Description of Unknown:uncultivated organism sequence
  REGION 1..1249: note = Category: MG28 effectors
  REGION 1..1249: note = Description: MG28-65 effector
MKEFTNLYPVSKTLRFELQPIGKTKENIEKNGILQRDEKRAEDYKIVKGFIDEYHKQFIKERLWSFKLPLNCEGHLNSLEEYQALYELPKRNDAQEAEFTEIKDNLRSIIAKRLTESGSAYERIFKKELIREDLIDFLENNEDKDIVRQFADFTTYFSGFHENRRNMYVAEEKSTAIAYRLIHQNLPKFMDNMKAFAKIADTPVAEHFADIYDGWKEYLNVGSIDEIFRLDYFTETLTQPHIEVYNYIIGKKILEDGTEIKGINEYVNLYNQQQKDKSKRLPFLVPLYKQILSDREKLSWLGEEFDSDEKMLAAINESYTHLHDLLMGDENESLRALLLHIKEFDLTKINITNDLSLTDISQHLFGRYDVFTNGIKDELRNITPRKRKESDEELEDRISKIFKTQKSFSIDFLDKLPQPVIDDGKPRSIEDYFMTLGAVNTETTQKENLFAQIENAYEDARTILQLTDTGDTLSQNKSAVAKIKALLDALKDLQHFIKPLLGSGEENEKDELFFGSFQMMWDELDTVTPLYNKVRNWLTRKPFSTEKIKLNFDNSQLLGGWDVNKEPDCTGVILRKEGFYYLGIMDKKSNHIFEADITPSVGECYDKIDYKLLPGANKMLPKVFFSKSRIDEFAPSEAIISSYKRGTHKKGADFNLAECHRLIDFFKQSINKHEDWSKFNFHFSDTKSYEDISGFYREVEQQGYMLSSHPVSSSYINQLVDEGKLYLFRIWSKDFSEFSKGTPNLHTLYWKMLFDERNLADVVYKLNGQAEVFYRKASIKPENRIIHKANHSIANKNELNSKRTSTFEYDIIKDRRYTVDKFQFHVPITINFKAAGQTNINPIVQDVIRQGGFSHIIGIDRGERHLLYLSLIDLKGNIIKQMTLNEIINEYKGQTYKTNYHDLLAKREGDRTDARRSWETIETIKELKEGYLSQVVHVISKMMVEYNAIVVLEDLNTGFMRGRQKIERQVYEKFEKMLIEKLNCYIDKHAAPSENTGLLHPLQLTCDAQKWKRSHQCGCLFYIPAWNTSKIDPVTGFTNLLDTRYDTREKARVFFSKFQRISYNAEKGWFEFALDYNDFTAKAEGTRTQWTLCTYGERIRTFRNPKKNHQWDDERIVLTDAFKQLFDTYDIDINGNLKETISAQTDAQFFKELLGLMKLLLQMRNSITNSEEDFLLSPVADDAGHFFDSREGNSSLPIDADANGAYNIARKGLWVIRKIQETANEEKPSLSITNKEWLHFAQTKPYLKD

SEQ ID NO: 206 - protein, 1247 aa, unidentified
  REGION 1..1247: note = Description of Unknown:uncultivated organism sequence
  REGION 1..1247: note = Category: MG28 effectors
  REGION 1..1247: note = Description: MG28-66 effector
MKEFTNLYPVSKTLRFELQPIGKTKENIEKNGILQRDEKRAEDYKIVKGFIDEYHKQFIKDRLWSFKLPLNCEGHLNSLEEYQALYELPKRNDAQEAEFTEIKDNLRSIIAKRLTESGSAYERIFKKELIREDLIDFLENNEDKDIVRQFADFTTYFSGFHENRRNMYVAEEKSTAIAYRLIHQNLPKFMDNMKAFAKIADTPVAEHFADIYDGWKEYLNVGSIDEIFRLDYFTETLTQPHIEVYNYIIGKKILEDGTEIKGINEYVNLYNQQQKDKSKRLPFLVPLYKQILSDREKLSWLGEEFDSDEKMLAAINESYIHLHDLLMGDENESLRALLLHIKDFDLAKINITNDLSLTDISQHLFGRYDVFTNGIKDKLRDITPRKKKDSDEDFEDRISKIFKTQKSFSIDFLDKLPQPVMDDGKPRSIEDYFMTLGAVNTETTQKVNLFAQIENAYEDARTILQLTDTGDTLSQNKSAVAKIKALLDALKDLQHFIKPLLGSGEENEKDELFYGSFQMMWDELDTVTPLYNKVRNWLTRKPFSTEKIKLNFDNSQLLGGWDVNKEPDCTGVILRKEGFYYLGIMDKKSNHIFEADITPSVGECYDKIDYKLLPGANKMLPKVFFSKSRIDEFAPSEAIISSYKRGTHKKGADFNLAECHRLIDFFKQSINKHEDWSKFNFHFSDTKSYEDISGFYREVEQQGYMLSSHPVSSSYINQLVDEGKLYLFRIWSKDFSEFSKGTPNLHTLYWKMLFDERNLADVVYKLNGQAEVFYRKASIKPENRIIHKANHSIANKNELNSKRTSTFEYDIIKDRRYTVDKFQFHVPITINFKAAGQTNINPIVQDVIRQGGFSHIIGIDRGERHLLYLSLIDQKGNIIKQMTLNEIINEYKGQTYKTNYHDLLAKREGDRTDARRSWETIETIKELKEGYLSQVVHVISKMMVEYNAIVVLEDLNTGFMRGRQKIERQVYEKFEKMLIEKLNCYIDKHAAPSENTGLLHPLQLTCDAQKWKRSHQCGCLFYIPAWNTSKIDPVTGFTNLLDTRYDTREKARVFFSKFQRISYNAEKGWFEFALDYNDFTAKAEGTRTQWTLCTYGERIRTFRNPKKNHQWDDERIVLTDAFKQLFDTYAIDINGNLKETISAQTDAQFFKELLGLMKLLLQMRNSITNSEEDFLLSPVADDAGHFFDSREGNSSLPIDADANGAYNIARKGLWVIRKIQETANEEKPSMSITNKEWLQFAQTKPYL

SEQ ID NO: 207 - protein, 1201 aa, unidentified
  REGION 1..1201: note = Description of Unknown:uncultivated organism sequence
  REGION 1..1201: note = Category: MG28 effectors
  REGION 1..1201: note = Description: MG28-67 effector
MEEALRDFVFQMDDEGKNNSLSEYFFLYSLGKRTEAQDNDFKDVKKNLREQIAKYFKASPKYKNLFKQELIKEDLCNNMQCNEEEQKLVEEFHNFTTYFTGFHENRKNMYSDEEKSTAIAFRLVHQNLPKFIDNIGVFDRVRNIDEIKAGIENLQKHFETEGLFKQGEKIEDFFTLDYYSRLAVQSRIEIYNAILGGKTTEKGEKIQGLNELINLYNQQHKETHLPKMKALFKQILSDRQAVSWIEESFKSDNEVLSSVNDFYENLKQNEIFERTKELLTSVGSYDLSKVYITNDQQLTSISQQLYGSWAVIENAILAEMQNETPRKKKEDAEKYNERLKKAYSNRSSFSIAYIDQCLEAVFGENRIPVEQHFANIGKAEIETEAECGKIKIPDVFTQIEQTYSAAKTLLCNPYPKGKHLSQSDEDIEKVKNLLDALKRFQHFIKPLTGSGDEAEKDEMFYSDLTELWAEIDQLNSLYNRVRNHLTGKPYSEEKLKLNFENASLLTGWDKNMERANTAVILRKGKLYYLAIMKKEHNSIFASDNLPDKGECYEKMVYKQIALPLGFGGFARKCFGSATKLGWTYPTNLLNKEGKIIIKDEEAKDVLPELIDCYKDFLNIYEKDGFKYSSYNFKFKPSNQYEKLSQFFAEIQQQGYKITFQNISSDYIDQLVNEGKLYLFQIYNKDFSPSSKGTPNMHTLYWQMLFDERNLNDGVYQLNGQAEVFFRKKSLNYTKPTHPANQAIANKNPFSKKDKSEFTYDLIKDKRFTMDKFLFHVPITINFKSSKTYDIDAKVRQWLQKADDVHIIGIDRGERHLLYLTVIDCKGNIKEQMSLNTIENEYNGNTYAFDYHKRLDEKEKERDAAKKSWKTVENIKELKEGYLSQAIHKITQLMLKYNAIIVLEDLNMGFMRGRQKVEKQVYQKFEKMLIDKLNYLADKKKDPSEMGGVLNAYQLTSKFESFTKLGRQSGFLFYIPAWNTSKIDPVTGFVNLFDTKYKSIDETKKFFDKFKSISYNKNKDWFEFSFDYNDFTSKAEGTKTQWTVCTNGERIENFRNGETSNQWSGRTINLSQELKTLFDGYGIDFTKDLQNSICSQSEKGFFEQLLRLFKLTVQMRNSISNTEIDYLISPVCDKKGVFYDSREDRKDLPNNADANGAYNIARKGLMILNHIKQSSDPSKKQEYNLTNKAWLNFVQKGSVEGK

SEQ ID NO: 208 - protein, 1248 aa, unidentified
  REGION 1..1248: note = Description of Unknown:uncultivated organism sequence
  REGION 1..1248: note = Category: MG28 effectors
  REGION 1..1248: note = Description: MG28-68 effector
MNNLKQFTGLYPVNKTLRFELKPVGKTKENIENKGILERDSQRTVDYKVVKGFIDEYHKQFIKDRLWSFKLPLFSEGRLDSLEEYMALYELSKRDEAQEAEFSEVKDNLRSIIAKRLTESGSAYERIFKKELIREDLIAFLEKDEEKEIVRQFADFTTYFDDFHKNRKNMYSAEEKSTAIAYRLIHQNLPKFMDNMKAFAKIAETSVTEHFADIYEGWKEYLNVGSIEEVFRLDYFSETLTQTHIEVYNYIIGKKPLDDGTEINGINVYVNLYNQQQKDKSQRLPLLVPLYKQILSDREKLWQVEEFDSDEKMLAAINESYEHLHDLLMGNENESLRSLLIHMKDFNLAQINITNELSLTDISQHLFSRYDVFTNGIKDKLRIITPRKKKESDEDFEDRISKIFKTQKSFSIDFLDKLPQPVMEDGKPRSVEDYYMSLGAVNTETTQKENLFAQIENAYEDVRPILQMKDTGDALSQNKPAVAKIKSLLDALKDLQHFIKPLLGSGEENEKDELFYGSFQMMWDELDTVTPLYNKVRNWLTRKPYSTEKIKLNFDNSQLLGGWDVNKEQDYTGVLLRKDGFYYLGIMDKKSNRIFEADGTPTDGECYEKMVYKQLGQISRQLPRIAFSKSWQQKITIPDDVIRIKKTESFKKNNEDLQKLISYYKSFISKHEEWNSYFNISFSNRNNYKNLPDFYSEVDTQFYNLSISKVSSSYINQLVDEGKLYLFRIWNKDFSEFSKGTPNLHTLYWKMLFDERNLADVVYKLNGQAEVFYRKASIKPENRVVHQANKPIDNKNGLNKKRTSTFEYDIIKDKRYTVDKFQFHVPITINFKATGQNNINPVVQETIRQGGFSHIIGIDRGERHLLYLSLIDLKGNIVKQMTLNDIVNEYKGQTYKTNYHDLLAKREGERTDARRSWETIETIKELKEGYLSQVVHIISKMMVEYNAIVVLEDLNTGFMRGRQKIERQVYEKFEKMLIEKLNCYIDKLADPTENTGLLHPLQLTCDTQKWKRSHQCGCLFYIPAWNTSKIDPVTGFVNLLDTRYDTREKARAFFSKFQRISFNSEKGWFEFVFDYNDFTTKAEGTRTQWTLCTYGERIRTFRNPQKNHQWDDERIMLTDAFTQLFDKYDIDINGNLKETISAQSDAQFFKDLLSLMKLLLQMRNSITNSEEDYLLSPVSDESGHFFDSREGISCLPIDADANGAYNIARKGLWVIRKIQETPDGEKPSLTITNKEWLQFAQTKPYLKE

SEQ ID NO: 209 - protein, 1166 aa, unidentified
  REGION 1..1166: note = Description of Unknown:uncultivated organism sequence
  REGION 1..1166: note = Category: MG28 effectors
  REGION 1..1166: note = Description: MG28-69 effector
MKYVALAENAKRDEDAFDEVKTQLRKEIVGAFSKNKTYGDLFGEKLIKQHLPNFVTDENEKRLVASFNEFTTYFEKFHKCRENMYSDEAKSTAIAHRLIHENLPMFYDNMKSFKKIAACEDCIDFTEFEAAFSEEFKEFKVEHLADIFQLEYFNNTLTQRKIDFYKLVIGGKVLEDGTKLKGVNEYVNLYNQQHKDARLPLLKPLYKMILSDKVALSWLPEEFKSDEEMVEAIQEMHKNLKGALTDNAENNLRDLLLNMDKYDLAHIYIANDLGLTDISQNIFGQYDVYTSAIKQALRNEYAPIPKERRNPELYDERINKLFKLRTSFSIAELNSLADSDHTIENHFKQLGAAERNGKQEIDLFSQIETAYAKASDILSGKHGNIGQSEAETALVKNLLDAYKSLQHFIKPLLGHGDEAEKDNEFDAKLRAAWDALDIINPLYNKVRNWLTRKPYSTEKIKLNFENAQLLNGWDKNKETDCTSVLLRKDGMYYLAIMNKKANHAFACDELPADGDCYEKIDYKQIALPMGLGAFVRKCGKTAEKLGWSCPEKLKNKDKKIITNDAEAEGVLPDLIDCYKAFLNTYEKDGFKYKDFNFKFKPSSEYSSLVEFFAEVPSQGYKIAFRKVSVAYINQLVESGKLYLFQIWNKNFSKFSKGTPNMHTLYWKQLFDERNLADIVYKLNGQAEVFYRKRSLKLEETTVHQAHQPIPNKNKQNEKRQSQFNYDIVKNRRFTVDKFQFHVPITLNFKATGRGNINDKVLEIIRNNGIKHVIGIDRGERHLLYLSLIDLKGNIIKQMTLNDIVNEYRGHTYATNYKDLLAEREDNRTEARRNWKKIDNIKEIKQGYLAQVVHIISKMMVEYKAIVILEDLNMGFMRGRQKIERSVYEQFEKSLIEKLNYYVDKQKDEEEVGGLLHALQLTSKFKSFKELGKQSGCLFYVPAWNTSKIDPVTGFVNLFDTKYVNVEKARAFFSNFDAIRYNAEKDWFEFAFNYSNFTDKAKDTREKWTLCTHGTSIRTFRNPSKLNQWDSEEVVLTDEFKKVFEKAGIDICGNLKNAICALKEKAHLEKLMQLMKLLLQMRNSKPNTEVDYMISPVADEQGNFYDSRCGNSALPDNADANGAYNIARKGLWVIRQIRETPAGKRPKLAIKNKEWLKFAQQKPYLDD

SEQ ID NO: 210 - protein, 1228 aa, unidentified
  REGION 1..1228: note = Description of Unknown:uncultivated organism sequence
  REGION 1..1228: note = Category: MG28 effectors
  REGION 1..1228: note = Description: MG28-70 effector
MRQKYDGFESCYGISKVIRTGLIPQGATLEHIEKKGLLLSEEKRAEDYTKVKKIIDRYHRKYIDNQLKDAELSGVEESYSLYCKTNRTEKENTDLKKFLEKLRKQVSNFLTSSDEFKRIDKKELIEKDLLNFVQGDEEEEELVKSFKGFTTYFKGFHENRKNMYSHEEKSTAIAYRVINQNMFRYFDNIRSISKFILANSENNIAELESIYSDKLKGKTLEEFFSVDNYSFFISQSGIDTYNMIIGGYSVDERTKVKGINEYINLFNQENHEKFGTLKPLYKQILAERTTESFLPEKFENDKEVIESLAAFSHNMSDTLLEIMEVFGKIGEYDASGIYLKYDSLKDISTCVFSDWSAITNALWERYDVQYIGKKKKETKAYIEEKRKHFKNLKSVSADEINTAMGENVLIPYSDAAKSLFEKICVAEENIRELINLDYPDDKELSKDKAAVKDIKAYLDSVKALQHHMKPLLGNQDESGKNEFFYGDFSGLWDELDALTPLYNKVRNYVTKKPYSTEKIKLNFDNSTLLNGWDLNKEEANTAILMQREGFLYLGIMDKKHNKIFRNIENTGCEDCYQKMEYKLLPGANKMLPKVFFSKKGIESFKPPLEILEIYKNETFKKGEAFNIDDCHTIIDFYKKALNEHEDWKKFEFKFSKTKDYRDISEFYREVEAQGYKISFKAIPKKIIDEYVEKGWLYLFKIWNKDFSEYSKGTPNLHTLYLKMLFDPRNLENVVYKLNGEAEIFYRKASIQPKDIIKHPANEAIKNKNPLNKKQSSIFKYDLIKDRRYTVDKFEFHVPITLNFKARGKENINTEVREYIKRSKNLYVIGVDRGERNLLYVSVVDADGSIVEQYSLNDIVNEYKGVQYRTDYHALLDTKEKNRDKARKEWTEIQNIKELKEGYISQVVHKICELMMKYEAIIALEDLNGGFKNSRKKVEKQVYQKFEKMLIEKLNYLVDKKADVNEPSGLLHALQLTSKFEGFNKLFGQSGFVFYVPAWNTSNIDPCTGFTNLFFSKDLRYASVENSLEFWKKFDSVAYDDTKDIFSFTFDYNNFNQRAEEIKSKSKWTVYSYGDRLETFRNADLNQQYDSREVKLTEAFKELFKKYEIPHENCEIKENILNCKERDFHDKLLHLFKLTLQLRNSKTGTMIDYMTSPVMDIDGNFFDSRTASSSLPQDADANGAYNIARKGLWLIEKLKNTKDADLPKAKLAIKNAEWLAYAQRNENNG

SEQ ID NO: 211 - protein, 1008 aa, unidentified
  REGION 1..1008: note = Description of Unknown:uncultivated organism sequence
  REGION 1..1008: note = Category: MG28 effectors
  REGION 1..1008: note = Description: MG28-71 effector
MNTYEELTGSVYLTKTISLALNPIGETLRHIEEKGFIAQDEQRAEDYKKVKDIIDRYHKYFITMCLDGFKFSTDKLMKYVALAENAKRDEDAFDEVKTQLRKEIVAAFEKGETYKDLFKKELILEHLPNFVTDENEKRLVASFNKFTTYFTGFHENRENMYSDEAKSTAIAHRLIHENLPMFYDNMKSFKKIAACEDCIDFAEFEAAFSEEFKEFKVEHLTDIFQLEYFNNTLTQRKIDFYKLVIGGKVLEDGTKLKGVNEYVNLYNQQHKDARLPLLKPLYKMILSDKVALSWLPEEFKSDEEMVEAIQEMHKNLKGALTDNAENNLRDLLLNMDKYDLAHIYIANDLGLTDISQNIFGQYDVYTSALKQALRNEYAPIPKERRNPELYDERINKLFKSRTSFSIAELNSLADCDHTIENHFKQLGAAERNGKQEIDLFSQIETAYAKASDILSGKHGNIGQSEAETALVKNLLDAYKSLQHFIKPLLGHGDEAEKDNEFDAKLRAAWDALDIINPLYNKVRNWLTRKPYSTEKIKLNFENAQLLNGWDKNKETDCTSVLLRKDGMYYLAIMNKKANHAFACDELPADGDCYEKIDYKQIALPMGLGAFVRKCGKTAEKLGWSCPERLKNKDKKIITNDAEAEGVLPDLIDCYKAFLNTYEKDGFKYKDFNFKFKPSSEYSSLVEFFAEVPSQGYKIAFRKVSVAYINQLVESGKLYLFQIWNKDFSKFSKGTPNMHTLYWKQLFDERNLADVVYKLNGQAEVFYRKRSLKLEETTVHQAHQPIPNKNKQNEKRQSQFNYDIVKNRRFTVDKFQFHVPITLNFKATGRGNINDKVLEIIRNNGIKHVIGIDRGERHLLYLSLIDLKGNIIKQMTLNDIVNEYRGHTYATNYKDLLAEREDNRTEARRNWKKIDNIKEIKQGYLAQVVHIISKMMVEYKAIVILEDLNMGFMRGRQKIERSVYEQFEKSLIEKLNYYVDKQKDEEEVGGLLHALQLTSKFKSFKELGK

SEQ ID NO: 212 - protein, 1242 aa, unidentified
  REGION 1..1242: note = Description of Unknown:uncultivated organism sequence
  REGION 1..1242: note = Category: MG28 effectors
  REGION 1..1242: note = Description: MG28-72 effector
MNTYEELTGLYSFKKTISLALNPIGETLRHIEEKGFIAQDEQRAEDYKKVKDIIDRYHKYFITMCLDGFKFSTDKLMKYVALAENAKRDEDAFDEVKTQLRKEIVGAFSKNKTYGDLFGEKLIKQHLPNFVTDENEKRLVASFNEFTTYFEKFHKCRENMYSDEAKSTAIAHRLIHENLPMFYDNMKSFKKIAACEDCIDFTEFEAAFSEEFKEFKVEHLADIFQLEYFNNTLTQRKIDFYKLVIGGKVLEDGTKLKGVNEYVNLYNQQHKDARLPLLKPLYKMILSDKVALSWLPEEFKSDEEMVEAIQEMHKNLKGALTDNAENNLRDLLLNMDKYDLAHIYIANDLGLTDISQNIFGQYDVYTSAIKQALRNEYAPIPKERRNPELYDERINKLFKSRTSFSIAELNSLADSDHTIENHFKQLGAAERNGKQEIDLFSQIETAYAKASDILSGKHGNIGQSEAETALVKNLLDAYKSLQHFIKPLLGHGDEAEKDNEFDAKLRAAWDALDIINPLYNKVRNWLTRKPYSTEKIKLNFENAQLLNGWDKNKETDCTSVLLRKDGMYYLAIMNKKANHAFACDELPADGDCYEKIDYKQIALPMGLGAFVRKCGKTAEKLGWSCPERLKNKDKKIITNDAEAEGVLPDLIDCYKAFLNTYEKDGFKYKDFNFKFKPSSEYSSLVEFFAEVPSQGYKIAFRKVSVAYINQLVESGKLYLFQIWNKDFSKFSKGTPNMHTLYWKQLFDERNLADVVYKLNGQAEVFYRKRSLKLEETTVHQAHQPIPNKNKQNEKRQSQFNYDIVKNRRFTVDKFQFHVPITLNFKATGRGNINDKVLEIIRNNGIKHVIGIDRGERHLLYLSLIDLKGNIIKQMTLNDIVNEYRGHTYATNYKDLLAEREDNRTEARRNWKKIDNIKEIKQGYLAQVVHIISKMMVEYKAIVILEDLNMGFMRGRQKIERSVYEQFEKSLIEKLNYYVDKQKDEEEVGGLLHVLQLTSKFKSFKELGKQSGCLFYVPAWNTSKIDPVTGFVNLFDTKSVKGEKVRAFFSNFDAIRYNAEKDWFEFAFNYSNFTDKAKDTREKWTLCTHGTSIRTFRNPSKLNQWDSEEVVLTDEFKKVFEKAGIDICGNLKNAICALKEKAHLEKLMQLMKLLLQMRNSKPNTEVDYMISPVADEQGNFYDSRCGNSALPDNADANGAYNIARKGLWVIKQIRETPAGKRPKLAIKNKEWLKFAQQKPYLDD

SEQ ID NO: 213 - protein, 1262 aa, unidentified
  REGION 1..1262: note = Description of Unknown:uncultivated organism sequence
  REGION 1..1262: note = Category: MG28 effectors
  REGION 1..1262: note = Description: MG28-73 effector
MSNFNEFTHLYQLSKTLRFELKPIGETLKHFNESGILDQDEHRAESYKKVKKLIDRYHKEFMEEALRDFVFQMDDEGKNNSLSEYFFLYSLGKRTEAQDNDFKDVKKNLREQIAKYFKASPKYKNLFKQELIKEDLCNNMQCNEEEQKLVEEFHNFTTYFTGFHENRKNMYSDEEKSTAIAFRLVHQNLPKFIDNIGVFDRVRNIDEIKAGIENLQKHFETEGLFKQGEKIEDFFTLDYYSRLAVQSRIEIYNAILGGKTTEKGEKIQGLNELINLYNQQHKETHLPKMKALFKQILSDRQAVSWIEESFKSDNEVLSSVNDFYENLKQNEIFERTKELLTSVGSYDLSKVYITNDQQLTSISQQLYGSWAVIENAILAEMQNETPRKKKEDAEKYNERLKKAYSNRSSFSIAYIDQCLEAVFGENRIPVEQHFANLGKAEIETEAECRKIKIPDVFTQIEQTYSAAKTLLYNPYPKGKHLSQSDEDIEKVKNLLDALKRFQHFIKPLTGSGDEAEKDEMFYSDLTELWAEIDQLNSLYNRVRNHLTGKPYSEEKLKLNFENTSLLTGWDKNMERANTAVILRKGKLYYLAIMKKEHNSIFASDNLPDKGECYEKMVYKQIALPLGFGGFARKCFGSATKLGWTYPTNLLNKEGKIIIKDEEAKDVLPELIDCYKDFLNIYEKDGFKYSSYNFKFKPSNQYEKLSQFFAEIQQQGYKITFQNISSDYIDQLVNDGKLYLFQIYNKDFSPSSKGTPNMHTLYWQMLFDERNLNDGVYQLNGQAEVFFRKKSLNYTKPTHPANQAIANKNPFKKKDKSEFTYDLIKDKRFTMDKFLFHVPITINFKSSKTYDIDAKVRQWLQKADDVHIIGIDRGERHLLYLTVIDCKGNIKEQMSLNTIENEYNGNTYAFDYHKRLDEKEKERDAAKKSWKTVENIKELKEGYLSQAIHKITQLMLKYNAIIVLEDLNMGFMRGRQKVEKQVYQKFEKMLIDKLNYLADKKKDPSEMGGVLNAYQLTSKFESFTKLGRQSGFLFYIPAWNTSKIDPVTGFVNLFDTQYKSDDKAKMFFSKFKSISYNKDKNWFEFSFDYNDFTNKAEGTKTQWTVCTNGERIENFRSGQKPNQWGGRTINLSQKFKSLFDEYGIDFTKDLQNAICSQSKKGFFKQLLYLFKLTVQMRNSNTETDYLISPVCDRNGNFYDNGNNNYDNDLPENADANGAYNIARKGLMILNHIKQSSDPSKKQEYNLTNKAWLNFVQKGSVEGK

SEQ ID NO: 214 - protein, 1250 aa, unidentified
  REGION 1..1250: note = Description of Unknown:uncultivated organism sequence
  REGION 1..1250: note = Category: MG28 effectors
  REGION 1..1250: note = Description: MG28-74 effector
MNTFNEFTNLYSLSKTLRFELQPIGKTKENIEKNGILSRDEKRAEDYQMVKGIIDEYHKQFITDRLWSFKLPLESEGRNDSLEEYHTLYEMSKRDERQEAAFTEVKDNLRGIIAKRLTEKGSAYERIFKKELIREDLIDFLKNEEKKELVRQFADFTTYFTGFHENRKNMYSAEEKSTAIAYRLIHQNLPKFMENMKAFAKIAETSVSEHFADIYEGWKEYLNVRSLEEIFRLDYFSETLTQPHIEVYNYIIGKKVLEDGTEIKGINEYVNLYNQKHKDKIPLLVPLYKQILSDREKLSWLAEEFDSDEKLLVAINETYNQLYNFLMGMENESLRSLLTHIKDFDLNHINITNDLSLTDISHQLFGRYDVFTSGIKDKLREKTRRKKGESDEDFEDRVSKIFKTHKSFSIAYLNKLPQPDMEDGKRRRVEEYFMELGAVNTETTQKENLFAQIENAYEDAKAVLQMKDTGDTLSQNKSAVAKIKNLLDVIKDLQHFIKPLLGSGEENEKDELFYGSFQMMWEELDAVTPLYNKVRNWLTRKPYSTEKIKLNFDNSQLLGGWDVNKEPDCTGVLLRKDEFYYLGIMDKKSNRIFDAEVTPSDGKCYEKIDYKLLPGANKMLPKVFFSKSRIDEFAPSEAIVSSYKRGTHKKGADFSLSDCHRLIDFFKQSINKHEDWSKFGFRFSDTKSYEDISGFYREVEQQGYMLSSHQVSESYIHQLVDEGKLYLFRIWNKDFSEFSKGTPNLHTLYWKMLFDERNLADVVYKLNGQAEVFYRKASIKPENRIVHLAKHPIANKNEFNKEPTSTFEYDIIKDRRYTVDKFQFHVPITINFKAAGQTNINPIVQDTIRKGNFSHIIGIDRGERHLLYLSLIDLRGNIVKQMTLNDIINEYKGTTYKTNYHDLLAKREGERTEARRSWDTIENIKELKEGYLSQVIHIISKMMVEYNAIVVLEDLNMGFMRGRQKIERQVYEKFEKMLIDKLNCYIDKQKEPMAEGGMLRALQLTNKFESFRKLGKQCGCLFYIPAWNTSKIDPVTGFVNLFDTRYENMAKAKVFFSKFKSIRYNSIKDWFEFSLDYNDFTTKAESTRTEWTLCTYGERIRTFRNPQKNHQWDDEELVLTAEFKQLFDRYGIDIQSNLKEAINAQTDAQFFKEMLGLMKLLLQMRNSITNSDTDYLLSPVADENGHFFDSREDITVLPDNADANGAYNIARKGLWVIRKIQETAEDEKPSLAITNKEWLQFAQTKPYLDD

SEQ ID NO: 215 - protein, 1280 aa, unidentified
  REGION 1..1280: note = Description of Unknown:uncultivated organism sequence
  REGION 1..1280: note = Category: MG29 active effectors
  REGION 1..1280: note = Description: MG29-1 effector
MFNNFIKKYSLQKTLRFELKPVGETADYIEDFKSEYLKDTVLKDEQRAKDYQEIKTLIDDYHREYIEECLREPVDKKTGEILDFTQDLEDAFSYYQKLKENPTENRVGWEKEQESLRKKLVTSFVGNDGLFKKEFITRDLPEWLQKKGLWGEYKDTVENFKKFTTYFSGFHENRKNMYTAEAQSTAIANRLMNDNLPKFFNNYLAYQTIKEKHPDLVFRLDDALLQAAGVEHLDEAFQPRYFSRLFAQSGITAFNELIGGRTTENGEKIQGLNEQINLYRQQNPEKAKGFPRFMPLFKQILSDRETHSFLPDAFENDKELLQALRDYVDAATSEEGMISQLNKAMNQFVTADLKRVYIKSAALTSLSQELFHFFGVISDAIAWYAEKRLSPKKAQESFLKQEVYAIEELNQAVVGYIDQLEDQSELQQLLVDLPDPQKPVSSFILTHWQKSQEPLQAVIAKVEPLFELEELSKNKRAPKHDKDQGGEGFQQVDAIKNMLDAFMEVSHAIKPLYLVKGRKAIDMPDVDTGFYADFAEAYSAYEQVTVSLYNKTRNHLSKKPFSKDKIKINFDAPTLLNGWDLNKESDNKSIILRKDGNFYLAIMHPKHTKVFDCYSASEAAGKCYEKMNYKLLSGANKMLPKVFFSKKGIETFSPPQEILDLYKNNEHKKGATFKLESCHKLIDFFKRNIPKYKVHPTDNFGWDVFGFHFSPTSSYGDLSGFYREVEAQGYKLWFSDVSEAYINKCVEEGKLFLFQIYNKDFSPNSTGKPNLHTLYWKGLFEPENLKDVVLKLNGEAEIFYRKHSIKHEDKTIHRAKDPIANKNADNPKKQSVFDYDIIKDKRYTQDKFFFHVPISLNFKSQGVVRFNDKINGLLAAQDDVHVIGIDRGERHLLYYTVVNGKGEVVEQGSLNQVATDQGYVVDYQQKLHAKEKERDQARKNWSTIENIKELKAGYLSQVVHKLAQLIVKHNAIVCLEDLNFGFKRGRFKVEKQVYQKFEKALIDKLNYLVFKERGATQAGGYLNAYQLAAPFESFEKLGKQTGILYYVRSDYTSKIDPATGFVDFLKPKYESMAKSKVFFESFERIQWNQAKGYFEFEFDYKKMCPSRKFGDYRTRWVVCTFGDTRYQNRRNKSSGQWETETIDVTAQLKALFAAYGITYNQEDNIKDAIAAVKYTKFYKQLYWLLRLTLSLRHSVTGTDEDFILSPVADENGVFFDSRKATDKQPKDADANGAYHIALKGLWNLQQIRQHDWNVEKPKKLNLAMKNEEWFGFAQKKKFRA

SEQ ID NO: 216 - protein, 753 aa, unidentified
  REGION 1..753: note = Description of Unknown:uncultivated organism sequence
  REGION 1..753: note = Category: MG29 effectors
  REGION 1..753: note = Description: MG29-2 effector
DTGFYADFVEAYKNYEQITVSLYNKARNHLSKKPFSKDKIKINFDSPTLLNGWDLNKESDNKSVILRKGGNYYLAIMHPKHTKVFSDYSESEHDGATFEKVNYKLLSGANKMLPKVFFSKKGAETFSPPQEILDLYKNDEHKKGKTFKLESCHKLINFFKFNISKYKVHPNDQFGWDVFGFDFSPTSTYKDLSDFYREVEAQGYKLWFSDISENYVNKCVEEGKLFLFQIYNKDFSPYSKGSPNLHTLYWKGLFEPENLKDVVLKLNGEAEIFYRKHSMKRDESVVHPAHVAIKNKNDLNPKKESTFDYDIVKDRRYTQDKFFFHVPITLNFKSQGFAKFNDKINALLAEQDDVHVIGIDRGERHLLYYTVVNSEGKIIEQGSLNQMDTDQGYSVDYQQKLDAKEKERDNSRKTWSSVENIKELKAGYLSHVVHKLAKLVIKHNAVVCLEDLNFGFKRGRFKVEKQVYQKFEKALIDKLSYLVFKDKVATEAGGYLNAYQLAAPFESFEKLGKQTGILYYVRADYTSKIDPVTGFIDFLKPKYESLLKSKTFFETFESICFNVEKNYFEFSLDYKRFMPSRKFGDYQTTWTICTYGDTRYHNRRNKAGKWETETINVTAQLKDIFKVYGIGFEHEADIKEAIAAIKDTKFYKKLYWILRVTLSLRHSVTGTDEDFILSPVADEKGVFFDSRNEVVEYPKDADANGAYHIALKGLWNLQQIQQHDWDEEKPKKLNLAMKNEEWFGFAQQKKFRQ

SEQ ID NO: 217 - protein, 1287 aa, unidentified
  REGION 1..1287: note = Description of Unknown:uncultivated organism sequence
  REGION 1..1287: note = Category: MG29 effectors
  REGION 1..1287: note = Description: MG29-3 effector
MDYSKFTKKYSISKTLRFELRPVGETAEYIEDFKSQYLRDVVAQDEKRAEEYLKIKELIDDYHRDYIEDKLSNPVNPDTGEYWFSDELFDTAYKEFIAFKKDTKNEKLRQIWMSRQELFRKMLVKAFVDKKDLFSKELITRDLPAWLSQKGIWEEHKATVESFSKFTTYFSGFHENRKNMYSDEDQSTAIAYRLMNENLPKFFNNCEAYRKNKEKYPSLDFGVLDLDDKFKPIYFRSLFTQSAIDEYAELLGGKTEESREKSIGLNEKINLYRQKSGLIRRDISEFTMLYKQILSDRESHSFIPDAFESDKEMFTSLAQYIEKANRLTSKLNKTLQKLQSANTDKIYLVSTELTNISQSMFSSYGMIESALKSDMEQNVYPAPKNGKVSSVLEAKRKKYMEEKVFSLAFLEEKLKPYLLETEQEEKSILSHLLEALKNAKLDNKLDEKVKTVLPLLKLEALDKKRIVPNSSNPNGSEGFLQVQNIQKMLDAFMSLSHALRPLHLVKGRKVIDMPDADAGFYADFSVQYEEYSQITISLYNKVRDYLTKKPYSKDKVKINFEVPTLLNGWAVNKETANASILFEKDGLYYMGIMHPKHKHLFEYSKNIDDMKNGKKSKVKDELYTKIQGGKNNSYRKIVYKLLPGANKMLPKVFFANSRLEFFSPSQDILDIRNRASDSKNGKAQKGYTKVDFSLSDCHKMIDFYKKSIDKHPEWREFEFDFSVTNSYKDLSGFYREVESQGYKIEFHDIKTKYIDQCIEEGKLFLFQIYNKDFSPHSKGSPNLHTMYWRGLFESENSKNVVLKLNGDAEMFYRKHSMKRKDTVVHRANETIDNKNKNNPKKTSTFAYDIVKDRRYTKDKFIFHVPITLNFKALNTFRFNDTINKELSKSIDTCVIGIDRGERHLLYYTVVDSKGNIIEQDTLNEISTDQGYKVNYQQKLHDKEQERDKARKSWGSVENIKELKDGYLSHVVHKLANLIIKHNAIVCLEDLNSGFKRGRFKVEKQVYQKFEKRLIDKLNYLVFKDAKEGEAGHYLNAYQLTAPFESFQKLGKQTGILFYVNADYTSKIDPATGFMDFLKPKYENLGKAKTFFESLESFIYNVEKDYFEFTFDYKKVTNKSLGSYKTVWTACTYGDVRYQNKKDEQGIWQTNSINVTQELKELCDDAQIEYKDGKELKDILALEKDTKFYKTLFWIMRLTLTLRHSRTGTDDDFILSPIANSNGEFFDSRKAPKTLPKDADANGAYNIALKGLWNLQKIREHDWEAEKPKNLNLYMKNEEWFSFIQSRV

SEQ ID NO: 218 - protein, 991 aa, unidentified
  REGION 1..991: note = Description of Unknown:uncultivated organism sequence
  REGION 1..991: note = Category: MG29 effectors
  REGION 1..991: note = Description: MG29-4 effector
MFEQFTKQFALQKTLRFELKPVGETADFLDDFKSQYLKDTVLKDEKRASDYQEIKELIDDYHREYIESCLHEPVDKKTGEILDFSVDLEEAWLYYQQLKDDPSKRGEWEKAQENLRKRLVTSFVDSGNLFKKEFITRDLPEWLKNKGLWEKHNDAVESFKGFTTYFTGFYDNRKNMYSSEAQSTAIANRLMNENLPRFFNNCVAFHTIQEKHPGFMLDVEDELLDCLGVQSLNDVFTPSFFVHLFSQSGITLFNELLGGKTRENGEKVQGLNEQINLYRQQHPDIARGFPRFTKLHKQILSDIESRSFIPDAFDDDKHLLESLEKYISEANKKLIPALQESMDKLSQADLSRVYLMGSSLTYLSQDIFHFFGTIPDAIRWHAENNISTKKEREHFIKQDVYALADLESIIISYVNQLDDSDEAHQLLNALPEPKRPVTSFIQQTLQQAIEAVSPLLSLDELSKNRRLPRDEKEKGGEGFQQTETIREMLDAFKVVSDAVKPLHLVKGRKPIDVPDVDTGFYADFAEAFEAYTQPTTALYNKARNHLTKKPFSKHKIKINFDAPTLLNGWDLNKESDNKSVILRKDGNYYLAIMHPKHTKVFANAPAVEERGEMYEKMNYKLLSGANKMLPKVFFSKKGIETFNPPQEILDLYKNNEHKKGSTFKLESCHRLIDFFKVNIPKYKVHPNDEFGWDVFGFNFSPTSSYKDLSGFYREVENQGYKVWFSDVSESYIQKCVEEGKLFLFQIYNKDFSPYSKGKPNLHTLYWKGLFEPANLKDVVLKLNGEAEIFYRKHSIKHGDKIIHRANEPIDNKNDSNPKKQSCFEYDITKDKRYTQDKFFFHVPISLNFKAQSPARFNDNINKMLSESEDICVIGIDRGERHLLYYTVVNSKGDIIEQGSLNHIETDQGYTVDYQQKLDAKEKQRDKARKTWSTIENIKELKAGYLSQVVHKLAQLIIKHNAIVCLEDLNFGFKRGRFKVEKQVYQKFEKAL

SEQ ID NO: 219 - protein, 1270 aa, unidentified
  REGION 1..1270: note = Description of Unknown:uncultivated organism sequence
  REGION 1..1270: note = Category: MG29 effectors
  REGION 1..1270: note = Description: MG29-5 effector
MFETFTKHFSLSKTLRFELRPVFGGAEMKEDFESEFLRKTVERDERRAKEYKELKRVIDDYFRDYIDATLAIPNHPNGFMEADALKQAYECYRLFRSAKGNAYSKAKKEWNNIQKELRESVASLFKKSDYEVKGSFFKNVLMPHVEGDPKKTELIKSFDKFTTYFTGFNENRKNIFSKDDKATTIGYRLIHENLPKFFDNCILYERIRNKFDDLVLSSEDELTQALGVTGLDEIFRPEVFAHVLTQPHITAYNELLGGYVDDQKVKHQGLNEQINLYRQQKKLSNRQLPIFAPLFKQILAESQSQSFAPEPFENDKEMLTAINVFLYSVDKHIEQLEASVKELHADEIEHIYFKAQSLTQLSQELFGRYDVIQSALQGYTDHHRDLFRTKAQREKFLDKTDFYSLYDLERAILEYVESLDADHPDRNAISNDTPVQSHLKNKFKKLKQKIEEEKKTITPLLSKEKLSKDRKLPKGENAPGGEGYRQVQQIKELLESYKTLAQTLRDLYPAKGRKRVEVGSPNMAFYNAFEEPFVEYDNECMALYNKARNYLSKKPYKRDKIKLNFEAPTLLNGWDLNKERANRSVLLLKNGNYYLAIMHPNHTDIFKKYMEMDNSDNYEKINYKLISDANRMLPRVFFSKKGIKTYDPPKSILELYKKGEHIKGPSFKLESLHRLIDYFKSVVSKYKADPGDQYGWEVFDFKFSPTSQYEDIGQFYKELEKQAYRVWFTPISSTYIEEAAKHGKLFLFQIYNKDFSPYAKGRPNLHTLYWKSLFEKENLQDVITKLNGEAEIFFRHHSIKKADTVIHKAGETIKNKNENNPKQESTFKHDIIKDRRYTVDKILFHVPITINFKNDKPGNFNDTVNRLLAKHPDTHIIGIDRGERHLLYLTVIDSDGNIVEQRSLNTIPTDRDYEVDYRQKLDAKEKERDKARKEWSTIENIKELKSGYLSQVVHELAKLIIQHNAIVVLEDLNFGFKRGRFRVEKQVYQKFEKALIDKLNYLVFKDRQAKEPGGYLNGYQLTAPFESFQKLGKQSGILFYVPAAYTSKIDPATGFIDFLKPKYESVEKAKAFFANFDAIRYNKEEEYFEFVFDYKNFESKNALSGYKTDWTVCTYGKRLRNKRNDQGYWESVSVDVTDDLKRLFERYGILYHNGDNLISQILEYDEKQLFELLIFAMRTTLAMRYSRTGEEEDYILSPVKDCNGDFFDSRKADPSLPQDADANGAYHIALKGAMLLERMREHDFNGKSKLDLLIKNEQWFEYISERLWGE

SEQ ID NO: 220 - protein, 1008 aa, unidentified
  REGION 1..1008: note = Description of Unknown:uncultivated organism sequence
  REGION 1..1008: note = Category: MG29 effectors
  REGION 1..1008: note = Description: MG29-6 effector
MFNHFTHKYSLSKTLRFELKPVGETADYLEDFKSQYLKDFIVKDQQRAEDYKIIKELIDDYHRQYIEEKLSAPVDPKTGELWLNPEYFEEAYSYYQKLKADQSDPKNRKQWEDTQTELRKKLVETFTNKADLFKKELITRDLPEFLKKKGQWEENKKVVEHFSRFTTYFSGFHENRKNMYTHEDHSTAIAYRLMNENLPRFFNNCLAYKHIKDKYNDLPLKINSELQSQLGVTNINDFFQPRYFINLFSQTGIDNYELLIGGKTEENGTKIQGLNEQINLYRQQLQHKMKDEAKADDKKSKRIYDLSGFTHLYKQILSDREKISFIPEAYEDDKQLLASLEEYIATVTDEKEGAIQKLEQSLQKLANADLSKVYIKGAGLTALSQNMFSAYGMITASLSYYADQKLSTKKKREDYLKQKVYSLDELNHHLIAYIDSKEKDDVLHEQLAKLPNPQQPISSYLISIIKQTQQDIELQATIDAVKPLLQLESLSKDRKAPELDNENDKGAVGFQQVQKIQKMLDGFMSVSHAVKLLHLVDGRKPIDMPDKDDSFYNGFAEVYKAYTDLTVTLYNKARNHLTTKLYSNDKIKINFDVPTLLNGWDANKESDNASILFEREGLYYLGIMHPKHKHLFNYTKGIDDIGNEKKTTAKDELYEKVAEKGDSGYRKIVYKLLPGVNKMLPKVFFSASRKDFFAPSEEVNRIRNTASHTKNGNPQKGHKKENFNLEDCHAIIDFFKVSLNKHPEWKDFNFSFSPTSSYEDLSGFYREVEHQGYRMDFQSIKESYIKDCVSEGKLFLFQIYNKDFSRYSKGKPNLHTLYWKGLFEPENLKDVVLKLNGEAEIFYRKHSIKREDRIIHKSGDTLDNKNTNNPKKTSKFEYDIVKDRRYTQDKFQFHVPITLNFKALGVNRFNDQINKELAQQKETCVIGIDRGERHLLYYTVVNSKGDIIEQDTLNTINTDKGYNVDYQQKLHTKEKEREKARKSWSSVENIKELKAGYLSHVVHKLAHL

SEQ ID NO: 221 - protein, 1324 aa, unidentified
  REGION 1..1324: note = Description of Unknown:uncultivated organism sequence
  REGION 1..1324: note = Category: MG29 effectors
  REGION 1..1324: note = Description: MG29-7 effector
MLNKFTNQYSLSKTLRFELKPVGETAGYLDDFKSQHLKEFVATDKQRADDYLIIKELIDDYHRAYIEEKLSAPVDPKTGELFLNSQDFEDAYSYYQQLKVDSKDPKHRETWEKTQAELRKKLVKAFVGKADLFGEKLIKQHLPEQLKKEGRWKENKKAVENFNKFTTYFSGFHENRKNMYTDKDQSTAIAFRLMNENLPRFFNNCDKYKKLKEKYPELLFENNKDILAKLGVDSLNDVFTPSFFINLFTQTGIDNYQLLLGGKSEDTGEKLKGLNEQINLFRQQKQKEAREQAQKENKKAKKITDLTGFTGLYKQILSDRQSASFILDEFENDRELLTKLNEFITLATKPEGTLEKLENALNHLNEIDPQKVFIKTAGLTDISQTLFHSYQIITTALHEFAENNLKTKKERENYLKQKAFSLAELDERLVDYIQDLEDSDPLHQQLQALNDPLQPIKGYLQEAITRAQQETDERPNLEQTIKEVEPLLTLKELSKNRQAPKKEGDKGGKGFQQIQKIQKMLDAFMAVSHALKPLHLVDGRKPIDMPEMDSGFYGEFSEAYEEYNQSCITLYNKSRNHLTKKPFKTDKIKINFDSPTLLKGWDANKESDNASLLFEKDGLYYLGIMHPKHKRLFDYIIGIDDIGNENKTKAKTDLYNQITTNKSGYRKIVYKLLPGANKMLPKVFFSRSRIAFFAPSDEVQRIRNTASHSKNGKPQKGFKKADFNLKDCHTMIDFFKDSINKHPEWKQFGFKFSPTESYEDLSGFYREVEQQGYRIDFHTIKESYIDECIKQGKLFLFQIYNKDFSTYSKGKPNLHTLYWKGLFEAENLKDTVLKLNGEAEIFYRKHSIKPNDIITHRANETIENKSKNYDKKTSTFAYDIIKDKRYTQDKFQFHVPITLNFKAPKAPGVSHFNNQINKAVAKSKDTHIIGIDRGERHLLYYTVINQKGEIIEQDTLNKIKAHKDYEVDYQQKLHDKETERQKARRSWSSVENIKELKAGYLSHVVHKLAVLIKEHNAIVCLEDLNFGFKRGRFKVEKQVYQKFEKTLIDKLNYLVFKDAEENEAGHYLKAYQLTAPFESFEKMGKQSGILYYVQAAYTSKIDPATGFINFLYTRYQSLSRSKEFFESFDFIRYNQAQDYFEFSFDYKNFPIRQNLKNYQTRWLACTYGDERYANKRNKQNQWESEIVNVTQELKTLFNKASIDFQNGKDLKDAIAQTKDTKFYKKLYWLLGLTLSLRHSKTGTEIDFILSPIQGKDGKFFDSREASNKHPKDADANGAYNIALKGLWNLQQIKQHDWNTEKPKKLNLNMKNEDWFGFIAERASL

SEQ ID NO: 222 - protein, 1324 aa, unidentified
  REGION 1..1324: note = Description of Unknown:uncultivated organism sequence
  REGION 1..1324: note = Category: MG29 effectors
  REGION 1..1324: note = Description: MG29-8 effector
MLNKFTNQYSLSKTLRFELKPVGETAGYLDDFKSQHLKEFVATDKQRADDYLIIKELIDDYHRAYIEEKLSAPVDPKTGELFLNSQDFEDAYSYYQQLKVDSKDPKHRETWEKTQAELRKKLVKAFVGKADLFGEKLIKQHLPEQLKKEGRWKENKKAVENFNKFTTYFSGFHENRKNMYTDKDQSTAIAFRLMNENLPRFFNNCDKYKKLKEKYPELLFENNKDILAKLGVDSLNDVFTPSFFINLFTQTGIDNYQLLLGGKSEDTGEKLKGLNEQINLFRQQKQKEAREQAQKENKKAKKITDLTGFTGLYKQILSDRQSASFILDEFENDRELLTKLNEFITLATKPEGTLEKLENALNHLNEIDPQKVFIKTAGLTDISQTLFHSYQIITTALHEFTENNLETKKERENYLKQKAFSLAELDERLVDYIQDLEDSDPLHQQLQALNDPLQPIKGYLQEAITRAQQETDERPNLEQTIKEVEPLLTLKELSKNRQAPKKEGDKGGKGFQQIQKIQKMLDAFMAVSHALKPLHLVDGRKPIDMPEMDSGFYGEFSEAYEEYNQSCITLYNKSRNHLTKKPFKTDKIKINFDSPTLLKGWDANKESDNASLLFEKDGLYYLGIMHPKHKRLFDYIIGIDDIGNENKTKAKTDLYNQITTNKSGYRKIVYKLLPGANKMLPKVFFSRSRIAFFAPSDEVQRIRNTASHSKNGKPQKGFKKADFNLKDCHTMIDFFKDSINKHPEWKQFGFKFSPTESYEDLSGFYREVEQQGYRIDFHTIKESYIDECIKQGKLFLFQIYNKDFSTYSKGKPNLHTLYWKGLFEAENLKDTVLKLNGEAEIFYRKHSIKPNDIITHRANETIENKSKNYDKKTSTFAYDIIKDKRYTQDKFQFHVPITLNFKAPKAPGVSHFNNQINKAVAKSKDTHIIGIDRGERHLLYYTVINQKGEIIEQDTLNKIKAHKDYEVDYQQKLHDKETERQKARRSWSSVENIKELKAGYLSHVVHKLAVLIKEHNAIVCLEDLNFGFKRGRFKVEKQVYQKFEKTLIDKLNYLVFKDAEENEAGHYLKAYQLTAPFESFEKMGKQSGILYYVQAAYTSKIDPATGFINFLYTRYQSLSRSKEFFESFDFIRYNQAQDYFEFSFDYKNFPIRQNLKNYQTRWLACTYGDERYANKRNKQNQWESEIVNVTQELKTLFNKASIDFQNGKDLKDAIAQTKDTKFYKKLYWLLGLTLSLRHSKTGTEIDFILSPIQGKDGKFFDSREASNKHPKDADANGAYNIALKGLWNLQQIKQHDWNTEKPKKLNLNMKNEDWFGFIAERASL

SEQ ID NO: 223 - protein, 1083 aa, unidentified
  REGION 1..1083: note = Description of Unknown:uncultivated organism sequence
  REGION 1..1083: note = Category: MG29 effectors
  REGION 1..1083: note = Description: MG29-9 effector
TGFNENRNNIFTKEAKATAIGYRLIHDNLPKFFDSCMLYDRIISTYEDLRFQVEDELITQLGVTTLNELFQPVAFAHLLTQANIESFNALLGGLNTQINQFKQEQKLNSRQLPTFAPLFKQILAKTESHSFIPEAFANDKELLDAIAIYRERSQEHLQKLEESFEALHSDEDEHIYYKAQSLTQLSQEMFGHYSVINDMLNLYVENHQERFRTKAQREKFLKKPNLYSLYDLESAINEYIEILDADHFYRKKIENDTPVQSYLKQKFNDLKEDIDKQEKIIAPLLSLNELSKNRNLPKNDDDQGGEGYRQVQQIKEFLDRYNDTVRILSNLYPAKGRERIEVEAPNMAFYNMFEEPFVEFESETFALYNKTRNYLSKKPYSKDKFKLNFESSKLLGGFVESKTEKSNNGTQHNAYLFRQKLDNGNYRYFLGISNNVKLFSRDKLIHDPHPEYERIHYYQGKINSLYGSSYDGNYNKDKETLSEKDLIKKIKMALSQYKNKILGVESILQTEYNNINNLRDDIEDAFKNKSFFHQAISKSEFEQAVNDPEKPLLVFEIYNKDFSLNKRNKNSKDNLHTMYFKGLMNENGYSIDIGSGELFFRKHSLKRKEAVIHTAKQPIKNKNSNNKKQTSTFDYDIVKDKRFTVDKFFLHLSIELNYKAPKISNNQKSKFKKDFNDKINQLLSQYPDTHIIGIDRGERHLLYYTLIDPKGNIVEQKSFNTIPTDRGYDVDYHQKLHKKEKERDRARKEWGTIENIKELKAGYLSQIVHQLAKLIIKHNAIVVLEDLNRGFKRGRFKVEKQVYQKFEKALIDKLNYLVFKDRDAKEAGGYLNGYQLTAPFESFQKLGKQSGILYYVPAAYTSKIDPASGFIDFLKPKYESIEKAKAFFANFDSIRYNSSDDYFEFSFRYSQFDINHPDYKDAWVVCTHGMRLRNKRNTQGHWETTTVDVSDDLKRLFDKYSFFYHDGDNLIDQIIEYDEKQLFEQMIFALRTTLAMRYSRVGEEEDYILSPVKGPDGIFYDSRKVDGSLPKDADANGAYHIALKGAMLLDRMRQHDFDSHSKPDMFIKNGQWFAFASKRLWEK

SEQ ID NO: 224 - protein, 881 aa, unidentified
  REGION 1..881: note = Description of Unknown:uncultivated organism sequence
  REGION 1..881: note = Category: MG29 effectors
  REGION 1..881: note = Description: MG29-10 effector
VLHEQLKKLPNPQQPISSYLVSIIKQTQQDVELQKIIDGVKPLLQLESLSKARKAPELGNENDKGAVGFQQVQKIQRMLDGFMSVSHAVKLLHLVDGRKPIDMPDKDDSFYNGFAEVYEAYTDLTVTLYNKARNHLTKKLYTNDKIKINFDAPTLLNGWDANKESDNASILFEREGLYYLGIMHPKHKHLFNYTKGIDDIGNEKKTTAKDELYEKVAEKGDSGYRKIVYKLLPGVNKMLPKVFFSASRKDFFAPSEEVNRIRNTASHTKNGNPQKGHKKENFNLEDCHAIIDFFKVSLNKHPEWKDFNFSFSPTSSYEDLSGFYREVEHQGYRMDFQSIKESYIKDCVSEGKLFLFQIYNKDFSRYSKGKPNLHTLYWKGLFEPENLKDVVLKLNGEAEIFYRKHSIKREDRIIHKSGDTLDNKNTNNPKKTSKFEYDIVKDRRYTQDKFQFHVPITLNFKALGVNRFNDQINKALAQQKETCVIGIDRGERHLLYYTVVNSKGEIIEQDTLNTINTDKGYNVDYQQKLHTKEKEREKARKSWSSVENIKELKAGYLSHVVHKLAHLIIKHNAIVCLEDLNSGFKRGRFKVEKQVYQKFEKALIDKLNYLVFKENKANDAGGYLNAYQLTAPFESFEKLFKQTGILYYVRADYTSKIDPATGFIDFLRPRYESLAKSKTFFENIESFKFNQAKDYFEMEFDYKKMKPSQKLGRYQSKWKVCTFGDVRYQNRRNDKGVWESEVINVTKKLKALLDDHDIEYQQEQDLKEALILKKDTKFYKELFWLLKLTLSLRHSKSGTEEDFILSPVANEQGVFFDSRNASDTQPKDADANGAYNIALKGLWNLQQIKKHDWDAEKPKKLNLAMKNEEWFGFAQNKEYKN

SEQ ID NO: 225 - protein, 1316 aa, unidentified
  REGION 1..1316: note = Description of Unknown:uncultivated organism sequence
  REGION 1..1316: note = Category: MG29 effectors
  REGION 1..1316: note = Description: MG29-12 effector
MSKIYDQFTHLYKIQKTLRFELKPVGETAIYINDFKSQYLQDVVHQDEQRAEYYKVVKDIIDDYHRDYIEKKLSQSVDTATGVIWVTPEDLEEAYCDYQNLKDNPRDRETRDAWVKRQESLRKQLVEAFSNNNDLFKKELITRDLPALLKHQGKWEENKEAVESFNKFTTYFTGFNENRKNMYSDKDQSTAIAHRVMNENLPRFFNNYLSYQKIKDKQASLEFSVETPLLTQMGVSSIDDIFQPRYFINLFTQSGLDSYQELLGGKTDEHGKKTQGLNEQINLYNQQQLDTKDKLPRFTSLYKQILSDRETNSFIPDAFKDDKELLKTLQDYIDHATKKEGFLERLEKSIELLSVVDNEKVYVKKAGLTDISSAIFNSYGIIGAALWHHAENTLYPNSTRRPATETLIKRRKSFCEQDVFSVAELNRIITSYIAQLEAIDPLHQQLKELTDPRQPIRAYFLDVFQQSKQDSELDTCIKNVSPLLSLESLSKKRQAPTLEGDQGDKGYQQLHSIQKMLDAFMTISYKLKPLHLVKGRKAIDMPDMDMGFYAGFSEAYETYSDTIISLYNKTRNHLTKVPFSKEKIKLNFGNPTLLNGWDSNKEAANSSLIFEKDGLYYLGIMHPKHKYLFDYITGIDDIGNDKKIKKKELLRGEIEVDENQGYRKIVYKLLPGANKMLPKVFFSNKRQAYFSPSSEILHIRNTASHSKNGKPQKSHIKAAFNINDCHKIIDFFKASINKHPEWKAFDFQFSPTKKYQDLSEFYREVEQQGYKVDFHPIKQSYIDECVEQGKLFLFQIYNKDFSPYSKGKSNLHTLYWKGLFEPENLNDVVLKLNGEAEVFYRRHSIKVADRTIHRANEAISNKNKEFHKKEESTFNYDIIKDRRYTQDKFQFHVPITLNFNAQGVSHFEDKVNLALQKAEDTHVIGIDRGERHLLYYTIVNSKGEIIEQDTLNKISTDQGYVIDYQNKLHKKEKERDKARKSWSSIENIKELKAGYLSHVVHKLAELIIKYDAIVCLEDLNFGFKRGRFSVEKQVYQKFEKALIDKLNYLVFKTSETTSPGHYLNAYQLTAPFKSFEKLGKQSGVLFYVQAAYTSKIDPSTGFIDFLKPKYKSLSASKVFFETMSSIIFNAEKDYFEFSFDYKKFNPSQKFGQYTTQWKACSFGELRYHNKRNNKGIWETRPINVTKELKQLFDDAGIQYQIGQELKESIILVKDTKFYKTLFWLLRLLLSLRHSRTGTDDDFILSPIENEHGVFFDSRNATDKQPKDADANGAYNIALKGLWNLQQIKQWDGEKHLNLSMKNEDWLSFITVKPYKR

SEQ ID NO: 226 - protein, 1259 aa, unidentified
  REGION 1..1259: note = Description of Unknown:uncultivated organism sequence
  REGION 1..1259: note = Category: MG30 active effectors
  REGION 1..1259: note = Description: MG30-1 effector
MHLSQTFTNKYQVSKTLRFELRPQGKTKETFERWIAELRTEKPSANNLIAEDEQRAEDYKEVKGIIDRFHRKVIEESLESLKLEGLSAYEELYFKREKEDIDLKEIENLQIQMRKQIREAFVEHPVFKDLFKKELIQVHLKEWLTDKQEIDLVAKFQKFTTYFGGFHENRQNVYSPDAKATAVGYRMIHENLPKFLDNRRIFNKIIKAHNELDFSSINTELEELLQGTTVNDVFSLEFFNETLTQTGIDIYNHVLGGYSSETGQKIQGVNEKINLYRQKNGLKARELPNLKPLFKQILSESQTASFVIEQIESNSDLLDRLDNFHSLLTNFEFQGRNEVNVMTELKNMLAALDSYEHEQVYFKNGPSLTQLSQKMFGQWGVIHKALEYYYEQVLNPLQGKKLTKKYESDKQKWLKSKQFNLSLIQKALDGYVPTIDTLESVNLIETLAKLEDKDGADLCIEVDKAYEHVAKLIEQGALSESYAQKKKEKQVIKEYLDGLMSLLHSVKPFYTTEVDIEKDAGFYGLFEPLYEQLNLVIPIYNLVRNYLTQKPYSTEKFKLNFENNTLLDGWDQNKEKANTCVLLRKEGNYFLAVMHKQHNKVFEELPQSEEDTYKKVVYKLLPRANNMLPKVFFSKKNIDYYKPEKELLAKYKLGTHKKGSNFSLNDCHALIDFFKDSISKHPDWAQFNFEFSPTKTYEDLSHFYKEVEHQGYKVNYAKVDVSYINQLVDDGKIFLFQIYNKDFSPYSKGKPNLHTLYWKAVFDERNLADTVYILNGKAEIFFREKSLNYSKEIMAKGHHRDELKDKFTYPIIKNKRFALDKFQFHVPLTMNFKAGSNPNINDRALDFLKNNPDIKIIGLDRGERHLLYLSLIDQKGNIIEQYTLNEIVSKYQGQTFKKDYHKLLDEKEKERDDARKNWDVIETIKELKEGYLSQVVHKITQMMIEHNAIVVLEDLNAGFKRGRHKVEKQVYQKFEKMLIDKLNYLVFKDHDKEKPGGLLNALQLTNKFESFQKLGKQSGLLFYVPAALTSKIDPATGFTNFLRPKHESILKSKSFIEGFTGIHFNSEKEYFEFKFDLKNIPNTRFPDDTKTEWTVCTTNVPRYWWNKSLNEGKGGQEKVLVTQRLQDLLARYDLGYAKGKDLKEDILTIEDASFYKELLWLLNVTVSLRHNNGKHGEQEEDAIISPVANDKGEFFNSSKANPSEPKDADANGAYHIALKGLWALRTINAYDKKEWRGIKLAISNKEWLQFVQQKPFLKT

SEQ ID NO: 227 - protein, 834 aa, unidentified
  REGION 1..834: note = Description of Unknown:uncultivated organism sequence
  REGION 1..834: note = Category: MG30 effectors
  REGION 1..834: note = Description: MG30-2 effector
KALDGYVPTIDTLESVNLIETLAKLEDKDGADLCIEVDKAYEHVAKLIEQGALSESYAQKKKEKQVIKEYLDGLMSLLHSVKPFYTTEVDIEKDAGFYGLFEPLYEQLNLVIPIYNLVRNYLTQKPYSTEKFKLNFENNTLLDGWDQNKEKANTCVLLRKEGNYFLAVMHKQHNKVFEELPQSEEDTYKKVVYKLLPRANNMLPKVFFSKKNIDYYKPEKELLAKYKLGTHKKGSNFSLNDCHALIDFFKDSISKHPDWAQFNFEFSPTKTYEDLSHFYKEVEHQGYKVNYAKVDVSYINQLVDDGKIFLFQIYNKDFSPYSKGKPNLHTLYWKAVFDERNLADTVYILNGKAEIFFREKSLNYSKEIMAKGHHRDELKDKFTYPIIKNKRFALDKFQFHVPLTMNFKAGSNPNINDRALDFLKNNPDIKIIGLDRGERHLLYLSLIDQKGNIIEQYTLNEIVSKYQGQTFKKDYHKLLDEKEKERDDARKNWDVIETIKELKEGYLSQVVHKITQMMIEHNAIVVLEDLNAGFKRGRHKVEKQVYQKFEKMLIDKLNYLVFKDHDKEKPGGLLNALQLTNKFESFQKLGKQSGLLFYVPAALTSKIDPATGFTNFLRPKHESILKSKSFIEGFTGIHFNSEKEYFEFKFDLKNIPNTRFPDDTKTEWTVCTTNVPRYWWNKSLNEGKGGQEKVLVTQRLQDLLARYDLGYAKGKDLKEDILTIEDASFYKELLWLLNVTVSLRHNNGKHGEQEEDAIISPVANDKGEFFNSSKANPSEPKDADANGAYHIALKGLWALRTINAYDKKEWRGIKLAISNKEWLQFVQQKPFLKT

SEQ ID NO: 228 - protein, 879 aa, unidentified
  REGION 1..879: note = Description of Unknown:uncultivated organism sequence
  REGION 1..879: note = Category: MG30 effectors
  REGION 1..879: note = Description: MG30-3 effector
VIHKALEYYYEQVLNPLQGKKLTKKYESDKQKWLKSKQFNLSLIQKALDGYVPTIDTLESVNLIETLAKLEDKDGADLCIEVDKAYEHVAKLIEQGALSESYAQKKKEKQVIKEYLDGLMSLLHSVKPFYTTEVDIEKDAGFYGLFEPLYEQLNLVIPIYNLVRNYLTQKPYSTEKFKLNFENNTLLDGWDQNKEKANTCVLLRKEGNYFLAVMHKQHNKVFEELPQSEEDTYKKVVYKLLPRANNMLPKVFFSKKNIDYYKPEKELLAKYKLGTHKKGSNFSLNDCHALIDFFKDSISKHPDWAQFNFEFSPTKTYEDLSHFYKEVEHQGYKVNYAKVDVSYINQLVDDGKIFLFQIYNKDFSPYSKGKPNLHTLYWKAVFDERNLADTVYILNGKAEIFFREKSLNYSKEIMAKGHHRDELKDKFTYPIIKNKRFALDKFQFHVPLTMNFKAGSNPNINDRALDFLKNNPDIKIIGLDRGERHLLYLSKNKKKGNIIEQYTLNEIVSKYQGQTFKKDYHKLLDEKEKERDDARKNWDVIETIKELKEGYLSQVVHKITQMMIEHNAIVVLEDLNAGFKRGRHKVEKQVYQKFEKMLIDKLNYLVFKDHDKEKPGGLLNALQLTNKFESFQKLGKQSGLLFYVPAALTSKIDPATGFTNFLRPKHESILKSKSFIEGFTGIHFNSEKEYFEFKFDLKNIPNTRFPDDTKTEWTVCTTNVPRYWWNKSLNEGKGGQEKVLVTQRLQDLLARYDLGYAKGKDLKEDILTIEDASFYKELLWLLNVTVSLRHNNGKHGEQEEDAIISPVANDKGEFFNSSKANPSEPKDADANGAYHIALKGLWALRTINAYDKKEWRGIKLAISNKEWLQFVQQKPFLKT

SEQ ID NO: 229 - protein, 1307 aa, unidentified
  REGION 1..1307: note = Description of Unknown:uncultivated organism sequence
  REGION 1..1307: note = Category: MG31 active effectors
  REGION 1..1307: note = Description: MG31-1 effector
MKTVEQFCGQKNGYSRSITLRNRLIPVGKTEENLQKANMLEADFNRAKAYSEVKNLIDDFHRSFIEDVLSNTKLGWKNLYDVFDLCQLEKDKIKKEKQKKDLQSIQAAMRKAIVKKFKDDERFSKLFKKELLSDLLPSIIKNDESGTITDKNEALKVFKGFSTYFSGFHQNRENLYSDEAKATAISNRIVNENFPKFHANVKVFEYLQKNFPEIISDTEESLKAFLNGKKLSEIFNPEKFNAVLCQSGIDFYNTVIGGISDENGKQKIQGLNEKINLASQQLPPEEKSKLKKKMTVLYKQILSDKKTASFIPIGFEKSEEVYKSIKQLKEEYFDKAYKLIERTFSAPDYDLSEIFVPAKELTAFSLAIFGNWSILNDGLFLLEKDNSKKELTEKQVENLHKEISKKDYSLADLQKAYERWANENGVPADKTVKSYFSLSELRANEKTKEKEPVDIVEKIKITYEKIDFENIENLQAEKEAATPIKNFLDEVQCLFHHLKLVDYRGEEQKDSAFYSKLDEILIPLSEIISLYNKVRNFVTKKPGEVKKIKLNFECPTLANGWDLNKESSNDAIILRKNGKYFLGIFNPEDKPKFSNDSICKNQQESHYEKMIYKLLPGPNKMLPKVFFSTKGQETFLPPKDLLLGYEQGKHKKGESFDKSFMHKLIDWFKYAINQHEDWKNFNFKFSPTESYEDMSGFYKEVELQGYKITFQNISENYIDSLIDSGKLYLFQIYNKDFAEKADGKKNLHTLYWENLFSPENLKDICLKLNGDAELFYRPASENLKVIKHEKDSILVNRTTTDGETIRDETYQEIYKFKNPAKQKKGFKLSNEAKSLLDSGKVVFKKARFEITKDKHFLQNTYLFHCPITMNFKAPEITGKKFNERVLEYLRNNPDVKIIGLDRGERHLIYLSLINQNGEIELQKTLNIVEQIRGDKENPVSVNYQEKLVQKEGDRNKARKNWQTIGNIKELKEGYLSNIVHEIAKLMVEQNAIVVMEDLNFGFKRGRFAVERQVYQKFENMLIEKLNYFAFKDRPATEPGGILNAYQLTDKSANISDVGKQCGWIFYIPASYTSKIDPKTGFANLFNTKGLTNVEKKKEVFSKFDSIRYDSKENCFVFSVNYSKLGDNADFKKNWEIYTHGERIVYSRKENKTFSVNPTENLEKAFDGQFAQSGINWKNKENLIDLIENISAEKSNAKFFDELLRSFTTTLQMRNSVPNTEEDYLISPVKAADGTFFDSRNEIAKGKDSGGKWISKFPVDADANGAYHIALKGLYLLQNNFNLNPKGYIENISNADWFKFVQKKEYLK

SEQ ID NO: 230 - protein, 759 aa, unidentified
  REGION 1..759: note = Description of Unknown:uncultivated organism sequence
  REGION 1..759: note = Category: MG31 effectors
  REGION 1..759: note = Description: MG31-2 effector
GSKAAHIFKSDSCFYLGIINKKLDKTDIDSIYQNGNTMIEKIVYDFQKPDNKNTPRLFIRSKGNAYAPAVSTYDLPIESVIDIYDKGLFKTEYREKNLEVYKKSLIKLIDYFKLGFSRHDSYKHYNFCWKETKDYADISEFYADTMRSCYQLKTERINFDNLMTLVDEGKLFLFQIYNKDFSTGKDGGNGSTGRKNMHTLYWENLFSKENLDDVVLQLSGGAELFFRQKSLEEENATIHEKNSFIVNRTYLKEVKGNKEIYETIPEEIYQEIYQKLNGKADTISDEAQELLSSGKVKYRAAPHRIIKDRHFTQDTYLFHCPISLNFKAQEITGKKFNDRVLEKIKNNSEIKIIGLDRGERNLIYLSLINQKGEIELQKTLNLVEQQKRLIDYQGKLVQKEGDRDKARKNWQTISNIKELKEGYLSAVVHELATLMVDNNAIVVMEDLNFGFKRGRFAVERQVYQKFEHMFIDKLNYLVFKDRKVTEPGGVLNAYQLTDKLEAFKDLGKQSGFLFYVPAGYTSKIDPATGFANLLDMTNLTNVQKKRDFFAKFDSICFDEEKQMFAFTFDYKNFNRKDAQEMSRTKWTVYSNGKRIQFCGKGKASKHIENLTEEFKTLFREFDYQNGNNILDSILEVGAALKAGEKPTKEIADFWDKLLVLFKLVLQMRNSDAKTGDDYIISPVMSESGNFFDSREQEKLGNNAKLPKDADANGAYHIALKGLYLLKAFDKTPEDQLKKVDMKISNADWFRFAQEKEYNK

SEQ ID NO: 231 - protein, 753 aa, unidentified
  REGION 1..753: note = Description of Unknown:uncultivated organism sequence
  REGION 1..753: note = Category: MG31 effectors
  REGION 1..753: note = Description: MG31-3 effector
IFKSDSCFYLGIINKKLDKTDIDSIYQNGNTMIEKIVYDFQKPDNKNTPRLFIRSKGNAYAPAVSTYDLPIESVIDIYDKGLFKTEYREKNLEVYKKSLIKLIDYFKLGFSRHDSYKHYNFCWKETKDYADISEFYADTMRSCYQLKTERINFDNLMTLVDEGKLFLFQIYNKDFSTGKDGGNGSTGRKNMHTLYWENLFSKENLDDVVLQLSGGAELFFRQKSLEEENATIHEKNSFIVNRTYLKEVKGNKEIYETIPEEIYQEIYQKLNGKADTISDEAQELLSSGKVKYRAAPHRIIKDRHFTQDTYLFHCPISLNFKAQEITGKKFNDRVLEKIKNNSEIKIIGLDRGERNLIYLSLINQKGEIELQKTLNLVEQQKRLIDYQGKLVQKEGDRDKARKNWQTISNIKELKEGYLSAVVHELATLMVDNNAIVVMEDLNFGFKRGRFAVERQVYQKFEHMFIDKLNYLVFKDRKVTEPGGVLNAYQLTDKLEAFKDLGKQSGFLFYVPAGYTSKIDPATGFANLLDMTNLTNVQKKRDFFAKFDSICFDEEKQMFAFTFDYKNFNRKDAQEMSRTKWTVYSNGKRIQFCGKGKASKHIENLTEEFKTLFREFDYQNGNNILDSILEVGAALKAGEKPTKEIADFWDKLLVLFKLVLQMRNSDAKTGDDYIISPVMSESGNFFDSREQEKLGNNAKLPKDADANGAYHIALKGLYLLKAFDKTPEDQLKKVDMKISNADWFRFAQEKEYNK

SEQ ID NO: 232 - protein, 1016 aa, unidentified
  REGION 1..1016: note = Description of Unknown:uncultivated organism sequence
  REGION 1..1016: note = Category: MG31 effectors
  REGION 1..1016: note = Description: MG31-4 effector
KKMTVLYKQILSDKKTASFIPIGFEKSEEVYKSIKQFKEEYFDKVYKLIEKTFSVPDYELSEIFVPAKELTAFSLAIFGNWSILNYGLFLLEKDNSKKELTEKQVENLHKEISKKDYSLADLQNAYERWANENGVPADKTVKSYFSLSELRANEKTKEKEPVDIVEKIKTAYEKIDFENIENLQAEKEAAVPIKNFLDEVQCLFHHLKLVDYRGEEQKDSAFYSKLDEILIPLSEIISLYNKVRNFVTKKPGEVKKIKLNFECPTLANGWDLNKESSNDAIILRKNGKYFLGIFNPEDKPKFSNDSICKNQEESHYEKMIYKLLPGPNKMLPKVFFSTKGQETFLPPKDLLLGYEQGKHKKGDAFDKSFMHKLIDWFKYAINQHEDWKNFNFKFSPTESYEDMSGFYKEAELQGYKITFQNISENYTDSLIDSGKLYLFQIYNKDFAEKADGKKNLHTLYWENLFSPENLKDICLKLNGEAELFYRPASENLKVIKHEKDSILVNRTTTDGETIRDEIYKEIYKFKNPAKQEKGFKLSDEAKSLLDSGKVVFKKARFEITKDKHFLQNTYLFHCPITMNFKAPEITGKKFNERVLEYLRNNPDVKIIGLDRGERHLIYLSLINQNGEIELQKTLNIVEQIRGDKEKPVPVNYQEKLVQKECDRDKARKNWQTIGNIKELKEGYLSNIVHEIARLMVEQNAIVVMEDLNFGFKRGRFAVERQVYQKFENMLIEKLNYFAFKDRPATESGGILNAYQLTDKSANISDVGKQCGWIFYIPASYTSKIDPKTGFANLFNTKGLTNVEKKKEFFSKFDSIRYDSKENCFVFSVNYSKLGDNADFKKNWEIYTHGERIVYSRKENKTFSVNPTENLEKTFDEQFVQSGINWKNKENLIDLIENISAEKSNAKFFDELLRSFTTTLQMRNSVPNTEEDYLISPVKAADGTFFDSRNEIVKGKNSSGKWISKFPVDADANGAYHIALKGLYLLQNNFNLNEKDYIENISNADWFKFVQEKEYLK

SEQ ID NO: 233 - protein, 1324 aa, unidentified
  REGION 1..1324: note = Description of Unknown:uncultivated organism sequence
  REGION 1..1324: note = Category: MG31 effectors
  REGION 1..1324: note = Description: MG31-5 effector
MFMKAIDNFCGQKNGYSRSITLRNALVPVGRTEENIQKLKLLEKDLERSRAYVEVKKLIDGFHRVFIEEVLSKTDLEWGPLYDQFELFQNEKDKQKKNKIKKDLETLQAAMRKQIVKKFKEDERFDKLFKKELLSDFVPAVITADESGSISDKKAALDAFKGFATYFTGFHQNRQNMYSEEAQSTAISNRIVNENFPKFYANVKLFEYLQKEFPEIIKDTEKSLANFLHGKKLASVFSKEGFNAVLCQSGIDFYNTVIGGISGEAGDKKVQGLNEKINLASQQLPAEEKHKLKRKMTVLYKQILSDRAAASFIPEGFESSEQVYESLKQFKEQSLDKAVPLIRELVDTNDCDLNQIYVPAKEVTDFSLKLFANWSIVHDGMFLLEKDSVKKSLSEKQVEALRKDIAKRDCTLSDLQKAYERWAKEYNIPVEKAARDYFNIAELRIDEKSKEKKFVNILKELDEKYCKINFEKKENLIKEKEAAAPIKDFLDEAQSLYHYLKIVDYRGEEQKDSDFYSKYDEILQTLSEIVPLYNKTRNYVTKKPNEVKKVKLNFDCPTCAKGWSLNNELMYGSIILRRGASYYLGIMNKEAHKSFKSYPGPIGDESCFEKMVYLQAADPSKDIPNLLKIDGITVKKNGRKDFDGVNRQIENYRNTYLPKDINEIRKSKKYLRSSDNFNKEALNKYIDYYKTLTAEYFSDYKFVFKPSKDYSSFQEFTDDVNSQAYQIQFITVSESYIDSLVDSGKLFLFKIYNKDYSTGKGGGNGSTGKKNLHTLYWENLFSEENLRDVCLKLNGEAELFWRDANPDVKDVCHKKGSALVNRTTLDGATIPEEIYQEIYKFKNNIAKSISDKAKELLDSGKVVCKEAKFDITKDRRFTKPTYLFHCPITMNFKAPEISNKDFNAKVQKILKDNPDVKIIGLDRGERHLIYLSLINQKGEIELQKTLNLVEQVRNDKTVSVNYQEKLVQKEGGRDKARKNWQTIGNIKELKEGYLSNIVHEIAELMVENNAIVVMEDLNFGFKRGRFAVERQVYQKFENMLIEKLNYLVFKDRKVGEPGGVLNAYQLANKSANVSDVGKQCGWIFYIPAAYTSKIDPKTGFANLFYTTGIANVEKKKEFFDKFDSVRFDRKTNSFVFAFDYGNFSDNADFKKKWEVYSCGERLVYSKADKTKICASPTEDLKALFDKQGINWNSEENFIDQIHAVQAERENCAFYDGLYRSFMAILQMRNSKPNSSNQEDDYLISPVMAVDGTFYDSRVEAAKGKDAEGKWISKLPVDADANGAYHIALKGLYLLKNDFNLNDKGYIENISNADWFMFAQRRFEN

SEQ ID NO: 234 - protein, 1306 aa, unidentified
  REGION 1..1306: note = Description of Unknown:uncultivated organism sequence
  REGION 1..1306: note = Category: MG31 effectors
  REGION 1..1306: note = Description: MG31-6 effector
MKAVEKFCGQKNGYSRSITLRNRLIPIGKTEENIQKLKLLDKDMERAKAYDEVKKLIDEFHRTFIEEVLSKASFEWAPLYDQFDLFQTEKDKLKKNKIKKELEVLQGVMRKKIVESFKKDKRFEKLFKKELLTEFVPAVIKNDESGTITDKQAALNVFKGFATYFTGFHQNRQNMYSEEAQSTAISNRIVNENFPKFYANVKVFEYLKNNYPEIINETEKSLAEFLKGKKLADIFSPESFNAVMSQRGIDFYNTVIGGISDESGSKKIQGLNEKINLASQQLPSEEKYKLKKKMTILYKQILSDRNTASFIPVGFEKSEEVYESVKHFKEEILDKVITNTKKLFDSVDYDLGQIYVPAKEVTEFSLKVFGNWSISHNGLFLLEQDMAKKALTEKQIEALKKEISKRDLSLSDLQNAYERWTKENDVKAEKNVRNYFKLTELRVDEKSKEKDSIEILKNLDVLYSKIDFKKQENLIKEKTSATPIKDYLDEIQNLYHYLKLVDYRGEEQKDTDFYSKYDEIIQALSEIIPLYNKVRNFVTKKPNEIKKVKLNFDCPTLANGWDLNKESSNDAIILRKNGNYYLGIFNPKDKPKFEYNNEDSGYEKMIYKLLPGPNKMLPKVFFSAKGLETFRPPKDLVLGYEEGKHKKGDNFDKVFMHKLIDWFKYAINQHEDWKNFNFKFSPTEFYEDMSGFYKEVELQGYKITFSKVSDNCINSLIDSGKLFLFQIYNKDYSTGEEGGNGSTGKKNQHTLYWENLFSEENLRDVCFKLNGEAEFFWRDANPNVKAVCHKKDSVLVNRTTSDGKSIPEEIYQEIYKYKNPEKQEKEFTLSKDAKELLESGTVVCKKAKFTITKDRHFTQQTYLFHCPITMNFKASEITGRKFNEHVQEILRNNPEVKVIGLDRGERHLIYLSLINQKGEIELQKTLNLVEQVRNDKTVSVNYQEKLVQKEVERDKARKSWQSISNIKELKEGYLSNIVHEIAKLMVENNAIVVMEDLNFGFKRGRFPVERQVYQKFENMLIEKLNYLVFKDKNVTEPGGVLNAYQLADKAVNVSDVGKQCGWIFYIPASYTSKIDPKTGFANLFYTAGLTNIEKKKDFFDKFDSIRYDRKLDSFVFGFDYSNFSDNADYNKKWELYSRGERLVYSKAEKSTISVNPTENLKVLFDKQGIVWDSEDNFIDQIHAVQAERDNVPFYDGLYRSFTAILQMRNSVPNSSKQEDDYLISPVMADDGNFYDSRLEAAKGKDEKGNWISKLPVDADANGAYHIALKGLYLLKNDFNLNEKGYIENISNADWFKFVQNKEYQDC

SEQ ID NO: 235 - protein, 789 aa, unidentified
  REGION 1..789: note = Description of Unknown:uncultivated organism sequence
  REGION 1..789: note = Category: MG31 effectors
  REGION 1..789: note = Description: MG31-7 effector
MKSIEIFCGQSNGYSRSITLRNRLIPIGKTEENIKKLKLLDNDINRSKAYVEVKKLIDDFHRSFIEDVLSKVKLEWGPLYVQFDLFQNEKDKQKKNKIKKELETLQGVMRKKIIKKFKDDDRFDKLFKKELLTEFVPTVIKNDESGTISDKQAALDEFKGFATYFTGFHQNRQNMYSAEAQSTAISNRIVNENFPKFYANIKVFEYLQKEYPAIITETEESLSEILKGKKLADIFCADGFNSVLSQSGIDFYNTIIGGVAGEAGTKKLQGINEKINLTRQQLPVEEKSKLKRKMTVLYKQILSDRRTASFIPVGFESSDEVYESVKQFKEDSLNKILSEMKILFEKSDYELSQIYVPAKEVTEFSLKLFGNWSILHDGLFLIEKDNAKKSLSENQIDILRKEIAKRDCSLADLQSAYKRWAKENDVKVEKTVMNYFRIAELRAEEKSKEKASVEILKELESAFDKIDFEKRENLIKEKESATPIKEFLDEVQNLYHYLKLVDYRGEEQKDTDFYSKYDEILQTLSEIIPLYNKVRNFVTKKPNEVKKVKLNFDNVSLAKGWDVNKESDYTCILLRRNGLYYLGVLNPKDKPKFDSENNGETSINKNDCYEKLVYKYFKDVTTMIPKCSTQLNDVKQHFKNSNEDYILENDNFIKPLVISKRIFDLNNKTFDEKKMFQIDYYRNTGDLKGYTEAVKDWISFCITFVHSYKSTCIYDFSSLGDCSQFKQVDQFYKEINLLLYKIWFVNVTAEKINSLVDSGKLFLFQIYNKDYSTGKDGGNGSTGKKNLHT

SEQ ID NO: 236 - protein, 1307 aa, unidentified
  REGION 1..1307: note = Description of Unknown:uncultivated organism sequence
  REGION 1..1307: note = Category: MG31 effectors
  REGION 1..1307: note = Description: MG31-8 effector
MKSIEQFCGQKNGYSRSITLRNRLIPVGKTEENLQKANMLEADFERAKAYAEVKNLIDDFHRSLIEDVLSNAKLDWKKLYVQFDLYQSEKDKLKKTKQKKDLQSVQGAMRKAIVKKFKDDERFSKLFKKDLLSDLLPSIIKNDESGTITDKNEALKVFKGFATYFSGFHQNRENLYSDEAKATAISNRIVNENFPKFHANVKVFEYLQKNFPKIISDTEESLKEFLNGKKLSEIFSPENFNAVLCQSGIDFYNTVIGGISDENKKQKIQGLNEKINLASQQLPPEEKSKLKKKMTVLYKQILSDKKTASFIPVGFEKSEEVYKSIKQFKEEYFDKAYKLIEKTFSAPDYDLSEIFVPAKELTAFSLAIFGNWSILNDGLFLLEKDKAKNELTEKQVENLHKEISKKDYSLADLQIAYERWANENGVQSDKTVKSYFTLSELRANEKTKKKEPIDIIEKIRIAYENIDFENIENLQAEKDAATPIKNFLDEVQCLFHHLKLVDYRGEEQKDSAFYSKFDEILIPLSEIIPLYNKVRNFVTKKPGEVKKIKLNFECPTLANGWDLNKESSNDAIILRNDGKYFLGIFNPENKPKFSNDSICKNQEEPHYEKMIYKLLPGPNKMLPKVFFSTKGQETFLPPKDLLLGYEQGKHKKGETFDKSFMYKLIDWFKYAIDQHEDWKNFNFQFSPTESYEDMSGFYKEVELQGYKITFQNISENYIDSLVDSGKLYLFQIYNKDFAEKADGKKNLHTLYWENLFSPENLKDICLKLNGEAELFYRPASENLKIIKHEKDSILVNRTTTDGETIRDEIYQEIYKFKNPAKQEKGFKLSDEAKSLLDSGKVVLKKARFEITKDKHFLQNTYLFHCPITMNFKAPEITGKKFNERVLEYLRNNPDVKIIGLDRGERHLIYLSLINQNGEIELQKTLNIVEQIRGDKENPVSVNYQEKLVQKEGDRDKARKNWQTIGNIKELKEGYLSNIVHEIAKLMVEQNAIVVMEDLNFGFKRGRFAVERQVYQKFENMLIEKLNYFAFKDRTATEPGGILNAYQLTDKSANVSDVGKQCGWIFYIPASYTSKIDPKTGFANLFNTKGLTNVEKKKEFFAKFDSIRYDSKEDCFVFNVNYSKLGDNADFRKNWEIYTHGERIVYSKKENKTFSVNPTENLKKAFDGQFAQSGIEWKNKENLIDLIENICAEKSNAKFFDELLRSFTTTLQMRNSVPNTEEDYLISPVKAADGTFFDSRNEIAKGKDSSGKWISKFPVDADANGAYHIALKGLYLLQNNFNLNEKGYIENISNADWFKFVQKKEYLK

SEQ ID NO: 237 - protein, 1335 aa, unidentified
  REGION 1..1335: note = Description of Unknown:uncultivated organism sequence
  REGION 1..1335: note = Category: MG31 effectors
  REGION 1..1335: note = Description: MG31-9 effector
MKTIDDFCGQKNGYSRSITLRNALIPIGKTEENIQKLKLLDKDVERSKAYVEVKKLIDDFHRTFIEEVLSKTKLEWGLLYKQFELYQNEKDKQKKNKIKKQLEQLQSGMRKDIVKQFKKDERFDKLFKKELLSDFVPTVIKNDESGTISDKQAALDAFKGFATYFTGFHQNRQNMYSEEAQSTAISNRIVNENFPKFYANVKLFEYLQKEFPEIIKETEDSLSNFLNGKRLAEIFSENGFNAVLSQNGIDFYNTVIGGISDEAGSKKLQGLNEKINLASQQLPKEEKYKLKRKMTVLYKQILSDRSTASFIPVGFETSEEVYESVKQFKEQNFDKVVSLVKKLSSKTDYDLNQIYVPAKEVTEFSLKLFGNWSILHDGLFLLEKDNAKKNFSEKQMETLRKEIAKRDCSLAELQKVYEELCSYNGEQLGINEKGYLVKKTYNDKDKIELNVRDNFFRFTELRLDENTKEKSFVEILKEVNKNYLKIDFDKQENLIKEKESSTPIKNFLDEVQNLYHYLKLVDYRGEEQKDSDFYSELDKILLELSEIVPLYNKVRNFVTKKPNEIKKVKVMFDCSSLLNGWGTDYGTKEAHIFIDSGKYYLGIVNNKLDKEDVESLKVVGEHMISKVIYDFQKPDNKNTPRLFIRSKGDSYAPAVSKYNLPITDIIDIYDKGLFKTEYRKINPEEYKKSLEKIIDYFKLGFSRHDSYKHYNFSWKKTTDYADIADFYSDTIKSCYQLKFEKVNYGNLVSLVDSGKLFLFQIYNKDYSTGKDGGNGSTGNKNLHTLYWENLFSEENLRDVCLKLNGEAELFWRDANQNVKDVCHKKGSVLVNRTMTDGSTIPEDIYQEIYKFKNKKSESLSDKAKELLDSGKVVCKEARFDITKDRHFTKQTYLFHCPITMNFKASEISNKDFNSKVQTLLKNNSDVKIIGLDRGERHLIYLSLINQKGEIELQKTLNLVEQVRNDKTVKVNYQEKLVQKEGDRDKARKNWQTIGNIKELKEGYLSNIVHEIAKLMVENNAIVVMEDLNFGFKRGRFAVERQVYQKFENMLIEKLNYLVFKDKKLTESGGVLNAYQLTNKSANVSDVGKQCGWIFYIHAAYTSKIDPKTGFANLFYTAGLTNVEKKKEFFDKFDSIRFDSKTDSFVFSFDYSNFSDNADFKKNWDVYSRGERLVYSKAERTAVCVNPTENLKALFEKQGINWNTEDNFIDQIQAVQAERENCSFYDGLYRSFMAILQMRNSKPNSSNQEDDYLISPVKAEDGTFYDSRVEAAKGKDSNGRLISKLPVDADANGAYHIALKGLYLLKNDFNLNDKGYIENISNADWFKFAQEKDYAE

SEQ ID NO: 238 - protein, 1306 aa, unidentified
  REGION 1..1306: note = Description of Unknown:uncultivated organism sequence
  REGION 1..1306: note = Category: MG31 effectors
  REGION 1..1306: note = Description: MG31-10 effector
MKTIENFCGQKNGYSRSITLRNRLIPIGKTEENIEKLQLLDNDIKRSKAYVEVKTMIDDFHRSFIEDVLSKAKLEWGPLYDLFDLFQNEKDKQKKSKIKKELETIQGVMRKQIVKKFKEDDRFDKLFKKELLTEFVPTVIKADESGTISDKRAALDVFKGFATYFTGFHQNRQNMYSEEAKATAISNRIVNENFPKFYANVKVFECLQKEYPEIITETEASLSEILNGKKLADIFSADGFNSVLSQSGIDFYNTIIGGIAGEAGTQKLQGVNEKINLARQQLPEEEKSKLKRKMTVLYKQILSDRSTASFIPVGFESSDEVYESVKQFKEDSLNKILSEIKTLFEKSDYDLSQIYVPAKEVTDFSLKLFGNWSILHDGLFLIEKDNAKKTFTEKQIENIRKDIAKRDCSLADLQNAYERWEKENDVKAEKTVKNYFKIAELRADEKSREKTSVEILNKIESAFEKIDFEKRDNLIKEKETAAPIKDFLDEVQNLYHYLKLVDYRGEEQKDTDFYSKYDQILQTLSEIVPLYNKVRNFVTKKPNEVKKVKLNFDCPTLASGWDLNKESSNDAILLRKDGNYYLGIFNSKDKPKFENCSTDGECYEKMIYKLLPGPNKMLPKVFFSTKGQETYLPSKEILLGYEEGKHKKGDNFDKDFMHKLIDWFKTAINQHEDWKNFNFKFSQTESYEDLSGFYKEVESQGYKIIFKKVSESYINSLVDSGKLFLFQIYNKDYSTGKDGGNGSTGKKNLHTMYWENLFSEENLRDVCLKLNGEAELFWRDANPDVKAVCHKKGSVLVNRTTSDGETIPEEIYQEVYKFKNPDKQENGFKLSDAAKELLDSGKVVCKEAKFDITKDRHFTQKTYLFHCPITMNFKASEITGRKFNEKVQQALKNNPDVKIIGLDRGERHLIYLSLINQKGEIELQKTLNLVEQVRNDKTVSVNYQEKLVQKEGERDKARKNWQSINNIKELKEGYLSNIVHEIAELMVENNAIVVMEDLNFGFKRGRFAVERQVYQKFENMLIEKLNYLVFKDKKVTEPGGVLNAYQLTDKSANISDVGKQCGWIFYIPAGYTSKIDPKTGFANLFYTAGLTNIEKKKDFFDRFDSIRYDRKTDSFVFSFDYSGVSDNADFNKKWEMYSRGERLVFSKAEKSIVRVNPTENLKALFDKQGISWSSEDNIIDQIQAVQAERENCAFYDGLYRSFTAILQMRNSVPNSSKEEDDYLISPVMAEDGTFYDSREEAAKGKTTDGKWISKLPVDADANGAYHIALKGLYLLKNNFNLNEKGYIENISNADWFKFVQEKKYAK

SEQ ID NO: 239 - protein, 1305 aa, unidentified
  REGION 1..1305: note = Description of Unknown:uncultivated organism sequence
  REGION 1..1305: note = Category: MG31 effectors
  REGION 1..1305: note = Description: MG31-11 effector
MKTIENFCGQKNGYSRSITLRNRLIPIGKTEENIEKLQLRDKDIKRSKAYVEVKTMIDDFHRAFIEEVLSKAKLEWGPLYDLFDLFQNEKDKQKKSKIKKELETIQGVMRKQIVKKFKDDDRFDKLFKKELLTEFVPTVIKADESGTISDKRAALDVFKGFATYFTGFHQNRQNMYSEEAKATAISNRIVNENFPKFYANVKVFECLQKEYPAIITETEEALSEILNGKKLADIFSADGFNSVLSQSGIDFYNTIIGGVAGEAGTQKLQGINEKINLARQQLPTEEKNKLKRKMSVLYKQILSDRSTASFIPIGFESSDEVYESVKQFKEQSLDNVISAAKELFEKSDYDLSQIYVPAKEVTDFSLKLFGNWSILHDGLFLIEKDNAKKSFTEKQIENLRKDIAKRDCSLADLQNAYERWAKENDVKAEKTVKNYFKIAELRADEKSREKTSVEILNKIESAFEKIDFEKRDNLIKEKETAAPIKDFLDEVQNLYHYLKLVDYRGEEQKDTDFYSKYDEIAQTLSEIVPLYNKVRNFVTKKPNEVKKVKLNFDCPTLASGWDLNKESSNDAILLRKDGNYYLGIFNSKDKPKFDNCSTEGECYEKMIYKLLPGPNKMLPKVFFSIKGQETYLPPEEILLGYEEGKHKKGDNFDKDFMYKLIDWFKTAINQHEDWKNFNFKFSQTESYEDLSGFYKEVESQGYKITFQKVAESYINSLVDSGKLFLFQIYNKDYSTGNDGGNGSTGKKNLHTLYWENLFSEENLRDVCLKLNGDAELFWRDANPDVKAVCHKKGSVLVNRTTSDGETIPEEIYQEVYKFKNPDKQEKSFKLSDAAKKLLDSGKIVCKEAKFDITKDRRFTKPTYLFHCPITMNFKAPEISNKDFNAKVQKILKDNPDVKIIGLDRGERHLIYLSLINQKGEIELQKTLNLVEQVRNDKTVSVNYQEKLVQKEGGRDKARKNWQTIGNIKELKEGYLSNIVHEIAELMVENNAIVVMEDLNFGFKRGRFAVERQVYQKFENMLIEKLNYLVFKDRKVGEPGGVLNAYQLANKSANVSDVGKQCGWIFYIPAAYTSKIDPKTGFANLFYTAGLTNVEKKKEFFDKFDSVRFDRKTNSFVFAFDYGNFSDNADFKKKWEVYSCGERLVYSKADKTAICASPTEDLKTLFDKQSINWNSEENFIDQIHAVQAERENCAFYDGLYRSFMTILQMRNSKPNSSNQEDDYLISPVMAADGTFYDSRVEAAKGKDAEGKWISKLPVDADANGAYHIALKGLYLLKNDFNLNDKGYIENISNADWFRFAQSRFEN

SEQ ID NO: 240 - protein, 1237 aa, unidentified
  REGION 1..1237: note = Description of Unknown:uncultivated organism sequence
  REGION 1..1237: note = Category: MG31 effectors
  REGION 1..1237: note = Description: MG31-12 effector
MKTVEQFCGQKNGYSRSITLRNRLILVGKTEENLQKANMLEADFNRAKAYSEVKNLIDDFHRSFIEDVLSNTKLGWKNLYDVFDLCQLEKDKIKKEKQKKDLQSIQAAMRKAIVKKFKDDERFSKLFKKELLSDLLPSIIKNDESGTITDKNEALKVFKGFSTYFSGFHQNRENLYSDEAKATAISNRIVNENFPKFHANVKVFEYLQKNFPEIISDTEESLKAFLNGKKLSEIFNPEKFNAVLCQSGIDFYNTVIGGISDENGKQKIQGLNEKINLASQQLPPEEKSKLKKKMTVLYKQILSDKKTASFIPIGFEKSEEVYKSIKQLKEEYFDKAYKLIERTFSAPDYDLSEIFVPAKELTAFSLAIFGNWSILNDGLFLLEKDNSKKELTEKQVENLHKEISKKDYSLADLQKAYERWANENGVPADKTVKSYFSLSELRANEKTKEKEPVDIVEKIKITYEKIDFENIENLQAEKEAATPIKNFLDEVQCLFHHLKLVDYRGEEQKDSAFYSKLDEILIPLSEIISLYNKVRNFVTKKPGEVKKIKLNFECPTLANGWDLNKESSNDAIILRKNGKYFLGIFNPEDKPKFSNDSICKNQQESHYEKMIYKLLPGPNKMLPKVFFSTKGQETFLPPKDLLLGYEQGKHKKGESFDKSFMHKLIDWFKYAINQHEDWKNFNFKFSPTESYEDMSGFYKEVELQGYKITFQNISENYIDSLIDSGKLYLFQIYNKDFAEKADGKKNLHTLYWENLFSPENLKDICLKLNGDAELFYRPASENLKVIKHEKDSILVNRTTTDGETIRDETYQEIYKFKNPAKQKKGFKLSNEAKSLLDSGKVVFKKARFEITKDKHFLQNTYLFHCPITMNFKAPEITGKKFNERVLEYLRNNPDVKIIGLDRGERHLIYLSLINQNGEIELQKTLNIVEQIRGDKENPVSVNYQEKLVQKEGDRNKARKNWQTIGNIKELKEGYLSNIVHEIAKLMVEQNAIVVMEDLNFGFKRGRFAVERQVYQKFENMLIEKLNYFAFKDRPATESGGILNAYQLTDKSANISDVGKQCGWIFYIPASYTSKIDPKTGFANLFNTKGLTNVEKKKEVFSKFDSIRYDSKENCFVFSVNYSKLGDNADFKKNWEIYTHGERIVYSRKENKTFSVNPTENLEKAFDGQFAQSGINWKNKENLIDLIENISAEKSNAKFFDELLRSFTTTLQMRNSVPNTEEDYLISPVKAADGTFFD

SEQ ID NO: 241 - protein, 779 aa, unidentified
  REGION 1..779: note = Description of Unknown:uncultivated organism sequence
  REGION 1..779: note = Category: MG31 effectors
  REGION 1..779: note = Description: MG31-13 effector
MKTVEQFCGQKNGYSRSITLRNRLIPVGKTEENLQKANMLEADFNRAKAYSEVKNLIDDFHRSFIEDVLSNTKLGWKNLYDVFDLCQLEKDKIKKEKQKKDLQSIQAAMRKAIVKKFKDDERFSKLFKKELLSDLLPSIIKNDESGTITDKNEALKVFKGFSTYFSGFHQNRENLYSDEAKATAISNRIVNENFPKFHANVKVFEYLQKNFPEIISDTEESLKAFLNGKKLSEIFNPEKFNAVLCQSGIDFYNTVIGGISDENGKQKIQGLNEKINLASQQLPPEEKSKLKKKMTVLYKQILSDKKTASFIPIGFEKSEEVYKSIKQLKEEYFDKAYKLIERTFSAPDYDLSEIFVPAKELTAFSLAIFGNWSILNDGLFLLEKDNSKKELTEKQVENLHKEISKKDYSLADLQKAYERWANENGVPADKTVKSYFSLSELRANEKTKEKEPVDIVEKIKITYEKIDFENIENLQAEKEAATPIKNFLDEVQCLFHHLKLVDYRGEEQKDSAFYSKLDEILIPLSEIISLYNKVRNFVTKKPGEVKKIKLNFECPTLANGWDLNKESSNDAIILRKNGKYFLGIFNPEDKPKFSNDSICKNQQESHYEKMIYKLLPGPNKMLPKVFFSTKGQETFLPPKDLLLGYEQGKHKKGESFDKSFMHKLIDWFKYAINQHEDWKNFNFKFSPTESYEDMSGFYKEVELQGYKITFQNISENYIDSLIDSGKLYLFQIYNKDFAEKADGKKNLHTLYWENLFSPENLKDICLKLNGDAELFYRPA

SEQ ID NO: 242 - protein, 874 aa, unidentified
  REGION 1..874: note = Description of Unknown:uncultivated organism sequence
  REGION 1..874: note = Category: MG31 effectors
  REGION 1..874: note = Description: MG31-14 effector
MKTVEQFCGQKNGYSRSITLRNRLIPVGKTEENLQKANMLEADFNRAKAYSEVKNLIDDFHRSFIEDVLSNTKLGWKNLYDVFDLCQLEKDKIKKEKQKKDLQSIQAAMRKAIVKKFKDDERFSKLFKKELLSDLLPSIIKNDESGTITDKNEALKVFKGFSTYFSGFHQNRENLYSDEAKATAISNRIVNENFPKFHANVKVFEYLQKNFPEIISDTEESLKAFLNGKKLSEIFNPEKFNAVLCQSGIDFYNTVIGGISDENGKQKIQGLNEKINLASQQLPPEEKSKLKKKMTVLYKQILSDKKTASFIPIGFEKSEEVYKSIKQLKEEYFDKAYKLIERTFSAPDYDLSEIFVPAKELTAFSLAIFGNWSILNDGLFLLEKDNSKKELTEKQVENLHKEISKKDYSLADLQKAYERWANENGVPADKTVKSYFSLSELRANEKTKEKEPVDIVEKIKITYEKIDFENIENLQAEKEAATPIKNFLDEVQCLFHHLKLVDYRGEEQKDSAFYSKLDEILIPLSEIISLYNKVRNFVTKKPGEVKKIKLNFECPTLANGWDLNKESSNDAIILRKNGKYFLGIFNPEDKPKFSNDSICKNQQESHYEKMIYKLLPGPNKMLPKVFFSTKGQETFLPPKDLLLGYEQGKHKKGESFDKSFMHKLIDWFKYAINQHEDWKNFNFKFSPTESYEDMSGFYKEVELQGYKITFQNISENYIDSLIDSGKLYLFQIYNKDFAEKADGKKNLHTLYWENLFSPENLKDICLKLNGDAELFYRPASENLKVIKHEKDSILVNRTTTDGETIRDETYQEIYKFKNPAKQKKGFKLSNEAKSLLDSGKVVFKKARFEITKDKHFLQNTYLFHCPITMNFKAP

SEQ ID NO: 243 - protein, 1328 aa, unidentified
  REGION 1..1328: note = Description of Unknown:uncultivated organism sequence
  REGION 1..1328: note = Category: MG31 effectors
  REGION 1..1328: note = Description: MG31-15 effector
MNIIFGGIFMKTIDDFCGQTSGYSRSITLRNRLIPIGKTEEIIQKQHLLDNDIKRARAYLEVKKMIDDFHRIFIEEVLSKAKLEWGPLYDQFDLFQNEKDKQKKNKIKKELESLQGVMRKQIVKKFKADGRFDKLFKKELLTEFVPTVIKADESGTISDKQAALDVFKGFATYFTGFHQNRQNMYSEEAQSTAISNRIVNENFPKFYANVKVFEYLQNECPAIITETEESLSDFLKGKRLADIFTEEAFNAVLSQGGIDFYNTIIGGVAGEAGTQKIQGVNEKINLARQQLPEEEKSKLKRKMTVLYKQILSDRSTASFIPVGFESSDEVYESVKQFKEDSLNKILSEMKILFEKSDYELSQIYVPAKEVTEFSLKLFGNWSILHDGLFLIEKDNAKKSLTEKQIDILRKDIAKRDCSLSDLQSAYERWTKENDVKVEKTVKNYFGIAELRVDEKSKEKTSVEILKELESAFDKIDFEKRDNLIKEKETAAPIKNFLDEVQNLYHYLKLVDYRGEEQKDTDFYSKYDEILQTLSEIIPLYNKVRNFVTKKPNEVKKVKLNFDCSSFLNGWGTDYGTKEAHIFIDSGKYYLGIVNEKLAKEDEDELKTPTSKVIKKVVYDFQKPDNKNTPRLFIRSKGTAFAPAVSQYNLPIESVIEIYDKGLFKKEYRKINPQVYKESLIKMIDYFKLGFTRHDSYKHYSFNWKDSSEYNDISEFYADVMSSCYQLKFEDTNFEKLLSLVDSGKLFLFQIYNKDYSTGKDGGNGSTGKKNLHTLYWKNLFSEENLRDVCLKLNGEAELFWRDANPNVKNVCHKKGSVLVNRTTSDGDTIPEKIYQEIYKFKNPDKQEKGFKLSDVAKEFLDSGKVVCKEAKFDITKDRHFTQKTYLFHCPITMNFKASEIPGKKFNEKVQQVLKNNPDVKIIGLDRGERNLIYLSLINQKGEIELQKTLNLVDQVRNDKTVSVNYQEKLVQKEGERDKARKNWQTISNIKELKEGYLSNIVHEIAELMVDNNAIVVMEDLNFGFKRGRFAVERQVYQKFENMLIEKLNYLVFKDKISTEPGGVLNAYQLTVKAANVSDVGKQCGWIFYIPASYTSKIDPKTGFANLFYTAGLTNIEKKKDFFDKFDSIRYDEKTDSFVFSFDYREFGDNADFKKKWEVYSRGERLIFSKAEKSVIRVNPTENLKALFDNQGINWASENNFMAQIHAVRAERENCAFYDGLYRSFTAILQMRNSVSNSSKQEDDYLISPVMAEDGSFYDSREEAEKGKTPDGKWISKFPVDADANGAYHIALKGLYLLKNNFNQNERGGIENISNADWFEFVQEKKYAK

SEQ ID NO: 244 - protein, 1302 aa, unidentified
  REGION 1..1302: note = Description of Unknown:uncultivated organism sequence
  REGION 1..1302: note = Category: MG31 effectors
  REGION 1..1302: note = Description: MG31-16 effector
MNVINKFCGQENGYSRSITLRNALIPIGKTEENIQKLKLLDKDIVRSKAYIEVKKLIDDFHRAFIEEVLSKIKLDWGPLFDQFELYQNERDKQKKNRIKNDLKKLQEGMRKDLVKKFKEDKRFDKLFKKELLSDFVPTVIKTDETGTISDKQAALDAFKGFATYFTGFHQNRQNMYSDEEQSTAISNRIVNENFPKFYANVKFFEYLQKDFPAIIKDTEESLAVFLKGKKLADIFSENGFNAVLSQSGIDFYNTVIGGISEEAGSKKIQGLNEKINLASQQLQAEEKHKLKKKMSVLYKQILSDRSTVSFIPVGFEASDEVYESVKQFKEQRLDKAISLVKKLTDKTDYDISQIYVPAKEVTEFSLKLFGNWSILYDGLFLLEKDGSKKNFTEKQVETLRKEIAKKDFSLEDLQNAYERWTKEYNSPVDKTTKNYFRIAELRLDENTKEKSFVEILKKLDESYSKIDFDKQKNLIKEKEAATPIKNFLDEVQNLYHYMKVVDYRGEEQKDSDFYSGLDEILQILSEIIPLYNKVRNFVTKKPNDVKKVKLNFDCPTLANGWDLNKESSNDAIILRKNGNYYLGIYNPKDKPKFETCTNGEECYEKMIYKLLPGPNKMLPKVFFSTKGKETFLPPEDILIGYEDGKHKKGGNFDKQFMYKLIDWFKAAINRHEDWKNFNFKFSPTESYEDLSGFYKEVELQGYKITFQNIAESYINSLVDSGKLFLFQIYNKDFSTGKDCGNGSTGKKNLHTLYWENLFSEENLRDVCLKLNGEAELFWRDANPNVKDVCHKKGSVLVNRTTSDGKSIPEDVYQEIYQFKNKLTDKISDKAKELLDSGKVVCKVAKFDITKDKHFTKSTYLFHCPITMNFRAPGISDKDFNVKVQSILKDNPDVKIIGLDRGERHLIYLSLINQKGEIELQKTLNLVEQVRNDKTVSVNYQEKLVQKEGDRDKARKNWQTIGNIKELKEGYLSNIVHEIAKLMVENNAIVVMEDLNFGFKRGRFAVERQVYQKFENMLIEKLNYLVFKDKKVTEPGGVLNAYQLANKSANVSDVGKQCGWIFYIPAAYTSKIDPKTGFANLFYTAGITNIEKKKDFFDKFDSIRYDRKTDSFVFSFDYSNFSDNADFKKKWEVYSCEDRLVFSKAEKTTVSVNPTENLKALFDKQEINWNTEDNFIDQIHAVQAERDNCAFYDGLYRSFMAILQMRNSKPNSSNQEDDYLISPVMADDGTFYDSRVEAAKGKDENGRWISKLPVDADANGAYHIALKGLYLLKNDFNLNDKGYIDNISNAEWFKFAQEKDYAE

SEQ ID NO: 245 - protein, 1334 aa, unidentified
  REGION 1..1334: note = Description of Unknown:uncultivated organism sequence
  REGION 1..1334: note = Category: MG31 effectors
  REGION 1..1334: note = Description: MG31-17 effector
MRTIDEFCGQKNGYSLSKTLRNKLIPVGKTEDKIKEYHLMENDYGRAEAYVEVKNLIDDFHRSFIAERLDKVSLDWTNLFNALNEYQKNQKDKLLKAKCKKVLEAQQKEMRKKIVQLFTGDKDNKDPVYEKLFKKELIEDLLPEAIKKDTSGIITQKEEALAKFHQFCTYFTNFHENRKTIYSAEDKSTAISNRIVNENFPKYVANIKVFEYLSKNFPKIIDDTENQLKNDLSGKKLKDIFTINGFNNVLSQKGIDFYNIIIGGIPEKEGIPRKQGINEAINLLRQGLPPERKNELKQRMTFLYKQILSDKEKVSFIPEVFNDSKEVYLAVQAFNAKCISSIIDKIADLYKQHNAYNLEKIFVPAKSLTAFSQSVYGNWSLLSECIFEKEKGEKTLSEKKLEDLTKKIAKNDYSLIDLQSAYDIWADKNNIEFNKRISINSYFNLNEIRQQKRPDGTYEKVVSNLIEDVKSTYIRIDFDNIKDLQQEKNASIPIKEYLDAVQNLFHYLKLVDYKGDALKDEMFYSSYDEYLQILSEIMSLYNKTRNFVTKKVGEIKKIKLNFDCSSLLSGWGTDYGSKAAHIFKSDSCFYLGIINKKLDKTDIDSIYQNGNTMIEKIVYDFQKPDNKNTPRLFIRSKGNAYAPAVSTYDLPIESVIDIYDKGLFKTEYREKNLEVYKKSLIKLIDYFKLGFSRHDSYKHYNFCWKETKDYADISEFYADTMRSCYQLKTERINFDNLMTLVDEGKLFLFQIYNKDFSTGKDGGNGSTGRKNMHTLYWENLFSKENLDDVVLQLSGGAELFFRPKSLEEENATIHEKNSFIVNRTYLKEVKGNKEIYETIPEEIYQEIYQKLNGKTDTISDEAQELLSSGKVKYRAAPHRIIKDRHFTQDTYLFHCPISLNFKAQEITGKKFNDRVLEKIKNNSEIKIIGLDRGERNLIYLSLINQKGEIELQKTLNLVEQQKRLIDYQGKLVQKEGDRDKARKNWQTIGNIKELKEGYLSAVVHEIATLMVDNNAIVVMEDLNFGFKRGRFAVERQVYQKFEHMFIDKLNYLVFKDRKVTEPGGVLNAYQLTDKLEAFKDLGKQSGFLFYVPAGYTSKIDPATGFANLLDMTNLTNVQKKRDFFAKFDSICFDEEKQMFAFTFDYKNFPGKGSQEMSRTKWTVYSNGERIQFCGKGKASKHIENLTEEFKTLFREFDYQNGNNILDSILEVGAALKAGEKPAKEIADFWDKLLVLFKLVLQMRNSDAKTGDDYIISPVMSESGNFFDSREQEKLGNNAKLPKDADANGAYHIALKGLYLLKAFDKTPEDQLKKVDMKISNADWFRFAQEKEYNK

SEQ ID NO: 246 - protein, 1334 aa, unidentified
  REGION 1..1334: note = Description of Unknown:uncultivated organism sequence
  REGION 1..1334: note = Category: MG31 effectors
  REGION 1..1334: note = Description: MG31-18 effector
MRTIDEFCGQKNGYSLSKTLRNKLIPVGKTEDKIKEYHLMENDYGRAEAYVEVKNLIDDFHRSFIAERLDKVSLDWTNLFNALNEYQKNQKDKLLKAKCKKVLEAQQKEMRKKIVQLFTGDKDNKDPVYEKLFKKELIEELLPEAIKEDTSGIITQKEEALAKFHQFCTYFTNFHENRKTIYSAEDKSTAISNRIVNENFPKYVANIKVFEYLSKNFPKIIDDTENQLKNDLSGKKLKDIFTVNGFNNVLSQKGIDFYNIIIGGIPEKEGIPRKQGINEAINLLRQGLPPERKNELKQRMTFLYKQILSDKEKVSFIPEVFNDSKEVYLAVQAFNAKCISSIIDKIADLYKQHNAYNLEKIFVPAKSLTAFSQSVYGNWSLLSECIFEKEKGEKTLSEKKLEDLTKKIAKNDYSLIDLQSAYDIWADKNNIEFNKRISINSYFNLNEIRQQKKPDGTYEKVVSNLIEDVKSTYIRIDFDNIKDLQQEKNASIPIKEYLDAVQNLFHYLKLVDYKGDALKDEMFYSSYDEYLQILSEIMSLYNKTRNFVTKKVGEIKKIKLNFDCSSLLSGWGTDYGSKAAHIFKSDSCFYLGIINKKLDKTDIDSIYQNGNTMIEKIVYDFQKPDNKNTPRLFIRSKGTAYAPAVSTYDLPIESVIDIYDKGLFKTEYREKNLEVYKKSLIKLIDYFKLGFSRHDSYKHYNFCWKETKDYADISEFYADTMRSCYQLKTERINFDNLMTLVDEGKLFLFQIYNKDFSTGKDGGNGSTGRKNMHTLYWENLFSKENLDDVVLQLSGGAELFFRPKSLEEENATIHEKNSFIVNRTYLKEVKGNKEIYETIPEEIYQEIYQKLNGKTDTISDEAQELLSSGKVKYRAAPHRIIKDRHFTQDTYLFHCPISLNFKAQEITGKKFNDRVLEKIKNNSEIKIIGLDRGERNLIYLSLINQKGEIELQKTLNLVEQQKRLIDYQGKLVQKEGDRDKARKNWQTIGNIKELKEGYLSAVVHELATLMVDNNAIVVMEDLNFGFKRGRFAVERQVYQKFEHMFIDKLNYLVFKDRKVTEPGGVLNAYQLTDKLEAFKDLGKQSGFLFYVPAGYTSKIDPATGFANLLDMTNLTNVQKKRDFFAKFDSICFDEEKQMFAFTFDYKNFPGKGSQEMSRTKWTVYSNGERIQFCGKGKASKHIENLTEEFKTLFREFDYQNGNNILDSILEVGAALKAGEKPAKEIADFWDKLLVLFKLVLQMRNSDAKTGDDYIISPVMSESGNFFDSREQEKLGNSAKLPKDADANGAYHIALKGLYLLKAFDKTPEDQLKKVDMKISNADWFRFAQEKEYNK

SEQ ID NO: 247 - protein, 1334 aa, unidentified
  REGION 1..1334: note = Description of Unknown:uncultivated organism sequence
  REGION 1..1334: note = Category: MG31 effectors
  REGION 1..1334: note = Description: MG31-19 effector
MRTIDEFCGQKNGYSLSKTLRNKLIPVGKTEDKIKEYHLMENDYGRAEAYVEVKNLIDDFHRSFIAERLDKVSLDWTNLFNALNEYQKNQKDKLLKAKCKKVLEAQQKEMRKKIVQLFTGDKDNKDPVYEKLFKKELIEELLPEAIKKDTSGIITQKEEALAKFHQFCTYFTNFHENRKTIYSAEDKSTAISNRIVNENFPKYVANIKVFEYLSKNFPKIIDDTENQLKNDLSGKKLKDIFTVNGFNNVLSQKGIDFYNIIIGGIPEKEGIPRKQGINEAINLLRQGLPPERKNELKQRMTFLYKQILSDKEKVSFIPEVFNDSKEVYLAVQVFNAKCISSIIDKIADLYKQHNAYNLEKIFVPAKSLTAFSQSVYGNWSLLSECIFEKEKGEKTLSEKKLEDLTKKIAKNDYSLIDLQSAYDIWADKNNIEFNKRISINSYFNLNEIRQQKRLDGTYEKVVSNLIEDVKSTYIRIDFDNIKDLQQEKNASIPIKEYLDAVQNLFHYLKLVDYKGDALKDEMFYSSYDEYLQILSEIMSLYNKTRNFVTKKVGEIKKIKLNFDCSSLLSGWGTDYGSKAAHIFKSDSCFYLGIINKKLDKTDIDSIYQNGNTMIEKIVYDFQKPDNKNTPRLFIRSKGNAYAPAVSTYDLPIESVIDIYDKGLFKTEYREKNLEVYKKSLIKLIDYFKLGFSRHDSYKHYNFCWKETKDYADISEFYADTMRSCYQLKTERINFDNLMTLVDEGKLFLFQIYNKDFSTGKDGGNGSTGRKNMHTLYWENLFSKENLDDVVLQLSGGAELFFRPKSLEEENATIHEKNSFIVNRTYLKEVKGNKEIYETIPEEIYQEIYQKLNGKTDTISDEAQELLSSGKVKYRAAPHRIIKDRHFTQDTYLFHCPISLNFKAQEITGKKFNDRVLEKIKNNSEIKIIGLDRGERNLIYLSLINQKGEIELQKTLNLVEQQKRLIDYQGKLVQKEGDRDKARKNWQTIGNIKELKEGYLSAVVHEIATLMVDNNAIVVMEDLNFGFKRGRFAVERQVYQKFEHMFIDKLNYLVFKDRKVTEPGGVLNAYQLTDKLEAFKDLGKQSGFLFYVPAGYTSKIDPATGFANLLDMTNLTNVQKKRDFFAKFDSICFDEEKQMFAFTFDYKNFNRKDAQEMSRTKWTVYSNGKRIQFCGKGKASKHIENLTEEFKTLFREFDYQNGNNILDSILEVGAALKAGEKPAKEIADFWDKLLVLFKLVLQIRNSDAKTGDDYIISPVMSEDGIFFDSREQEKLGNNAKLPKDADANGAYHIALKGLYLLKAFDKTPEDQLKKVDMKISNADWFRFAQEKEYNK

SEQ ID NO: 248 - protein, 1334 aa, unidentified
  REGION 1..1334: note = Description of Unknown:uncultivated organism sequence
  REGION 1..1334: note = Category: MG31 effectors
  REGION 1..1334: note = Description: MG31-21 effector
MRTIDEFCGQKNGYSLSKTLRNKLIPVGKTEDKIKEYHLMENDYGRAEAYVEVKNLIDDFHRSFIAERLDKVSLDWTNLFNALNEYQKNQKDKLLKAKCKKVLEAQQKEMRKKIVQLFTGDKDNKDPVYEKLFKKELIEELLPEAIKEDTSGIITQKEEALAKFHQFCTYFTNFHENRKTIYSAEDKSTAISNRIVNENFPKYVANIKVFEYLSKNFPKIIDDTENQLKNDLSGKKLKDIFTVNGFNNVLSQKGIDFYNIIIGGIPEKEGIPRKQGINEAINLLRQGLPPERKNELKQRMTFLYKQILSDKEKVSFIPEVFNDSKEVYLAVQAFNAKCISSIIDKIADLYKQHNAYNLEKIFVPAKSLTAFSQSVYGNWSLLSECIFEKEKGEKTLSEKKLEDLTKKIAKNDYSLIDLQSAYDIWADKNNIEFNKRISINSYFNLNEIRQQKKPDGTYEKVVSNLIEDVKSTYIRIDFDNIKDLQQEKNASIPIKEYLDAVQNLFHYLKLVDYKGDALKDEMFYSSYDEYLQILSEIMSLYNKTRNFVTKKVGEIKKIKLNFDCSSLLSGWGTDYGSKAAHIFKSDSCFYLGIINKKLDKTDIDSIYQNGNTMIEKIVYDFQKPDNKNTPRLFIRSKGNAYAPAVSTYDLPIESVIDIYDKGLFKTEYREKNLEVYKKSLIKLIDYFKLGFSRHDSYKHYNFCWKETKDYADISEFYADTMRSCYQLKTERINFDNLMTLVDEGKLFLFQIYNKDFSTGKDGGNGSTGRKNMHTLYWENLFSKENLDDVVLQLSGGAELFFRPKSLEEENATIHEKNSFIVNRTYLKEVKGNKEIYETIPEEIYQEIYQKLNGKTDTISDEAQELLSSGKVKYRAAPHRIIKDRHFTQDTYLFHCPISLNFKAQEITGKKFNDRVLEKIKNNSEIKIIGLDRGERNLIYLSLINQKGEIELQKTLNLVEQQKRLIDYQGKLVQKEGDRDKARKNWQTIGNIKELKEGYLSAVVHELATLMVDNNAIVVMEDLNFGFKRGRFAVERQVYQKFEHMFIDKLNYLVFKDRKVTEPGGVLNAYQLTDKLEAFKDLGKQSGFLFYVPAGYTSKIDPATGFANLLDMTNLTNVQKKRDFFAKFDSICFDEEKQMFAFTFDYKNFPRKGSQEMSRTKWTVYSNGKRIQFCGKGKAYKHIENLTEEFKTLFREFDYQNGNNILDSILEVGVDLKIGEKPTKEISDFWDKLLVLFKLVLQMRNSDAKTGDDYIISPVMAEDGFFFDSREQEKLGNSAKLPKDADANGAYHIALKGLYLLKAFDKTPEDQLKKVDMKISNADWFRFAQEKEYNK

SEQ ID NO: 249 - protein, 1332 aa, unidentified
  REGION 1..1332: note = Description of Unknown:uncultivated organism sequence
  REGION 1..1332: note = Category: MG31 effectors
  REGION 1..1332: note = Description: MG31-22 effector
MRTIDEFCGQKNGYSLSKTLRFELKPQGKTLENINKAGLVKVDEQRAKDYQDVKKLLDNYHKYFIDDILKNASEKDLDWKPLKDAVEEYQKDKTKDEQLKKEQDKMRSSIVKCFSADKKRFDHLTAATPYDLFKTELPEWLSKNSFPNLNNKAVETFKKFSTYFTGYQETRKNIYSAEAISTAVPFRIVHDNFPKFLQNLSIYKWINEKCPEVIKNAQNEIGSILAGKKLEDFFTLNSFNIFLTQTGANEQRGIDFYNQLIGGVKQQNIQIKGINQCINEYWQQHPEFAKENRRVKMVPLYKQILSDRSTLSFVIESIENDKELFDAVTKFNESITLIKDTETEKTSVLENISTLIKNISDFDANHVFVNAKDLAGISLVLFGKWDALQIRMNEFAKATFSTKQERSRWVKNLEENSTTKRKGVFSFAELDRVLAFSSEEINATEISIKDYFDTQYKKFFDAEKNEVVVTKEVTVLSVDDLLISIQSKWNSLQKVVNNSTTENQLKENTENVAILKDYLDCVNELFTRLKVLNVDKSEARDTSFYSVYDEVMETLSEIMPLYNKVRNYITKKSFDIGKYKLNFDNPTLASGWDLNKEDANTCVILEKDGNYYLGVMNAKNKPKFSAIQPDDSVPCYKKMVYKLLPGPNKMLPKVFFSTKGIATFNPPKEILEGYNAGKHKKGDTFDLNFCHKLIDYFKSAINQHPDWKNFNFKFSDTSTYKDTSDFYKEISEQGYKLSFVNVPVSIIDSWVDEGKLYLFQIYNKDFSPNSTGTPNMHTLYWRNLFSKENLDDVVLKLNGEAELFYRGVGIKNPVVHSVGSKVVNRTTKDGKTISEAIHDEIYKYVNRKIPELSQETKKLYENGLVVVKTIQKNHELIKDKHYTQEKFLFHVPITINYKASGNSYINENVRQFLKNNPDVNIIGLDRGERHLIYMSLIDQKGNIIQQKTFNTVERKKNGATVSVDYHEKLDQKEKERDAARKNWQTIGKIAELKEGYLSAVIHELVTLMIEHNAIIVMEDLNFGFKRGRFHVEKQVYQKFEHMLIDKLNYLVFKDRGLKESGGVLNGYQLAGIFESFQKLGKQSGFLFYVPAGYTSKIDPATGFANLLDMTNLTNVQKKRDFFAKFDSICFDEEKQMFAFTFDYKNFNRKDAQEMSRTKWTVYSNGKRIQFCGKGKASKHIENITEEFKTLFREFDYQNGNNILDSILEVGAALKAGEKPAKEIADFWDKLLVLFKLVLQMRNSDAKTGDDYIISPVMSEDGIFFDSREQEKLGNNAKLPKDADANGAYHIALKGLYLLKAFDKTPEDQLKKVDMKISNADWFRFAQEKEYSK

SEQ ID NO: 250 - protein, 1332 aa, unidentified
  REGION 1..1332: note = Description of Unknown:uncultivated organism sequence
  REGION 1..1332: note = Category: MG31 effectors
  REGION 1..1332: note = Description: MG31-23 effector
MRTIDEFCGQKNGYSLSKTLRFELKPQGKTLENINKAGLVKVDEQRAKDYQDVKKLLDNYHKYFIDDILKNASEKDLDWKPLKDAVEEYQKDKTKDEQLKKEQDKMRSSIVKCFSADKKRFDHLTAATPYDLFKTELPEWLSKNSFPNLNNKAVETFKKFSTYFTGYQETRKNIYSAEAISTAVPFRIVHDNFPKFLQNLSIYKWINEKCPEVIKNAQNEIGSILAGKKLEDFFTLNSFNIFLTQTGANEQRGIDFYNQLIGGVKQQNIQIKGINQCINEYWQQHPEFAKENRRVKMVPLYKQILSDRSTLSFVIESIENDKELFDAVTKFNESITLIKDTETEKTSVLENISTLIKNISDFDANHVFVNAKDLAGISLVLFGKWDALQIRMNEFAKATFSTKQERSRWVKNLEENSTTKRKGVFSFAELDRVLAFSSEEINATEISIKDYFDTQYKKFFDAEKNEVVVTKEVTVLSVDDLLISIQSKWNSLQKVVNNSTTENQLKENTENVAILKDYLDCVNELFTRLKVLNVDKSEARDTSFYSVYDEVMETLSEIMPLYNKVRNYITKKSFDIGKYKLNFDNPTLASGWDLNKEDANTCVILEKDGNYYLGVMNAKNKPKFSAIQPDDSVPCYKKMVYKLLPGPNKMLPKVFFSTKGIATFNPPKEILEGYNAGKHKKGDTFDLNFCHKLIDYFKSAINQHPDWKNFNFKFSDTSTYKDTSDFYKEISEQGYKLSFVNVPVSIIDSWVDEGKLYLFQIYNKDFSPNSTGTPNMHTLYWRNLFSKENLDDVVLKLNGEAELFYRGVGIKNPVVHSVGSKVVNRTTKDGKTIPEAIHDEIYKYVNRKIPELSQETKKLYENGLVVVKTIQKNHELIKDKHYTQEKFLFHVPITINYKASGNSYINENVRQFLKNNPDVNIIGLDRGERHLIYMSLIDQKGNIIQQKTFNTVERKKNGATVSVDYHEKLDQKEKERDAARKNWQTIGKIAELKEGYLSAVIHELVTLMIEHNAIIVMEDLNFGFKRGRFHVEKQVYQKFEHMLIDKLNYLVFKDRGLKESGGVLNGYQLAGIFESFQKLGKQSGFLFYVPAGYTSKIDPATGFANLLDMTNLTNVQKKRDFFAKFDSICFDEEKQMFAFTFDYKNFNRKDAQEMSRTKWTVYSNGKRIQFCGKGKASKHIENLTEEFKTLFREFDYQNGNNILDSILEVGAALKAGEKPAKEIADFWDKLLVLFKLVLQIRNSDAKTGDDYIISPVMSEDGIFFDSREQEKLGNNAKLPKDADANGAYHIALKGLYLLKVFDKTPEDQLKKVDMKISNADWFRFAQEKEYSK

SEQ ID NO: 251 - protein, 1332 aa, unidentified
  REGION 1..1332: note = Description of Unknown:uncultivated organism sequence
  REGION 1..1332: note = Category: MG31 effectors
  REGION 1..1332: note = Description: MG31-24 effector
MRTIDEFCGQKNGYSLSKTLRFELKPQGKTLENINKAGLVKVDEQRAKDYQDVKKLLDNYHKYFIDDILKNASEKDLDWKPLKDAVEEYQKDKTKDEQLKKEQDKMRSSIVKCFSADKKRFDHLTAATPYDLFKTELPEWLSKNSFPNLNNKAVETFKKFSTYFTGYQETRKNIYSAEAISTAVPFRIVHDNFPKFLQNLSIYKWINEKCPEVIKNAQNEIGSILAGKKLEDFFTLNSFNIFLTQTGANEQRGIDFYNQLIGGVKQQNIQIKGINQCINEYWQQHPEFAKENRRVKMVPLYKQILSDRSTLSFVIESIENDKELFDAVTKFNESITLIKDTETEKTSVLENISTLIKNISDFDANHVFVNAKDLAGISLVLFGKWDALQIRMNEFAKATFSTKQERSRWVKNLEENSTTKRKGVFSFAELDRVLAFSSEEINATEISIKDYFDTQYKKFFDAEKNEVVVTKEVTVLSVDDLLISIQSKWNSLQKVVNNSTTENQLKENTENVAILKDYLDCVNELFTRLKVLNVDKSEARDTSFYSVYDEVMETLSEIMPLYNKVRNYITKKSFDIGKYKLNFDNPTLASGWDLNKEDANTCVILEKDGNYYLGVMNAKNKPKFSAIQPDDSVPCYKKMVYKLLPGPNKMLPKVFFSTKGIATFNPPKEILEGYNAGKHKKGDTFDLNFCHKLIDYFKSAINQHPDWKNFNFKFSDTSTYKDTSDFYKEISEQGYKLSFVNVPVSIIDSWVDEGKLYLFQIYNKDFSPNSTGTPNMHTLYWRNLFSKENLDDVVLKLNGEAELFYRGVGIKNPVVHSVGSKVVNRTTKDGKTIPEAIHDEIYKYVNRKIPELSQETKKLYENGLVVVKTIQKNHELIKDKHYTQEKFLFHVPITINYKASGNSYINENVRQFLKNNPDVNIIGLDRGERHLIYMSLIDQKGNIIQQKTFNTVERKKNGATVSVDYHEKLDQKEKERDAARKNWQTIGKIAELKEGYLSAVIHELVTLMIEHNAIIVMEDLNFGFKRGRFHVEKQVYQKFEHMLIDKLDYLVFKDRGLKESGGVLNGYQLAGIFESFQKLGKQSGFLFYVPAGYTSKIDPATGFANLLDMTNLTNVQKKRDFFAKFDSICFDEEKQMFAFTFDYKNFNRKDAQEMSRTKWTVYSNGKRIQFCGKGKASKHIENLTEEFKTLFREFDYQNGNNILDSILEVGAALKAGEKPAKEIADFWDKLLVLFKLVLQIRNSDAKTGDDYIISPVMSEDGIFFDSREQEKLGNNAKLPKDADANGAYHIALKGLYLLKVFDKTPEDQLKKVDMKISNADWFRFAQEKEYSK

SEQ ID NO: 252 - protein, 1332 aa, unidentified
  REGION 1..1332: note = Description of Unknown:uncultivated organism sequence
  REGION 1..1332: note = Category: MG31 effectors
  REGION 1..1332: note = Description: MG31-25 effector
MRTIDEFCGQKNGYSLSKTLRFELKPQGKTLENINKAGLVKVDEQRAKDYQDVKKLLDNYHKYFIDDILKNASEKDLDWKPLKDAVEEYQKDKTKDEQLKKEQDKMRSSIVKCFSADKKRFDHLTAATPYDLFKTELPEWLSKNSFPNLNNKAVETFKKFSTYFTGYQETRKNIYSAEAISTAVPFRIVHDNFPKFLQNLSIYKWINEKCPEVIKNAQNEIGSILAGKKLEDFFTLNSFNIFLTQTGANEQRGIDFYNQLIGGVKQQNIQIKGINQCINEYWQQHPEFAKENRRVKMVPLYKQILSDRSTLSFVIESIENDKELFDAVTKFNESITLIKDTETEKTSVLENISTLIKNISDFDANHVFVNAKDLAGISLVLFGKWDALQIRMNEFAKATFSTKQERSRWVKNLEENSTTKRKGVFSFAELDRVLAFSSEEINATEISIKDYFDTQYKKFFDAEKNEVVVTKEVTVLSVDDLLISIQSKWNSLQKVVNNSTTENQLKENTENVAILKDYLDCVNELFTRLKVLNVDKSEARDTSFYSVYDEVMETLSEIMPLYNKVRNYITKKSFDIGKYKLNFDNPTLASGWDLNKEDANTCVILEKDGNYYLGVMNAKNKPKFSAIQPDDSVPCYKKMVYKLLPGPNKMLPKVFFSTKGIATFNPPKEILEGYNAGKHKKGDTFDLNFCHKLIDYFKSAINQHPDWKNFNFKFSDTSTYKDTSDFYKEISEQGYKLSFVNVPVSIIDSWVDEGKLYLFQIYNKDFSPNSTGTPNMHTLYWRNLFSKENLDDVVLKLNGEAELFYRGVGIKNPVVHSVGSKVVNRTTKDGKTIPEAIHDEIYKYVNRKIPELSQETKKLYENGLVVVKTIQKNHELIKDKHYTQEKFLFHVPITINYKASGNSYINENVRQFLKNNPDVNIIGLDRGERHLIYMSLIDQKGNIIQQKTFNTVERKKNGATVSVDYHEKLDQKEKERDAARKNWQTIGKIAELKEGYLSAVIHELVTLMIEHNAIIVMEDLNFGFKRGRFHVEKQVYQKFEHMLIDKLNYLVFKDRGLKESGGVLNGYQLAGIFESFQKLGKQSGFLFYVPAGYTSKIDPATGFANLLDMTNLTNVQKKRDFFAKFDSICFDEEKQMFAFTFDYKNFPGKGSQEMSRTKWTVYSNGKRIQFCGKGKASKHIENITEEFKTLFREFDYQNGNNILDSILEVGAALKAGEKPAKEIADFWDKLLVLFKLVLQMRNSDAKTGDDYIISPVMSESGNFFDSREQEKLGNSAKLPKDADANGAYHIALKGLYLLKAFDKTPEDQLKKVDMKISNADWFRFAQEKEYSK

SEQ ID NO: 253 - protein, 1332 aa, unidentified
  REGION 1..1332: note = Description of Unknown:uncultivated organism sequence
  REGION 1..1332: note = Category: MG31 effectors
  REGION 1..1332: note = Description: MG31-26 effector
MRTIDEFCGQKNGYSLSKTLRFELKPQGKTLENINKAGLVKVDEQRAKDYQDVKKLLDNYHKYFIDDILKNASEKDLDWKPLKDAVEEYQKDKTKDEQLKKEQDKMRSSIVKCFSADKKRFDHLTAATPYDLFKTELPEWLSKNSFPNLNNKAVETFKKFSTYFTGYQETRKNIYSAEAISTAVPFRIVHDNFPKFLQNLSIYKWINEKCPEVIKNAQNEIGSILAGKKLEDFFTLNSFNIFLTQTGANEQRGIDFYNQLIGGVKQQNIQIKGINQCINEYWQQHPEFAKENRRVKMVPLYKQILSDRSTLSFVIESIENDKELFDAVTKFNESITLIKDTETEKTSVLENISTLIKNISDFDANHVFVNAKDLAGISLVLFGKWDALQIRMNEFAKATFSTKQERSRWVKNLEENSTTKRKGVFSFAELDRVLAFSSEEINATEISIKDYFDTQYKKFFDAEKNEVVVTKEVTVLSVDDLLISIQSKWNSLQKVVNNSTTENQLKENTENVAILKDYLDCVNELFTRLKVLNVDKSEARDTSFYSVYDEVMETLSEIMPLYNKVRNYITKKSFDIGKYKLNFDNPTLASGWDLNKEDANTCVILEKDGNYYLGVMNAKNKPKFSAIQPDDSVPCYKKMVYKLLPGPNKMLPKVFFSTKGIATFNPPKEILEGYNAGKHKKGDTFDLNFCHKLIDYFKSAINQHPDWKNFNFKFSDTSTYKDTSDFYKEISEQGYKLSFVNVPVSIIDSWVDEGKLYLFQIYNKDFSPNSTGTPNMHTLYWRNLFSKENLDDVVLKLNGEAELFYRGVGIKNPVVHSVGSKVVNRTTKDGKTIPEAIHDEIYKYVNRKIPELSQETKKLYENGLVVVKTIQKNHELIKDKHYTQEKFLFHVPITINYKASGNSYINENVRQFLKNNPDVNIIGLDRGERHLIYMSLIDQKGNIIQQKTFNTVERKKNGATVSVDYHEKLDQKEKERDAARKNWQTIGKIAELKEGYLSAVIHELVTLMIEHNAIIVMEDLNFGFKRGRFHVEKQVYQKFEHMLIDKLNYLVFKDRGLKESGGVLNGYQLAGIFESFQKLGNQSGFLFYVPAGYTSKIDPATGFANLLDMTNLTNVQKKRDFFAKFDSICFDEEKQMFAFTFDYKNFNRKDAQEMSRTKWTVYSNGKRIQFCGKGKASKHIENITEEFKTLFREFDYQNGNNILDSILEVGAALKAGEKPAKEIADFWDKLLVLFKLVLQMRNSDAKTGDDYIISPVMSESGNFFDSREQEKLGNSAKLPKDADANGAYHIALKGLYLLKAFDKTPEDQLKKVDMKISNADWFRFAQEKEYNK

SEQ ID NO: 254 - protein, 1332 aa, unidentified
  REGION 1..1332: note = Description of Unknown:uncultivated organism sequence
  REGION 1..1332: note = Category: MG31 effectors
  REGION 1..1332: note = Description: MG31-27 effector
MRTIDEFCGQKNGYSLSKTLRFELKPQGKTLENINKAGLVKVDEQRAKDYQDVKKLLDNYHKYFIDDILKNASEKDLDWKPLKDAVEEYQKDKTKDEQLKKEQDKMRSSIVKCFSADKKRFDHLTAATPYDLLKTELPEWLSKNSFPNLNNKAVETFKKFSTYFTGYQETRKNIYSAVAISTAVPFRIVHDNFPKFLQNLSIYKWINEKCPEVIKNAQNEIGSILAGKKLEDFFTLNSFNIFLTQTGANEQRGIDFYNQLIGGVKQQNIQIKGINQCINEYWQQHPEFAKENRRVKMVPLYKQILSDRSTLSFVIESIENDKELFDAVTKFNESITLIKDTETEKTSVLENISTLIKNISDFDTNHVFVNAKDLAGISLVLFGKWDALQIRMNEFAKATFSTKQERSRWVKKLEENSTTKRKGVFSFAELDRVLAFSSEEINATGIRIKDYFDTQYKKFFDAEKNEIVVTKEVTVLSVDDLLISIQAKWNSLQKLINNSKNENQLKENEENVAILKDYLDCVNDLFTRLKVLNVDKSEARDTSFYSVYDEVMETLSEIMPLYNKARNYITKKTFDIGKYKLNFDNPTLASGWDLNKEDANTCVILEKDGSYYLGVMNAKNKPKFSAIQPDDSVPCYKKMVYKLLPGPNKMLPKVFFSTKGIATFNPSKEILEGYNAGKHKKGDTFDLNFCHKLIDYFKSAINQHPDWKNFNFKFSDTSTYKDTSDFYKEISEQGYKLSFVNVPVSIIDSWVDEGKLYLFQIYNKDFSPNSTGTPNMHTLYWRNLFSKENLDDVVLKLNGEAELFYRGVGIKNPVVHAVGSKVVNRTTKDGKTIPEAIHDEIYKYVNRKIPELSQDAKKLYENGLVVVKTIQKNHELIKDKHYTQEKFLFHVPITINYKASGNSYINENVRQFLKNNPDVNIIGLDRGERHLIYMSLIDQKGNIIQQKTFNTVERKKNGATVSVDYHEKLDQKEKERDAARKNWQTIGKIAELKEGYLSAVIHELVTLMIEHNAIIVMEDLNFGFKRGRFHVEKQVYQKFEHMLIDKLNYLVFKDRGLKESGGVLNGYQLAGVFESFQKLGKQSGFLFYVPAGYTSKIDPATGFANLLDMTNLTNVQKKRDFFAKFDSICFDEEKQMFAFTFDYKNFNRKDAQEMSRTKWTVYSNGKRIQFCGKGKASKHIENLTEEFKTLFREFDYQNGNNILDSILEVGAALKAGEKPAKEIADFWDKLLVLFKLVLQIRNSDAKTGDDYIISPVMSEDGIFFDSREQEKLGNNAKLPKDADANGAYHIALKGLYLLKAFDKTPEDQLKKVDMKISNADWFRFAQEKEYNK

SEQ ID NO: 255 - protein, 1332 aa, unidentified
  REGION 1..1332: note = Description of Unknown:uncultivated organism sequence
  REGION 1..1332: note = Category: MG31 effectors
  REGION 1..1332: note = Description: MG31-28 effector
MRTIDEFCGQKNGYSLSKTLRFELKPQGKTLENINKAGLVKVDEQRAKDYQDVKKLLDNYHKYFIDDILKNASEKDLDWKPLKDAVEEYQKDKTKDEQLKKEQDKMRSSIVKCFSADKKRFDHLTAATPYDLFKTELPEWLSKNSFPNLNNKAVETFKKFSTYFTGYQETRKNIYSAEAISTAVPFRIVHDNFPKFLQNLSIYKWINEKCPEVIKNAQNEIGSILAGKKLEDFFTLNSFNIFLTQTGANEQRGIDFYNQLIGGVKQQNIQIKGINQCINEYWQQHPEFAKENRRVKMVPLYKQILSDRSTLSFVIESIENDKELFDAVTKFNESITLIKDTETEKTSVLENISTLIKNISDFDANHVFVNAKDLAGISLVLFGKWDALQIRMNEFAKATFSTKQERSRWVKKLEENSTTKRKGVFSFAELDRVLAFSSEEINATEISIKDYFDTQYKKFFDAEKNEVVVTKEVTVLSVDDLLISIQSKWNSLQKVVNNSTTENQLKENTENVAILKDYLDCVNELFTRLKVLNVDKSEARDTSFYSVYDEVMETLSEIMPLYNKVRNYITKKSFDIGKYKLNFDNPTLASGWDLNKEDANTCVILEKDGNYYLGVMNAKNKPKFSAIQPDDSVPCYKKMVYKLLPGPNKMLPKVFFSTKGIATFNPPKEILEGYNAGKHKKGDTFDLNFCHKLIDYFKSAINQHPDWKNFNFKFSDTSTYKDTSDFYKEISEQGYKLSFVNVPVSIIDSWVDEGKLYLFQIYNKDFSPNSTGTPNMHTLYWRNLFSKENLDDVVLKLNGEAELFYRGVGIKNPVVHSVGSKVVNRTTKDGKTIPEAIHDEIYKYVNRKIPELSQETKKLYENGLVVVKTIQKNHELIKDKHYTQEKFLFHVPITINYKASGNSYINENVRQFLKNNPDVNIIGLDRGERHLIYMSLIDQKGNIIQQKTFNTVERKKNGATVSVDYHEKLDQKEKERDAARKNWQTIGKIAELKEGYLSAVIHELVTLMIEHNAIIVMEDLNSGFKRGRFHVEKQVYQKFEHMLIDKLNYLVFKDRGLKESGGVLNGYQLAGIFESFQKLGKQSGFLFYVPAGYTSKIDPATGFANLLDMTNLTNVQKKRDFFAKFDSICFDEEKQMFAFTFDYKNFNRKDAQEMSRTKWTVYSNGKRIQFCGKGKASKHIENLTEEFKTLFREFDYQNGNNILDSILEVGAALKAGEKPAKEIADFWDKLLVLFKLVLQIRNSDAKTGDDYIISPVMSEDGIFFDSREQEKLGNNAKLPKDADANGAYHIALKGLYLLKVFDKTPEDQLKKVDMKISNADWFRFAQEKEYSK

SEQ ID NO: 256 - protein, 1332 aa, unidentified
  REGION 1..1332: note = Description of Unknown:uncultivated organism sequence
  REGION 1..1332: note = Category: MG31 effectors
  REGION 1..1332: note = Description: MG31-29 effector
MRTIDEFCGQKNGYSLSKTLRFELKPQGKTLENINKAGLVKVDEQRAKDYQDVKKLLDNYHKYFIDDILKNASEKDLDWKPLKDAVEEYQKDKTKDEQLKKEQDKMRSSIVKCFSADKKRFDHLTAATPYDLFKTELPEWLSKNSFPNLNNKAVETFKKFSTYFTGYQETRKNIYSAEAISTAVPFRIVHDNFPKFLQNLSIYKWINEKCPEVIKNAQNEIGSILAGKKLEDFFTLNSFNIFLTQTGANEQRGIDFYNQLIGGVKQQNIQIKGINQCINEYWQQHPEFAKENRRVKMVPLYKQILSDRSTLSFVIESIENDKELFDAVTKFNESITLIKDTETEKTSVLENISTLIKNISDFDANHVFVNAKDLAGISLVLFGKWDALQIRMNEFAKATFSTKQERSRWVKNLEENSTTKRKGVFSFAELDRVLAFSSEEINATEISIKDYFDTQYKKFFDAEKNEVVVTKEVTVLSVDDLLISIQSKWNSLQKVVNNSTTENQLKENTENVAILKDYLDCVNELFTRLKVLNVDKSEARDTSFYSVYDEVMETLSEIMPLYNKVRNYITKKSFDIGKYKLNFDNPTLASGWDLNKEDANTCVILEKDGNYYLGVMNAKNKPKFSAIQPDDSVPCYKKMVYKLLPGPNKMLPKVFFSTKGIATFNPPKEILEGYNAGKHKKGDTFDLNFCHKLIDYFKSAINQHPDWKNFNFKFSDTSTYKDTSDFYKEISEQGYKLSFVNVPVSIIDSWVDEGKLYLFQIYNKDFSPNSTGTPNMHTLYWRNLFSKENLDDVVLKLNGEAELFYRGVGIKNPVVHSVGSKVVNRTTKDGKTIPEAIHDEIYKYVNRKIPELSQETKKLYENGLVVVKTIQKNHELIKDKHYTQEKFLFHVPITINYKASGNSYINENVRQFLKNNPDVNIIGLDRGERHLIYMSLIDQKGNIIQQKTFNTVERKKNGATVSVDYHEKLDQKEKERDAARKNWQTIGKIAELKEGYLSAVIHELVTLMIEHNAIIVMEDLNFGFKRGRFHVEKQVYQKFEHMLIDKLNYLVFKDRGLKESGGVLNGYQLAGIFESFQKLGKQSGFLFYVPAGYTSKIDPATGFANLLDMTNLTNVQKKRDFFAKFDSICFDEEKQMFAFTFDYKNFNRKDAQEMSRTKWTVYSNGKRIQFCGKGKAYKHIENLTEEFKTLFREFDYQNGNNILDSILEVGAALKAGEKPTKEIADFWDKLLVLFKLVLQMRNSDAKTGDDYIISPVMSESGNFFDSREQEKLGNSAKLPKDADANGAYHIALKGLYLLKAFDKTPEDQLKKVDMKISNADWFRFAQEKEYNK

SEQ ID NO: 257 - protein, 1332 aa, unidentified
  REGION 1..1332: note = Description of Unknown:uncultivated organism sequence
  REGION 1..1332: note = Category: MG31 effectors
  REGION 1..1332: note = Description: MG31-30 effector
MRTIDEFCGQKNGYSLSKTLRFELKPQGKTLENINKAGLVKVDEQRAKDYQDVKKLLDNYHKYFIDDILKNASEKDLDWKPLKDAVEEYQKDKTKDEQLKKEQDKMRSSIVKCFSADKKRFDHLTAATPYDLFKTELPEWLSKNSFPNLNNKAVETFKKFSTYFTGYQETRKNIYSAVAISTAVPFRIVHDNFPKFLQNLSIYKWINEKCPEVIKNAQNEIGSILAGKKLEDFFTLNSFNIFLTQTGANEQRGIDFYNQLIGGVKQQNIQIKGINQCINEYWQQHPEFAKENRRVKMVPLYKQILSDRSTLSFVIESIENDKELFDAVTKFNESITLIKDTETEKTSVLENISTLIKNISDFDTNHVFVNAKDLAGISLVLFGKWDALQIRMNEFAKATFSTKQERSRWVKKLEENSTTKRKGVFSFAELDRVLAFSSEEINATGIRIKDYFDTQYKKFFDAEKNEIVVTKEVTVLSVDDLLISIQAKWNSLQKLINNSKNENQLKENEENVAILKDYLDCVNDLFTRLKVLNVDKSEARDTSFYSVYDEVMETLSEIMPLYNKARNYITKKTFDIGKYKLNFDNPTLASGWDLNKEDANTCVILEKDGSYYLGVMNAKNKPKFSAIQPDDSVPCYKKMVYKLLPGPNKMLPKVFFSTKGIATFNPSKEILEGYNAGKHKKGDTFDLNFCHKLIDYFKSAINQHPDWKNFNFKFSDTSTYKDTSDFYKEISEQGYKLSFVNVPVSIIDSWVDEGKLYLFQIYNKDFSPNSTGTPNMHTLYWRNLFSKENLDDVVLKLNGEAELFYRGVGIKNPVVHAVGSKVVNRTTKDGKTIPEAIHDEIYKYVNRKIPELSQDAKKLYENGLVVVKTIQKNHELIKDKHYTQEKFLFHVPITINYKASGNSYINENVRQFLKNNPDVNIIGLDRGERHLIYMSLIDQKGNIIQQKTFNTVERKKNGATVSVDYHEKLDQKEKERDAARKNWQTIGKIAELKEGYLSAVIHELVTLMIEHNAIIVMEDLNFGFKRGRFHVEKQVYQKFEHMLIDKLNYLVFKDRGLKESGGVLNGYQLAGVFESFQKLGKQSGFLFYVPAGYTSKIDPATGFANLLDMTNLTNVQKKRDFFAKFDSICFDEEKQMFAFTFDYKNFNRKDAQEMSRTKWTVYSNGKRIQFCGKGKASKHIENLTEEFKTLFREFDYQNGNNILDSILEVGAALKAGEKPAKEIADFWDKLLVLFKLVLQIRNSDAKTGDDYIISPVMSEDGIFFDSREQEKLGNNAKLPKDADANGAYHIALKGLYLLKAFDKTPEDQLKKVDMKISNADWFRFAQEKEYNK

SEQ ID NO: 258 - protein, 1332 aa, unidentified
  REGION 1..1332: note = Description of Unknown:uncultivated organism sequence
  REGION 1..1332: note = Category: MG31 effectors
  REGION 1..1332: note = Description: MG31-31 effector
MRTIDEFCGQKNGYSLSKTLRFELKPQGKTLENINKAGLVKVDEQRAKDYQDVKKLLDNYHKYFIDDILKNASEKDLDWKPLKDAVEEYQKDKTKDEQLKKEQDKMRSSIVKCFSADKKRFDHLTAATPYDLFKTELPEWLSKNSFPNLNNKAVETFKKFSTYFTGYQETRKNIYSAEAISTAVPFRIVHDNFPKFLQNLSIYKWINEKCPEVIKNAQNEIGSILAGKKLEDFFTLNSFNIFLTQTGANEQRGIDFYNQLIGGVKQQNIQIKGINQCINEYWQQHPEFAKENRRVKMVPLYKQILSDRSTLSFVIESIENDKELFDAVTKFNESITLIKDTETEKTSVLENISTLIKNISDFDANHVFVNAKDLAGISLVLFGKWDALQIRMNEFAKATFSTKQERSRWVKNLEENSTTKRKGVFSFAELDRVLAFSSEEINATEISIKDYFDTQYKKFFDAEKNEVVVTKEVTVLSVDDLLISIQSKWNSLQKVVNNSTTENQLKENTENVAILKDYLDCVNELFTRLKVLNVDKSEARDTSFYSVYDEVMETLSEIMPLYNKVRNYITKKSFDIGKYKLNFDNPTLASGWDLNKEDANTCVILEKDGNYYLGVMNAKNKPKFSAIQPDDSVPCYKKMVYKLLPGPNKMLPKVFFSTKGIATFNPPKEILEGYNAGKHKKGDTFDLNFCHKLIDYFKSAINQHPDWKNFNFKFSDTSTYKDTSGFYKEISEQGYKLSFVNVPVSIIDSWVDEGKLYLFQIYNKDFSPNSTGTPNMHTLYWRNLFSKENLDDVVLKLNGEAELFYRGVGIKNPVVHSVGSKVVNRTTKDGKTIPEAIHDEIYKYVNRKIPELSQETKKLYENGLVVVKTIQKNHELIKDKHYTQEKFLFHVPITINYKASGNSYINENVRQFLKNNPDVNIIGLDRGERHLIYMSLIDQKGNIIQQKTFNTVERKKNGATVSVDYHEKLDQKEKERDAARKNWQTIGKIAELKEGYLSAVIHELVTLMIEHNAIIVMEDLNFGFKRGRFHVEKQVYQKFEHMLIDKLNYLVFKDRGLKESGGVLNGYQLAGIFESFQKLGKQSGFLFYVPAGYTSKIDPATGFANLLDMTNLTNVQKKRDFFAKFDSICFDEEKQMFAFTFDYKNFPGKGSQEMSRTKWTVYSNGERIQFCGKGKASKHIENLTEEFKTLFREFDYQNGNNILDSILEVGAALKAGEKPTKEIADFWDKLLVLFKLVLQMRNSDAKTGDDYIISPVMSESGNFFDSREQEKLGNNAKLPKDADANGAYHIALKGLYLLKAFDKTPEDQLKKVDMKISNADWFRFAQEKEYNK

SEQ ID NO: 259 - protein, 1332 aa, unidentified
  REGION 1..1332: note = Description of Unknown:uncultivated organism sequence
  REGION 1..1332: note = Category: MG31 effectors
  REGION 1..1332: note = Description: MG31-32 effector
MRTIDEFCGQKNGYSLSKTLRFELKPQGKTLENINKAGLVKVDEQRAKDYQDVKKLLDNYHKYFIDDILKNASEKDLDWKPLKDAVEEYQKDKTKDEQLKKEQDKMRSSIVKCFSADKKRFDHLTAATPYDLFKTELPEWLSKNSFPNLNNKAVETFKKFSTYFTGYQETRKNIYSAEAISTAVPFRIVHDNFPKFLQNLSIYKWINEKCPEVIKNAQNEIGSILAGKKLEDFFTLNSFNIFLTQTGANEQRGIDFYNQLIGGVKQQNIQIKGVNQCINEYWQQHPEFAKENRRVKMVPLYKQILSDRSTLSFVIESIENDKELFDAVTKFNESITLIKDTETEKTSVLENISTLIKNISDFDANHVFVNAKDLAGISLVLFGKWDALQIRMNEFAKATFSTKQERSRWVKNLEENSTTKRKGVFSFAELDRVLAFSSEEINATEISIKDYFDTQYKKFFDAEKNEVVVTKEVTVLSVDDLLISIQSKWNSLQKVVNNSTTENQLKENTENVAILKDYLDCVNELFTRLKVLNVDKSEARDTSFYSVYDEVMETLSEIMPLYNKVRNYITKKSFDIGKYKLNFDNPTLASGWDLNKEDANTCVILEKDGNYYLGVMNAKNKPKFSAIQPDDSVPCYKKMVYKLLPGPNKMLPKVFFSTKGIATFNPPKEILEGYNAGKHKKGDTFDLNFCHKLIDYFKSAINQHPDWKNFNFKFSDTSTYKDTSDFYKEISEQGYKLSFVNVPVSIIDSWVDEGKLYLFQIYNKDFSPNSTGTPNMHTLYWRNLFSKENLDDVVLKLNGEAELFYRGVGIKNPVVHSVGSKVVNRTTKDGKTIPEAIHDEIYKYVNRKIPELSQETKKLYENGLVVVKTIQKNHELIKDKHYTQEKFLFHVPITINYKASGNSYINENVRQFLKNNPDVNIIGLDRGERHLIYMSLIDQKGNIIQQKTFNTVERKKNGATVSVDYHEKLDQKEKERDAARKNWQTIGKIAELKEGYLSAVIHELVTLMIEHNAIIVMEDLNFGFKRGRFHVEKQVYQKFEHMLIDKLNYLVFKDRGLKESGGVLNGYQLAGIFESFQKLGKQSGFLFYVPAGYTSKIDPATGFANLLDMTNLTNVQKKRDFFAKFDSICFDEEKQMFAFTFDYKNFNRKDAQEMSRTKWTVYSNGERIQFCGKGKASKHIENITEEFKTLFREFDYQNGNNILDSILEVGAALKAGEKPAKEIADFWDKLLVLFKLVLQMRNSDAKTGDDYIISPVMSESGNFFDSREQEKLGNSAKLPKDADANGAYHIALKGLYLLKAFDKTPEDQLKKVDMKISNADWFRFAQEKEYNK

SEQ ID NO: 260 - protein, 1332 aa, unidentified
  REGION 1..1332: note = Description of Unknown:uncultivated organism sequence
  REGION 1..1332: note = Category: MG31 effectors
  REGION 1..1332: note = Description: MG31-33 effector
MRTIDEFCGQKNGYSLSKTLRFELKPQGKTLENINKAGLVKVDEQRAKDYQDVKKLLDNYHKYFIDDILKNASEKDLDWKPLKDAVEEYQKDKTKDEQLKKEQDKMRSSIVKCFSADKKRFDHLTAATPYDLFKTELPEWLSKNSFPNLNNKAVETFKKFSTYFTGYQETRKNIYSAEAISTAVPFRIVHDNFPKFLQNLSIYKWINEKCPEVIKNAQNEIGSILAGKKLEDFFTLNSFNIFLTQTGAKEQRGIDFYNQLIGGVKQQNIQIKGINQCINEYWQQHPEFAKENRRVKMVPLYKQILSDRSTLSFVIESIENDKELFDAVTKFNESITLIKDTETEKTSVLENISTLIKNISDFDANHVFVNAKDLAGISLVLFGKWDALQIRMNEFAKATFSTKQERSRWVKNLEENSTTKRKGVFSFAELDRVLAFSSEEINATEISIKDYFDTQYKKFFDAEKNEVVVTKEVTVLSVDDLLISIQSKWNSLQKVVNNSTTENQLKENTENVAILKDYLDCVNELFTRLKVLNVDKSEARDTSFYSVYDEVMETLSEIMPLYNKVRNYITKKSFDIGKYKLNFDNPTLASGWDLNKEDANTCVILEKDGNYYLGVMNAKNKPKFSAIQPDDSVPCYKKMVYKLLPGPNKMLPKVFFSTKGIATFNPPKEILEGYNAGKHKKGDTFDLNFCHKLIDYFKSAINQHPDWKNFNFKFSDTSTYKDTSDFYKEISEQGYKLSFVNVPVSIIDSWVDEGKLYLFQIYNKDFSPNSTGTPNMHTLYWRNLFSKENLDDVVLKLNGEAELFYRGVGIKNPVVHSVGSKVVNRTTKDGKTIPEAIHDEIYKYVNRKIPELSQETKKLYENGLVVVKTIQKNHELIKDKHYTQEKFLFHVPITINYKASGNSYINENVRQFLKNNPDVNIIGLDRGERHLIYMSLIDQKGNIIQQKTFNTVERKKNGATVSVDYHEKLDQKEKERDAARKNWQTIGKIAELKEGYLSAVIHELVTLMIEHNAIIVMEDLNFGFKRGRFHVEKQVYQKFEHMLIDKLNYLVFKDRGLKESGGVLNGYQLAGIFESFQKLGKQSGFLFYVPAGYTSKIDPATGFANLLDMTNLTNVQKKRDFFAKFDSICFDEEKQMFAFTFDYKNFNRKDAQEMSRTKWTVYSNGKRIQFCGKGKASKHIENLTEEFKTLFREFDYQNGNNILDSILEVGAALKAGEKPAKEIADFWDKLLVLFKLVLQIRNSDAKTGDDYIISPVMSEDGIFFDSREQEKLGNNAKLPKDADANGAYHIALKGLYLLKAFDKTPEDQLKKVDMKISNADWFRFAQEKEYNK

SEQ ID NO: 261 - protein, 1294 aa, unidentified
  REGION 1..1294: note = Description of Unknown:uncultivated organism sequence
  REGION 1..1294: note = Category: MG32 effectors
  REGION 1..1294: note = Description: MG32-1 effector
MTIFDSFTGLYKLSKTLRFELKPVGKTVEFLKEHNGLLGDFKRAEDYPKVKAILDEAHKDLIERALTGVELDWQPLADALEESRIGEKNTNLKDVQKKFREKIATLLSEDKGYEKLTDPTPRNFIQEKLKLTSNNLITPLKTFEKFACYFKGFQENRKNVYSSEEIVTAVPYRVVNDNFPKYYSNVKVFESLQAKYPGIIKAVEDNLKDYLNGCKLSSIFTLNNYSSCLTQSGISFINTIIGGYSVKDAPKIRGVNEEVNQYLQKHPELLREERPPRMTLLFKQILSDRETQSFVMTQFQNDTEAIAAIDAFAELLKEEKVLSFVVELLSTISSTTQNIYVAGSELAKISMRLSGYWGLIRDAQESCIETILAMTKVTKAKEKELREALEANVFALTDLLALDLTLVDEEDNEKKYSLLDYWSRENCDSVIQKVKDTETAYNTLKARVTTSNWLHESHDNVEIVKAYLDALQELLHYLKPLRVSNEINKNQGFYAEFDALYDTLELIIPLYNRVRNYLTRKVGDAQKVRLYFDLTTRTEGWMESKIKERKTVLFERDGAYYLGFIPSKNRLPAFNKFIPQGGDATYRRMVYKQIGNVSNYLSIKQMKPTLLRQISLASSDEKREYYTNILKWLGGEYDADKKVWKNGKFDKHTLSALELAQLISYVINEFIPNYDNLRGYKFKFNAPESYPNWKSFTDHVQMMGCYSINFEEVSKCKIDDLVERGDLYLFQLWNKDFSENSTGLPNLHTLYWRSLFAPENLQQAILQLNGGAELFYRFAPLQKPQTIHKKGTKLVNRHTCDGKLIPEVYYQEIYKWANGKLPEGLSATAKDWMAHATIKDAKHQITKDRRYTEDKYFFHVPITFNFTIANKSKSLNSLIQDATRNNPDVNIIGLDRGERNLLYLTLINQKGEILQQKSFNVVEHVNSEGKTIETNYHDKLKDRERDRDRARKSWDTIGKIKDLKEGYLSAVIHEIVTLMLEHNAIIVLEDLNSDFKRGRFCVERQVYQKFEKMLIDKLNYLSLKTRAITVPGGILKGYQLTEKFESFQKLGKQSGILFYVPAAYTSKIDPTTGFTNLFKLKKCTNAANRKVFFELFDEIRYDEKRKAFAFTFDYDKFKTSQTSYQKKWTVYSAETRLTYQREKDGNGREIIIRPTTLITDAVKLLGIEVKDGLNLLEVIQKTPAEPRTAKFYGDLFYAFERTLQMRNSSSETGDDYIESPVENTDGIRFDTREEAKKGKDAKLPIDADANGAYHIALKGLWYLKNDFNRDKDGKIQKITHAQWLKFMQAKEWLK

SEQ ID NO: 262 - protein, 1460 aa, unidentified
  REGION 1..1460: note = Description of Unknown:uncultivated organism sequence
  REGION 1..1460: note = Category: MG37 effectors
  REGION 1..1460: note = Description: MG37-1 effector
MASTNQSAVPTTQRAYMLRLHPARPFGNHEWKREAADMQAALWATHEAVNRGAKTFGEWLLTLRGGLSYRLADEPITEATGRSERTPTDRARRNRRILLALSWFSVEDESGAPVNSDVIVAYGDGCKLRQEAQQERNRKLIEALGSVLHAQGVPPSEIGELQAPGTWLGDCAQSLSSAIRPDAVWVNRSEVFSQLCTELPGLDADYAAVTTFSFFGGSEKYFYVDDGAAEENEAGEAGEEAADFRQKARQWISTNFGTGKKSDNARISAALKSLAGGNLDEFSGRSKADLVKYCVGLLGIDPSNATEDALRVAVGWNTGRPSKGRLAIQNLPDLLTKDGIGVFRRKIMEEADEKSKNASAKNVPAWIANMRAKIEAGIGIPYVTDRNLIGEYSVMLDHAARRVSIAQTWTKRAEAERRRFSDDSERMHDVPHAARSWLDRFSETRSSDTGAVGEYRIRPRALQGWELVVQRWSKSNCRTEEDRIAAVREIQADWEDNKKIGDIPLFEALATDDARCVWSPDGSSDPDILKRYVAASHARAKQAAFKVPAYRHPHPLSHPVFCDFGNSRWKIRFAVHEREYARRNGKGTVNKPGDAQGLQMGLWNGNGVQPHEMRWASKRLSVDLALDDLAVSDAVPVTLGSRFGRAALPSVLPVSVLNVFDEGDWNGRLQVPRSQLERIASLLAKNKVAAAKEFRQKLRWSLTFSPRLQPTGPFHDFAAQHGITPNRKGEYFPNGEQNRITKREGKAKLVLSRLPGLRLLSVDLGHRFAAACAVWESLSGPDFAKEIFGLTIESGSAEGLYLHTRHMDESGKERSTIYRRIGSDALPDGSDHPAPWARLSRQFLIKLQGEERSARKAAPTEIYSVRELEAGFGRVSEKDDLPTQVDELMSHTIRVSRLALRRHGDRARIAFAMISSYKPMPGDRKYNFFPNDTSDGFDDTPEQRHRKHIEFIQDALLLWHDLISSKGWQDQAAEQLWKQHIATLLGYQHPEPINRDGSGPERKKKRNENFDRLRGAAEALINNAPLRLTLNAEWKGRWESDDQDWRSHLRRLQDWARPPASKGSQAIRHVGGLSLTRLATLTELRRKVQVGFFTRLLPNGDKARIGERFGQKTLGVIEEMREQRVKQLASRITEAALGIGRVQPGTKHDPRRPRVRVDLPCHAIVIESLRNYRPDDLQTRRENRALMEWSSGKVRKYLEEACYLYGLHLREVPPNYTSRQCSRTGLPGIRCADVPIEQFRAAPFWRKIVDSARKRISQNKGTEEDRFFCDLDETYGNDVNPQAGRVATLRLPRKGGDLFVSAPVWAQLNRKDQYGNDRVSARPNDWSSKRALQADLNAAANIGLRALLDPDFPGTWWYVPCTARDGRATQDKVKGSSCFVAENWRILSVSERSATKREVVNAWHDPSTCSLSNRLDWRETTHYWNTVRARAVEALRQFNGLPRSNSAPVHNSLESALRER

SEQ ID NO: 263 - protein, 804 aa, unidentified
  REGION 1..804: note = Description of Unknown:uncultivated organism sequence
  REGION 1..804: note = Category: MG37 effectors
  REGION 1..804: note = Description: MG37-2 effector
LAELDLFNGRTIKAVRLRWQSKRLTNDLALHQTAVIDDATPVSRANRLGRAAAGAGSRSAVRILGVFDHKHWNGRLQAPRAQLHKLAKIRDNATVPEPARRQKYERGLSTIRWILTFSPRLQQKGPWLEYAAAQNLSAKSPHFAENRGRGWLAQHLLGRLDGLRILSVDLGQRYAAACAVWEAMSGDQVRATCASAGAPEPDKSALSIRVSVGGRRTILRRVGEDAWARLDRCFVIRLAGEDVPARKASPAEIQAVQTLCRELGYSDASRAAAAVDKLMSYALRVLRLGLQRHARRAMVVFGLAAKEKVVLGNQLRALSEDERTDSIGTALADWWTFAVSSRWPDPHAAALWDEHIADRAAGIELPPDLESFSFRERLLVREKLLKDVRPIAQALRPEEVEQLTEIWRLQWLGEEARWCKRLRWIKDWLLPRGSGAQCNSIRRVGGLSLRRLNNLRALYRLEKSFAGRLRVGVGGHRCESQVPSEEFGRKTLTALERLRENRVKQTASRIVAAALGLGKDLKRGHGERFAPCHAVVIENLTNYRPDEVRSRRENRQLMDWCAAKVKKYLNESCDLHGILLREVQAAYTSRQDSLSGAPGVRCADVPIRDFMACGGYWERELRRADKANSSGRSDARSRYLIALRDRISAAIPYPAAAATKGAVRIPVDGGPVFVSADPQSPAAHGTQADMNAAANIGLRALLDPDWAGRWWYVPCNASTGVPVADGLKGSALIQPNLTLFSSHNGAEKKPKRQVVNLWRDVSARPLNVGIWRTYAQYRASVMERVTAILLTGLQTLGDDVDLPF

SEQ ID NO: 264 - protein, 1484 aa, unidentified
  REGION 1..1484: note = Description of Unknown:uncultivated organism sequence
  REGION 1..1484: note = Category: MG37 effectors
  REGION 1..1484: note = Description: MG37-3 effector
MPDEALVNGSTAGTDLMVVTQRAYTLRLQGVDPQDHSWRDALWKTHEAVNKGAWAFGDWLLTLRGGLDHSLADAKVKGGKGNPDRDPTDEERKARRILLALSWLSVESKKGAPEKYRLDKQSSARSNLNPEEALREILKGRGLGKSEIESWVQDCSASLSAPIRDDAVWVNRSKAFDDAVKSVGCSLTRDEAWDMLERFFGSRDAYLAPAKGSEDESSETEQEDKAKDLVQKAGQWLSSRFGTGKGADFSRMAKIYEEIANRAGKAQPGMTGDKAIADLATALSKFSPTSNDLQGVLGLISGPGYKSATRKLLKRFRDKTPVTQEDFQNLQDKAREDAQKCKNKTGSKGHRPYADAVLRDVESVCGFTYLQDGGSARHSEFAVMLDHAARRVSLAHTWIKRAEAERSRFQEDAKKVDQVPEAAKKWLNNFCLERSRAAGALEPYRIRRRAVDGWKEVVAAWSKPDCKTTEDRIAAARALQDDPEIDKFGDIQLFEALAEDDAVCIWHKDDDPANPPDPQPLLDYVAATDAEFKKRHFKVPMYRHPDELLHPVFCDFGNSRWNICFDVHKNTKTPFPRTLCLTLWTGSEGMKPVPLRWQSKRLARDLAFGQDTRKDGASDVTRADRLGRAASNVGKNDAVNIAGLFEEKHWNGRLQAPRRQLEAIARYVEKHGWNEKAKNIRDAIQWSVTFSAKLQPNGPWCAYAKEHGLRKDPQYWPHTEVNKDRKGHARLILSRLPGLRVLSVDLGHRYAAACAVWEAISTRQFQQNIEDKKILRGGTDAESLYCHTEHTTDGKKHTTIYRRIGADTLPDGKPHPAPWARLDRQFLIKLQGEAEGAREASNEEIWAVHKMETVLGRSVPLIDRLVAAGWGSTEKQKARLDAIKKLGWVPIKRADASEDADTEEEEELAFRPSLSVDDLMSSAVRTMRLALKRHGDRARIAFAMTAAYKPMPGDRRYYFTESKDLSATEDATARNSKHIEFIQDALLLWYGLISSRGWRDEAARQLWDDHVAKLHGYKAPEEIGEDVSGAEREKKQKENREKLYDVGKALAQNESLRKTLHHAWKTRWEEDDGRWKKQLRWFKDWILPRGKYASDPSIRKVGGLSLTRLATLTEFRRKVQVGFFTRLKPYGTRAETKEQFGQSTLDALEHLREQRVKQLASRIVEAALGIGSENKQHWEGGKRPRARSKDPRFAPCYAVVIEDLTHYRPEETRTRRENRQLMSWSSSKVKKYLAEACQLHGLHLREVSAGYTSRQDSRTGAPGIRCHDVPVKEFMRSPFWRKQVAQAEKKQDEGKGDARERFLCVLNAKWKGQPEADWEKAGAVRVPLKGGEIFVSADQNSPAAKGLHADLNAAANIGLRVLTDPDWPGKWWYVPCDPVSFLPVKDKVEGSAVVKPDQPLPKSAQAQSGDGAKDKKKPGKRGASKSKESKKVVNLWCDISSSPLECREEWKEYAAYQNEVQSRVIHILEKQIKRLRQATARGVQ

SEQ ID NO: 265 - protein, 1500 aa, unidentified
  REGION 1..1500: note = Description of Unknown:uncultivated organism sequence
  REGION 1..1500: note = Category: MG37 effectors
  REGION 1..1500: note = Description: MG37-4 effector
MATAINYPTTQRAYTLRLRGIDPQDQSWRDALWATHEAVNRGAKVFGEWLLTLRGGLDHQLADAPVKVRGGTTRLPSDEERRDRRVLLALSWLSVEDAHGAPPDASLIVAKGTDSADCRARKLADALIAILQARSVAASEIGDPSKPPEDQPGTWLGDCMGSLSAAIRDDAVWVNRSKAFDAATQSCPSLTRDEIWDFLEPFFASPDAYLKPERAESDEGDSTSAATEDKAKDLVQKAGGWLSKRMGAGGGANFQDLARAYQAIAQWASSAQPGQSAQQAVGSLAGYLSQHGFSPTANDATGVLAVISGPGYKSATRNHITAIATSPEITPQDLSKLQELATKDKAGCSSKIGGKGPRPYATMILQQVEAACGFTYLQSDGPARHREFSVMLDHAARRVNVAHSWIKNAEAERRQFESDARRIKKVPQDALNWLRGYCEERGGASGSLEGYRIRRRAIDGWDQVVIRWSRSDCQSADDRIAAARQLQDDPEIDKFGDIQLFEALAAEEALCVWKPDGNPTAQPLKDFVAATEADAKKKRFKVPAYRHPDPLRHPVFTDFGNSRWGIEYSAHRAPAKCDELGQQVDRLTQAVAEAQRNLDGATAAQRASRESKLAEAQSKLVAAQTEFAAINDPHRVELKLWNGQAVAAIPMRWSSKRLIADLSLRRATQPSSDQRIGVTRADRLGRAAGNADDGRPVTITGLFQQDHWNGRLQAPRAQLDAIAKHVDKHGWDAKARRQIARIRWVVSFSAELSQQGPWFEFCHRFGEDAPARPFVSRHGEYAVKHRDNDQRKGHAKLILSRLPGLRVLAVDLGHRYAAACAVWEAISSDQMRQACAAANAPAPHPLAMYIHLKSTTAKGKPTTTIYRRIGPDKLPDDTPHPAPWARLDRQFLIKLPGEDRPARAASPDEIKAVEDFEDSVGRVRTAVDPPRKRGVDLLMHDAVRTARLALARHGRRARIAFQLISQVRILPGGRPQTLDDAGRRDLLNDTLADWYALATDSRWTDAAARQLWNERLAALNGGFTIDPPADASQPEAERTRAQRRQAEQELRHRLASLVEALFCNPTLCQQLHQAWTDRWNADDQQWRSRLKWLSRWLLPRGGSRRDGSRRHVGGLSLTRISTLIDFRRKVQVGYFTRLRPDGSRAEIGPQFGQSTLDAIQRLKDQRIKQLTSRIVEAALGIGVEQDRIWDAAKRKWRTVKRPREPRYHVDDQGVQQRDPRFQACHAVVIEDLSHYRPEETRTRRENRATMDWKSAETRKRLADHCQLYGLHLRDVNPQYTSRQDSRTGAPGCRCVDVSVADFLTKPAWRKQVAQARGKVASNRGDARDRLLVELDHQLTTANSLRGEMDSLRIPVNGGEVFVSADPRSPLAAGIQADLNAAANIGLRALMDPDFLGTWWYVPCDPSTKKPHIEKVKGSILATVGALQATSEEAAAPPRRGRGGTRSAAPREVINLWRDPSAVRIQDATAGEVWDVTPVYWSIVKDRVVDVLRQRNTKSGD

SEQ ID NO: 266 - protein, 1427 aa, unidentified
  REGION 1..1427: note = Description of Unknown:uncultivated organism sequence
  REGION 1..1427: note = Category: MG37 effectors
  REGION 1..1427: note = Description: MG37-5 effector
MTQHAYTLKLRSLYEQRSTNDEKTIVLKAKDAKHLWQTHLLINRGAQVFGDWLLTMRGGLSPSLADELIMEGKGTNKRNREPTEQEKADRHILLALSWLSVESYEGAPDKYVIASAVDDKDKRSKALITALEKVLKRQKITTNDINIWRRDCEDVFSSAIRDDAVWVNRADAFNDLSAEINWDYNDASSLLFHFIKQKDYFNLESKDNDKNNTIKDKESFGQVARGWLSANWGKGKKSDFSEIINKLQKIVNYDFNSLYKKSGYKIISVITQHLTTKKDSDNKETFKKLCKYIGWQGRSSKGRLALEKLYNKKSVTKKDIVYLNEKLQQEIKEKKSKNRVIPKWVAKIQKYLEEKINIKYQPLDMSRNLIGEFGVMFDHALRHVSVAHSWIKNAEINRRRFHEDAQKIDNVTKDAKEWLNEYTHEKQEFTGALGKYIINPRAIDGWKDILKGWKGCSNYEERVEVINTIQTNKNDADKHFGDANLFKRLAKDDTRAVWINNDNKFDETILKNYVDAKKASYDMQRFKVPAYRHPHPLLHPVYCDYGNSRLNVKYDAFDIINYVLNNKKIKGAEKVINKLSISLWDGTSFQNIPFFWGGKRFKTDLALDNINNLYSSNKHLSLKNSIETTKADRFGRSLVTADSIRLEIYNKGEWNARLQVDRRLLENINKKLKASNINCYSDIFSIKTSNAMKIQQLVYKLPWFLTTSPELQSAHTLKLGPWADYINSCKDKSPFLRNNKISYIGWPHYNKNKKRNKKGSMILSHLPNLRVLSVDLGHRYGATCVVWETISNKDIINLCKKHNVNQPKVDTIYHVIKTDKKIKIHFRRIAGNTLPDGLPHPASWARLERQFMIKLQGEDRSSRKIFNNEKQIAKQVAEFCGNLHDEKAFFNNNKNIEQLMSATVSILLDGIRRHNDIAKIAYYLSPERGRNPGDESLKKGLENALQLWHQLWNSKHYKHEFAKETWDKYIISFFSNKERQELTSIGDNKNKTCRKKQKAIFKNIAQKLSADDRMMMYKAWDNYWHERDGHGDKGKTKLCRQCIRLVRDWIMPRRDSDYVFSKQFRNVGGLSLTRINTFKKLYRVIKAYAGRPEPENIKINIAEKGDTSSKGMGDRILKAMENMRDTRIKQLASRIVEAALGLGKEQGKKDKNTKDISRPRENIFKPCHALIIENLKNYRPDELQTRRENRQLMTWSSHRIFDFLKDECDLFGIHLRTVSPSYTSRQDSRTGAPGIRCTDIPLTNFLKENSYWQQQVKKADEKKLKDDYSSFIVNAYSILIKKYGHTPPKDKWIRLPRRGGEIFVTADNNSPIAKGIHADINAAANIGLRALLDPDWAGSWWYVPCNKDGTPKSTEIKGSTIFKEINKLPLQGDIGGKGDIVNLWSDVSSSNLENKVWKYSTNYKSNVRKRVIERLMQQSILKKDQND

SEQ ID NO: 267 - protein, 1338 aa, unidentified
  REGION 1..1338: note = Description of Unknown:uncultivated organism sequence
  REGION 1..1338: note = Category: MG37 effectors
  REGION 1..1338: note = Description: MG37-6 effector
MAKETTTQRSYTVSLCKPELGAKAWKALAATHIGMAKGAKACGDMLLNMAAGIAPCAIEELGFSGAEAVRNARRMLTLTWFDVESEDGSPQEFVVPVEELPQKLRDHLISAGLDREEADSWLEDCQDVFATPIREDSCWIDRRSSFEAMEARLGVDISQSDIEDFCFGQFAILGSLKDYLIIPDYESLQPDGISDAPSKIQAARNMLSSRLGAGIGSDTAAMADAYDLINRALEGLSSGEHCPKNEFRRVIELELDDSMPDISFEEFVNSKIKGIGRPTATAQRMEAALACREFIPWSQIEALMEKSADDARKQRAKVGLKGRRPYFDAIMGDLEKKTGIPYPAEGNQTPARNWYSCLFDHAARGVSAHHTWVKRAESTRNATYANNEAFETLPDEARAFLSKYEKERSLSLGAVEPYVIRRKAITGWTKDHVKQLHNAKSAEERVEILKEAQSQGDMGDMTLLIDLVRDDALCAWHDVEGKPAEKILEVWAKHQELERERLHFKTPSYRHPDHLLHPVFADFGKSRPEATYTFGESLEQRTVTLMLVDGGGFSRFTFHWNSKRLMDDFDFSALEKEGKAAACAMTTRFGNSLEEERKPRLLLTKAAKKPIVSDVGTRLQLTRASLERCAKRQNDAMKNPDELDWFLSLALNIKPAPFTPKALIAQAKERKDENKARTSALSKLRYSRIHGLTFIGVDLGHRKAASCSVWKTCSAEEIEQLCIEAGHELPDKNTLHLTLDCIDRRINARRIGADTLPSSEQHPAPWAVLQREFAIELPGAKEEEQRAATKNELSFLANPYAISVETRSAKAKKSAYRTTSEAQYAAVEAIRRDVKQHASMASFIHLIRSKKITKPGGAEMLLSDDELVKTVEKRLEKELGNKYAKPAPWVENLPRSNDPSTCAHILCTEKEYVDALEKQWEEDDENIRIALRILRNWIFKGIEPYSDSRTACKGVGGLSLNRIATMQMAYQLVRSFSMRPFPTDTRRGIAMAERGELAELGRRMSAHINTMREQLAKHVASRIVEAALGLGGSQNTSEKRNVRTPGDRFQPCDLVVIESLTNYRPEQTRSRAENRRIMQWASARVGEMLRDECEIYGIALYETPAAYTSRQDSRTGLPGFRFKEVPVAAFVNGGSYHGVNIDRALSSDCENERRFYGELLKRWNKGKGEWDEPLRPEKTVWTLKRGAWVSKNGMLLKKGMAPQPIPIVANGSELFMASTDEGVLKIQADINAAGNIALRGVTDPDWAGSWWRVNIQAKSGMVEKRHRGSLAFDGTAIDPEGKAPHEGVIGAWSTVGATPLSDEKRKWSTYQKYWDDQRSKIFARLCRRYGIPPAIEEE

SEQ ID NO: 268 - protein, 1397 aa, unidentified
  REGION 1..1397: note = Description of Unknown:uncultivated organism sequence
  REGION 1..1397: note = Category: MG37 effectors
  REGION 1..1397: note = Description: MG37-7 effector
MAVKTTQRAYTLRLTGTDRNDQTWRENLWRTHEVVNKGAKAFGDWLLTLRGGLSHKLAEPEPDAKLPKGYTRDDLRRDRRILLALSWLSVESKVGAPERLIVAEADDPQRKEKVVKALERILNQRRCSPADAASWVANCRDSLSAAIREDAVWVNRKEAFDDLAGNWNGLTDDDALMTLSGFFGEASEYLCLPEGDSDSAGADGEHFSNLARAWLSSNWGTGTKSDKTQIAHALDVLAKANLSRLVGRAGTELAAALVGLLGKKLEDDQDPWEVLRLLIGWSTGRSSKGRMAIEKASSVSALAPEDLTRLQTKLGEEAASKLGKAGVSSPTWSADLRREIESVTQMQFVTGRNLIGEYATMLDHAARRVSQTHSWVKLAEARRQTFTAETARLGAVPRDIRDWLDAFCERRSMESGALAGYRIRRRAVDGWDEVVRAWSKSGNRTEADRVKAARGVEADPEMDKFGDIQLFEALADDEAKCVWLRDGKPDSGPLKDYVRAKDAEDRMRRYKVPAYRHPDPLLHPVFCDFGCSRWTISFGVHDSVRELDGLREALAKLAGSTEEMAEARRLKAKKAIAEARETLMKPEVLHGLSMGLWDGSAITPIGLKWQSKRLPGDLALADAGSTELTWLSRADRLGRAAGAVSSKDSAGIIGLFDQKEWNGRLQAPRVQLEAVARCKDTAKRARLRYRLEWLVTLSAELQPQGPWCDYAKAHDIKDDPKYWPHSDENKKRQGHAKLILSRLPSLRVLSVDLGHRYAATCAVWEALSEKEVRKVCSAAGQAAPKPDDTWLRLKTGQRTAVYRRTSADTWAHLDRQFTIKLQGENAPARMASPMEMKLVQELEKALGRTRSNENPFPQQVDELMSEAVFILRRGLRCHGDRARIAFNLTTDKRLLSGGRQEKLDKPGRVTLLQETLASWRNLADDNAWQDGCAKQWWDDFVAPLAADATLPATPAEDALLPTIKAYRRKLTDSLKSVAEVLSGNPQLRQKLHVLWATRWRADDAGLRVHLHEVHRWILPRGKGRADATIRHAGGLSLRRLATIRGIWQLQKAYSMRPDPDDLRKNVPKAGVTNEEFGRRTLDSFERLRENRVKQLASRIVEATLGIGREQSKVNCKDPKRPRERVYATCHAVVVEDLDNYRPDEVRTRRENRQLMQWSAAKVRDYLAESCQLHGLHLRKVYAGYTSRQDSRTGRPGVRCSDVPVPDFLRRIKPRIVDLRKKGDSESRFLAAAYDFWSGKPHTKGETVRIPQRGGDIFVSADPNSPAAKGLQADLNAAANIGLKALLDPDWPGKWWYVPCDAKTHIPVPEKVKGGAADIPDALAPVSSGDDDGKKRKRKTASGDITNFWRDPAATAVAQDGWVETPEYWSRVKDQVIRILMRQLSGKELAGIPYEPRL

SEQ ID NO: 269 - protein, 1148 aa, unidentified
  REGION 1..1148: note = Description of Unknown:uncultivated organism sequence
  REGION 1..1148: note = Category: MG37 effectors
  REGION 1..1148: note = Description: MG37-8 effector
DERGAPNGKGLRVATGRDTGDQRREAVEAALREILEKRGVNEEEIRAWLRDCGPSVEARIRDDAVWVNRSAVFDEVANGWDTANARGDAHTLLSFILGDEFLTPPTPNKLKKAADQVDEGDEDEQQERQQAIKASSRGAGQKTRHPFSHLLGQGGPFGKPTRNLLLRDRWRDHIKAELEQSTGIPVVDSQKDKGKMKKASGPSHTELQREMFSKAASRLAQIVTKQRQQEADRLARKEADDELCKMESDSSFADALAALRAYCDEYRVTSGAIGEFLIRPRQITGWESVLRRWASIGEQDPERALEARIDAVKEAQDADEEKKFGDVNLFFRLAEDKFKAAWQRAGKPDPTILQRFVKGMKARSDTERLKVAAFRHPDPCRYPVFAQFGVSRPDIRFRRLKAFADAPAGDDPRAVGMLLWHPKLKSARLTLMFGASKRLDREIGSACDNALRGTDRLPEVSRRGRLGAAAAGLQTADTLARVVRVFDLRSVKSRPAGDEQGDGDGDENGAEKLKAPKWNGTLSTNRRDLAEIGKLVNEDAKKAARSRLRWTLTVSMEMEGRGPWFRYVVASQDQTPFVRTVRKDKPNDKNDLGKGYSERKGDKRVEAEGRPYQEFNKPLKENKNQTALVEDSSTARGGKACLILSRLPSLRLLSVDLGHRFAAACAAWETLAKDAFEKECRDAEANGAKIVLGPEGCKPDEADYVHVVWPEKNSNAATNKARAEGRGKFQPVTVYRRIGSDQIPDGTAHPAPWARLDRQFFIKLQGENEGAREASNEEIWAVHQLEAELGRTAPLIERMVRGGFGQHEKQKRRLEALRGMGWEPATSDVLPGTADEDEGEARKVSRSVDELMFAAVRTMRLALRRHGDRARIAFAMTADHKPMPGGRKYYFDKAEDASTNDDEATRRGKHIEFFQDALSLWHDLFSSRGWKDGAAKALWDQHIATLSGYLAPEEIAEDLTGSERKKKRKENRDKLRVTAEALAKDSNRRRGLQEKWKQRWEADDGAPAEVDQTTGRKLKEGSGWHARLRWFQNWVMPSSRQGLKSIRHVGGLSLTRLALLTEFRRKVQVGFFTRLHPDGTKTETKEEFGQSTLDTLEHLRQQRVKQLASRIVEAALGIGRIKIPKRGKAPQRPRQAVDAPCHAVVIES

SEQ ID NO: 270 - protein, 777 aa, unidentified
  REGION 1..777: note = Description of Unknown:uncultivated organism sequence
  REGION 1..777: note = Category: MG37 effectors
  REGION 1..777: note = Description: MG37-9 effector
DIKWLLTFSPKLRPLGPWLEYGGKEKIKERQEVEEKGGRGNDARLLLCRLPRLRVLSVDLGHRYAAACAVWETLGEEDFKREIKGRKVLCGGSSGECMYCHTLHRDREGKVLKTIYRRIGADTLPDGRPHPAPWARLDRQFLIKLQGEREGAREASVEEIWKVHELEARLGRTKPLIDRLVAAGWGQTPGQKKRLRILEGLGWKQTQGVVDVTKDNEMSYKPSLSVDELMFSTVRTLCLALGRHGDRARIAHALTADYKKMPGGQRYYFNRAEDASVGDDESVRHEKHVEYILDALLRWHDLFEAKGWQDEEARELWDKYIANLSCCLEVSEMDDSLTDAELKKRRKDFKERLRPVAEAIVKDGKLRKKIQQEWKRRWERDDEKWREDIRWFKHWIFPRKKQAGPSIYRMGGLSLTRLATMTEFRRKVQVGFFTRLHPDGTTGEIGEDFGRKVLEDLEVMREQRVKQLVSRLVEAALGIGSEDLSHWEGQKRPQQRIEDPRFSPCHAIIIEDLTHYRPDETRTRRENRQLMTWSSSKVKKYLAEACELHGLYLLEVPARYTSRQDSRTGAPGIRCSDVSVAEFKNSPYWRKEVARAKAKNEKNQGDARDRYLCELDAQLAGSGRLKNVRVPIAGGEIFVSADTGSPATKGIQADLNAAANIGLRALVDPDWPGKWWYVPCDSSSFKPINDRVKGCKVIDTQESLKEASPGLAVKGEKNSEKKRQRRAKHREVVNLWRDISAKPVSAAYGPWDEYSVYWNRVQDQVVKILRNNLALSK

SEQ ID NO: 271 - protein, 755 aa, unidentified
  REGION 1..755: note = Description of Unknown:uncultivated organism sequence
  REGION 1..755: note = Category: MG37 effectors
  REGION 1..755: note = Description: MG37-10 effector
DRLGRAAAGVPASATVRIAGIFEQKDWNGRLQAPRARLNAIAARVARHGWDDKAKRMRARLRWLITFSARLQPSGPWVDYTATFPDDASAKPFVSRKGDYAVRHQGNDAREGHAKLVLSRLPGLRVLSVDLGHRYAAACAVWETLAKVVFEKERHDAEAKGAHVVLGPEGCKPEEAIYAHFVWPEKESNAATKKARQEGREKFHPVTVYRRIGPDELVDTSTGEVKEHPAPWARLDRQFLIKLQGEDHEARKASPAEVEAVQELERAVGREPPDQRSLRVDDLMSETVRTVRLTLQRHGRRARIAFNLTASKRLLPGGREEVLTDEGRVGLLADTLADWYALFAGKGWNDEWARQQWETYVTPLLQGAALPQIPEDAEATPKARKKYRADLTENLKPAAESLAQNEPLRMKLHCLWATRWSKDDIALRKCLRWLRDWILPRGKKVKEKAGRAIRHVGGLSLTRIATIKSLYQVQKAFHMRPEPEDLRKNAPSQGDDALLDFGRSILDVMEHLREQRVKQLASRIVEAALGIGIERQVGKKTPKRPRQRLYWKDEKGNEHGDRRFAPCHAVVIENLTHYRPDETRTRRENRQLMSWSSSKVKKYLAEACQLNGLHLREVQAGYTSRQDSRTGAPGVRCQDVPVKEFMRSPFWRKQVAQAEKKQAGDKGDARERLLCDLNAEWKGKPEADWEKAGTVRVPLKGGEIFVSARPCSCCKHGKRGGAPGLQADLNAAANIGLKALTDPDWPGKWWYVPCD

SEQ ID NO: 272 - protein, 788 aa, unidentified
  REGION 1..788: note = Description of Unknown:uncultivated organism sequence
  REGION 1..788: note = Category: MG37 effectors
  REGION 1..788: note = Description: MG37-11 effector
DWNGRLQAPRAQLNAIAARVTRHGWDDKAKQMRDRLRWLIAFSARLQPSGPWVEYARAFPDDAPAKPFVSRKGDYAVRHQDNDARKGHAKLILSRLPGLRLLSVDLGHRYAAACAVWETLSTEQVRKACQEAGNEPPKDSDLYLHLKNGQRTVVYRRIGPDTIEAVDESTGEIKPVPHPAPWARLDRQFLIKLQGEDHEARKASPAEAEAVQELERAVGREPPDQRSLRVDDLMSKTVHTVRLALRRQHGRRASIAFNLTAAKRLLPGGREEDLDEEGRVELLADRLSDWYTLFKGKGWNDEWAKEQWETHIAPLLQGAALPQISEDAEATPKARKKYRADLTEQLKPAAESLARNPSLCKKLHCLWATRWRDDDGALRKRLRWLRDWILPRGKNARRDPAIRHVGGLSLTRIATIKALYQVQKAFRTRPEPDDLRKNIPAKGDDALRDFGRSVLDVMEHMREQRVKQLASRIAEAALGVGRVKRFAGGKDPKRPREQVDRPCHAIVIENLAHYRPEETRTRRENRQLMTWSSSKVRKYLAEACQLYGLHLSEVNAGYTSRQDSRTGAPGIRCQDVPVQKFMQSPSWRREVAHAEKKHAEGKSEARERFLCDLNAKWKGREAEWEKAGTVRIPLNGGEIFVSAGPCKCCERNDRNGPAGLQADLNAAANIGLKALTDPDWPGKWWYVPCDPKTFKPVKDKVAGSAAIRLDKPLKDLPAAQGTDGARKKPSKTKAQQREIVNLWRDVSSQPISANDDWREYKPYWDHVQERVVKILRQWAGLTPNYKNQ

SEQ ID NO: 273 - protein, 1249 aa, unidentified
  REGION 1..1249: note = Description of Unknown:uncultivated organism sequence
  REGION 1..1249: note = Category: MG37 effectors
  REGION 1..1249: note = Description: MG37-12 effector
FGTGKGADFNHMSRVYRKIAEWVNSSSATPGQNGREFMVSLAEGLAEFNPRSKDLDGVKSLISGPGYKSATRNLLDHLWGSDTVTEDHLQRLREAASNDAASCSGKVGEKGRRPYADKILLDVEETCGFSYLTDSNGGDVLTKTRDSYPENYDWGTSRHKSFAVMLDHAARRVSIAHTWIKKAESRRQRFEADAQKIHEVPHNIREWLDNFCTEWSDITGALDGYRIRRRAIDGWKEVVKAWSLPDCRTKEDRVAAARQLQDNPELDKFGDIQLFEALAEDDALCVWHRNGELDSEPDPQPLIDYVAAEEAEFKKQQFKVPAYRHPDPLLHPVFCDFGNSRWDITFSAHRSGQNRNEQHDSYFTMTLWDGMRIGNIDLRWHSKRLTRDLALKDKNSPVKPQKEVTRADRLGRAAAGVSGYEAVRVAKLFQEKYWNGRLQAPREQLEAIARHVKQHGWDQRACLMRDRIRWTVTFSAPLQPSGPWLKYVEQHTSLSKWPHNEDNKTRKEMARLILCRLPGLRVLSVDLGHRFAAACAIWESLSSLDFQKETSSRKILRGGTGPDHLFCHTEHRDESGKRHVTIYRRIGADLLPDGTTHPAPWARLDRQFLIKLQGEEEGTREASNAEIWAVHQFEKAIGRALPLIDRLTNAGWGSTEKQQQRLQELNKLGWFPARQEKADLPDDEEVDFFRPSIAVDDLMASATRSARLALRRHGDRARIAFALKGEYKTLPGNRKYYFNSPRDASAEHDEKTRHSEYVQFLRDALEMWYNLASSNTWYDRKAREWWVEYIPEVPLPRDDTKIPARGTSGSDKQALKQQLLSVAERLQKNAELRRQLSDAWEKQWKEDDQKWRGYLRWLRQWILPRGGRVDRRAIRHTGGLSLARLATITALRRQVQVAYYTRLRPDGSRAEISENFARKTLDALEELRLQRVKQLASRIVEAALGVGSENRNHWEKERRRPRQQICDPRFNPCQAVVIERLDHYRPEEVRTRRENRQLMTWSAAKVKKYLAEECLLNGLHLREVSAAYTSRQDSRTGAPGMRCQDVSPREFAKSPLWRKLVGRKTTGQTNDLNPIQCFLIDMDETLRNGSWPGRTIRLPLRGGELFISADPSSPAAQGLQADLNAAANIGLRALTDPDWPGRWWYVPCDPATSRPKADRVNGSSAINISNPLRNVPTDNSPSTSTKKRGAKKTGSGDDKTVNLWRDISCAPVSSENGPWQEFSDYWEYVTQRVLGILAAHKQYGDSVPY

SEQ ID NO: 274 - protein, 839 aa, unidentified
  REGION 1..839: note = Description of Unknown:uncultivated organism sequence
  REGION 1..839: note = Category: MG37 effectors
  REGION 1..839: note = Description: MG37-14 effector
GRAGGGGTGDVAARYVKRLHKKYGNCRPQAPRAQLADIARHVQQHGLDQRACLMRDRIRWTVTFSAPLQPSGPWLKYVEQHTSLSKWPHNEDNKTRKEMARLILCRLPGLRVLSVDLGHRFAAACAIWESLSSLDFQKETSSRKILRGGTGPDHLFCHTEHRDESGKRHVTIYRRIGADLLPDGTTHPAPWARLDRQFLIKLQGEEEGTREASNAEIWAVHQFEKAIGRALPLIDRLTNAGWGSTEKQQQRLQELNKLGWFPARQEKADLPDDEEVDFFRPSIAVDDLMASATRSARLALRRHGDRARIAFALKGEYKTLPGNRKYYFNSPRDASAEHDEKTRHSEYVQFLRDALEMWYNLASSNTWYDRKAREWWVEYIPEVPLPRDDTKIPARGTSGSDKQALKQQLLSVAERLQKNAELRRQLSDAWEKQWKEDDQKWRGYLRWLRQWILPRGGRVDRRAIRHTGGLSLARLATITALRRQVQVAYYTRLRPDGSRAEISENFARKTLDALEELRLQRVKQLASRIVEAALGVGSENRNHWEKERRRPRQQICDPRFNPCQAVVIERLDHYRPEEVRTRRENRQLMTWSAAKVKKYLAEECLLNGLHLREVSAAYTSRQDSRTGAPGMRCQDVSPREFAKSPLWRKLVGRKTTGQTNDLNPIQCFLIDMDETLRNGSWPGRTIRLPLRGGELFISADPSSPAAQGLQADLNAAANIGLRALTDPDWPGRWWYVPCDPATSRPKADRVNGSSAINISNPLRNVPTDNSPSTSTKKRGAKKTGSGDDKTVNLWRDISCAPVSSENGPWQEFSDYWEYVTQRVLGILAAHKQYGDSVPY

SEQ ID NO: 275 - protein, 1402 aa, unidentified
  REGION 1..1402: note = Description of Unknown:uncultivated organism sequence
  REGION 1..1402: note = Category: MG37 effectors
  REGION 1..1402: note = Description: MG37-15 effector
HTLADTKVKGGKGKPDRDPTDEERKARRILLALSWLSVESKLGAPADFIIASGKVVAALEEILKSRNVAKNEIDEWKNDCSASLSAAIRDDAVWINRSKAFDDAVKSIGSSLTREEAWDMLERFFGIRDAYLAPAKGSEDESSEAEQEDKAKDLVQKAGQWLSSRFGTGKGADFRRMADVYNKIAEWAGNPQTSTTGNEAINNLAAALSEFNPASNDLQGVLGLISGPGYKSATRNLLTQIAAKATVTQQDLASLKDKATKDAQKCNQNTGSKGKRRYSDAILNNVEAVCGFTYLQDGDSARHSEFAVILDHAARRVSLAHTWIKRAEAERSRFEEDAKKVDQVPEAAKDWLNNFCLERSGLSGAQEPYRIRRRAVDGWKEVVTAWSKADCKTAEDRIAAARALQDDPEIDKFGDIQLFEALAENDAVCVWHKDGDAAKAPDPQPLIDYALAAEAEFKKRHFKVPAYRHPDALLHPIFCDFGKSRWGICFDVHKNAQTPFPRALCLTLWTGSGMVSVPLCWQSKRLARDLALGQDAQKDGTPKVTRADRLGRAASNVGKSDMVNIAGLFEQKDWNGRLQAPRQQLEAIAKRVDKHGWNDETAKKMLDRLQWLITFSARLQPQGPWCAYAKKHGLKENPQYWPHAKENENRKGHARLILSRLPGLRVLSVDLGHRYAAACAVWEAVNAEQVKEACKAAGRVEPEASDLYLHLKRKVTKQKKGNQVVVEETTIYRRIGADTLPDGKLHPAPWARLDRQFLIKLQGEEERVREASNEEIWAVHQLEAELGRTVPIIDRLVKAGWGQAGKQKTRLEALRELGWTPAKEAQGSDETEEGEPRKPSLSVDELMSSAVRTMRLALKRHSDRARIAHYLITDEKTKPGGIKERLDENGRIDLLQDALVMWHDLFSSRGWRDDAARQLWDDHIAKLSGYKAPEEIGEESSSPERRNKQKENREKLHDVAKALAQDVTLRKALHDAWKKRWEEDDGRWKKQLRRFKDWVLPRGKHASDPTIRKVGGLSLPRLATLTEFRRKVQVGFFTRLHPDGTRAETGEKFGQSTLDALEHLREQRVKQLASRIVEAALGIGSEGGKGWDGAKRPRQRISEPRFAPCHAIIIEDLTHYRPEETRTRRENRQLMTWSSSKVKKYLAEACQLHGLHLREVSASYTSRQDSRTGAPGTRCQDVPVKEFMRSPFWRKQVAQAEKKQAESKGDSRERFLCGLNAMWKDKAVADWEKAGAVRVPLKGGEVFVSADRISPSAKGLQADLNAAANIGLRALTDPDWPGKWWYVPCEPASFRPVKDKVDGSAVVNPDQPLRQSAQAQSGDAAKDKKKRGNKGAGKSKEVVNLWRDISSSPLECIEFGEWKEYAAYQNEVQSRVIRILEEQIKGRDKQPHEGSKEDDIPF

SEQ ID NO: 276 - protein, 820 aa, unidentified
  REGION 1..820: note = Description of Unknown:uncultivated organism sequence
  REGION 1..820: note = Category: MG37 effectors
  REGION 1..820: note = Description: MG37-16 effector
IAGLFEQKHWNGRLQAPRHQLEAIARYVGKHGWDQKAQKMRDAISWLVTLSANLQPQGPWCEFAERFHLRSDPKYRPHADINKNRKGHGRLILSRLPGLRVLAVDLGHRHAAACAVWEALSTEAFKDEVSAKRILRGGTDNDALYCHAEQETGGRKHVVIYRRIGSDTLPDGKPHPAPWARLDRQFLIKLQGEEEGVRQASNDEIWSVHQLEAELGRKRPLIDLLYKTRWAQKKNQTGTENKKLAELRNRGWVPTDDTHDPHDTEKHTSASPSLAVDELMSYAVRTMRLALKRHGDRARIAHYLITDEKTLPGGVRQKLDEKGRIDLVQDALVIWHGLFSSAAWRDDAAKQLWDDHISKLAGYKILNEIEEDLSALERRKKERQIRDELRETAAALAQKGDLRIALYDAWKRRWKEDDAQWKKRIRWFKDWILPRGKSANSRAIRRVGGLSLTRIATLTEFRRKVQVGFFTRLRPDGTKTEINEQFGQSVMDAIERLREQRVKQLASRIVEAALGIGRMKRPKKGKTPKRPDIRVDKPCHAVVIENLTHYRPEETRTRRENRQLMTWSSSKVHKYLDEACRLHGLHLRGEIPAAYTSRQDSRTGAPGLRCQDVSVDEFRRSPFFRKQVAQAKERMDENRGDARDRFLCDLDSTNGPGTFRIPLSGGEIFVSADPASPAAKGIQADLNAAANIGLRALLDPDWPGKWWYVPCEAASFKPVADKVKGSHAVKLDQPLRSPAEDNSAHGRRKSGKGDGRSKEVINLWRDVSSHPLECTAGGVWKEYAAYHEDVQCRVIKILDQQLNNGNRRGLDEFEADPLPF

SEQ ID NO: 277 - protein, 801 aa, unidentified
  REGION 1..801: note = Description of Unknown:uncultivated organism sequence
  REGION 1..801: note = Category: MG37 effectors
  REGION 1..801: note = Description: MG37-17 effector
KKQRFKVPAYRHPDAFLHPVFCDFGNSRWSIDYAVHRAPEKLARAQQLLEKKKEELTRAEQALSKASDPSKRSSIEKKLKTLNVAFKQQEAEVLWLESHHAMTMGLWNGSRIEDTPLLWQSKRFGSDIGQAGAEHPLVASRADRFGRAVAMAKDNAPVVPSGLFDLADWNGRLQAPRRQLDAIAAIHDRTDLSVEEKRQLVAKRIRTIRWLVTFSAKLQSRGPFIAYAAQHGLDWRYGAHGIENKSREGLAKLVLCRLPGLRILSVDLGHRYAAACAVWETLSAAQMQNACLEAGMEAPSQRTLYLHLKHFVNGKEKKTIYRRIGADTLPDGSPHPASWARLDRQFLIKLQGEDRDARPATCDEVVAVEQLETELGYVRPIKRKGREHLVDELMSDALRTLRLGLQRHGARARIAFNLTATKRTRPGGIQELLDQESRIGLLTETLLEWNELYAGERWADELARDMWNKQIQPLLGGTILQETNNQDVTPSAAKRRMQREETREKLRPVAKQIAENDSLCRQLNVLWSTRWQIEDAAWRMRLRWMRRWLLPRGINRDPQFRKSIRDVGGLSLIRIASFKSLYQVQKAYWMRPHPDDLRRNIPERGDSSLTSFGQRVLDAMERMRENRVKQLASRIAEAALGIGDETSVNAKNGRQKRPTERSNDPRFAPCHAVVIEDLTHYRPDETQTRRENRQLMSWSSSKVKKYLGEACQLNGLYLREVPPAYTSRQDSRTGAPGLRCNDVTVAEFYTSRFWRKQVEAAEKNQKDGKKGDARERYLLSIDERIRSEAYDRDVFRIPVKG

SEQ ID NO: 278 - protein, 1468 aa, unidentified
  REGION 1..1468: note = Description of Unknown:uncultivated organism sequence
  REGION 1..1468: note = Category: MG37 effectors
  REGION 1..1468: note = Description: MG37-18 effector
KQAAVTQRAYTLRLRGVDPQDQSWRDALWATHEAVNKGAKAFGDWLLTLRGGLDHALADAKVKGGKGKPDRDPTDEERKGRRILLALSWLSVESEKGAPEEYLVPHDLDKQSGTRSNWKTVDALREILRGRRLDESEIESWVRDCSASLSAAIRDDAVWVNRSKAFDDAVESVSSSLTRDEVWDMLERFFGSREAYLAPAKGAEDESAEVEQEDKAKDLVQKAGQWLSSRFGTGKGADFSRMATVYKEIANWAGKAQPGMTGDKAIADLAGALSEFSPTSNDLRGVLSLISGPGYKSATRNFLSQLATRTVVAESDLQSLQKSAKHDAQKCTANTGAKGQRPYSRVVLEQVESACGFTYLQDGGPARHSEFAVMLDHAARRVSLAHTWLKRAEAERRRFEEDAGRMGNVPASVKQWLDSFCADRSEASGALEPYRIRRRAVDGWKEVVAAWSKADCKTAEDRIAAARALQDDPEIQKFGDIQLFEVLADDEALCVWHKDGDSAKAPDPQPLIDYVLATDAEFKKRQFKVPAYRHPDALLHPVFCDFGNSRWDISFAVHEAGKSTVRKKKGQWQNSDPHALSMTLWTGSTVEPRRLRWQSKRLTRDLAFKEGKQNGNAPTVGRADRLGRAAAGVPEHGAVSIAGIFELEDWNGRLQAPRAQLNAIAARVARHDWDAKAKQMRDHLRWLITFSAKLQPSGPWLEYAAAFPDDAPAKPFVSRKGDYAVRHQGNDAREGHAKLILSRLPGLRVLSVDLGHRYAAACAVWETLSAKQVKAACQAAGHEPPKDSDVYLHLTKKVKKQKKGKEVEVEETTIYRRIGADTLPDGKPHPAPWARLDRQFLIKLQGEEEGAREASNQEIWAVHQMETVLGLSVPFIDRLIAAGWGCTEKQKSRLEELKKIGWTPAPKAESSGVQKENEEVDVCKPSLAVDELMSGAVRTVRLALQRHGRRARIAFNLTASKKLLSGGREEGLTDEGRVELLADTLADWYALFTGKGWTDEWARQQWETHVTPLLQGAALPKIPEDAEAAPKARKEYRADLTEHLKPVAETLAKDESLCARLHCLWATRWRENDVALRKRLRWLRDWILPRGRKAEADRAIRRVGGLSLTRIATIKSLYQVQKAFHMRPEPEDLRKNIPSKGDDALLDFGRSILDVMEHLREQRVKQLASRIAEAALGIGRMKRFAGGKDPKRPRERVDRPCHAVVIENLTHYRPDETRTRRENRQLMSWSSSKVKKYLAEACQLNGLHLREVSASYTSRQDSRTGAPGVRCQDVPVKEFMQSPFWRKQVAQAEKKQAKGKGDARERFLCDLNAKWKGRPEADWEKAGAVRVPLKGGEIFVSADEKSPAAKGLQADLNAAANIGLRALTDPDWPGKWWYVPCDPTNFKPAKDKVAGSPAICLDKPLKDTDGKAGARSREVVNLWRDVSSQPISANDDWREFTPYWNDAEARVVNILRQSAGLARDQGER

SEQ ID NO: 279 - protein, 804 aa, unidentified
  REGION 1..804: note = Description of Unknown:uncultivated organism sequence
  REGION 1..804: note = Category: MG37 effectors
  REGION 1..804: note = Description: MG37-19 effector
LAELDLFNGRTIKAVRLRWQSKRLTNDLALHQTAVIDDATPVSRANRLGRAAAGAGSRSAVRILGVFDHKHWNGRLQAPRAQLHKLAKIRDNATVPEPARRQKYERGLSTIRWILTFSPRLQQKGPWLEYAAAQNLSAKSPHFAENRGRGWLAQHLLGRLDGLRILSVDLGQRYAAACAVWEAMSGDQVRATCASAGAPEPDKSALSIRVSVGGRRTILRRVGEDAWARLDRCFVIRLAGEDVPARKASPAEIQAVQTLCRELGYSDASRAAAAVDKLMSYALRVLRLGLQRHARRAMVVFGLAAKEKVVLGNQLRALSEDERTDSIGTALADWWTFAVSSRWPDPHAAALWDEHIADRAAGIELPPDLESFSFRERLLVREKLLKDVRPIAQALRPEEVEQLTEIWRLQWLGEEARWCKRLRWIKDWLLPRGSGAQCNSIRRVGGLSLRRLNNLRALYRLEKSFAGRLRVGVGGHRCESQVPSEEFGRKTLTALERLRENRVKQTASRIVAAALGLGKDLKRGHGERFAPCHAVVIENLTNYRPDEVRSRRENRQLMDWCAAKVKKYLNESCDLHGILLREVQAAYTSRQDSLTGAPGVRCADVPIRDFMACGGYWERELRRADKANSSGRSDARSRYLIALRDRISAAIPYPAAAATKGAVRIPVDGGPVFVSADPQSPAAHGTQADMNAAANIGLRALLDPDWAGRWWYVPCNASTGVPVADGLKGSALIQPNLTLFSSHNGAEKKPKRQVVNLWRDVSARPLNVGIWRTYAQYRASVMERVTAILLTGLQTLGDDVDLPF

SEQ ID NO: 280 - protein, 904 aa, unidentified
  REGION 1..904: note = Description of Unknown:uncultivated organism sequence
  REGION 1..904: note = Category: MG37 effectors
  REGION 1..904: note = Description: MG37-20 effector
LTRAEQALSKASDPSKRSSIEKKLKTLNVAFKQQEAEVLWLESHHAMTMGLWNGSRIEDTPLLWQSKRFGSDIGQAGAEHPLVASRADRFGRAVAMAKDNAPVVPSGLFDLADWNGRLQAPRRQLDAIAAIHDRTDLSVEEKRQLVAKRIRTIRWLVTFSAKLQSRGPFIAYAAQHGFDWRYGAHGIENKSREGLAKLVLCRLPGLRILSVDLGHRYAAACAVWETLSAAQMQNACLEAGMEAPSQRTLYLHLKHFVNGKEKKTIYRRIGADTLPDGSPHPASWARLDRQFLIKLQGEDRDARPATCDEVVAVEQLETELGYVRPIKRKGREHLVDELMSDALRTLRLGLQRHGARARIAFNLTATKRTRPGGIQELLDQESRIGLLTETLLEWNELYAGERWADELARDMWNKHIQPLLGGTILQETNNQDVTPSAAKRRMQREETREKLRPVAKQIAENDSLCRQLNVLWSTRWQIEDAAWRMRLRWMRRWLLPRGINRDPQFRKSIRDVGGLSLIRIASFKSLYQVQKAYWMRPHPDDLRRNIPERGDSSLTSFGQRVLDAMERMRENRVKQLASRIAEAALGIGDETSVNAKNGRQKRPTERSNDPRFAPCHAVVIEDLTHYRPDETQTRRENRQLMSWSSSKVKKYLGEACQLNGLYLREVPPAYTSRQDSRTGAPGLRCNDVTVAEFYTSRFWRKQVEAAEKNQKDGKKGDARERYLLSIDERIRSEANDRDVFRIPVKGGEIFVSACGQDGGSNANRKAPPGLQADLNAAANIGLRAIFDPDWEGRWWYIPCDATTICPVAKKFNGCKAVDSSKPLRIVAEKVAVSSSGIDEKRSGRKGIALTDGSRIVNLWRDPSGAPIRRDVPSNSEWQDYAEYWNKVQSRVIANLRKSYGLREI

SEQ ID NO: 281 - protein, 869 aa, unidentified
  REGION 1..869: note = Description of Unknown:uncultivated organism sequence
  REGION 1..869: note = Category: MG37 effectors
  REGION 1..869: note = Description: MG37-21 effector
LWDGTHIEDTPLIWQSKRFGSDIGQPVEAQPLPVSRADRFGRAVALAQDNVPVIPSGLFDLSDWNGRLQAPRRQLEAIAAIRDSAKLSVNEKQQLVAKRIQSIRWLLTFSAKLQSHGPFIAYAAQHGFDWRYGAHGPENKSRQGLAKLILCRLPGLRILSVDLGHRYAAACAVWETLNAGQIQKACLDAGKEAPGPCTLYLHLKQIANGKEKKTIFRRIAADTLPDGSPHPAPWARLDRQFLIKLQGEDRDARLATSEEIAAVEQMENELGVVRQLKRKGRELLVDELMSDALRTLRLGLRRHGVRARIAFNLTANKRIRPGGKEEVLDQEGRVLLLTETLLAWYELYTAERWTDEPARELWNRHIQPLLGATILQNTVNQEDTPSAAKRRKLREETSGKLKHVAEEIAKNDSLCRQLHVLWSAQWQTEDVIWRTRLRMMRRWLLPRGVKRNAQLRISIRDVGGLSLTRIASFKSLYQVQKAYQMRPHPEDPRLNIPERGDSRLENFGQRVLDAMERMRENRVKQLASRIAEAALGIGGETGISSKDGSQKKRPTERSSDPRFAPCHAVVIEDLTHYRPDETQTRRENRQLMSWSSSKVKKYLGEACELNGLYLREVSPAYTSRQDSRTGAPGLRCNDVTVVEFNNSPFWRKQVGAAEKNQKEGNKGDARERYLLSIEEGIRGAANDRDIFRIPVKGGEIFVSACITDGGNNAKKNAPPGLQADLNAAANIGLRAIFDPDWEGRWWYIPCDAATLCPDAKKFIGCKAVDPTKPLRVVAEEGAISASGIGSKKSGRKKNAATDGTRIVNLWRDPSGAPIHRDVLRSPEWQDYAGYWNEVQHRVIRNLKTCYEQTSQQEDPFVSQDADKPF

SEQ ID NO: 282 - protein, 1171 aa, unidentified
  REGION 1..1171: note = Description of Unknown:uncultivated organism sequence
  REGION 1..1171: note = Category: MG37 effectors
  REGION 1..1171: note = Description: MG37-22 effector
MAAETTTRAYTIKISGEGNWRKLLWDTHVAVNRGAWVWGDWLLTLRGGLPASLTADHPDRRVLLALSWLSVESPASLAPDKHIVAYGTDEDRAAKVMARFREILSRKQVSDVAGWEGACEPALSARIRDDAVWVDRSAAFSGMQAKFPGLTTDWAANTLFDLLGGSEAYFAMPDDEEPAPTEAKDFVQKAGGWLSRNWGAGQKSDSTAISARLRRLADTPPKTVAGTSGDDAIARLLELVDADSESADAKNRSKLLKKAIGWKGRSSKGAVALQKLASASRVTPEQWEQTRTKFLEEADAQDSKATHRGVKPPWMDDLRNALEGWIGVPYRTTRDLIWEHGVSLDHALRRVSSAHSWIKRAEVERRQFQEAAEKEILPKATKRLDDFCTTRSGESGAIGEYVIHRRAIDGWDKIVRAWRQLSETATAKDRTQAARDVQSNLDDNEKFGDIFLFEALAADDAKCVWRDAKGRPDSQILKDYSAQTVAEHNQRRFKVPAYRHPDPLRNPIYVDFGNSRWGISYEALAASQRRQSLQVKLVKAKTDEAREKLRQDLAESADLRGVTLNLWTGVGVEPTKLRWHGSRLWKDLDLAHFGLPGDVSVTRADRLGRAVAGQPQGAVSVAEVFAAKDWNGRLQVPRKQLSRLADLVYGKENGVRRGADYFRLIATVENSRAKKEFERFNWFLTTSARFQPSGPWIEFIEKGLPSGIEYRSGRSGSYLNYEANKDRKGRARIQLARIPGLRVLSFDLGHRYAAACAVWETLTEAALQREIKGRQVLSGGVKAKSIYLHTYHTGDNGKSHRTIYRRTGEGMWARLDRQFLIKLQGEDWTARRAHHEEWEGFNKFRTFLGMQPSAELLRIDELQREAVKLARVGLRRLGDAARVALAMTATSKPISGGRTSGAFTPEERIGYLQEALVRWQELAQSGEFVDDWAKEQWHAWVIAKLGGPQSIAVEPDSRASDRKKRKETTAAPLKPVAEIIAEPQSRIAVELNHMWTERFRKLEHDWRLHLRWLRRLILPSKRDNDKNPRQIRNVGGLSVQRLQTIRALYETLKAFRMRPEPDDLRKNVPAWGDESLAQFGRRVLNRLERLREQRIKQLASRIVEGALGAGRMNVVRGRDHKRPQMSVDAPCHVVVAEDLEFYRPEETRFRRENRRLMDWAARNVRKYIVEG

SEQ ID NO: 283 - protein, 1478 aa, unidentified
  REGION 1..1478: note = Description of Unknown:uncultivated organism sequence
  REGION 1..1478: note = Category: MG37 effectors
  REGION 1..1478: note = Description: MG37-23 effector
MAASISPTQRAYTLRLTGHKNDENWRDALWRTHEAVNKGAKAFGEWLLTLRGGLDHNLATATLGKKPPSDRDVRDRRVLLALSWLSVEDERGAPTEFIVAKGAGAPEERKRKVRQRFEEILLGRGLSPDEAKEWATDCDDSLSAAIRDDAVWVDRSAAFDAARNRIGDTLTREEPWDVFNRFFRSQANYFAGIERPPDVLEDNDESDLESDDSKDERAKDLAQHAGKWLSNRFGGGSGANFGEMAEAYDALARAIREIPEGIPGDKAFFHLAVSLAAFQPKSDDLSGIRSLVSGPGHKSATHNLLEKLSSSGSSDQLIHQISEAAAQDASNCREKLGIKGPRTWSDTILKNVEDATGITYQHDGAGGARHTEYSVILDHAARRVSAGHSWIKRAESLRLRFERDKQRLDEVPADALAFLDLYCEDRTGLSGAAGRYRIRRRAIDGWTDVVRAWGKCADSQERIDRARELQSDPEMKFGDIQLFEALAEDAARCVWQSSGKPDPEILKSYVFARDAEDRMQRYKVPAYRHPDPLRNPVFCDFGKSRWSIDFAAHSGTPEKLDKARRGIEKAQVALEKAQAKKVRAGDNTAADKAQKDVEKCERQLAEKKAELQWLENPRSLRLGLWTGRQLEPTQLRWRSKRLAADLCIGGERGAPEGEVSRADRLGRAVGGVAAGGNPEIVGLFDLKDWNGRLQVPRAQLDAIARLLEKGRKSKADEAIRYLDWLVSFSAKLQPQGPWVDYAETTGLVRPDPKYWPHSDANKKRKERGRLILSRLPGLRLISVDLGHRYGASCAVWEAVSGKAVADACGAAGLAPPSADRVHLSIPCSKDGARRKQFYRRIAGDLLPDGKPHPAPWARLDREFTIKLQGEDKTPRKPFSNERKDVAAFKDWLGYSREKGGREPATVLDLMTHAVWLARLGLGRHGCRARIAWGLTANERLLPGGCKAAFNDAADQERFLTDLLLEWHGLAQPGSRNDPAAKQLWEEHIQPMGAETPQEEADTSFRERKKAREKLAERLAPVAAALRKNESLRKKLSIAWEQRWSRDDGEWKKRLKWLNRWLLPRGIMVEDEKTGRQRPPHAIRLKTIRNVGGLSLDRLAAIRSLYQVQKQYRMKPEPDNPRKNVPEKDDHSLDNFGKKTLDALEKMREQRVKQLASRIAEAALGIGSENARHWEGSRRPCERIADPRFAPCHAVVIENLTHYRPDETRTRRENRQLMAWSSSKVKKYLQEQCELHGLHLREVQAAYTSRQDSRTGAPGMRCVDVPVREFLREGGFWRGRVGKEQEKKEPERTHVEQLLVDLHGLWSKAPEAARWNKSVRVIQRGGEVFVPAAASSPIGKGLQADLNAAANIGLKALVDPDWPGAWWYVPCIAGSLIPVADKIKGAECAFADSKAPLRRNKESGEGNQRPAKSKGKSGKTKEIYNLWRDPGTGILAPGGWAFHKNYWQDVERRVAQNLRVSNGLAASIEPPPITEDVPY

SEQ ID NO: 284 - protein, 788 aa, unidentified
  REGION 1..788: note = Description of Unknown:uncultivated organism sequence
  REGION 1..788: note = Category: MG37 effectors
  REGION 1..788: note = Description: MG37-24 effector
MAEKNSKEQPVVTTQRAYTLRLSGTDKHDNSWCDRLWKTHEAVNKGAKVFGDWLLTMRGGLCHTLAEADVPGKGKKPARRPTQQEIKNRRIVLALSWLSVESKCGAPESYIVPHDSNTATGERKNWKTVEALREILRSRGLTEERAIEWADDCRDSLRATIREDAVWVNRSKAFDLAATNIGASLTREELWDFLQPFFANRHSYLEMDTVASATNGDSETDTEESKAASSDEKAKDLSQKAGQWLSSRFGTGPGADFSRFSKVYEVLATACRSIAPEVSGVEAINRLAIAIKKCSPSSNDIEGILGLISGPGYKSATRNILQQINRLQSVSEQDLSRLCDACEKDASQSRQKVGGKGSRPYADAILQDVERTCGICYARTEDHPSRHWQYAVILDHAARRVSMAHSWIKRAEEQRSKFEIEKNKLLRVPRDALAWLAAFCAKRSSDSGANDAYRIRRSAVDGWKQVVAAWAALPAKSEIAGSELRSDAERARIQVARELQDTVEKFGDIQLFEALAIREAKCVWMPDGKPDAQPLLDYVFGTDAIAKKQRFKVPAYRHPDAFLHPVFCDFGNSRWSIDYAVHRAPGKLTKARQLLEKKSAEISKAELALGKMDDALRHAAISETLQNLRAAYKQQQAEVAWLKTLQAITMGLWDGNGIQDTQLLWRSKRFGANIGQPDAVHPSPVSRADRFGRAVALAEDNVPVIPSGLFDLPEWNGRLQAPRRQLEAIAAMRDSAKLSAGEKQQLVAKRIHSIRWLVTFSAKLQSHGPFITYAEQHGFDWRYGMHGF

SEQ ID NO: 285 - protein, 918 aa, unidentified
  REGION 1..918: note = Description of Unknown:uncultivated organism sequence
  REGION 1..918: note = Category: MG37 effectors
  REGION 1..918: note = Description: MG37-25 effector
MAEKNSKEQPVVTTQRAYTLRLSGTDKHDNSWCDRLWKTHEAVNKGAKVFGDWLLTMRGGLCHTLAEADVPGKGKKPARRPTQQEIKNRRIVLALSWLSVESKCGAPESYIVPHDSNTATGERKNWKTVEALREILRSRGLTEERAIEWADDCRDSLRATIREDAVWVNRSKAFDLAATNIGASLTREELWDFLQPFFANRHSYLEMDTVASATNGDSETDTEESKAASSDEKAKDLSQKAGQWLSSRFGTGPGADFSRFSKVYEVLATACRSIAPEVSGVEAINRLAIAIKKCSPSSNDIEGILGLISGPGYKSATRNILQQINRLQSVSEQDLSRLCDACEKDASQSRQKVGGKGSRPYADAILQDVERTCGICYARTEDHPSRHWQYAVILDHAARRVSMAHSWIKRAEEQRSKFEIEKNKLLRVPRDALAWLAAFCAKRSSDSGANDAYRIRRSAVDGWKQVVAAWAALPAKSEIAGSELRSDAERARIQVARELQDTVEKFGDIQLFEALAIREAKCVWMPDGKPDAQPLLDYVFGTDAIAKKQRFKVPAYRHPDAFLHPVFCDFGNSRWSIDYAVHRAPGKLTKARQLLEKKSAEISKAELALGKMDDALRHAAISETLQNLRAAYKQQQAEVAWLKTLQAITMGLWDGNGIQDTQLLWRSKRFGANIGQPDAVHPSPVSRADRFGRAVALAEDNVPVIPSGLFDLPEWNGRLQAPRRQLEAIAAMRDSAKLSAGEKQQLVAKRIHSIRWLVTFSAKLQSHGPFITYAEQHGFDWRYGMHGFENKSRQGLAKLILCRLPGLRILSVDLGHRYAAACAVWETLSTGQIQKSCGVAGMEAPGPRTLYLHLKQIVDGKEKKTIYRRIGADTLPDGSPHPAPWARLDRQFLIKLQGEDRDARPATSEEIAAVEHME

SEQ ID NO: 286 - protein, 1503 aa, unidentified
  REGION 1..1503: note = Description of Unknown:uncultivated organism sequence
  REGION 1..1503: note = Category: MG37 effectors
  REGION 1..1503: note = Description: MG37-26 effector
MAELDPTQRAYTLRLQGQRREDYSWSDALWATHEAVNKGVKVFGDWLLTLRGGLDPGLAERPVKDKKGERPPEDKERKNRRILLALSWLSVESEQGAPEKYIVASGRDLTSERIEKVKTAFHEILKCKGLDENQIQAWTTDCLPSLSAAIREDAVWVNRNKAFEDAKRQYDITDEDVWDILEPFLGNVDAYFFIKDLPADDQDESAEESSGGGEEPKDLVKQAGQWLSSRFGTGKGADFDRMSAVYEKMAELTSRLEGEMTSGAFFESLAEHLSEFNPDSSEPQAILKLVSGPGYKSATRNLIKKFAEQPTLNSDDLMNFTNAAREDAQESRNKVGSKGQRNYADAILSSVERVCGFTYLTASDGSDVSVETRYQLPENYTWGTSRHKEFAVMLDHAARRVSIAHSWIKKAEARRNKFEADAQKIKDIHPDVKAYLDAYCESRASLVGSLEEYLIRPRAVSGWEEVVKAWAKLEKQPGWDNKEPDQRKQARVDVARELQDQIEKFGDIQLFESLASDDATLVWHKDGKADGEPDPELLKNYVKATVANFNKQRFKVPAYRHPDAYYHPVFCDFGNSRWDVRFSVHEAHTVLAEKKAQLERLQQEMQTTRNLTKKSKLQSQIKDLEEELRWLENPRLVQMKLWTGKSIAPVILRWQSKRLVQDLALKQNASTAPEVVSVSRADRLGRAAAGLSANHIVQVKNIFDEDHWNGRLQAPREQLEELARHVEKHGWDARAIKLRRSIQWLVTFSPKLEPWGPWCEYVNTHPDFKGLKTKNPSAWPHAEENKKRSGDARLILCRLPNLRVLSVDLGHRYAAACAVWETLSKEDFIKQTEGKKIKAGGTGSDSLYCHVEHECDGKKRTIIFRRIGSDILPDGSEHPAPWARLDRQFFIKLQGEQEGAREASNEEIWQVHELEKELGVNTPLIDRLVTTGWGETDGQQARLEDLRKRGWKPKTSLGITVDESAEEHDEEEARFRPSLSVDDLMAYTVRSLRLALKRHGDRARIAFAMEGKYMHVSGGRKYYFDEQRDASEGASSDERGKSYTEYLAKALQIWADLAYRVAYEPENNCQNGAESASKEAASFDSKYSDPKAEELWTKYIAHLPEYEKLERFGGSKKRAETQKKKKNEERLEKLAKALIDDVDRRTKIHDEFKAYWEEEDKRWSDRIKRVKRWLTGKGLGDTAESNSKHGRKVGGLSLTRIATLTEFRRKVQVGFYTRLRPDGSKKEIKEGFSQKLLDALEELREQRVKQLCSRIIEAALGVGSENVEHWEDTKKRPRGPLSAKDPRFAPCHAIVIENLEHYRPKEVRTRRENRQLMTWSAGHIRKLLKEETYLYGLHLREVSPSFTSRQDSRTGAAGIRCSDVTVREFLYSPRWRKRVLQARENGNKDVESEFLHMIDERLNDKQKHHTLSSVIRLPDRGGEIFVSSDPRSPAAVGIQADLNAAANIGLRALMDPDWPGKWWYVSCSASSFAPAQKYVKGSACMPPRLPVQRNESTDLDDGS

SEQ ID NO: 287 - protein, 1100 aa, unidentified
  REGION 1..1100: note = Description of Unknown:uncultivated organism sequence
  REGION 1..1100: note = Category: MG37 effectors
  REGION 1..1100: note = Description: MG37-27 effector
MAELELPKTQRAYTLRLRGADPADSSWRDALWATHEAVNKGAQVFGDWLLTLRGGLDHTLADTKVKGAKGKPDRDPTRDERCDRRILLALSWLSVESAPRQGDTHEKFVIASGKDDTPSSRDKKVVGKLREILKKRGLKDDDLAGWISDCEPSLSAAIRDDAVWVDRSAAFDAAQKCVGLSLTREEVWDLLQPFFGSREAYLASLEAAEDSDSEAAAEDKAKDLVQEAGQWLSSRFGTGKGADFAGMVNVYNTIAAWAKEQTGKTNRFGSEALSSLGKRLTVFKPKTNDADGILGLISGPGYKSATRNIILAWKEPSAQVTAENVAKLGEAAAEDAQKCTTNIGGKGHRQWSDALLREVEAACGFTYLQNDGPARHSEFAVMLDHAARRVSMGHNWIKRAESERRKFKADAAKVNNVPSKARSWLDQFCEQRAGISGAIDAYRIRKRAVGGWKEVVVKWNRPACKTVEDRVAAARELQDDPDIDKFGDIQLFEALAEDDAVCVWRMNGEANAQSLIDYAAATDAGARQRRFKVPAYRHPDPLSHPVFCDFGNSRWDISFSVHKARSDKAETEKKVALKKEAVEKARCAVEKDRGDNKETEAQSKLKKAQADLAEAEAKLAWLSSRHAISMGLWNGVKVGNSTPLFWSCKRLTNDMALRQNGYPTASMKVTRADRLGRAAVGATSDALIDILGVFDEEHWNGRLQAPRTQLNAIAAHVSKHGWDVKARKMRDRIRWLVSFSAKLRATGPWIDYAKKFSENAPAKPFVSRWGEYAVKHKENDSRAGHAKFALSRLPGLRVLSVDLGHRFAAACAVWEALPISTMKQEIVDRKIVAGGTAEHDLYCHVAKPTAKIAESGRNKGKPITEITIYRRIGADTLAKDTPHPAPWARLDRQFFIKLQGEEEGAREASNEEIWAVHQMETALGRSVALIDRLVAAGWGGTDKHKQKARLEALTKLGWQRSSEKPPYGKRPSLSVDELMSSAVRTLRLALKRHGDRARIAHYLIADEKTKPGGIKEKLDIKKGRIELLQDALVLWHDLFSSRGWRDDSARQLWDTHIARLSGYQTPEEIGEEASARERTAKEKETREKLSGAAQSLASNE

SEQ ID NO: 288 - protein, 1448 aa, unidentified
  REGION 1..1448: note = Description of Unknown:uncultivated organism sequence
  REGION 1..1448: note = Category: MG37 effectors
  REGION 1..1448: note = Description: MG37-28 effector
MAEQVAATQRAYTLRLRGVDPQGPSWREALWRTHEAVNKGAKAFGDWLLTLRGGLDHALADAKVKDGKSERCPTDDERKGRRILLALSWLSVESEKGAPAEHFVPHDLDKQSGTRSRWKTVDALKEILKGRGLCESEIELWVQDCSASLSATIRDDAVWVNRSKAFDTICNGQKIVEARKDCQTMLWYLLGDDYLTLPKKPEKPKEEPTETEGEPSEEESNQERRSAVIQSGKGAGQRTRHPFSHIFGDSTGFGKPLRKLDLRDHWKTHLETRVTASQIPMRDAKKKKEEGVSQKEGVSPEEGVSPTELHREMFSKAASRLAQIWTKQKQQEVERQNRKAADEALKTLEADTQCKSALDLLDALCVERGTASGAQEEYRIRPRQIDGWDRVVKAWDPTANTCDPTVAEEQRIAAAKRLQDEDSDEKFGDINLFIALAEDKYKAVWWHANAPKPEILKTYVKGKKARADAVRLKVAAFRHPDPYFNPVFCQFGVSRPRIEFRRLRDFTSKPEGRDVRAVGLLLWNGEKADLHVLHAVSKRMDREVGDACGSVQKGAADLAEVTRRSRLSIATLAQLPEKGSVRVAHVFDRKKVKARKTNEKGAGAEGASEPAREKEPEWNGTLLGERRALEAIGRLVEDGKHTEAKECRRRLHWWLIVSLEMRPQGPWLKYGEDNNLLEVRYDKQQKENVVATAPRNSRDEWRGLAYPFRHPCNEKGRKGMARHQLSRLSGLRVLSVDLGHRYAAACAVWETLTTGCFQTEIEGRRILRGGTGEDALYCHTEHEANGRTHTTIYRRIGPDKWPDRTPHPAPWARLDRQFLIKLQGEEDSAREASNDEIWAMHRMETALGRAVPLIDRLVAAGWGHTEKQKARLEGLKTLGWTPAPRAQQSADPEGTQEEGYRPSLCVDELMFSAVRTLRLGLRRHGDRARIAHYLITDEKIKPGGVKERLDENGRVELLLDALVLWHNLFSSRSWQDAAAKQLWDAHVAKMSGYQRPEEIREGISRQERKKKQEEIRHNLRCAAAALAKDANLRKALHDAWNERWKHDDEQWKKHLRWFKAWVLPHGPAANSCSIRKAGGLSLTRIATLTEFRRKVQVGFFTRLHPDGTKAQINEQFGQSTLDAIEHLREQRVKQLASRIAEAALGIGRMKRSEGGKDPRRPRARVDRPCHAVVIENLTRYRPEETRTRRENRQLMSWSSSKVKKYLAEACQLNGLHLREVQAGYTSRQDSRTGAPGIRCQDVPVKEFMQSPFWRRQVAQAEKRQAEGKGDARECFLCELNAKWKGKPEADWEKAGAVRIPLKGGEIFVSADPKSPAAKGLQADLNAAANIGLKALLDPDWAGRWWYVPCDPTSFKPVEDKVGGCAAICLDKPLKNASAAQDTDKPGKKRRKAGKQTGACVNLWRDVCSQPISAGDGWREFTPYWNGVQARVVNILRQAAGFARDPEER

SEQ ID NO: 289 - protein, 1420 aa, unidentified
  REGION 1..1420: note = Description of Unknown:uncultivated organism sequence
  REGION 1..1420: note = Category: MG37 effectors
  REGION 1..1420: note = Description: MG37-29 effector
MAERATVATTQRAYTLRLRGMDKSDNSWRDALWATHEAVNSGAKVFGDWLLTLRGGLSHKLADKPDVQGEPPSEQERKNRRILLALSWLSVEDRHGAPADFIVEQPVEALRTVLAARGLGEDELGSWIEDCSPSLSAHIREDAAWVNRSDAFDQFRSRTGGSADREYACRVVLGFLELKGPYFHVPSVDDDSSSSPAASGDDKPLVNEATGWLCDNWGVGKKTDKARVSGILDRLGRLDFDKFVGKSSIELLRFACQEIGLDAAEGAAAHTLCSNLIAHIGWQGRPSSARMALEAISAAPNVTDALAQRLTKKLRQEAAAKLEESGIAVPSWMPDERVRLERAIGLAYRDGKDRTFEFAVMLDHALRRVSGAHSWIKLAEGERRKFAEDAAKLQAVPAAVRELLNRFCEDRGGISGAVEAYRIRKRAIGGWDQIVAAWRACPDSEEARIDAARRVQAEWEDTDGKFGDIQLFEALATDDAKCVWENGPQPLQDYVAATTARADQLRFKVPAYRHPDPLRHPVFCDFGNSRWTIKFAVHERHKLNGGRPRKNVDADWLRDDSALSMQLWNGEALAPKPMRWSCKRLVNDLAIKQKPVSDGDAVTAVTRADRLGRAAAGATRDQQVRIANIFDEKDWNGRLQAPRVQLDAIARHVDRCGWDAKAQTMLRRIRWLVSFSPKLTPRGPWVDYCSQFDDASATRPFVSGKGEYAVKHAGNEARQGHARLILSRLPGLRVLSVDLGHRFAAACAVWQTITARQMEEACRTRGHQAPSPDDLFIHLKRRIRKTVKDKEREVEQTDVYRRIGPDRLPDGTEHPAPWARLERQFVIRLQGEGNARRATRDERDRVKDFETHIGFRNAADERMPSMVDELQFHALRLARLGIARHACRAKIAWALTSLCSLRPGGGQECFAEGSPEHAEHLTRCLMDWHAMAAESRWNDSQMRDLWNQNVAAIDPDLKIVEPPIEPPSERPTRQEREKNQNQTEERIRAAVGRLTIDSRTAAAGEIARRWNDDDARWREHLRWLRSWLLPRGLKKDKARARLARRMGGLSLTRIAAFKSLYQVQKAFFMRPDPANPRKRVPSPGDESLERFGQRVLDAMERLRDQRVKQLASRIAEAALGIGAEGIPGRRPDRCVHDPCHAIVIEDLTHYRPDDLQTRRENRQLMDWSSSKVRKHLSEACQLHGLHLREVSPAYTSRQSSRTGLPGVRCQDVSIMTFLKAPHWRKRARVAKERLEAHRGGALDCYLCELDEQLSRLANDRKSPWPPLRLPVRGGDLFVSVDGHTVQADLNAAANIGLRALLDPDFGGRWWYVPCNSVGKPLPEKVKGCPLFTGKPLTSADANPPTPRPAGKGRKKGARTDEPRTINLWRNPVAQPPESTTAWTTFDRFWPNVEAQVVKALQQQNEHRARIARNPLEETPF

SEQ ID NO: 290 - protein, 1392 aa, unidentified
  REGION 1..1392: note = Description of Unknown:uncultivated organism sequence
  REGION 1..1392: note = Category: MG37 effectors
  REGION 1..1392: note = Description: MG37-30 effector
MAESLPATQRAYTLRLRGADPDDESWREALWRTHEAVNKGAKAFGDWLLTLRGGLSHELADEPVKAKGGRRQPSADEKRDRRIVLALSWLSVESERGAPQQFIVASGKDNDKQRQHKLVKALRDILQKRGVGKAELDEWVKACEGPLGAAIREDAVWVNRSAAFDQAVKRIGKSLSRDQVWDLLERFFGSKNAYLAPIVLKDEAEPSEKAKDLVQKAGQWLSSRFGKGKGAKFEVLSGAYQEIERWAKSARPSSPAHLMAHLARLLKAPSEDLDGVLSIISGPGYKSATRNLLKKLSGQQRVSSEDLARLAKTAADDRVKCKSKVGEKGKRPWADTILEDVQRACGFKYIPDGGPARHRQFAVMLDHAARRVSVAHTWIKRAEAKRRSFEEDARKIGQVPSQAKQWLDDFCLERSRSSGSLEGYRIRKRAADGWEHVVSRWAGADCTTVADRIAVVRELQSDPEIDKFGDIQLFEALAEDDATCVWKPEGEPDPQPLKDYVAAKDAEFKRRRFKVPAYRHPDPLLHPIFCDFGCSRWDIKFDVHEAYKRKERKSTQTQTNPHGLTMRLWDGTDVSDVRLRWRTKRLFGDLNLGGAGAGKDVSRADRLGRAAAGAQEGEAVQIAGLFEDKDWNGRLQAPRPQLDAIARRVDAHGWDKQAVRMRARLEWLLTFSARLRPRGPWTEFAKKNDLRPDPVYWPHAAENKNRQGRGRLILSRLPGLRLLSVDLGHRYAAACAVWEAVSAEAVKKACKEAGHPNVKEDDLYLHLKRKDQGKLRTTIYRRIGADRLGQPTPRKEVAHPAPWARLERQFLIKLQGEDETPRKARKDEFKAVENLERELGRERSEADKLPHRIDELMSEAVRTVRLALGRHGNRARIAHYLVATEKTMPGGVVQSLDQSGRVRQIAYALELWYELAASSKWKDDWAAELWEKQAWAKDVPLQKRDEETVTRQALKKEKKERCGKLEAAAENLLRDGARCRDLSARWAKRWGEEDKKFRERLRWLRDWILPRGKKAAKNPAIRHVGGLSLTRLATIRSLWQVQKAFFTRMTPEGRRRDEDGRPLTAGEGFGQKVLDALDRMRDQRVKQLASRIVEAALGVGKEQEKCANRDPRRPRECVFEPCHAIVIENLTNYRPEETRTRRENRQLMRWSAGKVKKYLSELCQLHGLHLREVGAEYTSRQDSRTGAPGIRCQDVPVREFMRSPFWRKQVAQAEKKLEKGEGGARERLLCELNANWKDSSEKELKEAGVIRVPLNSGEIFVSADAKSPAAKGLQADLNAAANIGLRALLDPDWPGAWWYVPCDAKTMKPSKEEASGSAAVDMEKPLVQVSEAKPGARGGRGKSEKPVVNLWRDVSARALEPGDWRRWEPYWNDVSARVVRLLRKQQGLPDFA

SEQ ID NO: 291 - protein, 1451 aa, unidentified
  REGION 1..1451: note = Description of Unknown:uncultivated organism sequence
  REGION 1..1451: note = Category: MG37 effectors
  REGION 1..1451: note = Description: MG37-31 effector
MAGNDQNTTQRAYTLRLCGTDPNDQSWRVALWCTHEAVNKGAYAFGDWLLTMRGGLDHTLADAPIADRDPTDEERKARRILLALSWLSVESELGAPEEFIIASGEDAEMERNGRVLTALEDVLKKRGLRKEKIQEWIEDCSPSLSAAIRKDAVWVNRSKAFDAAIGTYHGLTREYAYTVINSFFRLDDKYLQLPDIGVDDQSGAGADVAESPEFRTLARQWVSTNFGTGEKSDADLILKKLNILVAADLIRFAKQSKVSFIKEMCNLLGIQGEDVDALRTGIGWKTGRKSKGRLAIDSLPEQVTSESIQRLQQKFEEEVSDKQRKTRDVPGWMPSFRQAIEKECGMPFRGDRDHIGEFAVMLDHAARRVSQAHSWIKRAEAERRRFEEDARKMDDVPEKTKEWLDSFCSERSDTSGALEPYRIRKRAVDGWKEVVAAWSKADCLTTEDRIAAARALQDDPEISKFGDIQLFEALAEEDAMCVWHKDGDPANAPDPQPLIYYALASEADFKKRQFKVPAYRHPDALKHPVFCDFGKSRWAIDYEIHRNAKTPSPRALTLTLWTGKEMKPVSLRWQSKRLAHDLNIKSDGRGEGASLVTRADRMGRAASGVSKDDEVEIAGLFETKEWNGRLQAPRCQLEDIARHVDKHGWDSKASVMLNAVQWLVTFSARLQPQEPWREYAKNNENVNLNLDKKNRQPHTDENKNRKGRHAKLVLSRLPGLRVLSVDLGHRYAAACAVWETLSIESFRKEIRGRTILRGGKDAEALYCHTEHEENGNKHVTIYRRIGADKLPDGATHPAPWARLDRQFLIKLQGEGEEAREASNEEIWAVHRMESELGRAVPLIDRLVAAGWGRTEKQAERLEALKRLGWEPPLATAPVVEDASGEDADAYRPSLAVDELMSSAVRTLRLALKRHGDRARIAYAMTATYKSMPGDRKYYFTKAEELSSNDDQATREEKHIEFILDALVLWQSLISSRGWRDEAAKLLWDKHIAKLPVYEAPEELGEDITSVERKKKRDNNREKLYGVAKALVQDRPLRNELHDAWNKRWEQDDARWREWLRWSRDWILPRGRQAGDHSIRKVGGLSLNRLATLTEFRRKVQVGYYTRLRPDGTRKEIGEAFGQKVLDDLEQMREQRVKQLASRIVEAALGIGSEDRAHWEGGKRPRQRIDDRRFAPCHAVVIENLTHYRPEETRTRRENRQLMTWSSSKIKKYLKEACQLHGLHLCEVTASYTSRQDSRTGAPGIRCQDVAVREFMLSPFWRKQVKRAEAKQAENKGDSRERFLCELNAKWKNKTEVEWRNAGVVRIPLRGGAVFVSADRRSPASKGIQADLNAAANIGLRALIDPDWPGKWWYVPCFSSSFIPTDESTKGSEAITGKPLKERPTDDTGKMATRKRSGRSSRSSGGVVNLWRDVSSLPVSADKGPWEEYQPYWNKVQERVVRILHDNMVDSG

SEQ ID NO: 292 - protein, 1472 aa, unidentified
  REGION 1..1472: note = Description of Unknown:uncultivated organism sequence
  REGION 1..1472: note = Category: MG37 effectors
  REGION 1..1472: note = Description: MG37-32 effector
MAHQAAVTQRAYTLRLRGEDPQDRSWRDALWATHEAVNKGAKAFGDWLLTLRGGLDHALADAKVEGGKGKPDRDPTDEERKGRRILLALSWLSVESEKGAPEEYLVPHDLDKQSGARSNWKTVDALREILKGRGLGESEIESWVQDCSASLTAAIRDDAVWVNRSKAFDDLCPRFRGLDRDYAAKTISFFFGNQGTYLALPNRDNDEDATTAVQSGDSSDFRERARQWVSTNFGTGTKSDNARICSALHTLATSNLMSFDGCSKADFLKHLATLLGRSEPNKEPEEVLRIAIGWTTGRPSAGLLAIKSLPDPVTANDIDTLQRKFADEKAKKEEKADLLRVPEWIRTFRETVERECGIPYVGKRDHIGEYSVMLDHAARRVSIVHSWIKRAEAERRRFDEDAKRMANVPEPAKNWLETFCLERSGASGARDQYRIRRRAVDGWEEVVAAWSKADCKTAEDRIAAARALQDDPEIQKFGDIQLFEALADDDALCVWHKDGDSAKAPDPQPLIDYVLASDAESKKGRFKVPAYRHPDALLHPVFCDFGKSRWDIKFDVHEARKSTARKKEGATQNSDPHALSMTLWTGSTFKSQKLRWQSKRLTHDLALGQGKQDHRAPEVARADRLGRAAAGVPASATVRIAGIFEQKDWNGRLQAPRARLNAIAARVARHGWDDKAKRMRARLRWLITFSARLQPSGPWVEYTATFPDDASAKPFVSRKGDYAVRHQGNDAREGHAKLVLSRLPGLRVLSVDLGHRYAAACAVWETLAKEVFEKERHDAEAKGAHVVLGPEGCKPEEAIYAHFVWPEKESNAATKKARQEGREKFHPVTVYRRIGPDELVDTSTGEVKEHPAPWARLDRQFLIKLQGEDHEARKASPAEVEAVQELERAVGREPPDQRSLRVDDLMSETVRTVRLALQRHGRRARIAFNLTASKRLLPGGREEVLTDEGRVGLLADTLADWYALFAGKGWNDEWARQQWETYVTPLLQGAALPQIPEDAEATPKARKKYRADLTENLKPAAESLAQNEPLRMKLHCLWATRWSKDDIALRKCLRWLRDWILPRGKKVKEKAGRAIRHVGGLSLTRIATIKSLYQVQKAFHMRPEPEDLRKNAPSKGDDALLDFGRSILDVMEHLREQRVKQLASRIVEAALGIGIERQVGKKTPKRPRQRLYWKDEKGNEHGDRRFAPCHAVVIENLTHYRPDETRTRRENRQLMSWSSSKVKKYLAEACQLNGLHLREVQAGYTSRQDSRTGAPGVRCQDVPVKEFMRSPFWRKQVAQAEKKQAGDKGDARERLLCDLNAEWKGKPEADWEKAGTVRVPLKGGEIFVSARPCSCCKHGKRGGAPGLQADLNAAANIGLKALTDPDWPGKWWYVPCDPTNFKPARDKVAGSAAICLDKPLKNAPAAQDTEGPRKKRDEAGARSRGVVYLWRDVSSRPISANDAWREFTPYWNDVQARVVNILQQLAKNQGVR

SEQ ID NO: 293 - protein, 809 aa, unidentified
  REGION 1..809: note = Description of Unknown:uncultivated organism sequence
  REGION 1..809: note = Category: MG37 effectors
  REGION 1..809: note = Description: MG37-33 effector
MAKDNAPVVPSGLFDLADWNGRLQAPRRQLDAIAAIHDRTDLSVEEKRQLVAKRTRTIRWLVTFSAKLQSRGPFIAYAAQHGFDWRYGAHGIENKSREGLAKLVLCRLPGLRILSVDLGHRYAAACAVWETLSAAQMQNACLEAGMEVPSQRTLYSHLKHFVNGKEKKTIYRRIGADTLPDGSPHPASWARLDRQFLIKLQGEDSDARPATCDEVVAVEQLETELGYVRPIKRKGREHLVDELMSDALRTLRLGLQRHGTRARIAFNLTATKRTRPGGIQELLDQESRIGLLTETLLEWNELYAGERWADELAMDMWNKHIQPLLGGTILQETNNQDVTPSAAKRRMQREETRKKLRPVAKQIAENDSLCRQLNVLWNTRWQIEDAAWRMRLRWMRRWLLPRGINRDPQFRKSIRDVGGLSLIRIASFKSLYQVQKAYWMRPHPDDLRRNIPERGDSSLTSFGQRVLDAMERMRENRVKQLASRIAEAALGIGDETSVNAKNGRRKRPTERSNDPRFAPCHAVVIEDLTHYRPDETQTRRENRQLMSWSSSKVKKYLGEACQLNGLYLREVPPAYTSRQDSRTGAPGLRCNDVTVAEFYTSRFWRKQVEAAEKNQKDGKKGDARERYLLSIDERIRSEANDRDVFRIPVKGGEIFVSACGQDGGSNANRKAPPGLQADLNAAANIGLRAIFDPDWEGRWWYIPCDATTICPVAKKFNGCKAVDSSKPLRIVAEKVAVSSSSIDEKRSGRKGIALTDGSRIVNLWRDPSGAPIRRDVPSNSEWQDYAEYWNKVQSRVIANLRKSYGLREI

SEQ ID NO: 294 - protein, 1325 aa, unidentified
  REGION 1..1325: note = Description of Unknown:uncultivated organism sequence
  REGION 1..1325: note = Category: MG37 effectors
  REGION 1..1325: note = Description: MG37-34 effector
MAKETTTQRSYTVSLCKPELGAKAWKALAATHIGMAKGAKACGDMLLNMAAGIAPCAIEELGFSGAEAVRNARRMLTLTWFDVESEDGSPQEFVVPVEELPQKLRDHLISAGLDREEADSWLEDCQDVFATPIREDSCWIDRRSSFEAMEARLGVDISQSDIEDFCFGQFAILGSLKDYLIIPDYESLQPDGISDAPSKIQAARNMLSSRLGAGIGSDTAAMADAYDLINRALEGLSSGEHCPKNEFRRVIELELDDSMPDISFEEFVNSKIKGIGRPTATAQRMEAALACREFIPWSQIEALMEKSADDARKQRAKVGLKGRRPYFDAIMGDLEKKTGIPYPAEGNQTPARNWYSCLFDHAARGVSAHHTWVKRAESTRNATYANNEAFETLPDEARAFLSKYEKERSLSLGAVEPYVIRRKAITGWTKDHVKQLHNAKSAEERVEILKEAQSQGDMGDMTLLIDLVRDDALCAWHDVEGKPAEKILEVWAKHQELERERLHFKTPSYRHPDHLLHPVFADFGKSRPEATYTFGESLEQRTVTLMLVDGGGFSRFTFHWNSKRLMDDFDFSALEKEGKAAACAMTTRFGNSLEEERKPRLLLTKAAKKPIVSDVGTRLQLTRASLERCAKRQNDAMKNPDELDWFLSLALNIKPAPFTPKALIAQAKERKDENKARTSALSKLRYSRIHGLTFIGVDLGHRKAASCSVWKTCSAEEIEQLCIEAGHELPDKNTLHLTLDCIDRRINARRIGADTLPSSEQHPAPWAVLQREFAIELPGAKEEEQRAATKNELSFLANPYAISVETRSAKAKKSAYRTTSEAQYAAVEAIRRDVKQHASMASFIHLIRSKKITKPGGAEMLLSDDELVKTVEKRLEKELGNKYAKPAPWVENLPRSNDPSTCAHILCTEKEYVDALEKQWEEDDENIRIALRILRNWIFKGIEPYSDSRTACKGVGGLSLNRIATMQMAYQLVRSFSMRPFPTDTRRGRRMSAHINTMREQLAKHVASRIVEAALGLGGSQNTSEKRNVRTPGDRFQPCDLVVIESLTNYRPEQTRSRAENRRIMQWASARVGEMLRDECEIYGIALYETPAAYTSRQDSRTGLPGFRFKEVPVAAFVNGGSYHGVNIDRALSSDCENERRFYGELLKRWNKGKGEWDEPLRPEKTVWTLKRGAWVSKNGMLLKKGMAPQPIPIVANGSELFMASTDEGVLKIQADINAAGNIALRGVTDPDWAGSWWRVNIQAKSGMVEKRHRGSLAFDGTAIDPEGKAPHEGVIGAWSTVGATPLSDEKRKWSTYQKYWDDQRSKIFARLCRRYGIPPAIEEE

SEQ ID NO: 295 - protein, 938 aa, unidentified
  REGION 1..938: note = Description of Unknown:uncultivated organism sequence
  REGION 1..938: note = Category: MG37 effectors
  REGION 1..938: note = Description: MG37-35 effector
MALTVETTQRAYTMRLTGDSDNTHWRELLWKTHELTNRGAHAFGDFLLTMRGGLSHELATGNTSEETRTRRIILAMSWLSVESKEGSPQQFHVPQNWEGKKQLGQYKVLEALESILTKRGLDRKEIEAWINDCTASLQARIRDDAVWVNRSECFDAFCKEAGVSVNRASAKNNLFFFISEDQYFLLKDIGEESANVPDSNSLNLVQLARKWLSNYWGAGIGNDKRSIKDSLTTIAGLDYGHMFDRSGTDLLNYIAVKLRFGEVEGDWDLRRLKSCIGWRSGRSSSAAMALEKIAAEKNISKEAVERFVEKCADEAKTIKVPDKESQDTQTWNENIRGQLERAIGVPYRDEKDHIDEFSVMLDHGARHVSVAHSWMLLQEGKRIEFSKDAQKLNKVPEEARQYLDEYCELRTELTSAVGDYVIRKRAIEGWKEVVKAWSASDCRTPEDYVEAARQAQAEDVEGGKFGDINLFEALAEEDACCVWRNDKGKPDADILKNYVEARWAETQMKRFKVPMYRHPDALRHPVYCDFGSSRFSIDYAALRAKKDVPVNSLTLTVYDGASFKPLTLRWQSKRLMKDIIDLRPKDNKDGDAIVVSRADRLGRAAGGAGDVKKGLTIATVFDEKKWNGRLQVSRRQLDNLERKLMKAGVPDKDRCKTVQSHLPNLDWFITFSPKLSPQGPWIDYAMENKLKVNAKNIFNWRQRFEPKKRGTLTYAPLCRLPDLRVLSVDLGHRYAASCAVMQTMSTKQLCALCEDAGATPPAGDALYFVLSEQNGEKPKKKWFRRIGPDRLPDGAEHPAPWAMIERQFTIKLDGEDDTVRGARKEEIKNAVGFCENIGIDENDLPKNAVDELMGFCVRQYRLALRRHSDVARIAFAMTAQHRHGMGGRKETLDSSGILEEKTKALLLWDNLRNGRGKAKETAERIWGNYLAVHVDRLG

SEQ ID NO: 296 - protein, 1442 aa, unidentified
  REGION 1..1442: note = Description of Unknown:uncultivated organism sequence
  REGION 1..1442: note = Category: MG37 effectors
  REGION 1..1442: note = Description: MG37-36 effector
MANQAAVTQRAYTLRLRGVDPQDQSWRDALWATHEAVNKGAKAFGDWLLTLRGGLDHALADAKVKGGKRKPDRDPTDEERKGRRILLALSWLSVESEKGAPDRHVVPHDLNKQSGSRSWKTVDALREILKGRGLDESEIESWVQDCSASLSAAIRDDAVWVNRSKAFDDAVKSIDCSLTRDEVWDMLDRFLGSRDAYLAPAKGAEDESAEAEQEDKAKDLVQKAGQWLSSRFGTGKGADFSRMAAVYEKIADWAGKARAGMTGDAAVAGLAAALSEFSPASNDLQGVFRLISGPGYKSATRKLLKQLPARPSVAQEDLENLRDSACDDAEKCKANTGSKRQRAYADAILKDVESVCGFTYLQEGGPARHSEFAVMLDHAARRVSLAHTWIKRAEAERRRFEEDARRMDKLPARVKQWLDAFCFERSERLKASGEKKTYRIRRRAVDGWKELVAAWSNADCKTAEDRIAAARALQDDPEIEKFGDIQLFEALADDEALCVWHKDGDLAKSPDPQPLIDYVLATDAEFKKRQFKVPAYRHPDALLHPVFCDFGNSRWDISFDVHKAVKTSERNRKNMMAQDPHALSMTLWTGSTVEPQRLRWQSKRLARDLALKGRQDANARPVTRADRLGRAAAGVFAHSAVRIAGIFAQEDWNGRLQAPRAQLDAIAARVARHGWDAKARQMRDHLRWLITFSAKLQLSGPWAGPEPSPWVEYTKTFPDDAPAKPFVSRKGDYAVRHQGNDARNGHAKLILSRLPGLRVLSVDLGHRYAAACAVWETLSAEQLKAACQAAGHEPPKDSDLYLYLKKKVKKQKKGKALEVEETTVYRRIGADVLPDGKPHPAPWARLDRQFLIKLQGEDTEARKASSAEVGAVQELERAVGREPPDQRSLRVDDLMSETVRTVRLALQRHGRRARIAFNLTASKRHLPDGREEVLTAEERVKLLADTLADWYALFTGKGWHDEWARQQWETHIAPLLQGSVLPQIPEDAEDVPKARRKYQDDLMERLSPLARSLAGNDSLCRKLHCLWATRWRENDVILRKRLRWLRDWILPRGRNAEGDPAIRHVGGLSLTRIATIKSLYQVQKAFHMRSEPEDPSRNNPSKGDDALLDFGRSILDVMEHMREQRVKQLASRIAEAALGIGRVKRLAGGKDPKRPRQRVDRPCHAVVIENLTHYRPEETRTRRENRQLMSWSSSKVSKYLAEACQLHGLHLREVQAGYTSRQDSRTGAPGVRCQDVPVSEFMQSPFWRKQVAQAEKKRAEGKGDARERFLCDLNEKWKGQPEADWKRAAAVRVPLKGGEIFVSADEKSPAAKGLQADLNAAANIGLRALTDPDWPGKWWYVPCDPTNFKPAKDKVAGSAAICLDKPLKNAPAAQDTDGPRKKRGKAEARSREVVNLWRDVSSQPISANDDWREFTPYWNEVQARVVNILRQSAGFARDQGER

SEQ ID NO: 297 - protein, 843 aa, unidentified
  REGION 1..843: note = Description of Unknown:uncultivated organism sequence
  REGION 1..843: note = Category: MG37 effectors
  REGION 1..843: note = Description: MG37-37 effector
MAQQPQVPVTQRAYTLRLSRAPGECAACHTDACDCWRDVLWATHEAVNRGTKAFGDWLLTLRGGLCHTLADMKVPAKGKKPARESTEEERRDRRVLLALSWLSVEDERGAPNGDGLRIATGRGTGDQRGKAVKAALHEILKKRGLNETEIESWLSDCGASLEARIREDAVWVNRSVCFDKAAKSVGDTLTREEVWDFLEPFFGTREAYFTGLSDSEEEEDESTREDEKAKDLVQKAGQWLSARFGTGAGADFNLMGGAYQKIAGWASRAASGNQGAKTMERLADCLELPSDSRDLNGVLGVISGPGYKSATRNHLKTMAGKPQVAQDDLDRLKELAEKDAAKCKENVGRKGRRPWSDRVLEDVEKACGFTYLQNDGPARHKEFSVMLDHAARRVSIAHSWIKRAEQRRREFEEDAKKRDALSTRAPEAVEWLDRFCADRSTATGASADSGYRIRKRAVEGWPHVVKAWSRPSCTTEDDRITAAREVQGDSEIEKFGDIQLFEALATAEAVCVWRNQDNEPDASILTDYAAATTAEHDQKRFKVPAYRHPDALRHPVFCDFGNSRWMIRFACHEATKARNGSKRSVKNDAESTQGRHGLRMGLWNGQSVDDVDLHWSSKRLTADLALDDHPDANAVKVTRGDRLGRAASGAVAHAAVMNVFEERDWNGRLQAPRAQLDRIARLEDDAKRAQAETLRRRLRWLVSFSPRLRPSGPFIEYAASHGIKPNRRGEYYPNAPANKGRERLGKLVLSRLPGLRVLSVDLGHRFAHPGTAPIPEGAMRADEPSLLAYLVSSGPYMLEGADQVDYAKPSGERPPPPGLGENGMALVRNPSWQASSDSLRPAY

SEQ ID NO: 298 - protein, 1469 aa, unidentified
  REGION 1..1469: note = Description of Unknown:uncultivated organism sequence
  REGION 1..1469: note = Category: MG37 effectors
  REGION 1..1469: note = Description: MG37-38 effector
MARKSESVADPPTAEAPLTQRAYTLRLRAVDPQDDSWRDALWATHEAVNKGAKVFGEWLLTLRGGLGHELAEPPPLPKGKTRSDDETAALQKSRRILLALSWLSVEDARGAPDGAIRIASGEDADSVRRDKVLATLRSVLAGRGVGQRAIESWISDCADSLSARIRDDAVWVNRSAAFDTKTKELRGLTHKYATETILSFFGPADDYFSLPDADADDGATLAAGDDDSKFKQKARQWISTNFGTGEKSDTGQIIESLRKLAKAELDRFARRPKAELIEAMSRKVHGPTPDFDGLRAGIGWSTGRPSKGRLAVEKLPDRPTKTDIEALQQKFAEEADDKESKSGARDVPKWMPGFRAFVEAAIGMPFVGSRNHIGEFSVMLDHAARRVSIGHSWIKRAEAERRRFEADAQRLGTVPADAAAWLDAYVRDRSGSAGGEYRIRRRAVEGWDEILKRWKRPTCASAEDRIAAAREVQADPEIDKFGDIQLFEALASDDALSVWRNGNDIAPDRLKDYVFAHDARFKQRRFKVPAYRHPDALRHPVFGDFGNSRWKVEYSVLEAAKAARGDRRISAQDAEWIENPRGIRMGLWNGDAVKDFDLWWSCKRLSADLALRQPAHNGQVRSVSRADRLGRAASGIKPGESPSPAGLFSQAEWNARLQAPRSQLTDLAAYLDRSDGRWDDRARKMRDRIAWLVTFSAKLECRGPFIDYAARHGITPNRKGEYYPNADRNKADKREGHAKLMLSRLPGLRVLSVDLGHRFAAACAVWETLSRAELKKEIAGRSVIDGGAGATDLYLHTRHTDCAGKERKTIYRRIGSDQLPDGSDHPAPWARLDRQFLIKLQGEESRARKASADEIETIRQMEIQLGYVREAHKPLPAQIDELLSEGVRLVRLGLRRHGDAARIAYAFHPEAARLTPGGGVEAHTPDTRQQAILDALIRWHGMAMSDRWSDPCAMDAWQTRIQPALTTELPALTPDADRWERNRFRTALEAALTPVATALSREGAETLHTLWSERWEADDAAWRPRLRQLRRMLLPRGLRPVAGDTDAQAAARKARRGAARHTGGLSLTRIATIRELYQVQKAYAMRPEPDNPRKNIPESNDDRFAEFGRSILEAVERLREQRVKQLASRIAEAALGVGRAPRTGDHDRKRPLSPVDAACHAIVIESLRNYRPDELQTRRENRALMNWSAGKVRKYLEEACQLHGLHLREVMPNYTSRQCSRTGLPGLRCDDVPIDEFLTAPWWNKAVNAAAKRLQENGNDSLDRLLVALRENRSGATTDSDKCSQRTLRLPRAGGDLFVAAPPSGDATKGRHRGALQADLNAAANIGLRALLDPDFPGRWWYIPCIEDKAAGTAVPRADKVKGSVCFGPDSSKPEQVGSLLKPGAGDSSDGQSRPARRQRNRRSNAEGKETTNFWSDPRAAALRNAKDGGFWLPTPAYWRWVRKRVVDALWEANGLGAPPADLVRDGRA

SEQ ID NO: 299 - protein, 1510 aa, unidentified
  REGION 1..1510: note = Description of Unknown:uncultivated organism sequence
  REGION 1..1510: note = Category: MG37 effectors
  REGION 1..1510: note = Description: MG37-39 effector
MARKTESAAEPPAPEAPLTQRAYTLCLRGTDTQDDSWRDALWATHEAVNKGAKVFGEWLLTLRGGLSHELAEPPPPPKGKKRRDDDAIAVRKHRRILLALSWLSVEDERGAPNGVFRVASGRESDSARHGKVLEAFKKILESRGIIGDEADSWVNDCTASLSSAIREDAVWVNRSAMFDAAVLKIGPSLTRDEVWDILEPFFGSREAYFAGVELTDEKSSAEEKAKDLVQKAGQWLSSRFGTGTGADFESMSKVYAAMAEWADAAPAFPSGADAIKNLAHSLADFRPATDDAGGILGLISGPGYKSATRNIVKNWESRTTVVTRDDLRKFAETATNDEHKSMANVGAKGRRPWSDRVLEQVEHACGFTYLQTGGPARHKQFSVMLDHAARRVSIAHSWIKRAEAERRRFEADAQRLGTVPADAAAWLDAFVQERSGSAGGEYRIRRRAIEGWDEVLKRWARSDCKTAEDRIAAAREVQADPEIDKFGDIQLFEALASDDALCVWKNGDNFTPDQLKDYVFAHDARFKQRRFKVPAYRHPDALRHPVFGDFGNSRWKVEYSALEAAKAARGGRRIGTEDADWLGNPRSVRLGLWNGDAVNDFDLRWSCKRLSADLALWQPAHNGQVRSVSRADRLGRAASGIKPDDSPSPAGLFSQAEWNARLQAPRSQLNDLAAYLDRNGGRWDDKAKRMRDRLAWLVTFSAKLECRGPFIDYAARHGINANRKGEYYPNADRNKADKREGHAKLILSRLPGLRVLSVDLGHRFAAACAVWEALPRHEFEQEIRGREIIAGGTGPEQLFCHTRYTDKAGKARTTVYRRIGSDTLPDGSEHPAPWTRLDRQFLIKLQGEDAPARKASPDEIKLVERLENELGRRRDDGLPLPRRVDDLMAEAVRTLRLGLRRHGRVAKIAYAFNPDCPGIPGMGGALKAIARGNDDHIKFLVNALADWHAMATDAAWDGSDARQLWNQHIKPVPNGFEVAESTRTEPNAERTTRQQRRKTEEELREKLRPIAEHFARASKESTRGIYEAWRDLWESKDGPKRTKSNFAHTLIHDQAGKVIGSRTAPKQGAPSPEGWHLRLRQTTDWITGRRPPGNISLSPGWKQHVGGLSLTRISTMRALYQLHKAFAMRPRPDKVQGAPERGESNAGTAQSILDAMERMREQRVKQLASHIAEAALGVGRMKQTDGRDRKRPRSPVDAPCHAIVIESLRNYRPDELQTRRENRALMNWSAGKVRKYLEEACQLHALHLREVMPNYTSRQCSRTGLPGMRCEDVPIDEFLSAPWWKKMVNAADKRLQDNGTDSQDRLLVELQKKWSIASDQEKRAQRTLRLPRAGGDLFVTAPPNRAATVEDRSQGALQADLNAAANIGLRALLDPDFPGRWWYIPCIEDKAARTAVPRADKVKGSTCFGPDPSKPEQFGSFLKPDAGDSPEGHPRPARRSGTRPSKADGKQTTNFWSDPSATALRNAQDGGFWLPTPAYWRWVRKRVVAALWQANGLDAPPADLVRDDQA

SEQ ID NO: 300 - protein, 1475 aa, unidentified
  REGION 1..1475: note = Description of Unknown:uncultivated organism sequence
  REGION 1..1475: note = Category: MG37 effectors
  REGION 1..1475: note = Description: MG37-40 effector
MARKTESVVETPAPEAPLTQRAYTLRLRGTDTQDDSWRDALWATHEAVNKGAKVFGEWLLTLRGGLSHELADQRVIEGKGASKKERDPTDDERRDRRILLALSWLSVESAPRDKDDPRKPFLIGAANGPTSREQALREALADILQKRGLSTPEIGDPNVEPENQPDTWLGQCGPSLAARIREDAVWVNRSAMFDAVTSGWQKQDARSDAHTLLSFILSDDFLTLPTAKKQQGKKNDKDPEASENESEQEERQKAVKASSRGAGQRTRHPFSHLLGEGKPFGKPQRTLSLRDQWHGYIKPKLEEVGIPVLDAKASNKGKRKDAAPAHTELQREMFSKAASRVAQIVTKQRQQEADRLARREADADLRMMENDAAYADALKALQEYCDEYRVMSGATGEFLIRPRAVTGWDRVVKRWAGITEANPDAAREARIEAVKEAQDADEEKKFGDANLFMRLADERYRPVWQINGNADRTILERFVKGMKARSDSKRLKVAAYRHPDPYFNPIFCQFGVSRPAIRFGRLKAFSDSPAANDLRAVGMLLWHPNKKCAQITVMHGVSRRLDREIGSACDQVQQDAGKLPSVSRRGRLGAAAAGLASADAPARVAGVFDLKKVKSRAKDDAKEEHEDEGSGNGKLKEPTWNGTLSTNRRDLAAIARLIANGDAQKAERRRQQLRWTLTVSMDMECRGPFIEYAARHGINANSKGEYYPNADRNKADRRKGHAKLILSRLPGLRVLSVDLGHRFAAACAVWDALPKADFEQEIKGREIIAGGTGPEHLFCHTQHKDAAGKQRTTIYRRIGCDNLPDDAKHPAPWARLDRQFFIKLQGEETPARKASPEETKLVERLERELGRRRDDGQRLPRRVDDLMAEAVRTLRLGLRRHGRVARIAYAFNPDCPGIPGMGGSLKAIERGSNDHIQFLVNALADWYALATDSVWNSSAARRLWNEHIKPVPNGFEIAQPTQPEPNAEPTTRQQQRKSEEALREKLRPIAEHFAGADKESTRGIHEAWKNLWEEQDGTGRSKGDFDHTLLRDQNGKVVGSRTRPKAGQETAGGWHEHLRRVTDWITGRRYPGEESPSNGWKQNVGGLSLTRIATMRSLYQLHKAFAMRPRPDKVQGAPERGESNAGTAQSILDAMERMREQRVKQLASRIVEAALGVGRMKQTDCRDRKRPRSPVDAPCHAIVIESLRNYRPDELQTRRENRALMNWSAGKVRKYLEEACQLHGLHLREVMPNYTSRQCSRTGLPGMRCDDVPIDEFLTAPWWNKAVNAAAKRLQENGTDSLDQMLVALREKWSKASDSDKRGQRTLRLPRAGGDLFVAAPPNGAATGQKPRRALQADLNAAANIGLRALLDPDFPGRWWYIPCIEDKAAGTAVPRADRVKGSACFGPDPSKPEQSGSLKPGAGHSSDEHSRPVRQQATSRSNADGQETTNFWSDPRATALRNAEDGSWLPTPAYWRWVRKRVVAALWKMNGLDA

SEQ ID NO: 301 - protein, 1481 aa, unidentified
  REGION 1..1481: note = Description of Unknown:uncultivated organism sequence
  REGION 1..1481: note = Category: MG37 effectors
  REGION 1..1481: note = Description: MG37-41 effector
MARRSASTSKPPGPVAPTTQRAYTLRLRRAPGKCPHCEQDACDCWREALWATHAAFNRGAKAFGDWLLTLRGGLSHELAEQPSPPKNKEPTCEESDAIRKNRRILLALSWLSVEDDCSAPTGTFRVASGKDSEAERKNKVLTAFRSILTARRMRSQDVESWIADCAASLSAKIREDAVWINRSACFDQRALDLKVLSREYAKAAVMSFFGPLDEYFKLPDEADDTKPAVGGDGPDFRTLARQWVSTNFGTGKKSDSEAIAQNLRKLADANLAPFSGKPKAALIAHLSVELDGSTADIDGLCRAIGWNTGRPSKGRVAIERLPDPPTETSIQTMQQKFREEAEAKASSKGLRQVPEWMPAFQKSIERDCGMPFKLGEGRDHIGEFSVMLDHAARRVSIGHSWIKRAEAERRRFEADAQRLNHIPAAAKDWLDQFVQFRSGSSGAAAAGGEYRIRRRAIEGWDEIIKRWKRAACKSPEDRVAAAREVQADPEIEKFGDIQLFEALAADDAECVWRGDGNGTPDPLKDYVAATDALDKMRRFKVPAYRHPDPLAHPVFGDFGNSRGDIRFAVHEAAKATRGTKRIAKDQKEWIRERHGLRMGLWDGQSVRTADLRWSSKRLVDDLALRNHVTTRRTGPVSRADRLGRAAAGLGADEAACVAGLFELPDWNGRLQAPRAQLDAIAACVAANGGKWDDKARKLRDRIEWLVSFSAKLECCGPFMEYASQNGIQPNGKGEYYPHAERNKGRTGHAKLILSRLPGLRVLAVDLGHRFAAACAVWEALSKIAFDAETKGREVVSGGRAADDLYCHTRHLDCAGKARTTIYRRIGPDKLPDGSDHPAPWARLDRQFLIKLQGEERPARAAGPAETAAVQQIETDLGRARGQEDLPPRPVDSLMREAVRTIRIALRRHGDAARIAYAFKPGAKRLKPGGGAQDHTPETHADAILEALLRWHELATGARWRDPWAETQWKDWVQPHISATLPELANDADRWERKRHRAALEQVLRPVAQMLIQRPTDALHQVWSKHWADEDLKWPSRLRWLRNWLLPRGPRARSGAARNVGGLSLLRIATLRELYQTQKAYAMRPEPDDPRKRIAGRNDDRYDELGRSVLQVIERLREQRVKQLASRIVEAALGVGRAKPTRGRQRPQSRVDVPCHAVIIESLRNYRPDELQTRRENRAIMNWSAGKVRKYLEEACQLHGLHLREVMPNYTSREDSRTGLPGVRCVDVPVDPKLGKPKAYWWNSVLSTARKKSIGDAASHDKQGDATSRFIVELAGCLDRLKADGKPLPKTVRVPRIGGDLFVAAPPTSCTAPAHQPHPACDGARALQADLNAAANIGLRALLDPDFPAKWWYVPCIDDQRGLALPRADKVLGSACFPGDPATFGSLLKTRTAAGPAVDGQAAPDRKPRTGTHRPGSAKSRSLGDGKATTNYWSDRSARDLRPADEGGHWQPTNVYWNWVRKRALLGLYSFNGLSPPSDDRP

SEQ ID NO: 302 - protein, 871 aa, unidentified
  REGION 1..871: note = Description of Unknown:uncultivated organism sequence
  REGION 1..871: note = Category: MG37 effectors
  REGION 1..871: note = Description: MG37-42 effector
MATAIQYPTTQRAYTLRLRGIDPQDQSWRDALWATHEAVNRGAKVFGEWLLTLRGGLDHQLADAPVKVRGGTTRLPSDEERRDRRVLLALSWLSVEDAHGAPRDASLIVAKGTDSADCRARKLADALIAILQARSVAASEIGDPSKPPEDQPGTWLGDCMGSLSAAIRDDAVWVNRSKAFDAATQSCPSLTRDEIWDFLEPFFAGAEAYLRPERAESDESESASEAAQEEKAKDLVQKAGGWLSKRMGAGGGANFQDLARAYQAIAQWASYAQPGQSGQQAVEVLAGYLSQHGFSPTANDATGVLSVIRGPGYKSATRNYIITAIAKSPAITAQNLSQLQELATKDNERCSSKIGGKGSRPYSNMILQHVEAACGFTYLQSDGAARHREFSVMLDHAARRANVAHSWIKKAEAERRQFESDARRIENVPQDALNWLRRYCEERGGASGSLEGYRIRRRAVDGWDKVVIRWSRSDCQSADDRIAAARQLQDDPEIDKFGDIQLFEALAAEEALCVWKPNGNPTAQPLKDFVAATEADAKKKRFKVPAYRHPDPLRHPIFADFGNSRWGIEYSAHRAPAQCDELRQKVDKLAAAVADAQRKLEGTKAAQRASRESKLAEAQSKLVAAQKEFAAISDPYRVELKLWNGRAVAAIPMRWSSKRLIADLSLRRATEPSSDQRIGVTRADRLGRAAGNADDGRPVTITGLFQQDHWNGRLQAPRAQLDAIAKHVDKHGWDAEARRQIARIRWVVSLSAELSQQGPWFEFCNRFGEDAPARPFVSRQGEYAVKHRDNDQRKGHAKLILSRLPGLRVLAVDLGHRYAAACAVWEAVTCEQMQHACQAAGTTSPDAQAMFVHLKCSNARGKTVTTIYRRI

SEQ ID NO: 303 - protein, 1505 aa, unidentified
  REGION 1..1505: note = Description of Unknown:uncultivated organism sequence
  REGION 1..1505: note = Category: MG37 effectors
  REGION 1..1505: note = Description: MG37-43 effector
MATENGKEQPNVTTQRAYTLRLSGLDKHDNTWRDRLWNTHEAVNKGAKAFGDWLLTMRGGLCHTLAEVDVPGIGKKPVCLPTRQEIKNRRIVLALSWLSVESFHGAPESLLVSHDLDMAAGERKNWKTIDALHEILRRRGLCEEQIDQWAIDCRDSLSAKIREDAVWVNRSKSFDLAKAKIRESLSREDIWDFLQPFFGNKYSYLKMKTAVTTTSEDFEADAEESKDESSEEKAKDLSQKAGQWLSSRFGTGTGADFSRFCEVYDAIANYCHNIQAGVSGTEVCGSLADALHEFSPRSMNINGILELISGPGYKSATRNVLQKINNLQSVSQLDLDRVHDASVKDAQQSREKVGGKGSRPYANAVLQDVEAACGITYHNTDNGPSHHWQYAVILDHAARRVSMAHSWIKRAEEERGKFEIEKDKLLRVPADARVWLDAFCTRRSSESGAIDSYRIRRSAIDGWKQVVAAWAALPTEAEDKDSVLPSAAESARIQKARELQDTIEKFGDIQLFEALSLPDAKCVWLTNGKPDAQPLMDYVAGTDAVSKKQRFKVPAYRHPDAFLHPVFCDFGNSRWSIDYAVHRAPEKLARAQQLLEKKKEELTRAEQALSKASDPSKRSSIEKKLKTLNVAFKQQEAEVLWLESHHAMTMGLWNGSRIEDTPLLWQSKRFGSDIGQAGAEHPLVASRADRFGRAVVMAKDNAPVVPSGLFDLADWNGRLQAPRRQLDAIAAIHDRTDLSVEEKRQLVAKRTRTIRWLVTFSAKLQSRGPFIAYAAQHGFDWRYGAHGIENKSREGLAKLVLCRLPGLRILSVDLGHRYAAACAVWETLSAAQMQNACLEAGMEVPSQRTLYSHLKHFVNGKEKKTIYRRIGADTLPDGSPHPASWARLDRQFLIKLQGEDSDARPATCDEVVAVEQLETELGYVRPIKRKGREHLVDELMSDALRTLRLGLQRHGTRARIAFNLTATKRTRPGGIQELLDQESRIGLLTETLLEWNELYAGERWADELAMDMWNKHIQPLLGGTILQETNNQDVTPSAAKRRMQREETRKKLRPVAKQIAENDSLCRQLNVLWNTRWQIEDAAWRMRLRWMRRWLLPRGINRDPQFRKSIRDVGGLSLIRIASFKSLYQVQKAYWMRPHPDDLRRNIPERGDSSLTSFGQRVLDAMERMRENRVKQLASRIAEAALGIGDETSVNAKNGRRKRPTERSNDPRFAPCHAVVIEDLTHYRPDETQTRRENRQLMSWSSSKVKKYLGEACQLNGLYLREVPPAYTSRQDSRTGAPGLRCNDVTVAEFYTSRFWRKQVEAAEKNQKDGKKGDARERYLLSIDERIRSEANDRDVFRIPVKGGEIFVSACGQDGGSNANRKAPPGLQADLNAAANIGLRAIFDPDWEGRWWYIPCDATTICPVAKKFNGCKAVDSSKPLRIVAEKVAVSSSSIDEKRSGRKGIALTDGSRIVNLWRDPSGAPIRRDVPSNSEWQDYAEYWNKVQSRVIANLRKSYGLREI

SEQ ID NO: 304 - protein, 1520 aa, unidentified
  REGION 1..1520: note = Description of Unknown:uncultivated organism sequence
  REGION 1..1520: note = Category: MG37 effectors
  REGION 1..1520: note = Description: MG37-44 effector
MAYQNGKEQPTVTNQRAYTLRLSGTNDQDSIWRNRLWHTHEAVNKGAKTFGDWLLTMRGGLCHTLAEADVPGKGNKPARHPTPQEIRSRRVVLALSWLSVESQHGAPERHLVSHDLDIATGERKNWKTVEALREILHGRCLCKELIDEWANDCRDSLSATIREDAVWVNRSKAFDLAAKKIGASLTREELWDFLQPFFANKHGYLQMDTVAGVTNGDSETDAEEAKEDSSEEKAKDLSQKAGQWLSSRFGTGTGADFSRFSKVYEVLAARCGSVAVGVSGVEAIRILAGTLADFSPGSNDIEGMLGLMSGPGYKSATRNILQKINTLQTVSQQDLDRLREASEKDALQSKQKVGGKGSRPYANAILQDVEAACGICYAGTGESPARHWQYAVILDHAARRVSMAHSWIKRAEEQRSKFEIEKDKLDHVPKDALAWLDAFCARRSSESGASDAYRIRRSAVDGWKQVVAAWAALPPKPENQGSELLSDAESARIQAARELQDTVEKFGDIQLFEALSLTGAKCVWQPDGRPDAQPLLDYVAGTDAISKKQRFKVPAYRHPDALLHPVFCDFGNSRWNINYAIHRAPEKLTPAQQLLEKKKAEIDKAELTLAKAGDAAKQANISEKINGLRAAFIQQQEKVAWLNSRHAMTMSLWDGTHIEDTPLIWQSKRFGSDIGQPVEAQPLPVSRADRFGRAVALAQDNVPVIPSGLFDLSDWNGRLQAPRRQLEAIAAIRDSAKLSVNEKQQLVAKRIQSIRWLLTFSAKLQSHGPFIAYAAQHGFDWRYGAHGPENKSRQGLAKLILCRLPGLRILSVDLGHRYAAACAVWETLNAGQIQKACLDAGKEAPGPCTLYLHLKQIANGKEKKTIFRRIAADTLPDGSPHPAPWARLDRQFLIKLQGEDRDARLATSEEIAAVEQMENELGVVRQLKRKGRELLVDELMSDALRTLRLGLRRHGVRARIAFNLTANKRIRPGGKEEVLDQEGRVLLLTETLLAWYELYTAERWTDEPARELWNRHIQPLLGATILQNTVNQEDTPSAAKRRKLREETSGKLKHVAEEIAKNDSLCRQLHVLWSAQWQTEDVIWRTRLRMMRRWLLPRGVKRNAQLRISIRDVGGLSLTRIASFKSLYQVQKAYQMRPHPEDPRLNIPERGDSRLENFGQRVLDAMERMRENRVKQLASRIAEAALGIGGETGISSKDGSQKKRPTERSSDPRFAPCHAVVIEDLTHYRPDETQTRRENRQLMSWSSSKVKKYLGEACELNGLYLREVSPAYTSRQDSRTGAPGLRCNDVTVVEFNNSPFWRKQVGAAEKNQKEGNKGDARERYLLSIEEGIRGAANDRDIFRIPVKGGEIFVSACITDGGNNAKKNAPPGLQADLNAAANIGLRAIFDPDWEGRWWYIPCDAATLCPDAKKFIGCKAVDPTKPLRVVAEEGAISASGIGSKKSGRKKNAATDGTRIVNLWRDPSGAPIHRDVLRSPEWQDYAGYWNEVQHRVIRNLKTCYEQTSQQEDPFVSQDADKPF

SEQ ID NO: 305 - protein, 1434 aa, unidentified
  REGION 1..1434: note = Description of Unknown:uncultivated organism sequence
  REGION 1..1434: note = Category: MG37 effectors
  REGION 1..1434: note = Description: MG37-45 effector
MDKQVAVTQRAYTLRLQGADPQDQSWREALWQTHEAVNKGARAFGDWLLTLRGGLDHTLADAKVKGGKGKPDRDPTNEERRDRRILLALSWLSVESAPKDGDTRKPFVTATGQDSQAIREEKVLCALRGILEKRGVRGADLEGWIKDCTPSLSAAIRDDAVWVNRSEAFDKAVDSIGSSLTRDEVWDMLERFFGSRQAYLAPAEGAEDESAEAEQEDKAKDLVQKAGQWLSSRFGTGKGADFSRMAAVYEKIADWAGKARAGMTGDAAVAGLAAALSEFSPASNDLQGVLRLISGPGYKSATRNLLNQFAARPSVAQEDLENLRDSACDDAEKCKANTGSKGQRAYADAILKDVESVCGFTYLQDGGPARHSEFAVMLDHAARRVSLAHTWIKRAEAERRRFEEDARRMDKVPASVKAWLDGFCLERSEASGALEPYRIRRRAVDGWKELVAAWSNADCRTAEDRIAAARALQDDPEIEKFGDIQLFEALADDEALRVWHKDGDSAKAPDPQLLIDYVLATDAEFKKRQFKVPAYRHPDALLHPVFCDFGNSRWDISFDVHEAVKTGGRNRKNMMVPQDPHALSMTLWTGSTVEPQRLRWQSKRLARDLALKGRQGSNAPEVTRADRLGRAAADVPARATVRIAGVFEQEDWNGRLQAPRAQLDAIAARVARHGWDDKARQMRDHLRWLITFSAKLQPSGPWLDYAAAFPDDAPAKPFVSRKGGYAVRHQDNDAREGHAKLSLSRLPGLRVLCVDLGHRYAAACAVWETLSATQVGDACRAAGREPPRDSDLYLHLKKKVKKQKKGTEVEVEETTIYRRIGADILPDGKPHPAPWARLDRQFLIKLQGEDREARKAGPAELEAVQRVEKEVGREPPDQRALRVDELMSETVRTVRLALQRHGRRARIAFNLTAHKKLLPGGREEVLTAEERIGLLADTLADWYALFTGKGWNDHWARQQWEAHITPLLQGAALPQMPHDAEDMPKARREYEADLMKRLSPVAKSLAGNESLRRQLHCLWATRWRDDDVTLQKCLRRLRDWILPRGRKAKADGAIRHVGGLSLTRIATIKSLYQVQKAFYMRPQPQDLRKNIPSKGDDALVGFGRRILDAMEHMREQRVKQLASRIAEAALGIGRVKRLAGGKDPKRPRQRVDRPCHAVVIENLTHYRPEETRTRRENRQLMSWSSSKVRKYLAEACQLHGLHLREVQAGYTSRQDSRTGAPGVRCQDVPVKQFMQSPFWRKQVAQAEKKRAEGKGDARERFLCDLNAKWNDKLEADWEKAGAVRIPLKGGEIFVSADRDSPAAKGLQADLNAAANIGLKALLDPDWPGRWWYVPCDPATFKPAEDKVAGSAAICLDKPLKNASVAQSTDRRVKKGGKTEARSREVVNLWRDVSSQPISADDNWREFAPYWNDVQARVVRILRQSAGLATDQEER

SEQ ID NO: 306 - protein, 1469 aa, unidentified
  REGION 1..1469: note = Description of Unknown:uncultivated organism sequence
  REGION 1..1469: note = Category: MG37 effectors
  REGION 1..1469: note = Description: MG37-46 effector
MEIPTTQRAYTLRVSGRDKNDHGWRNWLWRTHEAVNKGAKVFGDWLLTLRGGIDHSLADVKDESERTNRRIVLALSWLSVESQNGAPPKRFHVSADGTTDALAEILRLRKVSKPEIESWQRDCRASLTAATRLDAVWVNRSALFDEAAREIGKSLTRDEVWDLFDRFFGSRDAYFEGLATADEDDEEGGGAEEERAKDLAQKARGWLSNRFGSGSGADFSAIADEYDGFAKWCRWFHEHPKESIETSAKQLRKALRIDELPERLASTPGPPNRVQTTYQAIVAAISDGKRLPKEEYAELAEIADSQAEAKRKLVGRKDSKPWANKILDDVIEACRIPYRDTAAEADLINEYSVILDHAARRICMAHSWIKLAEANRQEFTKDARKLDELREYAPAAVSQLDNLCDERTKVTGAIEDYRIRRGAITDWERVVKSWSRKKCVTSADRIAAAREVQAEPENEKPGDIQLYELLAAENYLSVWKQGDKATHKTLQDYVAATDAQAKQRRFKVPAYRHPDPLLHPVFCDFGESRWSVDYSAHRAPAGRNNAHALLAKRTADLAKAREAMFKAKNAELRQKAQEKVSKLESAAAQALDDTQFMELRHGLRIKLFDGSCVDERDLVWHSKRLDSDLALRSDSSPGDELPIAVSRADRLGRAAAGANADAAVAVADLFKLKEWNGRLQAPRAQLNAIAAVRDRKRNKDLSMGDRKARVERMISRLQWLVTFSAKLQPQGPWLTFCQRLPEGFNYDPKKRRLYHKANKNRKGRAQIILARIPGLRVLSVDLGHRFAAGCAVWETLSSGDMKRACNEAGVPVPSTDDLHKVIKRDKRRTIYRRIAADRLPDGTPHPGPWVRLDRQFLIKLQGEESAARLGSPAEIAAVDRLEAELGYSRARPRTKAESSVDLLMAEAVRLVRLGIGRLKRRMRIAHQLTARQVAGMAQKKVKLDDAGRREVLTKTLRDWHDLATSRDWRDEFAVRTWQTHILPLVAGAELPEVPQLETGAARKKRLTAAEERLAPVAERLVARDVTTMREEWAHFVRAEKQLWQKRLRWLRDWLLPRKGRRNAASIRRVGGLSVLRIATLKELYQVQKAYRMLGDPDDPTKGIPQRGDDSLDRFGQRVLTAMERLRENRVKQLASRVIEAALGFGREPGSTGNKQNARSQSQTHEPCHAVVIENLKNYRPDESMTRRETRQLMAWASATVAKYLDEGCQLYGLYIRQVPAAYTSRQDSRTAAPGTRCQDVSVERFLRPHWAVVRSVNDLLPDAESAGMDFQERVTAAEKLVRSGKGNAEQRFLVELYQHSRKLPEQKRRGRSVRIPQRGGELFVSADRRSPIARGIQADLNAAANIGLKALLDPDWAGAWWYVPVDDRTYKPVEKSVAGSAALSISQALSEPPQRGDDEKERNKKKPSTRRGSSGDPQEIINLWRFVSAKELPKDKWFDYQQFQNIVRKSVIDILRAQAGIPEDRVGTQ

SEQ ID NO: 307 - protein, 1379 aa, unidentified
  REGION 1..1379: note = Description of Unknown:uncultivated organism sequence
  REGION 1..1379: note = Category: MG37 effectors
  REGION 1..1379: note = Description: MG37-47 effector
MKKWGKRIISGVIAASLLTAAAISGSEQGTGTVASVVQAGTETSFMGKLLEGGYIDAFTSWTQEEQNKFYDGLSPQQQSVFLEVTNCQITRELIKSERSKEELEQFFDRLQPYFLILKKGNQEKPDDEIVIECINQIEGTDYHSSEQYIKQLVSEKKDHYLEFYNALKLVKDGKLEIESAVDDFYKELGFLKKDRVPANSAEVSRQPVQVQKKAAVKAVSDGYSNFKAVSSLKALKDAVASVKKGEKIAVRVDKGFNVTSVIRTNGRHVKIYADGESGHNLNRTAGYKDVMLEVNGGSLTLGAYDGDGRAKNNLYINGKNIAASAPLIEVASGHLYLNKYSRIIDGYFLADFAGGAGIALNSGTSCYMFGGRIDNCRAKSSKDVSSSSPKSSHGGGVLVGNGSSFYMFAGSIEHCQSIHGGGIMNYGTLRLYGGAISDCAASNQKKDALGGAVKVQGAIETDGKVSSTKGDLGVWKYTRSAAWIVNGKDGYQQGTTTGVVLKNNQADAGGAICLNNGSNGAIQDCNINGNHSTGNGAGICLSNGSYKKGAALELKTGAVIHGNESKGYGGGIYCADSVKGSLSGGTMYDNSAKYGAGIYHEAEFRMSGGTVRSNHSGNSGGGIYAKGKLSMTGGEISANTAATYGGGAILKTAGGSVSGGSIKGNSASANGGGLQIDGTVSLSNASVSSNSASGKGGGISVSSSGTCNLSSGNVSGNTAKAGGGGIYIDGTCKANGSSFTGNQSSGDGGAVYIASGTFTTFQANQAVNIQGNSASGNGSGIYNRNITVLNNNAHILNNQCKNGTQRGIFHEGSLFSIEGNTEIQQEIYLAKDRFVTASNRYFSNSNSLKAKISLDTANIRNGYAVVKGNVSNSADGNYKTGEALLNNQSAGGRFVYAGSGYVMRPGNLKKSSSGCAPFSIVLSQAYQIRYDKNSKEEVMNMPTAAVKYWEEDIKLSALTPTGGSGSFVAWNTKADGTGDGYQPGNVYTANADATLFALWPHYRVEYLPGIRSAAGTTDSQEQNKSEEILLRKNGFRSSEGKFVGWKQDIYHAKKRAERESVGYAELREEKDRGKNDYLLEFSKQMRGMLTEKQLQNSNLLLDKDDIFILKALWDLKPNIILKDKQTFIENEKVDRKRILELIESCSDVEDGNLIENVKIINIKYGKTKNGWCPSEQNFPEGMNSTDVMDTYFMKLEKDESVDVEITFQVADSAGNITSAKGLVCVIYNNPPKLYSHNLAFYQEDISTKPQDILKEIQNNYNVEDIEDEKKGLKIPVSIINPSPLLIEQFNSVGKYKIVYQAVDSLGKKTNLESEVYIAENNPFKDSYKFSIRFINKKYLYTLKKESKWIKDQILNAQLTSQLEKTREDAVLRYKFKVSK

SEQ ID NO: 308 - protein, 1481 aa, unidentified
  REGION 1..1481: note = Description of Unknown:uncultivated organism sequence
  REGION 1..1481: note = Category: MG37 effectors
  REGION 1..1481: note = Description: MG37-49 effector
MPKQNKPPVTQRAYTLRLRGTDLNDQSWRDALWKTHEAINKGAKAFGDWLLTLRGGLDHSLVDTKVKGGKGNPDRDPTDEERKTRRILLALSWLSVESKLGAPENFIVASGEESAQDRNNKVIAALEEILKSRGVAENEIDQWKKDCSASLSAAIREDAVWVNRSKAFDEAVKSVAFSLTRDEVWDMLERFFKSPTAYLDPAKGSEHEYSETEKEEKAKDIVQNAGQWLSSRFGTGKGADFSRMAEVYEKIAVWAGNAQAGTTWNEAIRNLAAALSKFSPKTNDLQGVDGLISGTGHKSRTKNLLKVLAAKSEVTIQDLEILKNNAAEDARKCFQKKGSKGHLPYSDAILRDVESVCGFTYLQNGGPARHFEFAVMLGHAARRVSLAHTWIKRAEAERRRFEEDAKKMDNVPVKTKEWLDEFIRERSGFSGALEPYQIRRRAVDGWKEVVAAWSKAVCKTAEDRIAAARALQDDPEIDKFGDIQLFEALAADDALCVWHNEGNATNAPDPQPLIDYVLAAEAEFKKRHFKVPAYRHPDPLLHPVFCDFGKSSWDIKFAVHSFSKKRGRSNNRMTESNDLHAFSMTLWTGVRMQPVSLYWQSKRLARDLALGKYVRNEGAIAVTRADRLGRAASNTSNNDLVTIAGLFEQEYWNGRLEAPRRQLEAIARYVEKHGWDDQAEKMRDQIKWFVTFSAKLQPQGPWCAFAQKLRLSINPQYWPFADANKKRKAHAKLILSRLPGLRVLSVDLGHRYAAACAVWEALSSEEVLQACRAVGHEDPKESDLYLHLKKKVTKQKKGNPVEVEETTIYRRIGADKLPDGTPHPAPWARLDRQFLIKLQGEEEGVRQASNEEIWQVHQLEAALGRSKPLINRLISSGWGITKNQQSRIEALKKLGWCPPEQPESGDVSDADEEEITYKPPLSVDELMSSAVRTMRLALKRHGDRARIAHYLITDEKTKPGGVKEKLDANGRTEMLQDALVLWHDLFSSRSWRDDAAKQLWDEHIIKLTGDKLPEEIGEDASESERGKKKKENREKLHDAAKALAEDESLRKTLHDLWKTRWEEDDRQWKKHLRWFSDWVLPRGKAADDPAIRKVGGLSLTRLATLTEFRRKVQVGFFTRLHPDGTRAETKEQFGLSTLDALERMREQRVKQLASRIAEAALGIGSQDKRHWEGGNRPRRRINDPRFAPCHAVVIEDLTHYRPEETRTRRENRQLMTWSSSKVKKYLAEACQLYGLHFREIFAGYTSVQDSRTGAPGIRCQDVPVKEFMRSPFWRKQVKQAETKLSENKGDARERFLCSLNAMWKDKAVTDWERAGVVRLPLKGGEVFVSADPLSPAARGLQADLNAAANIGLRALTDSDWPGKWWYVPCESSSLRPVKEKVEGSPAVNPTQALPQSAQKQSDGAGAKKKRKGSGTGKPKEVVNLWRDVSSSPLDDPNAGEWKEYTAYQNEVQWRVVRILEEELKGRFQRLYEGAKEDGIPF

SEQ ID NO: 309 - protein, 1188 aa, unidentified
  REGION 1..1188: note = Description of Unknown:uncultivated organism sequence
  REGION 1..1188: note = Category: MG37 effectors
  REGION 1..1188: note = Description: MG37-50 effector
MPKQNKPPVTQRAYTLRLRGTDLNDQSWRDALWKTHEAINKGAKAFGDWLLTLRGGLDHSLVDTKVKGGKGNPDRDPTDEERKTRRILLALSWLSVESKLGAPENFIVASGEESAQDRNNKVIAALEEILKSRGVAENEIDQWKKDCSASLSAAIREDAVWVNRSKAFDEAVKSVAFSLTRDEVWDMLERFFKSPTAYLDPAKGSEHEYSETEKEEKAKDIVQNAGQWLSSRFGTGKGADFSRMAEVYEKIAVWAGNAQAGTTWNEAIRNLAAALSKFSPKTNDLQGVDGLISGTGHKSRTKNLLKVLAAKSEVTIQDLEILKNNAAEDARKCFQKKGSKGHLPYSDAILRDVESVCGFTYLQNGGPARHFEFAVMLGHAARRVSLAHTWIKRAEAERRRFEEDAKKMDNVPVKTKEWLDEFIRERSGFSGALEPYQIRRRAVDGWKEVVAAWSKAVCKTAEDRIAAARALQDDPEIDKFGDIQLFEALAADDALCVWHNEGNATNAPDPQPLIDYVLAAEAEFKKRHFKVPAYRHPDPLLHPVFCDFGNSRWDIKFAVHSFSKKRGLSKNSMTESNDLHAFSMTLWTGVRMQPVSLYWQSKRLARDLAFGKYVRNEGAIAVTRADRLGRAASNTSNNDLVTIAGLFEQEYWNGRLEAPRRQLEAIARYVEKHGWDDQAEKMRDQIKWFVTFSAKLQPQGPWCAFAQKLRLSINPQYWPFADANKKRKAHAKLILSRLPGLRVLSVDLGHRYAAACAVWEALSSEEVLQACRAVGHEDPKESDLYLHLKKKVTKQKKGNPVEVEETTIYRRIGADKLPDGTPHPAPWARLDRQFLIKLQGEEEGVRQASNEEIWQVHQLEAALGRSKPLINRLISSGWGITKNQQSRIEALKKLGWCPPEQPESGDVSDADEEEITYKPPLSVDELMSSAVRTMRLALKRHGDRARIAHYLITDEKTKPGGVKEKLDANGRTEMLQDALVLWHDLFSSRSWRDDAAKQLWDEHIIKLTGDKLPEEIGEDASESERGKKKKENREKLHDAAKALAEDESLRKTLHDLWKTRWEEDDRQWKKHLRWFSDWVLPRGKAADDPAIRKVGGLSLTRLATLTEFRRKVQVGFFTRLHPDGTRAETKEQFGLSTLDALERMREQRVKQLASRIAEAALGIGSQDKRHWEGGNRPRRRINDPRFAT

SEQ ID NO: 310 - protein, 1298 aa, unidentified
  REGION 1..1298: note = Description of Unknown:uncultivated organism sequence
  REGION 1..1298: note = Category: MG37 effectors
  REGION 1..1298: note = Description: MG37-51 effector
MPKQPKPPLTQRAYTLRLRGADSNDQSWRDALWQTHEAVNRGAKAFGDWLLTLRGGLDHSLADAKVKGKSGKPDRDPTDEERKARRILLALSWLSVESKLGAPAHCIIASGTEASEDRNRKVLAALEEILRSRGVGPDEIKAWKDDCSPSLCAAIRDDAVWVNRSKAFDEAVKSIGSSLTRDEVWDMLEHFFGGRDAYLAPAKGSEDESSETEQEDKAKDLVKKAGQWLSQRFGTGEGANFSRLAKAYEKIATWADQALSGMAGDKTMADLATALSEFNPPSNDLEGVLEQIKGRGHKSATRNLLSDIAAKATVTQQDLARLKDTATKDAQESKRKAGLKGQRPYSAAILKDVEYVCGFTYLQEGGRARHDEFAVILDHAARRVSLAHTWIKRAEAERRKFEEDAKKIGQVPKAAKDWLDQFCLERSGVSGALEPYRIRRRALDGWKEVVAAWSKSDCKTVEDRIAAARALQDDPEIDKFGDIQLFEALAADDAVCVWHKDGDAAKTPDPQPLIDYALAAEAEFKKRHFKVPAYRHPDALLHPIFCDFGNSRWDICFAVHTNVQTPSPRALSLTLWTGSEMKQVPLCWQSKRLARDLAFGQDARKDGASDVTRADRLGRAASNVGKSHVVNIAGLFKQKHWNGRLQAPRRQLEAIDRYVKKHGWDQKAENMRDAIQWSVTFSARLQPRGPWYAYAKEHGLREHPRYWPHAQENKKRKGHARLILSRLPGLRVLSVDLGHRSAAACAVWEAVTAEQVKEACQAAGQRKPEESDLYLHLKKKVTKQKKGKDVEVEETTIYRRIGADTLPDGTPHPAPWARLDRQFLIKLQGEEEGVREASNEEIWAVHQMEAALGRSVPLIDRLVASGWGATEKQKARLNTLRNLGWKPLEKAEAQEVPDGGEEMSFSPSLSVDELMSSAVRTMRLALKRHGDRARIAHYLITDEKTKPGGLKEKLDEHGRIDLLVDALVMWHGLFSSRGWRDDAARQLWDEHIAKLSGYKAPEEIGEPSSGPERRNQQKENREKLYEVAKALAQDKTLRGALHDAWKKRWEEDDGRWKRQLRWFKDWILPRGKHASNPTIRKVGGLSLSRLATLTEFRRKVQVGFFTRLHPDGTRAETQEQFGQSTLDALEHLREQRVKQLASRIVEAALGVGSEDKRHWDGKKRPRQRIADPRFAPCHAIVIEDLTHYRPEETRTRRENRQLMTWSSSKVKKYLAEACQLHGLHLREVSASYTSRQDSRTGAPGIRCQDVPVKEFMRSPFWRKQVAQAEAKQAENKGDARERFLCDLNAMWKDKTVAD

SEQ ID NO: 311 - protein, 1504 aa, unidentified
  REGION 1..1504: note = Description of Unknown:uncultivated organism sequence
  REGION 1..1504: note = Category: MG37 effectors
  REGION 1..1504: note = Description: MG37-52 effector
MPPGDHSPPVTQRAYTFRLRGPDPSDQSWRDALWKTHEAVNKGAKVFGDWLLTLRGGLAHTLVEARVKKKGNSKENGEDDREPTAEERKSRRILLALSWLSVESKLGAPEKFIVATGEEAAQERSRKVIGALKEILEKRGLTTSEIEQWENDCSASLSAAIRDDAVWVNRSKAFDEVVHRVGPSLTREELWDMLGLFFASPNAYLAPVTLSEEEPLGTEQEDKAKDLVKKAGQWLSSRFGTGKGADFSHIAGVYGKLAVWAHEAQAGMTGQQAIYNLIGALNEFNPSSNDLEGLLRLISGPGYKSATRNLLGQFNNKTAITQDDLKRLAETALADKVKCETNSRPKGERAYANSILHDVESACGFTYRVDKGEQPVPVSDYSHYANDYRWGPANHSEFAVMLDHAARRVSLAHTWIKRAEAERRQFEENAKKIDKVPKVAREWLDSLCAERSIVLGALEPYRIRRRAVDGWKHVVAAWSKSDCKTAQDRITAARLLQEDPEIDKFGDIQLFEALAEDHAVCVWQRDGEAGKTSDPQLLIDYALAAEAEFKKRHFKVPAYRHPEAFWHPVFCDFGQSRWKICFDVHKNRQSRRQRACANRISRKICFDVHKKRQTLRLSLEVWTGSKMLDMPLCWQCKRLARDLALGQDHKKDRSCQVTRADRLGRAVSNVARNQEVQILGLFEQEYWNGRLQAPRPQLEALGRYIEKHGWDAKAQKSCRAIRWMISFSPRLQPAGPWGKFAEKLQLNPNPKYWPHAEDNKDRGSRSKLILCRLPGLRVLSVDLGHRYAAACAVWEAVDAEQVKEACQAAGHREPNENDLYLHLKKRTTKQKKGSQGVVEETTIYRRIGADTLPDCTPHPAPWARLDRQFLIRLQGEEDEARAASNEEVWAVHKLEAELGRTIPLIDRLLGAGWGQTEKQKARLKALRELGWTPANKCQAFNSTDETELRRPSLAVDELMLDAVGTLRLALKRHGDRARIARYLITDERTKPGGVKEKLDENGRIELLQDALIIWHGLFSSPRWRDDAAKQLWNEHIAKLVGEQNLVEVSEDASGSERRTKQKQNREKLREAAKALVDDVALRQALHDMWKRRWEEEDREWRRRLRWFKDWVLPRREQARKAYSRPAETGSSSHPKRRARYAAIRRVGGLSLTRLATLTEFRRKVQVGFFTRLKPDGTKAEAKEGFGQSTLDALEHLRAQRVKQLASRIVEAALGVGRIRRFPGVKNPKRPDTPVDKPCHAIVIENLTHYRPEETRTRRENRQLMTWSSSKIKKYLAEACQLYGLHLREVTAAYTSRQDSRTGAPGLRCQDVPVKEFMRSLFWRKEVAQAEKKLTAGKGSSYERLLCELNQRWKDNSPGDGKRAELLRLPHKGGEIFVSAAPDSPAARGLQADLNAAANIGLRALTDPDWPGKWWHVPCNAVTFRPVEDKVKGSAAVKLDQSLRQVAHPQSKDPGAKKSKEIVNLWCDISSLPLEHREWKLDWEPYPAYWNNVQCRVIRVLQGKV

SEQ ID NO: 312 - protein, 1477 aa, unidentified
  REGION 1..1477: note = Description of Unknown:uncultivated organism sequence
  REGION 1..1477: note = Category: MG37 effectors
  REGION 1..1477: note = Description: MG37-53 effector
MPQQAKPPVTQRAYTLRLRGADPSDTSWRKALWQTHEGVNKGAKAFGDWLLTLRGGLDHTLADAKVKSGKGKPDRDPTDEERKGRRILLALSWLSVESERGAPEGYIIASGKEAAEDRNGKVVAALEDILKSRGLADTEIAEWKKDCSASLSAAIRDDAVWVNRSKAFDEAAKSVGCSLTREEVWDMLERFFGSREAYLAPAKGSEDDSSETEQEDKAKDLVQKAGQWLSSRFGTGTGADFRRMADVYGKIAAWADKAPAGMTGAKAIEDLATALRQFNPASNDLTGVLGLISGPGYKSATRNLLNQLAAQTTVTQQDLAYLKDKATDDAQKCKQNTGSKGRRPYSDAILKDVESVCGFTYLQKDGPARHSEFAVILDHAARRVSLAHTWIQRAEAERRRFEEDAQKMANVPGPVKDWLDSFCAERSQASGALEPYRIRRRAVDGWKDVVAAWSKSSCRTSADRIAAARALQDDPEIDKFGDIQLFEALAEDDAACVWHKEGDAAKSPDPQPLMDYVLASEAEFKKRHFKVPAYRHPDALLHPVFCDFGKSRWDICFDVHKNVQTPFPRAVCLTLWTGSEMKPVPLCWQSKRLARDLALGQGGQKDGTSEVTRADRLGRAASNVTKSAEVKISGLFEQADWNGRLQAPRQQLEAIAAVRDNLSLSDQERERRMSGMMDRIRWLVTFSAKLQPQGPWCEYAERHGLRTDPRYWPHADTNKDRKGHARLILSRLPDLRVLSVDLGHRYAAACAVWEAVNAEQVTEACRAAGHEAPKASDLYLHLKKKVTKQKKGKPVDVEETTIYRRIGADTLPDGAPHPAPWARLDRQFLIKLQGEEEEVREASNEEIWAVHQLEKELGRVTPLVDRLVTSGWGGTDKQKARLEKLKQLGWSPAKEDKPESDESSDDMESDGYKSSLSVDELMSSAVRTLRLGLKRHGDRARIAHCLVTDEKTKPGGIKEKLDENGRVDLLQDALVLWHDLFSSRGWRDDAARQLWDEHVAKLSGYKAPEEIVEESSGPERKKKQKENREKLYDVAKAMAQDMTLREALHDAWKKRWEEDDERWKKRLRWFKDWVLPRGKHASDPTIRKVGGLSLPRLATLTEFRRKVQVGFFTRLQPDGTRAETKEQFGQSALDALEHLREQRVKQLASRIAEAALGIGSEARKHCDQGKRPRQRIDDPRFAPCHAVVIEDLTHYRPEETRTRRENRQLMTWSSSKVKKYLAEACQLHGLHLREVSAGYTSRQDSRTGAPGIRCQDVPVKEFMRSPFWRKQIAQAEKKQAEGKGDARERFLRELNAMWKDKTVADWEKAGVIRVPVRWGEIFVSASRDSQGAKSLQADLNAAANIGLRALTDPDWPGKWWYVPCEPASFRPVKDKVDGSAVVNPDQALRRSAQAQSGDAAKDKKKRGNKGGGKSKEVVNLWRDISSSPLECIEFGEWKEYAAYQNEVQCQVIRVLKEQIEGRDKQPHEGSKEDDISF

SEQ ID NO: 313 - protein, 1011 aa, unidentified
  REGION 1..1011: note = Description of Unknown:uncultivated organism sequence
  REGION 1..1011: note = Category: MG37 effectors
  REGION 1..1011: note = Description: MG37-54 effector
MPQQPTTQRAYTLRLRGADPNETSWREALWQTHEAVNKGAKVFGDWLLTLRGGLDHALADTKVKGKKGKPDRDPSAEERKARRILLALSWLSVESKLGAPADFIIASGEETAEARNAKVIAALEEILRSRDVAEEAIGDVTKKPEDQPGTWIGDCAPSLTAAIREDAVWVNRSKAFDEAVKSIGSSLTREEAWDMLERFFGSRDAYLAPAKGSEDESSETEQEDKTKDLVQKAGQWLSSRFGTGKGADFCRMADVYKKIAEWADNAQADTTGNDAINNLAAFLSEFNPASNDLKGVLGLISGPGYKSATRNLLTQIAAKATVTQQDLARLKDTATEDARKCYQNTGSKGQRRYADSILKDVESVCGFTYLQEGGPARHSEFAVILDHAARRVSLAHTWIKRAEAERRKFEEDAKKIGQVPKAAKDWLDQFCLERSGVSGAQEPYRIRRRAVDGWKEVVTAWSKADCKTAEDRIAAARALQDDPEIDKFGDIQLFEALAEDDAVCVWHKDGDAAKTPDPQPLIDYALAAEAEFKKRHFKVPAYRHPDALLHPIFCDFGKSRWDICFDVHKNTKTPFPRTLCLTLWTGSEMVSVPLCWQSKRLARDLALDHGRQDLGSPKVTRADRLGRAASNVTENDEVKIAGLFEQADWNGRLQAPRQQLEAIARYVAKNGWDEKAKKMRDAIQWLVTFSAKLQPNGPWCAYAEEHNLNKDPQYWPHADTNKDRKSHARIILSRLPGLRVLSVDLGHRYAAACAVWEALSDKAFKEDLEGKKIIRGGTSDNSLYCHTEHEVNGKKHITIYRRIGADTLPDGTPHPAPWARLDRQFLIKLQGEEEGVREASNEEIWQVHQMECTLGRKTPLIDRLVAAGWGSTEKQKARLDALKNLGWKPVEKAETSEDADTEEEELSFRPSLSVDELMSSAVRTMRLGLKRHGDRARVAYYLITDEKTKPGGIKEKLDENGRIDLLQDALVIWHDLFSSRGWRDDAAKRLWDENIARLCGYKAPEEIGENA

SEQ ID NO: 314 - protein, 1461 aa, unidentified
  REGION 1..1461: note = Description of Unknown:uncultivated organism sequence
  REGION 1..1461: note = Category: MG37 effectors
  REGION 1..1461: note = Description: MG37-55 effector
MPQQPTTQRAYTLRLRGADPNETSWREALWQTHEAVNKGAKVFGDWLLTLRGGLDHALADTKVKGKKGKPDRDPSAEERKARRILLALSWLSVESKLGAPADFIIASGEETAEARNAKVIAALEEILRSRDVAEEAIGDVTKKPEDQPGTWIGDCAPSLTAAIREDAVWVNRSKAFDEAVKSIGSSLTREEAWDMLERFFGSRDAYLAPAKGSEDESSETEQEDKTKDLVQKAGQWLSSRFGTGKGADFCRMADVYKKIAEWADNAQADTTGNDAINNLAAFLSEFNPASNDLKGVLGLISGPGYKSATRNLLTQIAAKATVTQQDLARLKDTATEDARKCYQNTGSKGQRRYADSILKDVESVCGFTYLQEGGPARHSEFAVILDHAARRVSLAHTWIKRAEAERRKFEEDAKKIGQVPKAAKDWLDQFCLERSGVSGAQEPYRIRRRAVDGWKEVVTAWSKADCKTAEDRIAAARALQDDPEIDKFGDIQLFEALAEDDAVCVWHKDGDAAKTPDPQPLIDYALAAEAEFKKRHFKVPAYRHPDALLHPIFCDFGKSRWDICFDVHKNTKTPFPRTLCLTLWTGSEMVSVPLCWQSKRLARDLALDHGRQDLGSPKVTRADRLGRAASNVTENDEVKIAGLFEQADWNGRLQAPRQQLEAIARYVAKNGWDEKAKKMRDAIQWLVTFSAKLQPNGPWCAYAEEHNLNKDPQYWPHADTNKDRKSHARLILSRLPGLRVLSVDLGHRYAAACAVWEALSDKAFKEDLEGKKIIRGGTSDNSLYCHTEHEVNGKKHITIYRRIGADTLPDGTPHPAPWARLDRQFLIKLQGEEEGVREASNEEIWQVHQMECTLGRKTPLIDRLVAAGWGSTEKQKARLDALKNLGWKPVEKAETSEDADTEEEELSFRPSLSVDELMSSAVRTMRLGLKRHGDRARVAYYLITDEKTKPGGIKEKLDENGRIDLLQDALVIWHDLFSSRGWRDDAAKRLWDENIARLCGYKAPEEIGENASGVERKTKQKENREKLHGVAKALAQDVTLRKALHDAWKKRWEEDDGRWKKQLRWFKDWVLPRGKHASDPTIRKVGGLSLTRLATLTEFRRKVQVGFFTRLHPDGTRAETGEKFGQSALDALEHLREQRVKQLASRIVEAALGIGRMKRPAKGKDPKRPEVRVDEPCHAIVIEDLTHYRPEEVRTRRENRQLMDWASSKVKKYLSEACQLHGLHLREVSAAYTSRQDSRTGAPGIRCEDVPVKDFLNLPFWKKEVKSAESKDDAQSKYFIALCEKASVMTEEEKKKTSFRIPRRGGEIFVSADETSPASKGLQADLNAAANIGLRALTDQDWPGKWWYVPCDPVSFLPVKDKVEGSKAVKLDQPLLAQEQSGDGAKDKKKRGKKGAGKSKEVVNLWRDVSSREISPEDVAWEYYSAYQNKVQSRVISILKEQMKDRDRQPHEGSKEDDIPF

SEQ ID NO: 315 - protein, 1284 aa, unidentified
  REGION 1..1284: note = Description of Unknown:uncultivated organism sequence
  REGION 1..1284: note = Category: MG37 effectors
  REGION 1..1284: note = Description: MG37-56 effector
MPSRTSPRAYTMKLAPVSSAGADDWQLPLVRTHEKFNAAVRYWADFLLTLCGGFRPADVPAPEGDGQDRMQTRYRRIFLALSWLRVESQDPLNEDYRVRPDQLRDMLAEILTDRGLDAQVIGSWQEECSQIFSSPIRPEACWVNRARMFDERFRGLSDAERAQIFSDVIFRFVGADVYWAPPEEDAGGRARNDYIKPARAWLSERTGTGKGRDFARIAENKERIAGWAATAPAGLGIQQLRQDLAAAMGWETSLEAFRNGITHVQSNGPPPRSVRLLRDLADGMPIDLRELEKACREEADRDRKKVGRKGRTPWAERLWAEYCTRIQAPLQIDFNAPALSEAAIRVFSNWSWIKRSVSEREQASSGRELISQVPLEARTFLDEYCQRRAEETGAIAQFRIRRRAIAGWEDIVRAWSQEACRTLDDRQAAVAAAQADTPESFGDARLFLDLAADQARCVWQPYGTPDHHILVRYVQAREAEAVYMARKVPMFRHPDPWRHPAFVQFGNSRPRVRYVRPADSPDGRGLVELQLVDAGSGKLRYVRFRWRSKRVLKELLGADQGQVSTGAPPVPRIHRLALAAAGIASPEHASVKVFEGKAEWNARLQFPRGRHGRSTPGRSWLLTLSAQLSPLQKAAPAPATDPRGQGARLRFSRQPEGLRILGVDLGQKAAAACAVWETVSRESLERECRLRRVCAPSPEDLHFEIPDECGRQRHYRRIASDFLPDGQTPHPSPWARLERLFLIRLPGEDEAARPLLKHENEEIARFGGQIGFGPLRERRVDKQMRHCLREARLYLRRLGNLAKLSWDLQHSEWGRSAERWLDLARTDTPLGRWSAQMWREATGEPPPVGGAGGRAGSSPPADASRLLEARLAGKGAIWAETVAARFEEERQLARELVRWLRRWVAPQGTRGKANRSVGGVSMLRINNLTDLYRVEKMWATLPQPDLKDSRTVPQEFCAKLLLIRDQLRETRVRLIASRILEAAVGLGMEPERRKGEPLARRLAAPPPDPRHRRCDVIAIENLSGYGTSDSRPRRENRGLMNWSKERIRKRLLEGAELLGLRVEEVLPNYTSRQDFRTGAPGIRGRMVKAGRLAQLKTWERLLQRAADRNDPVAQYVRTLASNLERIPDSAMVFVPEDGGDIFVPDTDASPAGGIHADMNAAANIGLKAVLDPDWAGAWWYVPVRPDTGRPDTAERLRGCRAPGLDRMRVDLPGSGDPIRNAWRHPSSQPLHLSQWQPYAEYWENVKRAALRRQLERLFSSPSFAASPTGPRTWPAAPLTDPSQL

SEQ ID NO: 316 - protein, 1142 aa, unidentified
  REGION 1..1142: note = Description of Unknown:uncultivated organism sequence
  REGION 1..1142: note = Category: MG37 effectors
  REGION 1..1142: note = Description: MG37-57 effector
MSQQTQLPPTQRAYTLRLRGTDFFDWSWRDALWHTHEAVNRGAYKFGDWLLTLRGGLDHSLANARGKGKSKDNQSVCELTNEERRTRRILLALSWLSVESMLGAPEQFIVATGQEAAKDRSAKVIKALEGILSKRGLEEKEIEEWKNDCAASLSADIRDDAVWVNRSEAFDEAVKRIGSSLHREEVWDMLERFFGSRNAYFAPAKNAESENESGKAQQEEKAKDLVQKAGQWLSSRFGTGKGANFSRMAKVYGKIVGWADMAPQNVNGSNAIASLAESLSEFTPAPNDLPDVLGLISGPGYKSATRELLKKIADKDNVTQADIEALRKKAASDVEKCNQNTGSKGQKAYSDAILNDVECACGFTYLQKGDSARHSEFAVMLDHAARRVSLAHTWIKRAEAERSKFEEDAKKINQIPKPAKDWLDQFCLERSGALGALEPYRIRRRAIDGWKEVVTAWSKKDCKTTEDRIAAARALQDDPEIDKFGDIQLFEALAADDAQCVWLKDDGTPNPQILIDYTLATEAQFKKRIFKVPAYRHPDPLLHPVFCDFGCSRWKIDFSMREAATKLSVVEAKLKKKQVAVQNAEQLLEKCRGQGERQNKAEERLREAQEELQKVQRELEYLRSPQLLKMTLFNSTELKEYVLGWQSKRLFKDLVVEKQASNDNSKKITRADRLGRAAGNASVDSPIEILHIFEEQEWNGRLQAPRQQLEALARYVKKHGWDSKAEKMRDNIKWLITFSARLQPQGPWCEYAREKNSFGLKDDPKFWPHTATNKTRKGLAQIILSRLPGLRVLSVDLGHRYAAACTVWESLSTEVFRKDIEGRKILCGGTDANALYCHTEHETNGKKHTTIYRRIGADTLPDGTPHPAPWARLDRQFLIKLQGELEGTREASNKEIWTVHQMEAAFGRAQPLIDRLVAAGWGNTEKQKSRLEALKNLGWVSVSQNEILGELDVEEQTNRYEPSLSVDELMLSAVRTLRLGLKRHSDRAKIAHYLITDEKTKPGSVKEKLDENTRIELLQNALVIWHNLFSSRAWNDGAAKKLWDEHIVKLSGHTTPDDISEDSPENKGTIKQKEKQKKLYDVAKALSQELAIRKFLYNAWRKRWEEDDEMWKKELRWFKDWVLPPAKILLVRKSSVVYSFSG

SEQ ID NO: 317 - protein, 1479 aa, unidentified
  REGION 1..1479: note = Description of Unknown:uncultivated organism sequence
  REGION 1..1479: note = Category: MG37 effectors
  REGION 1..1479: note = Description: MG37-58 effector
MSQQVKPPVTQRAYTLRLRGIDPSDTSWRKALWQTHEGVNKGAKAFGDWLLTLRGGLDHTLADTKVKGGKGKPDRDPTDEERKARRILLALSWLSVESKLGAPVGFIIASGTEAAEDRNRKVVAALEEILKSRNVATNEIDQWKNDCSASLSAAIRDDAVWVNRSKAFDEAVKSIGSSLTREEAWDMLERFFGSRDAYLAPAKGSEDESSETEQEDKAKDLVQKAGQWLSSRFGTGKGADFCRMANVYGKIAAWADNAQADTTGNDAINNLAAALNEYSPEPNDLKGVLGLISGPGYKSATRNLLNQLAAKATVTQQDFVSLKDKASNDAQKCKQNTGSKGPRPYSDAILKNVESVCGFTYLQDGGPARHSEFAVILDHAARRVSLAHTWIKRAEAERRKFEEDAKKIDQVPKAAKDWLDSFCLERSGASGALEPYRIRRRAVDGWKEVVAAWSKADCKTAEDRIAAARALQDDPEIDKFGDIQLFEALAEDDAVCVWHKDGDAAKPPDPQPLIDYALAAEAEFKKRHFKVPAYRHPDALLHPVFCDFGNSRWDICFDVHKNVQTPFPRALSLTLWTGSGMVSVPLCWQSKRLARDLALGQNAQNDGSSEVTRADRLGRAASNVTKSDEVKISGLFEQEDWNGRLQAPRQQLEAIAAVRDNLSLSDQERERRMSGMIDRIRWLVTFSAKLQPQGPWCEFAEKIQIGINPQYWPHADTNKDRKGHARLILSRLPGLRVLSVDLGHRYAAACAVWEAVNAEQINVACRAAGHREPKASDLYLHLKRKTTKQKKGDQVEFKETTIYRRIGADTLPDGTPHPAPWARLDRQFLIKLQGEEEGVRAASNEEIWAVHRLEVELGRTAPLIDRLVKAGWGQSGKQKTRLDALRNLGWAPANEVQGSDEMDEGEVHKPSLSVDELMSSAVRTMRLALKRHGDRARIAFAMTAAYKPMPGDRKYYFTEAKDASANEDATARNGKHIEFIQDALLLWYGLTSSRGWRDDAARQLWDDHIAKLSVYKAPEEIGEDASGVERKTKQKENREKLHDVAKALAQDVNLRKVLHNAWKKRWEKDDERWKKQLRWFKDWVFPRGKHASDPAIRKVGGLSLPRLATLIEFRRKVQVGFFTRLQPDGTRAETKEQFGQSALDTLEHLREQRVKQLASRIVEAALGIGRVRRPLGGKDPKRPDVRVDEPCHAIVIEDLTHYRPEETRTRRENRQLMTWSSSKVKDYLSEACQLHGLHLREVSASYTSRQDSRTGSPGIRCQDVPVKEFMRSPFWRKQVAQAEKKGDAHERFLCELNAMWKDKTVADWEKAGAVRVPLKGGEVFVSADRISPSAKGLQADLNAAANIGLRALTDPDWPGKWWYVPCEPASFRPAKDKVDGSAVVNPGQPLRQSAQAQSGDAAKDKKKRGNKGAGQSKEVVNLWRDISSSPLECIECGEWKEYAAYQNEVQYRVIRILEEQIKGRDRQPHEGSREDDIPF

SEQ ID NO: 318 - protein, 1518 aa, unidentified
  REGION 1..1518: note = Description of Unknown:uncultivated organism sequence
  REGION 1..1518: note = Category: MG37 effectors
  REGION 1..1518: note = Description: MG37-59 effector
MTELQTQRAYTLRLKGIDEKDQSWRDALWKTHEAVNKGAKVFGDWLLTLRGGLDHTLADAEIPGEKGKPDRAPTQEERKHRRILLALSWLSVESERGAPEEFIVATGKEPAATRNDKVIAALKDILRGRNLTEEKISEWTEVCTPSLSAAIREDAVWVNRSRAFDEAVKRIGSSLTREEVWDMLECFFGSRNAYLAPVKISEDESSDGEQEEKAKDLVQKAGQWLSSRFGTGEGADFAKMAAVYAKIAAWAGNAQAGTTGNEVINNLATALREFTPKSNDLKGVLDLISGPGYKSATRNLLKQIANTKTVTREDISKLQETAGEDSEECATKTGSKGKRAYADAILKDVESVCGFTYRIDKDGQPVSVADYSKYDEDYKWGSSRHKEFAVMLDHAARRVSLAHTWIKRAEAERRKFEEDSKKIMQVPQAAKDWLDAYCAQRSEASGALEPYRIRKRAIQGWKEIIASWNKPDCKTAEDRIAAARQLQDDPEIEKFGDIQLFEALAEDDAQCVWKKEDGTLDPEILINYTLASEAMFKKQHFKVPSYRHPDAFLYPVFCDFGNSRWELDFSIREAATKLKEIEAKIEKQRQEVHKVQQALEKCENDEKRPKMEERLKEAQKKLQESQNYGEYLHSNNKITMVLFDGTFVKKHIFAWQSKRLTKDLALYQEPSADPKNVVSRADRLGRAVASVGINDAVKVAGLFEQENWNGRLQAPRQQLEAIAQYVEKHGWDNKAEKMRASIKWFITFSAKLQSKGPWNEFARKHGLKEDPHYWPHAEKNENRTAHSRLILSRLPGLRVLSVDLGHRYAAACAVWEALGSEAFKKDIEGKRIIRGDTDENALYCHTEHEANGKKHITIYRRIGADTLPDGAHHPAPWARLDRQFLIKLQGEDEQAREASNEEIWKVHQLENTLGRRTPLIDRLIAGGWGYTEKQKARLEVLTNLGWCPTNKTDNQEEGDEEETAILSKPSLLVDDLMFSAVRTLRLALKRHGDRARIAHYLITDEKTKPGGVKEKLDKNGRVELLLDALGLWHDLFSSPGWHDEKAKQLWNAYIAGLLPEGELQQAKSVTTSAALGGQQKKEKKEKLRAVAEALYLNSDLCHSLNEVWRKRWEEDDKQWRIYIRWFKDWIMPRGANAKSPAIRHVGGLSLTRLATLTEFRRKVQVGFFTRLHPDGTKTETREDFGQKTLDTLEHLREQRVKQLASRIVEAALGIGSEDKRHWDGKKRPRQRIADPRFVPCHAVVIENLTHYRPEETRTRRENRQIMEWASSKVKKYLSEICQLHGLHLREVSAAYTSHQDSRTGAPGIRCQDVSLIEFMKSPFWRKQVAQAEKKQKEGKGDAVERYLCELNQKWKGASEEEWRKAGFVRIPLRGGEIFVSAAGHDSPAAKGIHADLNAAANIGLRALLDPDWSGKWWYVPCNSSTMCPARDKVTGSAAVNPGQPLQVSAQLESDDAAKDTKKRKKKGDGKSKEIINLWRDISSYPLEDTRGGTWSNKTVYWNRVQSNVVHILQNQMKG

SEQ ID NO: 319 - protein, 766 aa, unidentified
  REGION 1..766: note = Description of Unknown:uncultivated organism sequence
  REGION 1..766: note = Category: MG37 effectors
  REGION 1..766: note = Description: MG37-60 effector
MVTGARWPLSPKKSLSDLSAVRGQDHILSRIPGLRVLSVDLGHRYAAACAVWEAISTRQFQQNIEGKKILRGGTDAESLYCHTEHTTDGKKHTTIYRRIGADTLPDGTPHPAPWARLDRQFLIKLQGEEEDSREASNEEIWQVHQMEVELGRRTPIIDRLVASGWGTTERQKARLATLKNLGWKPVEVAGAQEDADAEEEETSFRPSLSVDELMSSAVRTMRLALKRHGDRARIAHYLITDEKTKPGGIKENLDENGRIELLQDALVIWHDLFSSRGWRDDAAKRLWDEHIARLCGYKAPEEIGENASGVERKTKQKENREKLHGVAEALAQDVTLRKALHDAWKKRWEGDDGRWKKQLRRFRDWVLPRGKHASDPTIRKVGGLSLPRLATLTEFRRKVQVGFFTRLHPDGTRAETKERFGQSALDALEHLREQRVKQLASRIAEAALGIGRMRRPVGGKDPKRPDVRVDEPCHAIVIEDLTHYRPEETRTRRENRQLMTWSSSKVKKYLAEACQLHGLHLREVAASYTSRQDSRTGAPGIRCQDVPVNEFMRSPFWRKQVKQAEAKQAENKGDARERFLCDLNTMWKDKTVADWEKAGVIRVPVRGGEIFVSASQDFQGAKSLQADLNAAANIGLRALTDPDWPGKWWYVPCEPASFRPVKDKVDGSAVVNPDQPLRQSAQAQSGDAAKDKKKRGDKGAGKSKEVDNLWRDISSSPLEWIEFGEWKEYAAYQNKVQSRVIRILEEQIKGRDKQPHEGSKEDDIPF

SEQ ID NO: 320 - protein, 758 aa, unidentified
  REGION 1..758: note = Description of Unknown:uncultivated organism sequence
  REGION 1..758: note = Category: MG37 effectors
  REGION 1..758: note = Description: MG37-61 effector
NRHSYLEMDTVASATNGDSETDTEESKAASSDEKAKDLSQKAGQWLSSRFGTGPGADFSRFSKVYEVLATACRSIAPEVSGVEAINRLAIAIKKCSPSSNDIEGILGLISGPGYKSATRNILQQINRLQSVSEQDLSRLCDACEKDASQSRQKVGGKGSRPYADAILQDVERTCGICYARTEDHPSRHWQYAVILDHAARRVSMAHSWIKRAEEQRSKFEIEKNKLLRVPRDALAWLAAFCAKRSSDSGANDAYRIRRSAVDGWKQVVAAWAALPAKSEIAGSELRSDAERARIQVARELQDTVEKFGDIQLFEALAIREAKCVWMPDGKPDAQPLLDYVFGTDAIAKKQRFKVPAYRHPDAFLHPVFCDFGNSRWSIDYAVHRAPGKLTKARQLLEKKSAEISKAELALGKMDDALRHAAISETLQNLRAAYKQQQAEVAWLKTLQAITMGLWDGNGIQDTQLLWRSKRFGANIGQPDAVHPSPVSRADRFGRAVALAEDNVPVIPSGLFDLPEWNGRLQAPRRQLEAIAAMRDSAKLSAGEKQQLVAKRIHSIRWLVTFSAKLQSHGPFITYAEQHGFDWRYGMHGFENKSRQGLAKLILCRLPGLRILSVDLGHRYAAACAVWETLSTGQIQKSCGVAGMEAPGPRTLYLHLKQIVDGKEKKTIYRRIGADTLPDGSPHPAPWARLDRQFLIKLQGEDRDARPATSEEIAAVEHMENELGVVRQLKRKGRELLVDELMSDTLRTLRLGLRRHGER

SEQ ID NO: 321 - protein, 952 aa, unidentified
  REGION 1..952: note = Description of Unknown:uncultivated organism sequence
  REGION 1..952: note = Category: MG37 effectors
  REGION 1..952: note = Description: MG37-62 effector
PAYRHPDPLLHPVFCDFGCSRWQICFDVRKNVRTTSPRRLCLTLFTGSGMELVPFSWQSKRLARDLALEQRHRNPEASEVTRADRLGRAAAGVSAGGAVSIKNIFNEENWNGRLQAPRSQLAAIAARVDKHGWDAKALRMLDRLRWLITFSPRLEPTGPWIEYALRIPDDAAAKPFLSRKNGFAVLHRSNDDRKGLAKLILSRLPGLRVLSVDLGHRYAAACAVWETLSADQVREACQAAGHDGPTECDLYLHLKKDGRTVIYRRIGADTLSDGTPHPAPWARLDRQFLIKLQGEEHKAREASNAEIWAVHQMEAALGRSVPLIDRLVASGWGQRTEGQRARLEALKQLGWRPVTKKSASDDESQWQAACHEGVTPEAEKSASDDEYKPSLSIDELMSSAVRTMRLALKRHGDRARIAHYLITDEKTKPGNVKEQLDENGRIELLQDALVLWHDLFSSKGWQDNKAKELWYVHIATLPEYKAFQSSGEGHAGPERRGKPEEDREKLGVVAQALAPNVTLREALHNAWKKRWEEDDARWKALLRWCKDWILPRGEAANSPAIRKVGGLSLIRLATLTEFRRKVQVGFFARLRPDGKKAETGEKFGRKTLDALEELREQRVKQLASRIAEAALGIGKEHVFPTAKEPQKKCWCGSVHRKKDPKRPRERVHSPCHAVVIENLTHYRPEETRTRRENRQLMSWSSGKVKKYLAEACQLNGLHLREVNAAYTSRQDSRTGAPGIRCQDVPVKEFMRSPFWREQVAQAKKKQAEGKGDARERFLCDLDEQWKNRSEDEWKKAGPVRVPLQGGEIFVSADGTSPAAKGLHADLNAAANIGLCALTDPDWPGRWWYVPCDPASFKPIKDKVEGSAAVKPDQALRQPAQAQRGDAARDRKKRGKVGGRSREVVNLWRDVSSRPISPNDSWQEFTPYWNDVQARVVNILRQSAGLTRGQGEP

SEQ ID NO: 322 - protein, 1018 aa, unidentified
  REGION 1..1018: note = Description of Unknown:uncultivated organism sequence
  REGION 1..1018: note = Category: MG37 effectors
  REGION 1..1018: note = Description: MG37-63 effector
PESARIQKARELQDTIEKFGDIQLFEALSLPDAKCVWLTNGKPDAQPLMDYVAGTDAVSKKQRFKVPAYRHPDAFLHPVFCDFGNSRWSIDYAVHRAPEKLARAQQLLEKKKEELTRAEQALSKASDPSKRSSIEKKLKTLNVAFKQQEAEVLWLESHHAMTMGLWNGSRIEDTPLLWQSKRFGSDIGQAGAEHPLVASRADRFGRAVVMAKDNAPVVPSGLFDLADWNGRLQAPRRQLDAIAAIHDRTDLSVEEKRQLVAKRTRTIRWLVTFSAKLQSRGPFIAYAAQHGFDWRYGAHGIENKSREGLAKLVLCRLPGLRILSVDLGHRYAAACAVWETLSAAQMQNACLEAGMEVPSQRTLYSHLKHFVNGKEKKTIYRRIGADTLPDGSPHPASWARLDRQFLIKLQGEDSDARPATCDEVVAVEQLETELGYVRPIKRKGREHLVDELMSDALRTLRLGLQRHGTRARIAFNLTATKRTRPGGIQELLDQESRIGLLTETLLEWNELYAGERWADELAMDMWNKHIQPLLGGTILQETNNQDVTPSAAKRRMQREETRKKLRPVAKQIAENDSLCRQLNVLWNTRWQIEDAAWRMRLRWMRRWLLPRGINRDPQFRKSIRDVGGLSLIRIASFKSLYQVQKAYWMRPHPDDLRRNIPERGDSSLTSFGQRVLDAMERMRENRVKQLASRIAEAALGIGDETSVNAKNGRRKRPTERSNDPRFAPCHAVVIEDLTHYRPDETQTRRENRQLMSWSSSKVKKYLGEACQLNGLYLREVPPAYTSRQDSRTGAPGLRCNDVTVAEFYTSRFWRKQVEAAEKNQKDGKKGDARERYLLSIDERIRSEANDRDVFRIPVKGGEIFVSACGQDGGSNANRKAPPGLQADLNAAANIGLRAIFDPDWEGRWWYIPCDATTICPVAKKFNGCKAVDSSKPLRIVAEKVAVSSSSIDEKRSGRKGIALTDGSRIVNLWRDPSGAPIRRDVPSNSEWQDYAEYWNKVQSRVIANLRKSYGLREI

SEQ ID NO: 323 - protein, 798 aa, unidentified
  REGION 1..798: note = Description of Unknown:uncultivated organism sequence
  REGION 1..798: note = Category: MG37 effectors
  REGION 1..798: note = Description: MG37-64 effector
QAARKLQDTIEKFGDIQLFESLSLPDAKCVWLTNGKPDAQPLMDYVAGTDAVSKKQRFKVPAYRHPDAFLHPVFCDFGNSRWSIDYAVHRAPEKLARAQQLLEKKKEELTRAEQALSKASDPSKRSSIEKKLKTLNVAFKQQEAEVLWLESHHAMTMGLWNGSRIEDTPLLWQSKRFGSDIGQAGAEHPLVASRADRFGRAVAMAKDNAPVVPSGLFDLADWNGRLQAPRRQLDAIAAIHDRTDLSVEEKRQLVAKRIRTIRWLVTFSAKLQSRGPFIAYAAQHGFDWRYGAHGIENKSREGLAKLVLCRLPGLRILSVDLGHRYAAACAVWETLSAAQMQNACLEAGMEAPSQRTLYLHLKHFVNGKEKKTIYRRIGADTLPDGSPHPASWARLDRQFLIKLQGEDRDARPATCDEVVAVEQLETELGYVRPIKRKGREHLVDELMSDALRTLRLGLQRHGARARIAFNLTATKRTRPGGIQELLDQESRIGLLTETLLEWNELYAGERWADELARDMWNKHIQPLLGGTILQETNNQDVTPSAAKRRMQREETREKLRPVAKQIAENDSLCRQLNVLWSTRWQIEDAAWRMRLRWMRRWLLPRGINRDPQFRKSIRDVGGLSLIRIASFKSLYQVQKAYWMRPHPDDLRRNIPERGDSSLTSFGQRVLDAMERMRENRVKQLASRIAEAALGIGDETSVNAKNGRQKRPTERSNDPRFAPCHAVVIEDLTHYRPDETQTRRENRQLMSWSSSKVKKYLGEACQLNGLYLREVPPAYTSRQDSRTGAPGLRCNDVTV

SEQ ID NO: 324 - protein, 917 aa, unidentified
  REGION 1..917: note = Description of Unknown:uncultivated organism sequence
  REGION 1..917: note = Category: MG37 effectors
  REGION 1..917: note = Description: MG37-65 effector
QLFEALAADDAIVVWQSDGKADPLKDYVAAKAAEDRLHRYKVPAYRHPDPLLHPVFCEFGCSRWTIKFGIHQAWQALAQARAELTKAKGILASARSEDEKMKANVRVPKAQRRQEFEQARAAQRLTMDLWTGNDIKTTEMRWQSKRMPGDLAFATALSDSPVFLPRADRLGRAAGGAALSDAPAVSGLFEQNEWNGRLQAPRPELEAIARCQDPHRKTRLRSRLNWLITFSAELQPQGPMIAFAAAHDLQIRNSPLSTAKFLHVNEPRLSTNEGRKGYARFTLPPLSGLRVLSVDLGHRYAAACAVWETISETRLAELCKAAGHRPPQPKDMALHLPGQRNGKKVKTIFRRTGPAMWARLDRQFTIKLQGEDKPSRKASTHEFEAVVRFEKELGRTRSDENPLPHDVMRLMAEAVRSARLGLRRHGDRARIAFNLTTKTKLLPGGRTEKLTPETSVELLQDTLVLWHNLRNSPTWQDDFAESCWNESIAPLLENVVLPEPPVEGAAAQTVKAFRRTLRDKLKPAAQNLAGNPQLRQKLHTLWATRWRKDDEAWRGRLRWLRDWLLPRGKAKSDASIRHVGGITLTRLATIRGLWQTQKAFALRPDPDDLRRNVPKRGASSERFGQRVLDALDHLRENRIKQLASRIVEAALGIGKEQPKVNRRDPKRPRSQVHSPCHAVVIEDLKNYRFADSRPRRENRQLMQWSARNVRRYLAEACQLYGLHLCEVFAGYTSRQDSRTGAPGCRATDLPVPDFLKRYDRLVKNAEGEERKFLEALKARWDGCTDRSKLVRILDRAGKLFVSADESSPAVKGIQADLNAAANIGLRALLDPDWPGKWWWVPCGKDGKPAEKECKGTRAFDLNLQLLPATECRGKDIVNAWRDVSADPIVPGKGMSYAEYWNRVKARVVVNLRRQAGL

SEQ ID NO: 325 - protein, 1078 aa, unidentified
  REGION 1..1078: note = Description of Unknown:uncultivated organism sequence
  REGION 1..1078: note = Category: MG37 effectors
  REGION 1..1078: note = Description: MG37-66 effector
RAEAERSRFEEDAKKVDQVPEAAKDWLNNFCLERSGLSGAQEPYRIRRRAVDGWKEVVTAWSKADCKTAEDRIAAARALQDDPEIDKFGDIRLFEALAEDDAVCVWHKDGDAAKAPDPQPLIDYALAAEAEFKKRHFKVPAYRHPDALLHPIFCDFGKSRWDICFDVHKKVQTPFPRALCLTLWTGSGMNTVPLCWQSKRLARDLALGQDAQNDGSSEVTRADRLGRAASSVAKSDEVKISGLFEQADWNGRLQAPRQQLEAIAVVRDNLSLSDQERERRMSGLMDRIQWLVTFSAKLQPQGPWCKYAQDQKLGLNIDPQYWPHAGENKNRKGQARLILSRLPGLRVLSVDLGHRYAAACAVWEAVSTETFRKEINGKNILRGGSGKDDLYCHTKHDAESKKHTTIYRRIGADTLPDGEPHPAPWARLDRQFLIKLQGEEEGAREASNEEIWAVHQMEIALGRSVPLIDRLVAAGWGCTERQKSRLEELKKLGWKPLPAAEPTGDESGEDEGADVYKPSLAVDELMSSAVRTMRLALKRHGDRARIAHYLIADKKTKPGGIKEKLDENGRIELLQDALVLWRDLFSSRGWRDDAAKQLWDDDITRLSGYKAPEKIGEDVSGVERKKKQKENREKLRDVAKALAQDVTIRGKLHDAWKKRWEEDDGRWKKQLRWFNDWIFSRGKAADNSTIRKVGGLSLTRLATLTEFRRKVQVGFFTRLHPDGARAETKEQFGQSALDAIENLREQRVKQLASRIAEAALGVGRMKRPRGGKDPKRPDIRVDEPCHAVVIEDLTHYRPEETRTRRENRQLMTWSSSKVKKYLAEACQLHGLHLREVSASYTSRQDSRTGAPGTRCQDVPVKEFMRAPFWRKQVAQAEKKQAESKGDSRERFLCGLNAMWKDKAVADWEKAGAVRVPLKGGEVFVSADRISPSAKGLQADLNAAANIGLRALTDPDWPGKWWYVPCEPASFRPVKDKVDGSAVVNPDQPLRQSAQAQSGDAAKDKKKRGNKGAGKSKEVVNLWRDISSSPLECIEFGEWKEYAAYQNEVQCQVIRILEEQIKDRDRQPHEGSKEDDIPF

SEQ ID NO: 326 - protein, 793 aa, unidentified
  REGION 1..793: note = Description of Unknown:uncultivated organism sequence
  REGION 1..793: note = Category: MG37 effectors
  REGION 1..793: note = Description: MG37-67 effector
RKEKVVAAFREILKTRLKPNVAQAEIESWVADCAESLAAQIRKDAVWVNRSAIFDRATAGWDEASARSDAHTLLSHVLSDEYLTLPTAKKSQKKNTDANDDEDQEEQEQRQSAVKASSKGAGDRTRHPFSHIFREGKPFGGAKSLVLVERWWSYLKPLVEAAGISLPPRGKAKLKGGDELQREMFSKAASRVAQIVTKQRQQEADRLERKKADAALRLMEEDESFNAALTALRTYCDDYRVMSGATGEFLLRPRQVGTGWDRVVRRWSAISEADPERAREARVEAVKEIQDSDEDKKFGDANLFFRLAEDRFTTVWCPDGNPHNADPTILDRFVKGMKARSDSERLKVAAFRHPDPYRNPIFCQFGVSRPKIHFGRLKTFTDDHAGNDPRAVGMLLWHPVSNSAKLTLLHGVSQRLDREIGAARDQVQQNTEELRAVSRRGRLGAAAGGLPNADSPARVAGVFDLKTITHRATDEEQEDADNERPETGKLKEPKWNGTLSADRRELEAIRKLIDKGDMQKANRCRQQLRWTLTVSMKMEGRGPWITFASKWEEAHGHKYQPFGAFATNDKLKGRNRLFRWQWDRDARDFVVNLTKPFENPTDAKGRDGHARLILSRLPGLRLLSVDLGHRFAAACAVWEASPLSVLKKEIKNREIIAGGTGTHDLYCHTRHIDEHRKERTTIYRRVGTDKLDDGSAHPASWARLDRQFFIKLQGEQWPARMASEAEYEYVQRLESELGRVRGNNNQLPWRVDDLMSEAVRSARLALGRHGDAARIAYAFKPDSVLLTPGGGSA

SEQ ID NO: 327 - protein, 1101 aa, unidentified
  REGION 1..1101: note = Description of Unknown:uncultivated organism sequence
  REGION 1..1101: note = Category: MG37 effectors
  REGION 1..1101: note = Description: MG37-68 effector
RTSSSFASDEYLIRRRAIDGWERVVKAWAQLGDEATRQQRIDAAREIQSNLDDNEKFGDIQLFAGFGDDDADEPRPCLADEAAVVVWLTEAGKPDPDILENYSAATVAAHNRRRFKVPAYRHPDPLRHPVFVDYGNSRWGISYSALRESQARAKLKEKLNSAATDSARQKLQEQLQALPELRSVTLDLWTGQQVESVPFRWHGKRLWKDLDLDHFGEPAANTATRADRFGRAVAGQPQAAVSIAEVFGQKDWNGRLQAPRRELDHLADLVYGKRADADFDKLARLTSGSAPHRARKALENLHWFLTTSAKLKPQGPWLDYVARGLPDGVEYRSGRNGPYLNYVVNKDRKGRARLELARLPGLRVLSLDLGHRYAAACTVWETLSTAQMEAACKAAGRPLPQADEPFIHTKQPTEALQKSGRRKGQPVTKTTIYRRIGPNLLPDGTEHPAPWARLDRQFLLKLPGEDHPARFATRTEFADFNRLRLVAGLREDTAQVIENRPDCVNRRVDQLQVDAVRITQLGLRRLGNLARVAYILTAATKPLAGGQSSTPLSREERVDYVLDALVRWQELAQSTEYTNKWAKELWSDQWAKDLWSEWVQGHFGGPQLVDVSGDTPRSERQRRSEDSRNRLRSVAEQLAAPNGAANCELHRLWSTKWQSRSDKWRVQLRWLRRIILPRIGPRPSGTDAEAHVRRRQHARAIRQMGGLSLRRLKTIRDLYQVLKAFHMRPEPDNLRKNVPEPGDDSLLNFGRRILDQLERLREQRIKQLASRIVEAALGVGSENRREHWNGRRRPSQPIADARFAPCHAVVIENLENYRPEDTRLRRENRQLMTWAARNVRKYIVEGCQLNGLHFVEVSPTYTSRQDSRTGAPGVRCEDLPRTAFANAVEVFRGNPPSSPESSTHSHREVSYIVSLLRKAEDKRNRGEPVSAREQVALSLAERIDDVPPHCGVIRLPRNGGEVFVSANPTSPSSQGLQADLNAAANIGLRALGDPDWLGSWWYLLVDAATGIPVTERIQGSTVWTERVTTSVLAHVADGQSGRRRGTKKERTAVYAFSPWHLSWGQIDRDGVWTTTKNYWPEVERRVADLLISRQTEPETPW

SEQ ID NO: 328 - protein, 840 aa, unidentified
  REGION 1..840: note = Description of Unknown:uncultivated organism sequence
  REGION 1..840: note = Category: MG37 effectors
  REGION 1..840: note = Description: MG37-69 effector
SVDLALDDLAVSDAVPVTLGSRFGRAALPSVLPVSVLNVFDEGDWNGRLQVPRSQLERIASLLAKNKVAAAKEFRQKLRWSLTFSPRLQPTGPFHDFAAQHGITPNRKGEYFPNGEQNRITKREGKAKLVLSRLPGLRLLSVDLGHRFAAACAVWESLSGPDFAKEIFGLTIESGSAEGLYLHTRHMDESGKERSTIYRRIGSDALPDGSDHPAPWARLSRQFLIKLQGEERSARKAAPTEIYSVRELEAGFGRVSEKDDLPTQVDELMSHTIRVSRLALRRHGDRARIAFAMISSYKPMPGDRKYNFFPNDTSDGFDDTPEQRHRKHIEFIQDALLLWHDLISSKGWQDQAAEQLWKQHIATLLGYQHPEPINRDGSGPERKKKRNENFDRLRGAAEALINNAPLRLTLNAEWKGRWESDDQDWRSHLRRLQDWARPPASKGSQAIRHVGGLSLTRLATLTEVRRKVQVGFFTRLLPNGDKARIGERFGQKTLGVIEEMREQRVKQLASRITEAALGIGRVQPGTKHDPRRPRVRVDLPCHAIVIESLRNYRPDDLQTRRENRALMEWSSGKVRKYLEEACYLYGLHLREVPPNYTSRQCSRTGLPGIRCADVPIEQFRAAPFWRKIVDSARKRISQNKGTEEDRFFCDLDETYGNDVNPQAGRVATLRLPRKGGDLFVSAPVWAQLNRKDQYGNDRVSARPNDWSSKRALQADLNAAANIGLRALLDPDFPGTWWYVPCTARDGRATQDKVKGSSCFVAENWRILSVSERSATKREVVNAWHDPSTCSLSNRLDWRETTHYWNTVRARAVEALRQFNGLPRSNSAPVHNSLESALRER

SEQ ID NO: 329 - protein, 1130 aa, unidentified
  REGION 1..1130: note = Description of Unknown:uncultivated organism sequence
  REGION 1..1130: note = Category: MG37 effectors
  REGION 1..1130: note = Description: MG37-70 effector
VMLDHAARRVSIAHSWIKRAEAERRRFEADAKRLDTVPDKAAAWLDAFVQERSGSVGGEYRIRRRAIEGWDDVLKRWGRADCKTADDRIAAAREVQADPEIEKFGDIQLFEALAADDAQCVWRLNGKVDPSPLRDYVLGHDASFRKRRFKVPAYRHPDPLRHPVFCEFGNSRWSIEYSAHKAHSKLGKVRDTVKKKKESLDKTCAQLKKARSAARPNPERIARLEARIATIRDDLQNAQKEADRLASHRGVRMRLWDGNDTVLHDLKWSSKRLVADLAIDVQHTSHPTGVTRADRLGSSASGATGDVAILNVFDEKHWNSRLQAPRAELDRIARLEDKGETRRAESLKRRLRWLITFSPRMLPYGPFIDYAARFADDAPARPVVSYNGEYIIKHADSDKRKGHAMLILSRLPGLRVLSVDLGHRFAAACAVWETLSITDFKKEVEGCDIAAGGSGEHDLYLHTLHTDVRGKQRKTIYRRIGPDVLSDGKQHPAPWARLDRQFLIKLQGEEMPARAALPAEMEFVRRLEADLGRSRDANNPLPRRVDELMSEAVRSLRLGLARHARRAKIAWALDPATRSVLGMGGAETAFRPGDENHVKLLVNALFDWHSLASDHKWSDDAARGLWNKHIVPLDDAWEINPPHLNADNRDNITRQQRRKDDETLRKRLKPIAQSLAASDRAQIHKAWCERWQRDDGMPADRSRGAPATGWHARLRQVHDWIVGRRCPGSDAPSHSWKKHVGGLSLTRLSTMRSLYRLHKSFAMRPRPDKPRGAPEKGETNAGVAKSLLDAMERMREQRVKQLASRIVEAALGVGRMKPAAGRDRKRPRSRVDEPCHAVVIESLRHYRPDELRTRRENRALMNWSASKVRKRLEEACQLYGLYLREVPASYTSRQCSRTGLPGVRCADVPVTEFLSAPWWSKAISAAKKKIDGRSTNAEARLLVDLHEKWSAANPHDRQGCTVRVPRNGGDLFVAAPPRRCASSRGSNDAATSALQADLNAAANIGLRALLDPDFWGRWWYVLCDAATGKPARDKYAGSACIDLDKQLLPPQAKADSAVRKRGRKGGGDRINAWRDVAAENGLDPAKGWQVHTAYWNDVKARVVSALRRVNGLPIPEDASSADLASQAGRG

SEQ ID NO: 330 - protein, 1282 aa, unidentified
  REGION 1..1282: note = Description of Unknown:uncultivated organism sequence
  REGION 1..1282: note = Category: MG37 effectors
  REGION 1..1282: note = Description: MG37-72 effector
VWVNRSKAFDAFDEAVKSIDRSFVWDMLERFFGSREAYLAPEKGVEDEAAEVEQEDKAKDLVQKAGQWLSNRFGTGKGADFSRMATVYQKIAEWAGKDQPERAGKEAIADLAAALNAASNDLQGVLGLISGPGYKSATRNLLKQYNEKPLLTTQDFKNLQKKATDDECKCREKTDSKGRRPYADAILKDVESACRFTYQQDGGRARHSEFAVMLDHAARRVSLAHTWIKRAEAERRRFEEDAKRMANVPGPAKEWLDTFCQERSGVLGALEPYRIRRRAVDGWKEVVTAWSKCSCRNSEDRIAAARALQDDPHIEKFGDIQLFEALADDDAARVWHKDGDCAKPPDPQPLIDYVLANDAESKKRRFKVPAYRHPDALLHPVFCDFGKSRWDIKFAVHEARKNTACKNKKKNVMRNDDSHALSMTLWTGSTVEPRLLRWQSKRLMHDLALTQDKQDGTAREVTRADRLGRAATGMRADDAVSIAGIFEQNDWNGRLQAPRAQLDAIAARVAKHGWDAKARQMRDRLHWLITFSAKLQPSGPWFEYAAQFPDDAPAKPFVSHKGDYAITHQSTGKRNYHAKLILSRLPGLRVLSVDLGHRYAAACAVWHTLSKKDFENDLRDKRIVRGGIGENDLFCHAEYERNGKTYTVVYRRIGADSIESVDKETNEVRTASHPAPWARLERQFLIKLQGEDTEARKAGPAEVAAVQELDKAVGRKPPDRRSLRVDDLMSEAVRTMRLALQRHGRRARIAFSLTAKKKLLPGGREESLTHEGRVALLADTLADWYALFTGKGWDDEWAKQQWETHFTPLLHGTALPQSPGDAEATPKARKQYQADLTERLKPVAESLAKNGSLCWKLHCLWATRWRENDVALRKHLRWLRDWILPRGKAKNDKAIRHVGGLSLTRIATIKSLYQAQKAYHMRPDPEDLRKNIPSKGDDTLRHFGRRILDVMEHLREQRVKQLASRIAEAALGIGIEHSAARKTPRRPRQRLYWKDEQGNEHGDRRFAPCHAVVIENLTHYRPEETRTRRENRQLMSWSSSKVKKYLAEACQLNCLHLREVQAGYTSRQDSRTGAPGVRCQDVPVKEFMQSPFWRKQVAQATKKLAEGKGNARERFLCDLNAKWKDKSEADWEKAGVVRLSLKGGEIFVSADANSPAAKGVQADLNAAANIGLKALLDPDWPGRWWYVPCDAKTFKPAKDKVGGSAAIDPYEPLKNALTAQDTDGPKKKRGKARKQNREYANLWRDVSSQPISADDGWRESTPYWNDVQKRVVDILRQSAGLA

SEQ ID NO: 331 - protein, 489 aa, unidentified
  REGION 1..489: note = Description of Unknown:uncultivated organism sequence
  REGION 1..489: note = Category: MG37 effectors
  REGION 1..489: note = Description: MG37-73 effector
MKAQGRVNSPAALRRLEQVLNQLRELHDACLYQWRLAENNHEPKWFDANRQQKELTLMRAHSPEHDNVLRRLQDNVIRHTAARWNKYLKDENTGRPRYKTGRFRTIALDSPQGRVIRFTATGKPVLHINSLPAIRLLTSQQIPSDRQPRAVRITLKGRMIHVRLSYQFELPERLEPTLATSPVGVDLGIALSMATSTGQTFRSPKQAYLQTQERKARRKLSKVIAAAMATGTAGFRAALDADGRQRLTKKGRPMRQLVWSSGKPTKSYLKARRRLSAITERLALLRREFRHRVTTSLIEKAAAEGRDLLAMENLQVKNMTASARGTVEKPGRNVRAKSGLNRAILQEAWGETLTMLEYKAERAGIASVRVYAQATSITCSCCGHRDPKSRTSQSRFKCTACDYQANADFNASLNIADRGMLYFQKRKGLSIEDLRQARRDESHSGGTEGPETGPAGHPASQTSQESPINASASVLTRRDPAQAESFAIF

SEQ ID NO: 332 - protein, 438 aa, unidentified
  REGION 1..438: note = Description of Unknown:uncultivated organism sequence
  REGION 1..438: note = Category: MG37 effectors
  REGION 1..438: note = Description: MG37-74 effector
MSDAVDPHLTEPYGPRTSSCATELICRDCGYRTPLLDRAFKCPACGEGLDIDYDYDRAKQLIEGRPVEGRPWNLWRFEELLPITGRRAQSRVGAFAGKTPLIHAERLGAELGLSNLYLKDDSTNRPSLSYKDRVVGMAIARLLELGKDEVGCVSTGNVGTAVASLAAQAGATPYIFYPGNMEKGKAKACRAMGAQVIQLDANYDQANRACRELAITTGMEFANITLRPFYAEGAKTMAFEVVEELGWKAPDHFVIPAAGGTLSSRVHKGLLELEKVGLAETAGSKINIAQASGCSPIATAIGAGGGEIVPQTPETAAHSLAIGAPGDGALVVDAVVSRNGSGATASDEEIFEAIDLLGATEGILTEPAGGTTIASTAKLAQEGRIAPDETVVAVISGNGLKTLHEHPEKSWPEMVPCEVGAMEEMLNDFRQAAAAALH

SEQ ID NO: 333 - protein, 497 aa, unidentified
  REGION 1..497: note = Description of Unknown:uncultivated organism sequence
  REGION 1..497: note = Category: MG37 effectors
  REGION 1..497: note = Description: MG37-75 effector
MQNCQVRTIKAQGRVNSRAALSRLEQVLDQLRELHDACLYQHRLAEKNHEPKRFDVNRQQKELTLLQADSPEQNNLLRRLQGNVIRHTAARWNKYLKESATGRPRYKTSRFRTIALDSPQGKVMRFTASGKPVLHISSLPAIRLLTSQEILDDRQPRAVRITLKGGRIQVRLSYQFEVRERQDPTLATSPIGVDLGIALSVATSTGQTFQSPKQLYLQAQERKYRRKLNRIVASAMATGTAGFRAVLDADGSQMLTRKGRPMRELVWTSGKPAKAYLKARRRLSEITERLALLRREFRHRVTTSLIEKAAAEGRDLLAMEDLQVRNMTASARGTVEKPGRNVRAKSGLNRAILHEAWGETLTMLEYKAERAGIPSVRVNAQATSITCSCCGHKDPKSRNSQSSFKCTACHYQANADSNASLNIADRGMLYFQKRKGLSIESLRQARRDAGLSGGTEGPDTGPAGQPASQNNLESPTNASKSALTGPDRGKTESLAIF

SEQ ID NO: 334 - protein, 1489 aa, unidentified
  REGION 1..1489: note = Description of Unknown:uncultivated organism sequence
  REGION 1..1489: note = Category: MG37 effectors
  REGION 1..1489: note = Description: MG37-76 effector
MPDEALVNGSTAGTDRVVVTQRAYTLRLQGVDPQDHSWRDALWKTHEAVNKGAWAFGDRLLTLRGGLDHALADAKVEGGKGKPDRDPTDEERKARRILLALSWLSVESEKGAPEKYLVPHDLDKQSGARSNWKTVDALKEILKGRGLGKSEIESWVQDCSSSLSAPIRDDAVWVNRSKAFDDAVKSVGCSLTRDEAWDMLERFFGSRDAYLAPAKGSEDESSETEQEDKAKDLVQKAGQWLSSRFGTGKGADFSRMATIYEEIANRAGKAQPGMTGDKAIADLATALSKFSPPSNDLQGVLGLISGPGYKSATRNLLLDRFRDKTPVTQEDFQNLQDKAREDAQKCKNKTGSKGHRPYADAVLRDVESVCGFTYLQDGGSARHSEFAVMLDHAARRVSLAHTWIKRAEAERSRFQEDAKKVDQVPEAAKKWLNNFCLERSRAAGALEPYRIRRRAVDGWKEVVAAWSKPDCKTTEDRIAAARALQDDPEIDKFGDIQLFEALAEDDAVCIWHKDGDPANPPDPQPLLDYVAATDAEFKKRHFKVPMYRHPDELLHPVFCDFGNSRWNICFDVHKNTKTPFPRTLCLTLWTGSEGMKPVPLRWQSKRLARDLAFGQDTRKDGASDVTRADRLGRAASNVGKNDAVNIAGLFEEKHWNGRLQAPRRQLEAIARYVEKHGWNEKAKNMRDAIQWSVTFSAKLQPKGPWCAYAKEHGLRKDPQYWPHTEVNKDRKGHARLILSRLPGLRVLSVDLGHRYAAACAVWEAISTRQFQQNIEGKKILRGGTDAESLYCHTEHTTDGKKHTTIYRRIGADTLPDGKLHPAPWARLDRQFLIKLQGEAEGAREASNEEIWAVHEMETVLGRSVPLIDRLVAAGWGSTEKQKARLDAIKKLGWVPIKRADASEDADTEEEEELAFRPSLSVDDLMSSAVRTMRLALKRHGDRARIAFAMTAAYKPMPGDHRYYFTEAKDLSANEDATARNSKHIEFIQDALLLWYGLISSRGWRDEAARQLWDDHVAKLHGYKAPEEIGEDVSGAEREKKQKENREKLYDVGKALAQNESLRKTLHHAWKTRWEEDDGRWKKQLRWFKDWILPRGKKYASDPSIRKVGGLSLTRLATLTEFRRKVQVGFFTRLKPDGTRAETKEQFGQSTLDALEHLREQRVKQLASRIVEAALGIGSENKQHWEGGKRPRARSKDPRFAPCHAVVIEDLTHYRPEETRTRRENRQLMSWSSSKVKKYLAEACQLHGLHLREVSAGYTSRQDSRTGAPGIRCHDVPVKEFMRSPFWRKQVAQAEKKQDEGKGDARERFLCDLNAKWKGQPEADWEKAGAVRVPLKGGEIFVSADQNSPAAKGLHADLNAAANIGLRVLTDPDWPGKWWYVPCDPDSFLPVKDKVEGSAVVKPDQPLPKSAQAQSGDGAKDKKKPGKRGASKSKESKKVVNLWCDISSSPLECREWKEYAAYQNEVQSRVIHILEKQIKRLRQATARGVQ

SEQ ID NO: 335 - protein, 1379 aa, unidentified
  REGION 1..1379: note = Description of Unknown:uncultivated organism sequence
  REGION 1..1379: note = Category: MG37 effectors
  REGION 1..1379: note = Description: MG37-77 effector
MKKWGKRIISGVIAASLLTAAAISGSEQGTGTVASVVQAGTETSFMGKLLEGGYIDVFTSWTQEEQNKFYDGLSPQQQSVFLEVTNCQITRELIKSERSKEELEQFFDRLQPYFLILKKGNQEKPDDEIVIECINQIEGTDYHSSEQYIKQLVSEKKDHYLEFYDALKLVKDGKLEIESAVDDFYKELGFLKKDRVPANSAEVSRQPVQVQKKAAAKAVSDRYSNFKAVSSLKALKDAVASVKKGEKIAVRVDKGFNVTSVIRTNGRHVKIYADGESGHNLNRTAGYKDVMLEVNGGSLTLGAYDGDGRAKNNLYINGKNIAASAPLIEVTSGHLYLNKYSRIIDGYFLADFAGGAGIALNSGTSCYMFGGRIDNCRAKSSKDVSSSSPKSSHGGGVLVGNGSSFYMFAGSIEHCQAIHGGGIMNYGTLRLYGGAISDCAASNQKKDALGGAVKVQGAIETNGKVSSTKGDLGVWKYTRSAAWIVNGKDGYQQGTTTGVVLKNNQADAGGAICLNNGSNGAIQDCNINGNHSTGNGAGICLSNGSYKKGAALELKTGAVIHGNESKGYGGGIYCADSVKGSLSGGTMYDNSAKYGAGIYHEAEFRMSGGTVRSNHSGNSGGGIYAKGKLSMTGGEISANTAATYGGGAILKTVGGSVSRGSIKGNSASANGGGLQIDGTVSLSNASVSSNSASGKGGGISVSSSGTCNLSSGNVSGNTAKAGGGGIYIDGTCKANGSSFTGNQSSGDGGAVYIASGTFTTFQANQAVNIQGNSASGNGSGIYNRNITVLNNNAHILNNQCKNGTQRGIFHEGSLFSIEGNTEIQQEIYLAKDRFVTASNRYFSNSNSLKAKISLDTANIRNGYAVVKGNVSNSADGNYKTGEALLNNQSAGGRFVYAGSGYVMRPGNLKKSSSGCAPFSIVLSQAYQIRYDKNSKEEVMNMPTAAVKYWEEDIKLSALTPTGGSGAFVAWNTKADGTGDGYQPGNVYTANADATLFALWPHYRVEYLPGIRSAAGTTDSQEQNKSEDILLRKNGFRSSEGKFVGWKQDISSARKRMELEPVGYKELKEEREKGKLNHILDFAESYKKVNSSENLDNINSLLDVEDIFFMEGQWDSKPDIILNDKKTFLENEKIKKNDLLKVVKGCYDEEDGELTKKVQIIKLDYTKSMKGYRPETQNFSGGMNDTDVMDTYFMKLEKDETVEVKVTFQAEDSVGNVAEKEGTVCVTYNNPPKLHSQNLAFYQKDIDNNPQTILKEIFENYQVEDIEDDKKGLKVPVSVIDPIPLQIEKLNSVGEHKIVYQAIDSLGKKTKLDSIVYIAENNPFKDSYKYNVRFINKKYLYTLKESSKWKKNEELNAQLTSQLEKTKEDAELKYEFEIKK

SEQ ID NO: 336 - protein, 437 aa, unidentified
  REGION 1..437: note = Description of Unknown:uncultivated organism sequence
  REGION 1..437: note = Category: MG37 effectors
  REGION 1..437: note = Description: MG37-78 effector
MSDAVDPHLTEPYGLRTRSCATELVCRDCGYRTPLLDKAFKCPACGEGLDIDYDYELAKKRIAERPAAERPWNIWRFEELLPILNLRAQQRVAQFAGKTPLIHAERLGAELGLSNLYLKDDSTNRPSLSYKDRVVGMAIARLLELGKDEVGCVSTGNVGTAVASLAAQAGARPYIFYPGNMEKGKAKACRAMGAQVIQLDANYDQANRACRELALETGMEFANITLRPFYAEGAKTMAFEVVEELGWQAPDHFVIPAAGGTLSSRVHKGLVELEKVGLAETTGSKINIAQASGCSPIAAAIVGGGEIEHQTPETAAHSLAIGAPGDGNLVVDAVRSRSGSAATASDEEIWNAIDLLGTTEGILTEPAGGTTIASTARLAQEGKIGPDETVVAIISGNGLKTLHEHPEKDWPEGVPCEVGAMERLLNDFRQAAATALH

SEQ ID NO: 337 - protein, 431 aa, unidentified
  REGION 1..431: note = Description of Unknown:uncultivated organism sequence
  REGION 1..431: note = Category: MG37 effectors
  REGION 1..431: note = Description: MG37-79 effector
MTEGRGDRRTRSCATELVCRGCGYRAPLLETAFRCPGCDLGLDIEYDYERAKSLISEVGLGERPQNIWRFEELLPIVSGVARARVAQFAGQTPLIRAERLGAELGLHNLYVKDDSTNRPSLSYKDRVVGMAVARALEIGAGEIGCVSTGNVGTATASLAAAAGLKPYVFYPANLERAKARGCRALGAQVCQVDGNYDEANRACRELTEATGIPFANISLRPFYAEGAKTLAYELVESLGWRSPDHVVMPAAGGTLSSRVHKGLVELETLGLAATAATKLHVGQPTGCSPIATTIVEGAEEIVPQQPETLAHSLAIGAPGDGDLVVEAVRSRGGTAAAVPDGEILEAMELLAATEGVLTEPAGGTTVAATMKLAQRGVIDPDAVTVIVISGNGLKTLSEQPVKPWPEGVPCNATTMEEVVVEFREGGVTSRT

SEQ ID NO: 338 - protein, 1379 aa, unidentified
  REGION 1..1379: note = Description of Unknown:uncultivated organism sequence
  REGION 1..1379: note = Category: MG37 effectors
  REGION 1..1379: note = Description: MG37-80 effector
MKKWGKRIISGVIAASLLTAAAISGSEQGTGTVASVVQAGTETSFMGKLLEGGYIDVFTSWTQEEQNKFYDGLSPQQQSVFLEVTNCQITRELIKSERSKEELEQFFDRLQPYFLILKKGNQEKPDDEIVIECINQIEGTDYHSSEQYIKQLVSEKKDHYLEFYDALKLVKDGKLEIESAVDDFYKELGFLKKDRVPANSAEVSRQPVQVQKKAAAKAVSDRYSNFKAVSSLKALKDAVASVKKGEKIAVRVDKGFNVTSVIRTNGRHVKIYADGESGHNLNRTAGYKDVMLEVNGGSLTLGAYDGDGRAKNNLYINGKNIAASAPLIEVTSGHLYLNKYSRIIDGYFLADFAGGAGIALNSGTSCYMFGGRIDNCRAKSSKDVSSSSPKSSHGGGVLVGNGSSFYMFAGSIEHCQAIHGGGIMNYGTLRLYGGAISDCAASNQKKDALGGAVKVQGAIETNGKVSSTKGDLGVWKYTRSAAWIVNGKDGYQQGTTTGVVLKNNQADAGGAICLNNGSNGAIQDCNINGNHSTGNGAGICLSNGSYKKGAALELKTGAVIHGNESKGYGGGIYCADSVKGSLSGGTMYDNSAKYGAGIYHEAEFRMSGGTVRSNHSGNSGGGIYAKGKLSMTGGEISANTAATYGGGAILKTVGGSVSGGSIKGNSASANGGGLQIDGTVSLSNASVSSNSASGKGGGISVSSSGTCNLSSGNVSGNTAKAGGGGIYIDGTCKANGSSFTGNQSSGDGGAVYIASGTFTTFQANQAVNIQGNSASGNGSGIYNRNITVLNNNAHILNNQCKNGTQRGIFHEGSLFSIEGNTEIQQEIYLAKDRFVTASNRYFSNSNSLKAKISLDTANIRNGYAVVKGNVSNSADGNYKTGEALLNNQSAGGRFVYAGSGYVMRPGNLKKSSSGCAPFSIVLSQAYQIRYDKNSKEEVMNMPTAAVKYWEEDIKLSALTPTGGSGAFVAWNTKADGTGDGYQPGNVYTANADATLFALWPHYRVEYLPGIRSAAGTTDSQEQNKSEDILLRKNGFRSSEGKFVGWKQDISSARKRMELEPVGYKELKEEREKGKLNHILDFAESYKKVNSSENLDNINSLLDVEDIFFMEGQWDSKPDIILNDKKTFLENEKIKKNDLLKVVKGCYDEEDGELTKKVQIIKLDYTKSMKGYRPETQNFSGGMNDTDVMDTYFMKLEKDETVEVKVTFQAEDSVGNVAEKEGTVCVTYNNPPKLHSQNLAFYQKDIDNNPQTILKEIFENYQVEDIEDDKKGLKVPVSVIDPIPLQIEKLNSVGEHKIVYQAIDSLGKKTKLDSIVYIAENNPFKDSYKYNVRFINKKYLYTLKESSKWKKNEELNAQLTSQLEKTKEDAELKYEFEIKK

SEQ ID NO: 339 - protein, 446 aa, unidentified
  REGION 1..446: note = Description of Unknown:uncultivated organism sequence
  REGION 1..446: note = Category: MG37 effectors
  REGION 1..446: note = Description: MG37-81 effector
MSTTTTQSLARGSRKRTRSCATGLRCHRCDLSYALEESVFACPQCGKGLDITYDYELAARRFEEVPRETRARNIWRFEELLPIVDASAQARVGSHGGYTPLIRADRLGAELGIANLYLKDDSTSRPSLSYKDRVVAMSVARLLELGRTEMGCVSTGNVGTAVASYAAKAGADAYVFYPNRLEDTKARACAAMGAKVCQVEGNYDEANRRCREVAESTGMEFANITLRPFYAEGAKTEAFEIVEQLEWKAPEHIITAAAGGTLSSRLHKGLGELQLLGLAETDSTRIHIAQPSGCNPISAAILAEEAEIRPITPETAAHSLAIGAPGDGYLVIDAVLKRGGTGGFASDPEIFAGVDLLAATEGLLTEPAGGTTVAVLHKMAAEGRFGADEVVVAIITGNGLKTLDDHPDKPWPAKIECELDAMLEALEELKSTAALRDRALEALAHR

SEQ ID NO: 340 - protein, 435 aa, unidentified
  REGION 1..435: note = Description of Unknown:uncultivated organism sequence
  REGION 1..435: note = Category: MG37 effectors
  REGION 1..435: note = Description: MG37-82 effector
MSDAHLGGPGGPRTSSCATELVCRDCGYRTPLLDTAFKCPACGEGLDIAYDYERAKSLIAERGLGERPQNIWRFEELLPITSRAAQQRVGQFSGHTPLIHAERLGAELGLKNLYLKDDSTNRPTLSYKDRVVSMAVARLLELGKDEIGCVSTGNVGTAVAALAAKAGATAYIFYPGNMEKGKAKACRALGAQVCQLDGNYDQANRACRELSLASGIEFANITLRPFYAEGAKTMAFEVVEELGWQAPDHFVIPAAGGTLSSRVHKGLNELETVGLAETAGTRINIAQAGGCGPIATAILGGGEIEPQTPDTAAHSIAIGAPGDGALVLDAVRTRGGSAAMATDAEIFGAIDLLGATEGLLTEPAGGTTIAATARLASEGKIGAEETVIAVISGNGLKTLQDHPEKEWPEMVACDVETMGAQLAEFRQAAAAGVAR

SEQ ID NO: 341 - protein, 1379 aa, unidentified
  REGION 1..1379: note = Description of Unknown:uncultivated organism sequence
  REGION 1..1379: note = Category: MG37 effectors
  REGION 1..1379: note = Description: MG37-83 effector
MKKWGKRIISGVIAASLLTAAAISGSEQGTGTVASVVQAGTETSFMGKLLEGGYIDVFTSGTQEEQNKFYDGLSPQQQSVFLEVTNCQITRELIKSERSKEELEQFFDRLQPYFLILKKGNQEKPDDEIVIECINQIEGTDYHSSEQYIKQLVSGKKDHYLEFYNALKLVKDGKLEIESAVDDFYKELGFLKKDRVPANSAEVSRQSVQVQKKAAAKAVSDGYSNFKAVSSLKALKDAVASVKKGEKIAVRVDKGFNVTSVIRTNGRHVKIYADGESGHNLNRTAGYKDVMLEVNGGSLTLGAYDGDGRAKNNLYINGKNIAASAPLIEVTSGHLYLNKYSRIIDGYFLADFAGGAGIALNSGTSCYMFGGRIDNCRAKSSKDVSSGSPKSSHGGGVLVGNGSSFYMFAGSIEHCQAIHGGGIMNYGTLRLYGGAISDCAASNQKKDALGGAVKVQGAIETDGKVSSTKGDLGVWKYRRSAAWIVNGKDGYQQVTTTGVVLKNNQADAGGAICLNNGSNGAIQDCSINGNHSTGNGAGICLSNGSYKKGAALELKMGAVIHGNESKGYGGGFYCADSVKGSLSGGTMYDNSAKYGAGIYHEAEFRMSGGTVRNNHSGNSGGGIYAKGKLSMTGGEISANTAATYGGGAILKTAGGSVSGGSIKGNSASANGGGLQIDGTVSLSNASVSSNSASGKGGGISVSSSGTCNLSSGNVSGNTAKAGGGGIYIDGTCKANGSSFTGNQSSGDGGAVYIASGTFTTFQANQAVNIQGNSASGNGSGIYNRNITVLNNNAHILNNHCKNGTQRGIFHQGSLFSIEGNTEIQQEIYLAKDRFVTASNRYFSNSNSLKAKISLDTANIRNGYAVVKGNVSNSADGNYKTGEALLNNQSAGGRFVYAGSGYVMRPGNLKKSSSGCAPFSIVLSQAYQIRYDKNSKEEVMNMPTAAVKYWEEDIRLSALTPASGSGAFVAWNTKADGTGDGYQPGNVYTANADATLFALWPHYRVEYLPGIRSAAGTTDSQEQNKSEDILLRKNGFRSSEGKFVGWKQDISSARKRMELEPVGYKELKEEREKGKLNHILDFAESNKKVNSSENLDNINSLLDVEDIFFMEGQWDSKPDIILNDKKTFLENEKIKKNDLLKVVKGCYDEEDGELTKKVQIIKLDYAKSMKGYRPETQNFSGGMNDTDVMDTYFMKLEKDETVEVKVTFQAEDSVGNVAEKEGTVCVTYNNPPKLHSQNLAFYQKDLDNNPQTILKEIFENYQVEDIEDDKKGLKVPVSVIDPIPLQIEKLNSVGEHKIVYQAIDSLGKKTKLDSIVYIAENNPFKDSYKYNVRFINKKYLYTLKESSKWKKDEELNAQLTSQLEKTKEDAVLKYEFEIKK

SEQ ID NO: 342 - protein, 437 aa, unidentified
  REGION 1..437: note = Description of Unknown:uncultivated organism sequence
  REGION 1..437: note = Category: MG37 effectors
  REGION 1..437: note = Description: MG37-84 effector
MSDAVDPHLTGPDGPRTRSCATELICRDCGYRTPLLDTAFKCPACGEGLDIDYDYERAKRRIEERGLEGRPGNVWRFEELLPITNLRAQQRVAQFAGKTPLIHAERLGAELGLSNLYLKDDSTNRPSLSYKDRVVGMAIARLLELGKDEVGCVSTGNVGTAVASLAAQAGARPYIFYPGNMEKGKAKACRAMGAQVIQLDANYDQANRACRELALTIGMEFANITLRPFYAEGAKTMAFEVVEELGWQAPDHFVIPAAGGTLSSRVHKGLVELEKVGLAETAGSKIDIAQASGCSPIATAIVGGGEIEPQMPETAAHSLAIGAPGDGALVVDAVRSRSGSAATASDDEIWNAIDLLGTTEGILTEPAGGTTVAATARLAQEGKIGPDETVVAVISGNGLKTLHEHPEKDWPEGVPCEVGEMERLLNDFRQAAATALH

SEQ ID NO: 343 - protein, 437 aa, unidentified
  REGION 1..437: note = Description of Unknown:uncultivated organism sequence
  REGION 1..437: note = Category: MG37 effectors
  REGION 1..437: note = Description: MG37-85 effector
MSDAADPHLSEPYGLRTNSCATELACRDCGYRTPLLDRAFKCPACGEGLDVDYDYELARKRIEDRPPAERPSNIWRFEELLPILNRRAQQQVGAFAGKTPLIHAERLGAELGLSKLYLKDDSTNRPSLSYKDRVVGMAIARLLELGKSEVGCVSTGNVGTAVAALAAQAGATPYIFYPGNMEKGKAKACRALGAQVIQLDANYDQANRACRELAITTGMEFANITLRPFYAEGAKTMAFEVVEELGWQAPDHFVIPAAGGTLSSRVHKGLVELEKVGLAETAGSKIDIAQASGCSPIAAAIVGGGEISPQTPETAAHSLAIGAPGDGALVLDAVRSRQGSAATASDDEIFGAIDLLGATEGILTEPAGGTTIASTARLAQEGKIAPDETVVAIISGNGLKTLHEHPEKSWPENVPCEVGAMEEMLNDFRQAAAAALR

SEQ ID NO: 344 - protein, 1379 aa, unidentified
  REGION 1..1379: note = Description of Unknown:uncultivated organism sequence
  REGION 1..1379: note = Category: MG37 effectors
  REGION 1..1379: note = Description: MG37-86 effector
MKKWGKRIISGVIVASLLTAAAISGSEQGTGTVASVVQAGTETSFMGKLLEGGYIDVFTSWTQEEQNKFYDGLSPQQQSVFLEVTNCQITRELIKSERSKEELEQFFDRLQPYFLILKKGNQEKPDDEIVIECINQIEGTDYHSSEQYIKQLVSEKKDHYLEFYNALKLVKDGKLEIESAVDDFYKELGFLKKDRVPANSAEVSRQPVQVQKKAAAKAVSDGYSNFKAVSSLKALKDAVASVKKGEKIAVRVDKGFNVTSVIRTNGRHVKIYADGESGHNLNRTAGYKDVMLEVNGGSLTLGAYDGDGRAKNNLYINGKNIAASAPLIEVTSGHLYLNKYSRIIDGYFLADFAGGAGIALNSGTSCYMFGGRIDNCRAKSSKDVSSSSPKSSHGGGVLVGNGSSFYMFAGSIEHCQAIHGGGIMNYGTLRLYGGAISDCAASNQKKDALGGAVKVQGAIETNGKVSSTKGDLGVWKYTRSAAWIVNGKDGYQQGTTTGVVLKNNQADAGGAICLNNGSNGAIQDCNINGNHSTGNGAGICLSNGSYKKGAALELKTGAVIHGNESKGYGGGIYCADSVKGSLSGGTMYDNSAKYGAGIYHEAEFRMSGGTVRSNHSGNSGGGIYAKGKLSMTGGEISANTAATYGGGAILKTVGGSVSGGSIKGNSASANGGGLQIDGTVSLSNASVSSNSASGKGGGISVSSSGTCNLSSGNVSGNTAKAGGGGIYIDGTCKANGSSFTGNQSSGDGGAVYIASGTFTTFQANQAVNIQGNSASGNGSGIYNRNITVLNNNVHILNNQCKNGTQRGIFHEGSLFSIEGNTEIQQEIYLAKDRFVTASNRYFSNSNSLKAKISLDTANIRNGYAVVKGNVSNSADGNYKTGEALLNNQSAGGRFVYAGSGYVMRPGNLKKSSSGCAPFSIVLSQAYQIRYDKNSKEEVMNMPTAAVKYWEEDIKLSALTPTGGSGAFVAWNTKADGTGDGYQPGNVYTANADATLFALWPHYRVEYLPGIRSAAGTTDSQEQNKSEDILLRKNGFRSSEGKFVGWKQDISSARKRMELEPVGYKELKEEREKGKLNHILDFAESYKKVNSSENLDNINSLLDVEDIFFMEGQWDSKPDIILNDKKTFLENEKIKKNDLLKVVKGCYDEEDGELTKKVQIIKLDYTKSMKGYRPETQNFSGGMNDTDVMDTYFMKLEKDETVEVKVTFQAEDSVGNVAEKEGTVCVTYNNPPKLHSQNLAFYQKDIDNNPQTILKEIFENYQVEDIEDDKKGLKVPVSVIDPIPLQIEKLNSVGEHKIVYQAIDSLGKKTKLDSIVYIAENNPFKDSYKYNVRFINKKYLYTLKESSKWKKNEELNAQLTSQLEKTKEDAVLKYEFEIKK

SEQ ID NO: 345 - protein, 1379 aa, unidentified
  REGION 1..1379: note = Description of Unknown:uncultivated organism sequence
  REGION 1..1379: note = Category: MG37 effectors
  REGION 1..1379: note = Description: MG37-87 effector
MKKWGKRIISGVIAASLLTAAAISGSEQGTGTVASVVQAGTETSFMGKLLEGGYIDVFTSWTQEEQNKFYDGLSPQQQSVFLEVTNCQITRELIKSERSKEELEQFFDRLQPYFLILKKGNQEKPDDEIVIECINQIEGTDYHSSEQYIKQLVSEKKDHYLEFYNALKLVKDGKLEIESTVDDFYKELGFLKKDRVPANSAEVSRQPVQVQKKAAAKAVSDGYSNFKAVSSLKALKDAVASVKKGEKIAVRVDKGFNVTSVIRTNGRHVKIYADGESGHNLNRTAGYKDVMLEVNGGSLTLGAYDGDGRAKNNLYINGKNIAASAPLIEVTSGHLYLNKYSRIIDGYFLADFAGGAGIALNSGTSCYMFGGRIDNCRAKSSKDVSSSSPKSSHGGGVLVGNGSSFYMFAGSIEHCQAIHGGGIMNYGTLRLYGGAISDCAASNQKKDALGGAVKVQGAIETNGKVSSTKGDLGVWKYTRSAAWIVNGKDGYQQGTTTGVVLKNNQADAGGAICLNNGSNGAIQDCNINGNHSTGNGAGICLSNGSYKKGAALELKTGAVIHGNESKGYGGGIYCADSVKGSLSGGTMYDNSAKYGAGIYHEAEFRMSGGTVRSNHSGNSGGGIYAKGKLSMTGGEISANTAATYGGGAILKTVGGSVSGGSIKGNSASANGGGLQIDGTVSLSNASVSSNSASGKGGGISVSSSGTCNLSSGNVSGNTAKAGGGGIYIDGTCKANGSSFTGNQSSGDGGAVYIASGTFTTFQANQAVNIQGNSASGNGSGIYNRNITVLNNNAHILNNQCKNGTQRGIFHEGSLFSIEGNTEIQQEIYLAKDRFVTASNRYFSNSNSLKAKISLDTANIRNGYAVVKGNVSNSADGNYKTGEALLNNQSAGGRFVYAGSGYVMRPGNLKKSSSGCAPFSIVLSQAYQIRYDKNSKEEVMNMPTAAVKYWEEDIKLSALTPTGGSGAFVAWNTKADGTGDGYQPGNVYTANADATLFALWPHYRVEYLPGIRSAAGTTDSQEQNKSEDILLRKNGFRSSEGKFVGWKQDISSARKRMELEPVGYKELKEEREKGKLNHILDFAESYKKVNSSENLDNINSLLDVEDIFFMEGQWDSKPDIILNDKKTFLENEKIKKNDLLKVVKGCYDEEDGELTKKVQIIKLDYTKSMKGYRPETQNFSGGMNDTDVMDTYFMKLEKDETVEVKVTFQAEDSVGNVVEKEGTVCVTYNNPPKLHSQNLAFYQKDIDNNPQTILKEIFENYQVEDIEDDKKGLKVPVSVIDPIPLQIEKLNSVGEHKIVYQAIDSLGKKTKLDSIVYIAENNPFKDSYKYNVRFINKKYLYTLKESSKWKKNEELNAQLTSQLEKTKEDAVLKYEFEIKK

SEQ ID NO: 346 - protein, 430 aa, unidentified
  REGION 1..430: note = Description of Unknown:uncultivated organism sequence
  REGION 1..430: note = Category: MG37 effectors
  REGION 1..430: note = Description: MG37-88 effector
MSSFAETTRSCATELVCRDCGLRLPLEDTTSKCLGCGQGLDIEYDYELAKARLAELPTAQRAINIWRFEELLPIHDATAQRRVGINSGRTPLIHADRLGAELGLRKLYIKDDSTQRPSLSYKDRVVSMAVARLLELGKDEIGCVSTGNVGTAVASLAAKAGVTAYVFYPSNLEPGKARACRALGAAVIQLDGNYDQANRACRELALASGVQFANITLRPFYAEGAKTVAYEVVEKLDWISPDHFVIPAAGGTLSSRVHKGLVELERVGLAETSATKIHAAQPDGCGPIAEAILDGSGEIKHQTPHTAAHSLAIGAPGDGSLVVDAVMSRGGSAAAVTDEEIFEAIDLLGATEGILTEPAGGTTIASTAKLANEGKLGADETVVAVISGNGYKTLDEHPEKPWPSMVSCDVESMGEMLAEFRQHGVGATFS

SEQ ID NO: 347 - protein, 1379 aa, unidentified
  REGION 1..1379: note = Description of Unknown:uncultivated organism sequence
  REGION 1..1379: note = Category: MG37 effectors
  REGION 1..1379: note = Description: MG37-89 effector
MKKWGKRIISGVIAASLLTAAAISGSEQGTGTVASVVQAGTETSFMGKLLEGGYIDVFTSWTQEEQNKFYDGLSPQQQSVFLEVTNCQITRELIKSERSKEELEQFFDRLQPYFLILKKGNQEKPDDEIVIECINQIEGTDYHSSEQYIKQLVSEKKDHYLEFYDALKLVKDGKLEIESAVDDFYKELGFLKKDRVPANSAEVSRQPVQVQKKAAAKAVSDRYSNFKAVSSLKALKDAVASVKKGEKIAVRVDKGFNVTSVIRTNGRHVKIYADGESGHNLNRTAGYKDVMLEVNGGSLTLGAYDGDGRAKNNLYINGKNIAASAPLIEVTSGHLYLNKYSRIIDGYFLADFAGGAGIALNSGTSCYMFGGRIDNCRAKSSKDVSSSSPKSSHGGGVLVGNGSSFYMFAGSIEHCQAIHGGGIMNYGTLRLYGGAISDCAASNQKKDALGGAVKVQGAIETNGKVSSTKGDLGVWKYTRSAAWIVNGKDGYQQGTTTGVVLKNNQADAGGAICLNNGSNGAIQDCNINGNHSTGNGAGICLSNGSYKKGAALELKTGAVIHGNESKGYGGGIYCADSVKGSLSGGTMYDNSAKYGAGIYHEAEFRMSGGTVRSNHSGNSGGGIYAKGKLSMTGGEISANTAATYGGGAILKTVGGSVSGGSIKGNSASANGGGLQIDGTVSLSNASVSSNSASGKGGGISVSSSGTCNLSSGNVSGNTAKAGGGGIYIDGTCKANGSSFTGNQSSGDGGAVYIASGTFTTFQANQAVNIQGNSASGNGSGIYNRNITVLNNNAHILNNQCKNGTQRGIFHEGSLFSIEGNTEIQQEIYLAKDRFVTASNRYFSNSNSLKAKISLDTANIRNGYAVVKGNVSNSADGNYKTGEALLNNQSAGGRFVYAGSGYVMRPGNLKKSSSGCAPFSIVLSQAYQIRYDKNSKEEVMNMPTAAVKYWEEDIKLSALTPTGGSGAFVAWNTKADGTGDGYQPGNVYTANADATLFALWPHYRVEYLPGIRSAAGTTDSQEQNKSEDILLRKNGFRSSEGKFVGWKQDISSARKRMELEPVGYKELKEEREKGKLNHILDFAESYKKVNLSENLDNINSLLDVEDIFFMEGQWDSKPDIILNDKKTFLENEKIKKNDLLKVVKGCYDEEDGELTKKVQIIKLDYTKSMKGYRPETQNFSGGMNDTDVMDTYFMKLEKDETVEVKVTFQAEDSVGNVAEKEGTVCVTYNNPPKLHSQNLAFYQKDIDNNPQTILKEIFENYQVEDIEDDKKGLKVPVSVIDPIPLQIEKLNSVGEHKIVYQAIDSLGKKTKLDSIVYIAENNPFKDSYKYNVRFINKKYLYTLKESSKWKKNEELNAQLTSQLEKTKEDAELKYEFEIKK

SEQ ID NO: 348 - protein, 1378 aa, unidentified
  REGION 1..1378: note = Description of Unknown:uncultivated organism sequence
  REGION 1..1378: note = Category: MG37 effectors
  REGION 1..1378: note = Description: MG37-90 effector
MKKWGKRIISGVIVASLLTAAAISGSEQGTATVSSVVQAGTEMSFMGKLLEGGYIDVFTSWSQEEQNKFYDRLSPKEKSVFLEVTNCQIIRELIKSERTKEELERLFDRLEPYFLMLKKGSQEKPDEEIVIECINQIEGKDYESLEQYLKQLVSEKHGYYLDFYTALKRVKDGKSEIQSAVNDLYKNLGFLKEDKVPAKPDKVSPLPVQVQKKAAKAVSDGYSNFKAVSSLKALKDAVASVEKGEKIAVRVDKGFNVTSAIRTNGRHVKIYADGESARNLNRAVGYKDAMLEVNGGSLTLGAYDGDGRAKNNLYINGKNVAASAPMIEVISGQLYLNKYSRIIDGYFLADFAGGAGIAMNSGTSCYMFGGKIDSCRAKSSKDVSSSSPKSSHGGGVLVGNGASFYMFAGSIEHCQAIHGGGIMNYGTLRLYGGTVSDCAASNKKKDALGGAVKVQGAIETDGKVNSTKGDLGVWKYTRSGTWAVNGKDGYQQKSTTGVVLKNNQADAGGAVCLNNGSNGAIQDCNIYGNHSNGNGAGICLSNGSYKKGAALEIKAGAVIHGNESKGYGGGIYCADSVKGSLRGGSMYDNSAVYGAGVYHEAEFRMTGGTVRNNHSGNSGGGIYAKGKLSMTGGEISSNTAATYGGGAILKNAGGSLSGGSIKNNTASVNGGGLQIDGAVSFSNVSVSSNSASGKGGGISVSSAGTCSFSSGNVSGNTSKAGGGGIYIDGTCKANGSNFTGNQSYGDGGAVYIASGTFTTFQANQAVNIQGNSASGNGSGIYNRNTAILNNNAHILNNQCKNGTQRSIFHEGSLFSIEGHTEIQQEIYLAKDRFITVSNRYFSNSNSLTARISLDAANIRNGYAAVKGNISNSADSNYKTGDALLNNQSVNGRFMYAGSGYVMRPGNLKKSSSGCVPYSIVLSQAYQIRYDKNSKEEVMNMPTAAVKYWEEDIRLSALTPSGGSGVFVAWNTNADGTGDGYQPGNVYTANADATLFALWPHYRVEYLPGIQGAAGTTDSQEQNKSENILLRKNGFRSSEGKFIGWKQDISSARKRRELEPVGYKELKEERERGKSDHILAFAKSYKKVNASVNLDNKNSLLNAEDIFFMEGQWDSKPDIILHDKKTFLENEKIRKNDLLKAVKGCYDDEDGDLTEKVQIIKLDYGTSMEGYRPEPQNFSGGMNDTDVMDTYFMKLEKDETVEVKVIFQVEDSVGNVAEKEGTVYVTYNNPPKLHSQNLAFYQKDLDNNPQTVLKEILENYQVEDLEDDKSGLKVPVSVVDPIPMQIEKLNSVGEHKIVYQAIDSLGKKTKLDSTVYIAENNPFKDSYKYNVRFINKKYLYTLKESSKWKKDGKLNAQLTSQLEKTREDAVLKYEFKIKK

SEQ ID NO: 349 - protein, 430 aa, unidentified
  REGION 1..430: note = Description of Unknown:uncultivated organism sequence
  REGION 1..430: note = Category: MG37 effectors
  REGION 1..430: note = Description: MG37-94 effector
MLNAEDRTRSCATELVCRDCGRRLPLLDTTSKCLGCGQGLDVDYDYELAKARLAEHPTAERAINIWRFEELLPIVDARAQARVGRYSGRTPLIHADRLGAELGLKKLYLKDDSTQRPSLSYKDRVVSMAIARLLELGKEEIGCVSTGNVGTAVSSLAAKAGVTAYVFYPSNMERGKARACRALGAAVCQLDGNYDEANRACRELALASGIQFANITLRPFYAEGAKTVAYEVVEQLEWEAPDHFVIPAAGGTLSSRVHKGLNELEMVGLAETSGTKINVAQPSGCGPIAAAILDGSGEIEPQTPHTAAHSLAIGAPGDGPLVVDAVMSRGGSAATATDPEIFDAIDLLGATEGILTEPAGGTTVASTIKLANEGKLGPDDTVVAIISGNGYKTLDEHPDKPWAEGVACEVDSMTEMLNEFRQHGVGATLS

SEQ ID NO: 350 - protein, 440 aa, unidentified
  REGION 1..440: note = Description of Unknown:uncultivated organism sequence
  REGION 1..440: note = Category: MG37 effectors
  REGION 1..440: note = Description: MG37-95 effector
MSTAVGRAEENQTTRSCVTELVCQKCDVKLPITDMEAFCPTCGKCLDVAYDYELAASRLREMPMSERPASIWRLSELLPIRDSRAQAQVGQFSGLTPLIPANRLGAELGLKKLYVKDDSTSRPSLSYKDRVVSTAIARLIELGKSEIGCVSTGNVGTAVASLAAKAGVTPYVFYPNRLEQTKARACRALGARVCQVSGNYDEANRECRKVAAASGLEFANITLRPFYAEGAKTMAFEIVEQLGWNAPDHIVSATAGGTLSSRLHKGLIELETVGLAQTSSTKMHIAQPDGCSPIASAIIAHQPEIQPCKPTTAAHSLAIGSPGDGYLVIEAVRSRHGSAASASDEEIFLGIDLLAATEGILTEPAGGTTIAVLKKLAEAGEIDPDAVVVAIITGNGLKTLDDHPEKTWPSMVECESESMLSVLSDFQHEQAASAGQPLPA

SEQ ID NO: 351 - protein, 438 aa, unidentified
  REGION 1..438: note = Description of Unknown:uncultivated organism sequence
  REGION 1..438: note = Category: MG37 effectors
  REGION 1..438: note = Description: MG37-96 effector
MSDAADPHLSEPYGLRTRSCATELTCRDCGYRTPLLDRAFKCPACGEGLDVDYDYELAKQRIAERPAGERPWNIWRFEELLPILNRRAQLRVAQFAGKTPLIHAERLGAELGLSRLYLKDDSTNRPSLSYKDRVVGMAIARLLELGKEEVGCVSTGNVGTAVASLAAQAGARPYIFYPGNMEKGKAKACRAMGAQVIQLDANYDQANRACRELALETGMEFANITLRPFYAEGAKTMAFEVVEELGWQAPDHFVIPAAGGTLSSRVHKGLVELERVGLAETAGSKINIAQASGCSPIASAISEGGEIVTQTPETAAHSLAIGAPGDGHLVVDAVRSREGAAATASDEEIFGAIDLLGATEGILTEPAGGTTIASTARLAQEGRIGPDETVVAIISGNGLKTLHEHPEKDWPEGVPCEVGAMEEILNDFRQAAAAAALR

SEQ ID NO: 352 - protein, 430 aa, unidentified
  REGION 1..430: note = Description of Unknown:uncultivated organism sequence
  REGION 1..430: note = Category: MG37 effectors
  REGION 1..430: note = Description: MG37-97 effector
MLNDQARTRSCATEMVCRDCGRTYPLSDTAFRCHGCGNGLDIDYDYELAKKRLGEIPPAEREINIWRFEELLPITDASAQARVGRYSGRTPLIHADRLGAELGLKKLYLKDDSTQRPSLSYKDRVVSMAVARLLELGKDEIGCVSTGNVGTSVSSLAAKAGVAAYVFYPSNMERGKARACRALGAAVIQLDGNYDQANRACRELALASGMQFTNITLRPFYAEGAKTEAYEIVEQLEWCSPDHIVIPAAGGTLSSRVHKGLNELEMVGLAETSQTKINVAQAEGCNPIATAILEEADEIEPQTPNTVAHSIAIGAPGDGALVVDAVKSRGGSAAAVTDQEIFEGIDLLGATEGVLTEPAGGTTIACTAKLANEGKLGPDDTVVAIVSGNGYKTLDEHPEKSWPEMVAPDVEAMSEVLNELRQHGVGATLS

SEQ ID NO: 353 - protein, 430 aa, unidentified
  REGION 1..430: note = Description of Unknown:uncultivated organism sequence
  REGION 1..430: note = Category: MG37 effectors
  REGION 1..430: note = Description: MG37-98 effector
MSPFAEETRSCATELVCRDCGQRLPLMDTTFKCLGCGQGLDIDYDYELAKARLGELPMSEREINIWRFEELLPILDARAQRRVGFYSGRTPLIHADRLGAELGLRKLYLKDDSTQRPSLSYKDRVVSMAVARLLELGKEEIGCVSTGNVGTAVASLAAKAGVTAYVFYPSNLEPGKARACRALGAAVIQLDGNYDQANRACRELALASGVQFANITLRPFYAEGAKTVAYEVVEKLDWISPDHFVIPAAGGTLSSRVHKGLQELEKVGLSETAATKIHAAQPDGCGPIAGAILDGSGEIQPQTPHTAAHSLAIGAPGDGPLVVDAVMSRGGSAATVTDEEIFEAIDLLGATEGILTEPAGGTTVASTAKLAAEGKFGPDETVVAVISGNGYKTLDEHPEKPWPSMVSCDVESMGEMLAEFRQHGVGATLS

SEQ ID NO: 354 - protein, 439 aa, unidentified
  REGION 1..439: note = Description of Unknown:uncultivated organism sequence
  REGION 1..439: note = Category: MG37 effectors
  REGION 1..439: note = Description: MG37-99 effector
MRRPSTPPSSPSGSRKRTRSCATGLVCHRCERNFPLEQAIFACPDCGKGLDVAYDYELAARHFAEVPRAERPLNIWRFEELLPIVGTSAQALVGSYAGYTPLIAADRLGAELGLSNLYLKDDSTSRPSLSYKDRVVSMSVARLLELGKDEIGCVSTGNVGTAVASLAAKAGVDAYVFYPSHLEAMKARACRALGAEVCQVEGNYDEVNRRCRDLAAATGMEFANITLRPFYAEGAKTAAFEIVEQLDWQSPDHIVTPAAGGTLSSRLHKGLGELQLLGLAETSATRIHIAQPSGCNPIASAILAEEAEIHAVTPETAAHSLAIGAPGDGYLVIDAVRKRGGTGGFASDPEIFAGIDLLASTEGLLTEPAGGTTIAVLEKLAAAGRFAPDDTVVAVITGNGLKTLDEHPAKPWPDKVDCELDAMLAALEELGRKPSPVAA

SEQ ID NO: 355 - protein, 444 aa, unidentified
  REGION 1..444: note = Description of Unknown:uncultivated organism sequence
  REGION 1..444: note = Category: MG37 effectors
  REGION 1..444: note = Description: MG37-100 effector
MSTQTAQSPPGAGQRTRSCATGVACHRCEKHYPLEDTVFACPGCGKGLDVVYDYELAARHFKEVPSSERPQNIWHFEELLPIVDASAQARVGLHSGYTPLIRADRLGAELGLSNLYLKDDSTSRPSLSYKDRVVSMSVARLLERGKTEIGCVSTGNVGTAVASMAAAAGVDAYVFYPNRLEDMKARACMALGAKVCQVEGNYDEANRRCREVAETTGMDFANITLRPFYAEGAKTAAFEIVEQLDWRSPDHIITAAAGGTLSSRLHKGLLELQHLGLSETDPTRIHIAQPSGCNPIATAIIAEEAEVRPVTPETAAHSLAIGAPGDGYLVIDAVLKRGGTGGFASDPEIFAGIDLLAATEGLLTEPAGGTTVAVLEKLAAAGRFAPDDTVVAIITGNGLKTLDDHPPKPWPAKVDCELDAMLAALSELKSGGSLVDSAREQLHA

SEQ ID NO: 356 - protein, 444 aa, unidentified
  REGION 1..444: note = Description of Unknown:uncultivated organism sequence
  REGION 1..444: note = Category: MG37 effectors
  REGION 1..444: note = Description: MG37-101 effector
MSTQTAQSPPGAGQRTRSCATGVACHRCEKHYPLEDTVFACPGCGKGLDVVYDYELAARHFKEVPSSERPQNIWHFEELLPIVDASAQARVGLHSGYTPLIRADRLGAELGLSNLYLKDDSTSRPSLSYKDRVVSMSVARLLERGKTEIGCVSTGNVGTAVASMAAAAGVDAYVFYPNRLEDMKARACMALGAKVCQVEGNFDEANRRCREVAETTGMDFANITLRPFYAEGAKTAAFEIVEQLDWRSPDHIITAAAGGTLSSRLHKGLLELQHLGLSETDPTRIHIAQPSGCNPIATAIIAEEAEVRPVTPETAAHSLAIGAPGDGYLVIDAVLKRGGTGGFASDPEIFAGIDLLAATEGLLTEPAGGTTVAVLEKLAAAGRFAPDDTVVAIITGNGLKTLDDHPPKPWPAKVDCELDAMLAALSELKSGGSLVDSAREQLHA

SEQ ID NO: 357 - protein, 430 aa, unidentified
  REGION 1..430: note = Description of Unknown:uncultivated organism sequence
  REGION 1..430: note = Category: MG37 effectors
  REGION 1..430: note = Description: MG37-103 effector
MLSPEDRTRSCATEMVCRDCGRTYPLLDTAFRCHGCGNGLDIDYDYELATKRLAEIPPAEREINIWRFEELLPIVDARAQARVGRYSGRTPLIHADRLGAELGLKKLYIKDDSTSRPSLSYKDRVVSMAIARLLELGNDEIGCVSTGNVGTAVSSLAAKAGVAAYVFYPSNMERGKARACRALGAAVIQLDGNYDQANRACRELALASGMQFTNITLRPFYAEGAKTEAYEVVEQLEWHSPDHFVIPAAGGTLSSRVHKGLNELEMVGLAETSGTKINVAQAEGCDPIATAILDGSGEIEPQSPQTAAHSIAIGAPGDGALVVDAVKSRGGSAASVTDAEIFEGIDLLGATEGILTEPAGGTTIASTAKLAAEGKIGPEDTVVAIVSGNGYKTLDEHPDKPWAEGVACEVEAMGEVLNELRQHGVGATLG

SEQ ID NO: 358 - protein, 437 aa, unidentified
  REGION 1..437: note = Description of Unknown:uncultivated organism sequence
  REGION 1..437: note = Category: MG37 effectors
  REGION 1..437: note = Description: MG37-104 effector
MSDAVDPHLTGPEGPRTRSCATELVCRDCGYRTPLLDTAFKCPACGEGLDVDYDYERAKEAIAERGLEGRPANVWRFEELLPITSLGAQRRVAQFAGKTPLIHAERLGAELGLSNLYLKDDSTNRPSLSYKDRVVGMAIARLLELGKDEVGCVSTGNVGTAVASLAAQAGARPYIFYPGNMEKGKAKACRAMGAQVIQLDANYDQANRACRELAITTGMEFANITLRPFYAEGAKTMAFEVVEELGWQAPDHFVIPAAGGTLSSRVHKGLVELETVGLAETAGSKINIAQASGCSPIATAIVGGGEIEPQMPETAAHSLAIGAPGDGTLVLDAVRSRGGSAATASDDEIWNAIDLLGATEGILTEPAGGTTIASTARLAQEGKIGPDETVVAVISGNGLKTLHEHPEKDWPEGVPCEVGAMEQLLNDFRQAAAAALH

SEQ ID NO: 359 - protein, 437 aa, unidentified
  REGION 1..437: note = Description of Unknown:uncultivated organism sequence
  REGION 1..437: note = Category: MG37 effectors
  REGION 1..437: note = Description: MG37-105 effector
MSEAVEPHLEGTYGSRTRSCATELACRDCGYRTPLLDTAFKCPACGEGLDIDYDYELAKARIAEHDLSARPHNIWRFEELLPILSRKAQAKVGQFSGQTPLIHADRLGAELGLKKLYLKDDSTNRPTLSYKDRVVGMAIARMLELGKDEIGCVSTGNVGTAVAALAAKAGAAAYIFYPGNMEKGKAKACRALGAHVCQLDGNYDQANRACRELALTSGMQFANITLRPFYAEGAKTMAFEVVEELGWVAPDHFVIPAAGGTLSSRVHKGLNELELVGLAETSGTKINIAQPSGCGPIAGAILDGGEIQHQAPNTAAHSLAIGAPGDGSLVVDAVRTRGGTAATASDDEIFAAIDLLAATEGVLTEPAGGTTIASTAKLAAEGKLGPDDTVVAVISGNGLKTLQDHPEKTWPEMVACEVETMESVLNDFRREVAAVHH

SEQ ID NO: 360 - protein, 445 aa, unidentified
  REGION 1..445: note = Description of Unknown:uncultivated organism sequence
  REGION 1..445: note = Category: MG37 effectors
  REGION 1..445: note = Description: MG37-106 effector
MSIQTAESPPQGSRQRTRSCAIELACRRCDNHYPLEQAVFACPDCGKGLDVVYDYELAARHFREVASSERPQNIWHFEELLPIVDASAQARVGRHAGYTPLIQADRLGAELGIANLYLKDDSSNRPSLSYKDRVVSMSVARLLELGKSEIGCVSTGNVGTAVASLAAKAGVDAYVFYPNRLEDTKARACMALGAKVCQVEGNYDEANRRCRELAEATGMEFANITLRPFYAEGAKTAAFEIVEQLDWRAPDHIVTAAAGGTLSSRLHKGLVELQLLGLSETDSTRIHIAQPSGCNPIASAILAEEAEIHAVTPETAAHSLAIGNPGDGYLVIDAVLKRGGTGGFASDPEIFAGIDLLAATEGLLTEPAGGTTIAVLEKLAAAGRFAADETVVATITGNGLKTLDDHPRKPWPAKIDCELDAMRAALEDLKSSGSLVQSAREQLHF

SEQ ID NO: 361 - protein, 438 aa, unidentified
  REGION 1..438: note = Description of Unknown:uncultivated organism sequence
  REGION 1..438: note = Category: MG37 effectors
  REGION 1..438: note = Description: MG37-107 effector
MSDAVDPHRTEPYGLRTRSCATELTCRECGYRTPLLDKAFKCPACGEGLDVDYDYELAKKRIAERSTDERPWNIWRFEELLPILNRRAQERVAQFAGKTPLIHAERLGAELGLSRLYLKDDSTNRPSLSYKDRVVGMAIARLLELGKDEVGCVSTGNVGTAVASLAAQAGARPYIFYPGNMEKGKAKACRAMGAQVIQLDANYDQANRACRELALETGMEFANITLRPFYAEGAKTMGFEVVEELGWQAPDHFVIPAAGGTLSSRVHKGLVELEKVGLAETAGSKINIAQASGCSPIATAITGGGEIVTQTPETAAHSLAIGAPGDGNLVVDAVRSREGSAATASDEEIWSAIDLLGATEGILTEPAGGTTIASTARLAQEGKIGPDETVVAVISGNGLKTLHEHPEKDWPEGVPCEVGAMEQILNDFRQAAAAAALR

SEQ ID NO: 362 - protein, 437 aa, unidentified
  REGION 1..437: note = Description of Unknown:uncultivated organism sequence
  REGION 1..437: note = Category: MG37 effectors
  REGION 1..437: note = Description: MG37-108 effector
MSDAVDPHLEAPAGPQTRSCATELICRDCGYRTPLLDTAFKCPACGEGLDVDYDYERAQATIAAHPLDERPHDLWRFEELLPITSQRAQSRVGQISGQTPLIHAERLGAELGLNRLYIKDDSTNRPTLSYKDRVVGMAIARLLELGKDEVGCVSTGNVGTAVSALAAAAGAKAYVFYPGNMEKGKAKACRALGAQVCQLDGNYDQANRACRELSLASGIEFANISLRPFYAEGAKTMAFEVVEQLGWEAPDHLVIPAAGGTLSSRVHKGLNELQTVGLATTEGAKLNIAQASGCSPIAAAIRGGGELEPQTPETAAHSIAIGAPGDGNLVIDAVRTRGGWAATASDPEIFEAIDLLGRTEGLLTEPAGGTTIACTARLAQEGKIGRDEVVVAAITGNGLKTIADHPEKPWPEGVACNVEAMSEMLAEFRATAETALH

SEQ ID NO: 363 - protein, 1379 aa, unidentified
  REGION 1..1379: note = Description of Unknown:uncultivated organism sequence
  REGION 1..1379: note = Category: MG37 effectors
  REGION 1..1379: note = Description: MG37-109 effector
MKKWGKRIVSGVIAVSLLAAASISRQKPGGNTVESIVQAGTEASFMGSLLQGEYIDVFTSWPVKEQNVFYDSLKPQERSVFFEVTNYQIIRQLTKTGRKKKDLDDLLQKLGAYFQLLRIGSVEKAKEQTVIECINEIEKTEYQSADEYVKQLIPEKQTCYMEFYLALNQAWKDKKDIQDAVDELYKKLGFKEEKKQDSPTTAVIKSSRTVQQKAAAKAVSDGFSNFKAVSSLKEMKDAIDSVKKGEKLAVRVDKGFNVTSAIKTNGRHVKLYADSVSGHNLNRTSAYKGAMIEVNGGSLTLGAYDGDGRAKNTLYINGKNVTATASLIEVTSGQLYLNKYSRIMDGYYLADFAGGGGVTLESGTSCYMFGGKIDGCQAANSKDVSSSSPKSSHGGGIVVNDKASFYMFSGSVERCKAVHGGGIMVYGTARLYGGTITDCAAVNKKNDALGGAVKVQGAFSTDGKTTSVTGDFAAWKYTRSNTWSVNGKDGYEQASTSGAVLKNNQANAGGSVCINNGSKGTIQDCNIYGNQSTGNGAGICLSNGSYKKGASLEIKNGAGIHGNTSSGYGGGVYCADSVKGSISGGSVYNNTASYGAGIYHEAEFLMSGGTVRNNQSANSGGGFYAKGKLVTTGGEVAGNTAKTYGGGAIIKSAGASISGVRIKSNSAAVNGGGVQLDGQAVVSNAAVSENTASAKGGGISVSTAGGLQMNKGTVSGNTAKSNGGGINADGTCKVNGSNLTGNQVNGDGGAVYVGSGTFTTFQANQAVNIEGNSAAKNGAGIYNKNVTVLNNNAHILINQCKNGSEHNVFHAGSQLLVEGNAEIKQEVYLTKDRFITASSKYFSSANSLTMKISMDSSNVRNGYAVVKGDIPDTRDSSYKAGDTLLHNQAAEGRFAYTGTCYGLRPGNLKKSSSGCVPYSIVLSQAYKICYDKNSTQEVRNMPTAAVKHWEEDMRLSELVPSSGSGVFVAWNTRSDGTGNGYQPGNLYTANEDVILFALWPHYKVEYVPGIQGTNGVTDSQEQNKSEDILLRKNGFRSSEGKFICWKQDAYKARKRNEMEAAGYTDLKTERDGQGQDYVFGFSKNLRRGNLNSNSENAGSLLDVDDIFIMKGQWDFKPDIILKDKMIFRENEKVNRKKLLELVESCHDIEDGDLMKRIQISKIQYGMTKKGKKPKDVIFSNGMENSDLMNTYFMLLDKNETVNVKITFQVEDSAGNLTTKEGFVYVNYNHPPKLHSYNLAYYQQELETKDQIVLKEIIENCKVEDIEDDEQGIKIPVSVVEPIPLQIEKLKAAGKHKIVYKAVDSLGKETKLETELYIAEGSPYLDSYIYRVRFINKDYLHTLDQNSKWRKNLDLNKKLVTQLEKTENDVLMKYKFQSNK

SEQ ID NO: 364 - protein, 1378 aa, unidentified
  REGION 1..1378: note = Description of Unknown:uncultivated organism sequence
  REGION 1..1378: note = Category: MG37 effectors
  REGION 1..1378: note = Description: MG37-110 effector
MKKWGKRIISGVIVASLLTAAAISGSEQGTATVSSVVQAGTEMSFMGKLLEGGYIDVFTSWTQEEQIKFYDRLSPKEKSVFLEVTNCQIIRELIKSERTKEELERFFDRLEPYFLMLKKGSQEKPDEEIVIECINQIEGKDYESLEQYLKQLVSEKHGYYLDFYTALKRVKDGKSEIESAVNDLYKNLGFLKEDKVPAKPDKVSPLPVQVQKKAAKAISDGYSNFKAVSSLKALKDAVASVEKGEKIAVRVDKGFNVTSAIRTNGRHVKIYADGESAHNLNRAVGYKDAMLEVNGGSLTLGAYDGDGRAKNNLYINGKNVAASAPMIEVTSGQLYLNKYSRIIDGYFLADFAGGAGIAMNSGTSCYMFGGKIDSCRAKSSKDVSSSSPKSSHGGGVLVGNGASFYMFAGSIEHCQAIHGGGIMNYGTLRLYGGTVSDCAASNKKKDALGGAVKVQGAIETDGKVNSTKGDLGVWKYTRSGTWAVNGKDGYQQKSTTGVVLKNNQADAGGAVCLNNGSNGAIQDCNIYGNHSNGNGAGICLSNGSYKKGAALEIKTGAVIHGNESKGYGGGIYCADSVKGSLRGGSMYDNSAVYGAGVYHEAEFRMTGGTVRNNHSGNSGGGIYAKGKLSMTGGEISSNTAAAYGGGAILKNAGGSLSGGSIKNNTASVNGGGLQIDGAVSFSNVSVSSNSASGKGGGISVSSAGTCNFSSGNVSGNTSKAGGGGIYIDGTCKANGSNFTGNQSYGDGGAVYIASGTFTTFQANQAVNIQGNSASGNGSGIYNRNTAILNNNAHILNNQCKNGTQRGIFHEGSLFSIEGHTEIQQEIYLAKDRFITASNRYFSNSNSLTARISLDAANIRNGYAAVKGNISNSADSNYKTGDALLNNQSVNGRFMYAGSGYVMRPGNLKKSSSGCVPYSIVLSQAYQIRYDKNSKEEVMNMPTAAVKYWEEDIRLSALTPSGGSGVFVAWNTNADGTGDGYQPGNIYTANADATLFALWPHYRVEYLPGIQGAAGTTDSQEQNKSENILLRKNGFRSSEGKFIGWKQDISSARKRRELEPVGYKELKEERERGKSDHILAFAKSYKKVNASVNLDNKNSLLNAEDIFFMEGQWDSKPDIILHDKKTFLENEKIRKNDLLKAVKGCYDDEDGDLTEKVQIIKLDYGTSMEGYRPEPQNFSGGMNDTDVMDTYFMKLEKDETVEVKVIFQVEDSVGNVAEKEGTVYVTYNNPPKLHSQNLAFYQKDLDNNPQTVLKEILENYQVEDLEDDKSGLKVPVSVVDPIPMQIEKLNSVGEHKIVYQAIDSLGKKTKLDSTVYIAENNPFKDSYKYNVRFINKKYLYTLKESSKWKKDGKLNAQLTSQLEKTREDAVLKYEFKIKK

SEQ ID NO: 365 - protein, 432 aa, unidentified
  REGION 1..432: note = Description of Unknown:uncultivated organism sequence
  REGION 1..432: note = Category: MG37 effectors
  REGION 1..432: note = Description: MG37-111 effector
MSLSADQRTRSCATELVCHDCGLRLPLLDTTFKCLGCGQGLDIDYDYELARARLADQPVAQRELNIWRFEELLPIVDASARARVGRYSGRTPLIHADRLGAELGLRKLYLKDDSTQRPSLSYKDRVVSMAVARLLELGKEEIGCVSTGNVGTAVASLAAKAGVAAYVFYPSNLERGKARACRALGAAVIQLDGNYDEANRACRELAMASDIQFANITLRPFYAEGAKTMAFEVVEQLDWVSPDHFVIPAAGGTLSSRVHKGLEEMEKVGMAETAATKIHIAQAGGCDPIATAILDGGGEIEAQRPNTAAHSLAIGAPGDGPLVIDAVTSRGGSAASATDPEIFEALDLLGATEGILTEPAGGTTIAAAMKLANEGKLGPDDTVVAVISGNGYKTLDEHPDKPWPEGVAPEVEAMEQTLAQFRNTGTSAALSG

SEQ ID NO: 366 - protein, 1378 aa, unidentified
  REGION 1..1378: note = Description of Unknown:uncultivated organism sequence
  REGION 1..1378: note = Category: MG37 effectors
  REGION 1..1378: note = Description: MG37-112 effector
MKKWGKRIISGVIVASLLTAAAISGSEQGTATVSSVVQAGTETSFMGKLLEGGYIDVFTSWTQEEQNKFYDRLSPKEKSVFLEVTNCQIIRELIKSERTKEELERFFDRLEPYFLMLKKGSQEKPDEEIVIECINQIEGKDYESLEQYLKQLVSEKHGYYLDFYTALKRVKDGKSEIESAVNDLYKNLGFLKEDKVPAKPDKVSPLPVQVQKKAAKAVSDGYSNFKAVSSLKALKDAVASVEKGEKIAVRVDKGFNVTSAIRTNGRHVKIYADGESAHNLNRAVGYKDAMLEVNGGSLTLGAYDGDGRAKNNLYINGKNVAASAPMIEVTSGQLYLNKYSRIIDGYFLADFAGGAGIAMNSGTSCYMFGGKIDSCRAKSSKDVSSSSPKSSHGGGVLVGNGASFYMFAGSIEHCQAIHGGGIMNYGTLRLYGGTVSDCAASNKKKDALGGAVKVQGAIETDGKVNSTKGDLGVWKYTRSGTWAVNGKDGYQQKSTTGVVLKNNQADAGGAVCLNNGSNGAIQDCNIYGNHSNGNGAGICLSNGSYKKGAALEIKTGAVIHGNESKGYGGGIYCADSVKGSLRGGSMYDNSAVYGAGVYHEAEFRMTGGTVRNNHSGNSGGGIYAKGKLSMTGGEISSNTAATYGGGAILKNAGGSLSGGSIKNNTASVNGGGLQIDGAVSFSNVSVSSNSASGKGGGISVSSAGTCSFSSGNVSGNTSKAGGGGIYIDGTCKANGSNFTGNQSYGDGGAVYIASGTFTTFQANQAVNIQGNSASGNGSGIYNRNTAILNNNAHILNNQCKNGTQRGIFHEGSLFSIEGHTEIQQEIYLAKDRFITVSNRYFSNSNSLTARISLDAANIRNGYAAVKGNISNSADSNYKTGDALLNNQSVNGRFMYAGSGYVMRPGNLKKSSSGCVPYSIVLSQAYQIRYDKNSKEEVMNMPTAAVKYWEEDIRLSALTPSGGSGVFVAWNTNADGTGDGYQPGNVYTANADATLFALWPHYRVEYLPGIQGAAGTTDSQEQNKSENILLRKNSFRSSEGKFIGWKQDISSARKRRELEPVGYKELKEERERGKSDHILAFAKSYKKVNASVNLDNKNSLLNAEDIFFMEGQWDSKPDIILHDKKTFLENEKIRKNDLLKAVKGCYDDEDGDLTEKVQIIKLDYGTSMEGYRPEPQNFSGGMNDTDVIDTYFMKLEKDETVEVKVIFQVEDSVGNVAEKEGTVYVTYNNPPKLHSQNLAFYQKDLDNNPQTVLKEILENYQVEDLEDDKSGLKVPVSVVDPIPMQIEKLNSVGEHKIVYQAIDSLGKKTKLDSTVYIAENNPFKDSYKYNVRFINKKYLYTLKESSKWKKDGKLNAQLTSQLEKTREDAVLKYEFKIKK

SEQ ID NO: 367 - protein, 438 aa, unidentified
  REGION 1..438: note = Description of Unknown:uncultivated organism sequence
  REGION 1..438: note = Category: MG37 effectors
  REGION 1..438: note = Description: MG37-113 effector
MSEAVDPRLGGPGGPRTSSCATELVCRECGYRAPLSDTAFRCPTCDAGLDVDYDYERAKASIAARGLAERPWNIWRFEELLPIAGRRAAGTVAQFAGQTPLIPARRLGAELGLRNLYVKDDSTNRPSLSYKDRVVGMAVARALELGAGEIGCVSTGNVGTATASLAAAAGLKPYVFYPANLERAKARGCRALGAQVCQVDGNYDEANRACRELTEATGIPFANISLRPFYAEGAKTLAYELVEGLGWRSPDHVVMPAAGGTLSSRVHKGLLEFEILDLAETAATKLHVGQPTGCSPIVTTIVDGAKEIVPQQPETLAHSLAIGAPGDGDLVVEAVRSRGGSAAAVPDGEIIEAMELLAATEGVLTEPAGGTTVAATMKLAQRGEIAPDDVVVIVISGNGLKTLSEQPVKPWPEGVPCNAATMEEVVVEFREGGVTSRA

SEQ ID NO: 368 - protein, 430 aa, unidentified
  REGION 1..430: note = Description of Unknown:uncultivated organism sequence
  REGION 1..430: note = Category: MG37 effectors
  REGION 1..430: note = Description: MG37-114 effector
MLSSEDRTRSCATELVCRDCGRRLPLLDTTSKCLGCGNGLDIDYDYELAKARLAEHPTSERAINIWRFEELLPILDARAQARVGRYSGRTPLIHADRLGAELGLKKLYLKDDSTQRPSLSYKDRVVSMAVARLLELGKDEIGCVSTGNVGTAVASLAAKAGVTAYVFYPSNMERGKARACRALGAAVCQLDGNYDEANRACRELALASGIQFANITLRPFYAEGAKTVAYEVVEQLDWVAPDHFVIPAAGGTLSSRVHKGLNELEMVGLAQTSGTKINVAQAEGCNPIAAAILDGSGEVKPQAPNTAAHSIAIGAPGDGALVVNAVMSRGGSAAAVADSEIFDAIDLLGATEGILTEPAGGTTVASTIKLANEGKLGPEDTVVAVISGNGYKTLDEHPDKPWAEGVACELDAMTEMLNEFRLHGVGATLS

SEQ ID NO: 369 - protein, 430 aa, unidentified
  REGION 1..430: note = Description of Unknown:uncultivated organism sequence
  REGION 1..430: note = Category: MG37 effectors
  REGION 1..430: note = Description: MG37-115 effector
MSLSADQRTRSCATELVCHDCGLRLPLLDMTFKCLGCGQGLDIDYDYELAAARVAEQPIAERELNIWRFEELLPIVDAKARDRVGRYSGRTPLIHADRLGAELGLRKLYLKDDSTQRPSLSYKDRVVSMAVARLLELGKGEMGCVSTGNVGTAVASLAAKAGVAAYVFYPSNLERGKARACRALGAAVIQLDGNYDEANRACRELALASGIQFANITLRPFYAEGAKTMAFEVVEQLDWVSPDHFVIPAAGGTLSSRVHKGLGEMETVGMAETAATKIHIAQPEGCGPIATAVLDGSGKIEAQRPQTAAHSLAIGAPGDGPLVVDAVTSRGGSAATATDPEIFEALDLLGATEGILTEPAGGTTIAATIKLANEGKLGPDDTVVAVISGNGYKTLDEHPDKPWPERVACEVEAMEETLAGFRGAEAALSR

SEQ ID NO: 370 - protein, 448 aa, unidentified
  REGION 1..448: note = Description of Unknown:uncultivated organism sequence
  REGION 1..448: note = Category: MG37 effectors
  REGION 1..448: note = Description: MG37-116 effector
MSPQTAQSLGSGPPAPRQRTRSCATGLACHRCGSHYPLEQAIFACPDCGKGLDVVYDYEHAASHFRDVPSSERPHNIWHFEELLPIVDAAAQARVGQHSGYTPLIRADRLGAELGLSNLYLKDDSSNRPSLSYKDRVVSMSVARLLERGGTEIGCVSTGNVGTAVASMAAKAGVDAYVFYPNRLEDTKARACMALGAKVCQVEGNYDEANRRCRELAESTGMDFANITLRPFYAEGAKTAAFEIVEQLEWQAPDHIITAAAGGTLSSRLHKGLVELQLLELAETDSTRIHIAQPSGCNPIATAIVAEEAEIRAVTPETAAHSLAIGNPGDGYLVIDAVLKRGGTGGFASDPEIFAGIDLLAATEGLLTEPAGGTTIAVLEKLAAAGRFAPDDTVVAIITGNGLKTLDDHPAKSWPDKIECELDAMLAALSELKSSGTLVDSARRQLHP

SEQ ID NO: 371 - protein, 438 aa, unidentified
  REGION 1..438: note = Description of Unknown:uncultivated organism sequence
  REGION 1..438: note = Category: MG37 effectors
  REGION 1..438: note = Description: MG37-117 effector
MSTATGRVEDDKTTRSCVTELVCHRCDVRRPITDTEAFCPECGKCFDVAYDYELAKARLGELAMGERPQNIWRLSELLPIRSARAQAEVGQVSGMTPLIAATRLGSRLGLRKLYLKDDSTQRPSLSYKDRVVSSAIARALELGKTEIGCVSTGNVGTAVAALAAKAGVTPYVFYPNRLEQTKAKACRALGARVCQVAGNYDEANRECKKVAAASGLEFANITLRPFYAEGAKTTVFEIVEQLGWRAPDHIVSATAGGTLSSRLHKGLVELETVGLAQTGSTKMHIAQPAGCSPIASAIEAGDKEIHPCTPETAAHSLAIGSPGDGYLVIDAVLSRKGSAGTANDEEIFAGIDLLAETEGILTEPAGGTTIAVLKKLVESGELDPDATVVAIITGNGLKTLEDHPEKPWPQTECEAESMLAVLSDLQGQAASARQPLPV

SEQ ID NO: 372 - protein, 439 aa, unidentified
  REGION 1..439: note = Description of Unknown:uncultivated organism sequence
  REGION 1..439: note = Category: MG37 effectors
  REGION 1..439: note = Description: MG37-118 effector
MSDAVDPHLTEPYGLRTRSCATELTCRDCGYRTPLLDKAFKCPACGEGLDVDYDYDLAKQRIAERPAAERPWNIWRFEELLPILNRRAQERVAQFAGKTPLIHAERLGAELGLSNLYIKDDSTNRPSLSYKDRVVGMAIARLLELGKTEVGCVSTGNVGTAVAALAAQAGATPYIFYPGNMEKGKAKACRALGAQVIQLDANYDGANRACRELALATGMEFANITLRPFYAEGAKTMAFEVVEEMGWQPPDHFVIPAAGGTLSSRVHKGLVELEKVGLAETAGSKINIAQASGCSPISTAITAGGAEISPQTPETAAHSIAIGAPGDGALVVDAVVGRGGSGATATDEEIFGAIDLLGETEGILTEPAGGTTIACTARLAQEGKIAPDETVVAVISGNGLKTLHEHPEKTWPEMVPCEAGAMEEILNDFRQAAATAALR

SEQ ID NO: 373 - protein, 445 aa, unidentified
  REGION 1..445: note = Description of Unknown:uncultivated organism sequence
  REGION 1..445: note = Category: MG37 effectors
  REGION 1..445: note = Description: MG37-119 effector
MSTQTAQNPPSRSRQRTRSCATGLVCHRCENHYPLEQAIFACPDCGKGLDVAYDYERAASHFKEVPGSERPENIWRFEELLPIVDAAAQARVGRYAGFTPLIHADRLGAELGLSNLYLKDDSTSRPSLSYKDRVVSMSVARLLELGKHEIGCVSTGNVGTAVASMAAKAGVDAYVFYPNRLEDMKARACMALAAKVCQVEGNYDEANRRCRELALATGMEFANITLRPFYAEGAKTAAFEIVEQLDWRAPDHIVTAAAGGTLSSRLHKGLGELQLLGLSETDPTRIHIAQPSGCNPIASAILAEEAEIKPVTPETAAHSLAIGAPGDGYLVIDAVRKRGGTGGFASDPEIFAGIDLLAATEGLLTEPAGGTTIAVLEKLAAAGRFAPDETVVAIVTGNGLKTLDDHPQKPWPAKVDCELDAMLAALTELKGGGSLIDSAREQLRA

SEQ ID NO: 374 - protein, 445 aa, unidentified
  REGION 1..445: note = Description of Unknown:uncultivated organism sequence
  REGION 1..445: note = Category: MG37 effectors
  REGION 1..445: note = Description: MG37-120 effector
MSTQTAHSPAQGSRQRTRSCATGLACHRCDHSYPLEDAIFACPDCGKGLDVVYDYELAARHFREVPAAERPQNVWHFEELLPIVDARAQARVGQHTGYTPLIRAERLGAELGIGNLYLKDDSTSRPSLSYKDRVVSMSVARLLERGGSEIGCVSTGNVGTAVASLAAKAGVDAYVFYPNRLEDMKARACRALGAKVCQVEGNYDEANRRCRELAEATGMDFANITLRPFYAEGAKTAAFEIVEQLEWDAPDHIVTAAAGGTLSSRLHKGLVELQLLGLAETDATRIHIAQPSGCNPIASAILAEEAEVVPVTPETAAHSLAIGAPGDGYLVVDAVRTRGGTAGYASDPEIFAGFDLLAATEGLLTEPAGGTTVAVLEKLAAAGRFEADETVVAIITGNGLKTLDDHPAKPWPAKVDCELDAMRAALEDLKSGASLIDSAREQLHV

SEQ ID NO: 375 - protein, 1372 aa, unidentified
  REGION 1..1372: note = Description of Unknown:uncultivated organism sequence
  REGION 1..1372: note = Category: MG37 effectors
  REGION 1..1372: note = Description: MG37-121 effector
MKKWGKRIISGVIAASLLTAAAISGSEQGTGTVASVVQAGTETSFMGKLLEGGYIDVFTSGTQEEQNKFYDGLSPQQQSVFLEVTNCQITRELIKSERSKEELEQFFDRLQPYFLILKKGNQEKPDDEIVIECINQIEGTDYHSSEQYIKQLVSGKKDHYLEFYNALKLVKDGKLEIESAVDDFYKELGFLKKDRVPANSAEVSRQSVQVQKKAAAKAVSDGYSNFKAVSSLKALKDAVASVKKGEKIAVRVDKGFNVTSVIRTNGRHVKIYADGESGHNLNRTAGYKDVMLEVNGGSLTLGAYDGDGRAKNNLYINGKNIAASSGHLYLNKYSRIIDGYFLADFAGGAGIALNSGTSCYMFGGRIDNCRAKSSKDVSSGSPKSSHGGGVLVGNGSSFYMFAGSIEHCQAIHGGGIMNYGTLRLYGGAISDCAASNQKKDALGGAVKVQGAIETDGKVSSTKGDLGVWKYRRSAAWIVNGKDGYQQVTTTGVVLKNNQADAGGAICLNNGSNGAIQDCSINGNHSTGNGAGICLSNGSYKKGAALELKMGAVIHGNESKGYGGGFYCADSVKGSLSGGTMYDNSAKYGAGIYHEAEFRMSGGTVRNNHSGNSGGGIYAKGKLSMTGGEISANTAATYGGGAILKTAGGSVSGGSIKGNSASANGGGLQIDGTVSLSNASVSSNSASGKGGGISVSSSGTCNLSSGNVSGNTAKAGGGGIYIDGTCKANGSSFTGNQSSGDGGAVYIASGTFTTFQANQAVNIQGNSASGNGSGIYNRNITVLNNNAHILNNHCKNGTQRGIFHQGSLFSIEGNTEIQQEIYLAKDRFVTASNRYFSNSNSLKAKISLDTANIRNGYAVVKGNVSNSADGNYKTGEALLNNQSAGGRFVYAGSGYVMRPGNLKKSSSGCAPFSIVLSQAYQIRYDKNSKEEVMNMPTAAVKYWEEDIRLSALTPASGSGAFVAWNTKADGTGDGYQPGNVYTANADATLFALWPHYRVEYLPGIRSAAGTTDSQEQNKSEDILLRKNGFRSSEGKFVGWKQDISSARKRMELEPVGYKELKEEREKGKLNHILDFAESNKKVNSSENLDNINSLLDVEDIFFMEGQWDSKPDIILNDKKTFLENEKIKKNDLLKVVKGCYDEEDGELTKKVQIIKLDYAKSMKGYRPETQNFSGGMNDTDVMDTYFMKLEKDETVEVKVTFQAEDSVGNVAEKEGTVCVTYNNPPKLHSQNLAFYQKDLDNNPQTILKEIFENYQVEDIEDDKKGLKVPVSVIDPIPLQIEKLNSVGEHKIVYQAIDSLGKKTKLDSIVYIAENNPFKDSYKYNVRFINKKYLYTLKESSKWKKDEELNAQLTSQLEKTKEDAVLKYEFEIKK

SEQ ID NO: 376 - protein, 407 aa, unidentified
  REGION 1..407: note = Description of Unknown:uncultivated organism sequence
  REGION 1..407: note = Category: MG37 effectors
  REGION 1..407: note = Description: MG37-122 effector
MFACPGCGKGLDVVYDYELAARHFKEVPSSERPQNIWHFEELLPIVDASAQARVGLHSGYTPLIRADRLGAELGLSNLYLKDDSTSRPSLSYKDRVVSMSVARLLERGKTEIGCVSTGNVGTAVASMAAAAGVDAYVFYPNRLEDMKARACMALGAKVCQVEGNYDEANRRCREVAETTGMDFANITLRPFYAEGAKTAAFEIVEQLDWRSPDHIITAAAGGTLSSRLHKGLLELQHLGLSETDPTRIHIAQPSGCNPIATAIIAEEAEVRPVTPETAAHSLAIGAPGDGYLVIDAVLKRGGTGGFASDPEIFAGIDLLAATEGLLTEPAGGTTVAVLEKLAAAGRFAPDDTVVAIITGNGLKTLDDHPPKPWPAKVDCELDAMLAALSELKSGGSLVDSAREQLHA

SEQ ID NO: 377 - protein, 1378 aa, unidentified
  REGION 1..1378: note = Description of Unknown:uncultivated organism sequence
  REGION 1..1378: note = Category: MG37 effectors
  REGION 1..1378: note = Description: MG37-123 effector
MKKWGKRIISGVIVASLLTAAAISGSEQGTATVSSVVQAGTETSFMGKLLEGGYIDVFTSWTQEEQNKFYDRLSPKEKSVFLEVTNCQIIRELIKSERTKEELERFFDRLEPYFLMLKKGSQEKPDEEIVIECINQIEGKDYESLEQYLKQLVSEKHGYYLDFYTALKRVKDGKSEIESAVNDLYKNLGFLKEDKVPAKPDKVSPLPVQVQKKAAKAVSDGYSNFKAVSSLKALKDAVASVEKGEKIAVRVDKGFNVTSAIRTNGRHVKIYADGESAHNLNRAVGYKDAMLEVNGGSLTLGAYDGDGRAKNNLYINGKNVAASAPMIEVTSGQLYLNKYSRIIDGYFLADFAGGAGIAMNSGTSCYMFGGKIDSCRAKSSKDVSSSSPKSSHGGGVLVGNGASFYMFAGSIEHCQAIHGGGIMNYGTLRLYGGTVSDCAASNKKKDALGGAVKVQGAIETDGKVNSTKGDLGVWKYTRSGTWAVNGKDGYQQKSTTGVVLKNNQADAGGAVCLNNGSNGAIQDCNIYGNHSNGNGAGICLSNGSYKKGAALEIKTGAVIHGNESKGYGGGIYCADSVKGSLRGGSMYDNSAVYGAGVYHEAEFRMTGGTVRNNHSGNSGGGIYAKGKLSMTGGEISSNTAATYGGGAILKNAGGSLSGGSIKNNTASVNGGGLQIDGAVSFSNVSVSSNSASGKGGGISVSSAGTCSFSSGNVSGNTSKAGGGGIYIDGTCKANGSNFTGNQSYGDGGAVYIASGTFTTFQANQAVNIQGNSASGNGSGIYNRNTAILNNNAHILNNQCKNGTQRGIFHEGSLFSIEGHTEIQQEIYLAKDRFITVSNRYFSNSNSLTARISLDAANIRNGYAAVKGNISNSADSNYKTGDALLNNQSVNGRFMYAGSGYVMRPGNLKKSSSGCVPYSIVLSQAYQIRYDKNSKEEVMNMPTAAVKYWEEDIRLSALTPSGGSGVFVAWNTNADGTGDGYQPGDVYTANADATLFALWPHYRVEYLPGIQGAAGTTDSQEQNKSENILLRKNGFRSSEGKFIGWKQDISSARKRRELEPVGYKELKEERERGKSDHILAFAKSYKKVNASVNLDNKNSLLNAEDIFFMEGQWDSKPDIILHEKKTFLENEKIRKNDLLKAVKGCYDDEDGDLTEKVQIIKLDYGTSMKGYRPEPQNFSGGMNDTDVMDTYFMKLEKDETVEVKVIFQVEDSVGNVAEKEGTVYVTYNNPPKLHSQNLAFYQKDLDNNPQTVLKEILENYQVEDLEDDKSGLKVPVSVVDPIPMQIEKLNSVGEHKIVYQAIDSLGKKTKLDSTVYIAENNPFKDSYKYNVRFINKKYLYTLKESSKWKKDGKLNAQLTSQLEKTREDAVLKYEFKIKK

SEQ ID NO: 378 - protein, 439 aa, unidentified
  REGION 1..439: note = Description of Unknown:uncultivated organism sequence
  REGION 1..439: note = Category: MG37 effectors
  REGION 1..439: note = Description: MG37-125 effector
MSDAVDPHLTEPYGLRTRSCATELTCRECGYRTPLLDKAFKCPACGEGLDVDYDYDLAKQRIAERPAAERPWNIWRFEELLPILNRRAQERVGQFAGKTPLIHAERLGAELGLSKLYIKDDSTNRPSLSYKDRVVGMAIARLLELGKNEVGCVSTGNVGTAVAALAAQAGATPYIFYPGNMEKGKAKACRAMGAQVIQLDANYDGANRACRELALATGMEFANITLRPFYAEGAKTMAFEVVEEMGWQAPDHFVIPAAGGTLSSRVHKGLVEMETVGLAETAGSKINIAQASGCSPISTAITAGGAAIEAQTPETAAHSIAIGAPGDGALVVDAVVSRGGSGATASDEEIFGAIDLLGETEGILTEPAGGTTIACTARLAQEGKIAPDETVVAVISGNGLKTLQEHPEKSWPEMVPCEAGAMEEILNDFRQAAATAALR

SEQ ID NO: 379 - protein, 437 aa, unidentified
  REGION 1..437: note = Description of Unknown:uncultivated organism sequence
  REGION 1..437: note = Category: MG37 effectors
  REGION 1..437: note = Description: MG37-126 effector
MSDAANPHLTEPYGLRTNSCATELTCRDCGYRTPLLDRAFKCPACGEGLDVDYDYDLAKRRIEERPMAERPWNIWRFEELLPILNRRAQQRVGAFAGKTPLIHAERLGAELGLSNLYLKDDSTNRPSLSYKDRVVGMAIARLLELGKDEVGCVSTGNVGTAVASLAAQAGAKPYIFYPGNMEKGKAKACRAMGAQVIQLDANYDGANRACRELALATGMEFANITLRPFYAEGAKTMAFEVVEELDWRAPDHFVIPAAGGTLSSRVHKGLVEMEKVGLAETAGSKINIAQASGCSPIATAIVGGGEIEHQTPETAAHSLAIGAPGDGNLVVDAVRSRGGSAATASDEEIWNAIDLLGSTEGILTEPAGGTTIASTARLAQEGKIAPDETVVAVISGNGLKTLHEHPEKDWPEGVPCEVGAMEDLLNDFRQAAAAALR

SEQ ID NO: 380 - protein, 439 aa, unidentified
  REGION 1..439: note = Description of Unknown:uncultivated organism sequence
  REGION 1..439: note = Category: MG37 effectors
  REGION 1..439: note = Description: MG37-127 effector
MSDAVDPHLTEPYGSRTSSCATELACRDCGYRTPLLDKAFKCPACGEGLDVDYDYELARKRIAARPLAARPWNIWRFEELLPILNRRAQEQVGAFAGKTPLIHAERLGAELGLSNLYLKDDSTNRPSLSYKDRVVGMAIARLLELGKDEVGCVSTGNVGTAVAALGAQAGARPYIFYPGNMEKGKAKACRALGAQVIQLDANYDQANRACRELALATGMEFANITLRPFYAEGAKTMAFEVVEELGWKAPDHFVIPAAGGTLSSRVHKGLRELEMVGLAETAAAKINIAQASGCSPISTAISAGGAEIEVQTPETAAHSLAIGAPGDGALVVDAVVSRGGAGATASDEEIFEAIDLLGATEGILTEPAGGTTIASTARLAQEGKIGPDETVVAVISGNGLKTLHEHPEKTWPEMVPCEVGAMEEMLNDFRRAAAAAALR

SEQ ID NO: 381 - protein, 437 aa, unidentified
  REGION 1..437: note = Description of Unknown:uncultivated organism sequence
  REGION 1..437: note = Category: MG37 effectors
  REGION 1..437: note = Description: MG37-128 effector
MSDAADPHLGEAIGPRTSSCDTELVCRDCGYRTPLLDTAFKCPACGEGLDIDYDYERAKSLIAKRGLAERPDNIWRFEELLPILSQRAQGMVGQFSGQTPLIKADRLGAELGLKNLYLKDDSTNRPTLSYKDRVVSMAIARMLALGKDEIGCVSTGNVGTAVAALAAKAGARAYIFYPGNMEKGKAKACRALGAQVCQLDGNYDQANRACRELSLASGIEFANITLRPFYAEGAKTMAFEVVEQLGWTAPDHFVIPAAGGTLSSRVHKGLSELETVGLAETGATRINIAQASGCGPIATAILEGGEIVPQTPDTAAHSIAIGAPGDGALVVDAVRSRGGSAATVSDEEIFGAIDLLGATEGILTEPAGGTTVAVTAKLAAEGKLGADETVVAVISGNGLKTLQDHPEKQWPEMVACDVETMGAMLADFRQAAATTLH

SEQ ID NO: 382 - protein, 448 aa, unidentified
  REGION 1..448: note = Description of Unknown:uncultivated organism sequence
  REGION 1..448: note = Category: MG37 effectors
  REGION 1..448: note = Description: MG37-129 effector
MSIQTAEVPDQGQPAPRQRTRSCATGLACHRCGHSYPLESTVFSCPDCGKGLDVVYDYELAARHFKEIPTSERPQNIWHFEELLPIVDASAQARVGLHAGYTPLIRADRLGAELGIANLYLKDDSSNRPSFSYKDRVVSMSVARLLERGGTEIGCVSTGNVGTAVASMAAKAGVDAYVFYPNRLENMKARVCMALGAKVCQVEGNYDEANKRCRELAESTGMDFANITLRPFYAEGAKTAAFEIVEQLDWRAPDHIVTAAAGGTLSSRLHKGLVELQQLGLSETDATRIHIAQPSGCNPIASAILAEEAEIHPVTPETAAHSLAIGAPGDGYLVVDAVRKRGGTGAFASDPEIFAGIDLLAATEGLLTEPAGGTTVAVLEKLAAVGRFGPDETVVAIITGNGLKTLDDHPPKPWPDKVDCELDAMQEALSELKSSGTLVESARAQLHV

SEQ ID NO: 383 - protein, 441 aa, unidentified
  REGION 1..441: note = Description of Unknown:uncultivated organism sequence
  REGION 1..441: note = Category: MG37 effectors
  REGION 1..441: note = Description: MG37-131 effector
MTTSTPQRSSQRTRSCATGLVCHRCDNSYPLEQSIFACPDCGKGLDVVYDYELAATHFRDFPTSERPQNIWHFEELLPIVDAGAQSRVGRYSGYTPLIRADRLGAELGLGNLYLKDDSTSRPSLSYKDRVVSMAVARLLERGGTEIGCVSTGNVGTAVAAMAAKAGVDAYVFYPNALEEMKARACRALAAKVCQVEGNYDQANRRCREVAETTGMDFANITLRPFYAEGAKTAAFEIVEQLDWNAPEHIVIPAAGGTLSSRVHKGLVEMAHLGLSETGQTKIHIAQPSGCNPIASAIIAEEAEVVPVTPETVAHSLAIGAPGDGYLVIDAVLSRGGTGGFASDPEIFAGIDLLASTEGLLTEPAGGTTIAVLEKMAAAGTFAQDETVVAIITGNGLKTLDEHPDKPWPAKVKCELDAMLEALTELKAEETLLNSAQRLLGS

SEQ ID NO: 384 - protein, 352 aa, unidentified
  REGION 1..352: note = Description of Unknown:uncultivated organism sequence
  REGION 1..352: note = Category: MG37 effectors
  REGION 1..352: note = Description: MG37-132 effector
MRAQQRVAQFAGKTPLIHAERLGAELGLSNLYLKDDSTNRPSLSYKDRVVGMAIARLLELGKDEVGCVSTGNVGTAVASLAAQAGARPYIFYPGNMEKGKAKACRAMGAQVIQLDANYDQANRACRELALTIGMEFANITLRPFYAEGAKTMAFEVVEELGWQAPDHFVIPAAGGTLSSRVHKGLVELEKVGLAETAGTKIDIAQASGCSPIATAIVGGGEIEPQMPETAAHSLAIGAPGDGALVVDAVRSRSGSAATASDDEIWYAIDLLGTTEGILTEPAGGTTVAATARLAQEGKIGPDETVVAVISGNGLKTLHEHPEKDWPEGVPCEVGEMERLLNDFRQAAATALH

SEQ ID NO: 385 - protein, 431 aa, unidentified
  REGION 1..431: note = Description of Unknown:uncultivated organism sequence
  REGION 1..431: note = Category: MG37 effectors
  REGION 1..431: note = Description: MG37-134 effector
MSLAADQRTRSCATELVCRDCGLRLSLADTTFKCLQCGQGLDIDYDYELAAARLADLSLSERPLNIWRFEELLPIVDRAAQARVGKNSGRTPLIHADRLGAELGLKRLYLKDDSTARPSLSYKDRVVSMAIARLLELGKEEIGCVSTGNVGTAVASLAAKAGVAPYVFYPANMERGKARACRALGAAVIQLDGNYDEANRACRELALASGIQFANITLRPFYAEGAKTLAFEVLEQLDWKPPEHFVIPAAGGTLSSRVHKGLGEMEAVGIVGTSQVKISVAQPDGCGPIAKAVLDGTGEISAQKPNTAAHSLAIGAPGDGALVVDAVMSRGGSAATASDAEIFEAIDLLGATEGILTEPAGGTTIAATAKLAQAGKLGPEDTVVAVISGNGYKTLDEHPEKEWPSMVAPEVEAMERTLAEFRGARTGAALS

SEQ ID NO: 386 - protein, 445 aa, unidentified
  REGION 1..445: note = Description of Unknown:uncultivated organism sequence
  REGION 1..445: note = Category: MG37 effectors
  REGION 1..445: note = Description: MG37-135 effector
MSTPTSQSRAADPARRTRSCAQALVCRRCDLEYPLQERVFACPQCGKGLDVSYDYELAACRFEEIPPAARPQNIWQFEELLPIVDASAQARVGLTAGYTPLIAADRLGAELGIANLYLKDDSTSRPSLSYKDRVVAMSVARLLELGERAMGCVSTGNVGTAVASYAAKAGVDAYVFYPNRLEDTKARACRALGAKVCQVEGNYDEANRCCREVAQATGMEFANITLRPFYAEGAKTSAFEIVEQLNWRAPDHIVTAAAGGTLSSRLHKGLCELAQLELADTEPTRIHIAQPSGCNPIASAILAEEAEIQAVTPETAAHSLAIGAPGDGYLVIDAVRKRGGTGGFASDPEIFAGIDLLASTEGILTEPAGGTTIAVLEKLAAGGRFGPDDTVVAIITGNGLKTLDDHPEKPWPAKIDCELDAMLAALEELRRGGSPSASARERLPA

SEQ ID NO: 387 - protein, 430 aa, unidentified
  REGION 1..430: note = Description of Unknown:uncultivated organism sequence
  REGION 1..430: note = Category: MG37 effectors
  REGION 1..430: note = Description: MG37-136 effector
MLNSEDRTRSCATELVCRDCGRRLPLLDTTSKCLGCGNGLDIDYDYELARARLSEVPPAEREINIWRFEELLPIVDARAQARVGRYSGRTPLIHADRLGAELGLKKLYLKDDSTSRPGLSCEERVVSMAIARLLELGKEEIGCVSTGNVGTAVASLAAKAGITAYVFYPSNMERGKARACRALGAAVCQLDGNYDEANRACRELALASGIQFANITLRPFYAEGAKTLAYEVVEQLEWVAPDHIVIPAAGGTLSSRVHKGLNELETVGLAETSQVKISVAQPEGCGPIATAIIDGSGEIEPQSPQTAAHSLAIGAPGDGALVVDAVMSRGGSAATASDPAIFEAIDLLGATEGVLTEPAGGTTIASTIKLANEGKLGPDDTVVAVISGNGYKTLDEHPDKPWAEGVACEVDSMTEMLDEFRRHGVGAMLG

SEQ ID NO: 388 - protein, 430 aa, unidentified
  REGION 1..430: note = Description of Unknown:uncultivated organism sequence
  REGION 1..430: note = Category: MG37 effectors
  REGION 1..430: note = Description: MG37-137 effector
MLNPEDRTRSCATEMVCRDCGRTYPLLDTAFRCHGCGNGLDIDYDYELAKKRLSEIPPAEREINIWRFEELLPITDARAQARVGRYSGRTPLIHADRLGAELGLKKLYLKDDSTQRPSLSYKDRVVSMAVARLLELGKDEIGCVSTGNVGTSVSSLAAKAGVAAYVFYPSNMERGKARACRALGAAVIQLDGNYDQANRACRELALASGMQFTNITLRPFYAEGAKTEAYEVVEQLEWVSPDHFVIPAAGGTLSSRVHKGLNELEMVGLAETSQTKINVAQAEGCNPIATAILDGSGEIAPQTPNTVAHSIAIGAPGDGPLVVDAVRSRGGSAAAVTDAEIFEGIDLLGATEGILTEPAGGTTIACTAKLANEGKLGPDETVVAIVSGNGYKTLDEHPEKSWPEMIAPEVEAMSEVLDELRSHGVGAPLS

SEQ ID NO: 389 - protein, 437 aa, unidentified
  REGION 1..437: note = Description of Unknown:uncultivated organism sequence
  REGION 1..437: note = Category: MG37 effectors
  REGION 1..437: note = Description: MG37-138 effector
MSDAVDPHLGGASGPRTSSCATELICRDCGYTTPLLDSAFKCPACGEGLDIDYDYDRAKALIAERGLDERPQNIWRFEELLPIASRAAQQKVGQFAGRTPLIRADRLGAEIGLNNLYLKDDSTNRPTLSYKDRVVSMAIARLLELGKNEVGCVSTGNVGTAVAALAAKAGATAYIFYPGNMEKGKAKACRALGAQVCQLDGNYDQANRACRELSLASGIEFANITLRPFYAEGAKTMAFEIVEELGWIAPDHLVIPAAGGTLSSRVHKGLNELEIVGLAETAGTKINIAQAGGCSPIATAIRDGGELEPQTPETAAHSLAIGAPGDGNLVLDAVRTRGGSAAAPSDPEIFAAIDLLGATEGVLTEPAGGTTIAATAKLAAEGKIAPDDVVVATISGNGLKTLSEHPDKPWPEMVACDVDTMGAMLSDFRQAAAAALH

SEQ ID NO: 390 - protein, 445 aa, unidentified
  REGION 1..445: note = Description of Unknown:uncultivated organism sequence
  REGION 1..445: note = Category: MG37 effectors
  REGION 1..445: note = Description: MG37-139 effector
MSSSSTTASSQGTRQRTRSCATELVCHRCDHRYPLTDTVFACPDCGKGLDIAYDYELAGTHFRDFPISERPQNIWHFEELLPILDANAQARVGQYSGYTPLIRADRLGAELGLNNLYLKDDSTSRPSLSYKDRVVSMSVARLLERGKTEIGCVSTGNVGTAVASMAATAGVDAFIFYPNRLEEMKARACMALGAKVVQVEGNYDEANRRCREVAAETGMDFANITLRPFYAEGAKTAAFEIVEQLQWASPDHIVSPAAGGTLSSRMHKGLGELQLLGLSETEGTQIHIAQPSGCNPIASAILAEEAEVVPVMPETAAHSLAIGAPGDGYLVIDAVHKRGGTAAFASDPEIFAGIDLLAATEGLLTEPAGGTTIAVLEKLAAAGRFAPEDTVVALITGNGLKTLDEHPSKAWPAKIDCELDPMLGALAELKRTPTLMQTAREQLRA

SEQ ID NO: 391 - protein, 445 aa, unidentified
  REGION 1..445: note = Description of Unknown:uncultivated organism sequence
  REGION 1..445: note = Category: MG37 effectors
  REGION 1..445: note = Description: MG37-141 effector
MSTSSSNGPGERPRQQTRSCATGLACHRCGLSYALDEDAYACPQCGKGLDIVYDYERAARLFTEVPREQRPQNIWRFEELLPIVDAGAQARVGAHAGCTPLIRADRLGAELGIANLYLKDDSTSRPSLSYKDRVVAMSIARLLELGKDEIGCVSTGNVGTAVASYAAKAGVTAYVVYPNRLEDTKARACAALGARVCQVEGNYDEANRRCKEVAAAAEMEFANITLRPFYAEGAKTAAFEIVEQLSWNAPAHIVTAAAGGTLSSRLHKGLAELEQLGLAHTSSTRIHIAQPSGCNPIASAILAEEAEVHPITPETAAHSLAIGAPGDGYLVIDAVLKRGGTAGFASDPEIFAGIDLLAATEGLLTEPAGGTTVAVLEKLAKEGRFATDDVVVAIITGNGLKTLDDHPEKPWPAKIDCELDAMLAALAELKREGALAERALEQLHA

SEQ ID NO: 392 - protein, 436 aa, unidentified
  REGION 1..436: note = Description of Unknown:uncultivated organism sequence
  REGION 1..436: note = Category: MG37 effectors
  REGION 1..436: note = Description: MG37-143 effector
MSDAVDPHLTEPYGLRTRSCATELTCRDCGYRTPLLDKAFKCPACGEGLDVDYDYELAKKRIAERSTAERPWNIWRFEELLPILNLRAQQRVAQFAGKTPLVHAERLGAELGLSNLYLKDDSTNRPSLSYKDRVVGIAIARLLELGKDEVGCVSTGNVGTAVAALAAQAGARPYIFYPGNMEKGKAKACRGLGAQVIQLDANYDQANRACRELAITTGMEFANITLRPFYAEGAKTMAFEVVEELGWRAPDHFVIPAAGGTLSSRVHKGLVELEKVGLAETAAAKIDIAQASGCSPIATAIQGGGEIEPQTPETAAHSLAIGAPGDGNLVVDAVRSRGGAAAAVSDEEIWGAIDLLGTTEGILTEPAGGTTIASTARLAQEGRIGPDDLVVAVISGNGLKTLQEHPDKPWPEMVPCEVGAMEEMLNDFRQAAAALH

SEQ ID NO: 393 - protein, 1379 aa, unidentified
  REGION 1..1379: note = Description of Unknown:uncultivated organism sequence
  REGION 1..1379: note = Category: MG37 effectors
  REGION 1..1379: note = Description: MG37-144 effector
MKKWGKRIISGVIAASLLTAAAISGSEQGTGTVASVVQAGTEMSFMGKLLEGGYIDVFTSWTQEEQNKFYDGLSPQQQSVFLEVTNCQITRELIKSERSKEELEQFFDRLQPYFLILKKGNQEKPDDEIVIECINQIEGTDYHSSEQYIKQLVSEKKDHYLEFYDALKLVKDGKLEIESAVDDFYKELGFLKKDRVPANSAEVSRQPVQVQKKAAAKAVSDRYSNFKAVSSLKALKDAVASVKKGEKIAVRVDKGFNVTSVIRTNGRHVKIYADGESGHNLNRTAGYKDVMLEVNGGSLTLGAYDGDGRAKNNLYINGKNIAASAPLIEVTSGHLYLNKYSRIIDGYFLADFAGGAGIALNSGTSCYMFGGRIDNCRAKSSKDVSSSSPKSSHGGGVLVGNGSSFYMFAGSIEHCQAIHGGGIMNYGTLRLYGGAISDCAASNQKKDALGGAVKVQGAIETNGKVSSTKGDLGVWKYTRSAAWIVNGKDGYQQGTTTGVVLKNNQADAGGAICLNNGSNGAIQDCNINGNHSTGNGAGICLSNGSYKKGAALELKTGAVIHGNESKGYGGGIYCADSVKGSLSGGTMYDNSAKYGAGIYHEAEFRMSGGTVRSNHSGNSGGGIYAKGKLSMTGGEISANTAATYGGGAILKTVGGSVSGGSIKGNSASANGGGLQIDGTVSLSNASVSSNSASGKGGGISVSSSGTCNLSSGNVSGNTAKAGGGGIYIDGTCKANGSSFTGNQSSGDGGAVYIASGTFTTFQANQAVNIQGNSASGNGSGIYNRNITVLNNNAHILNNQCKNGTQRGIFHEGSLFSIEGNTEIQQEIYLAKDRFVTASNRYFSNSNSLKAKISLDTANIRNGYAVVKGNVSNSADGNYKTGEALLNNQSAGGRFVYAGSGYVMRPGNLKKSSSGCAPFSIVLSQAYQIRYDKNSKEEVMNMPTAAVKYWEEDIKLSALTPTGGSGAFVAWNTKADGTGDGYQPGNVYTANADATLFALWPHYRVEYLPGIRSAAGTTDSQEQNKSEDILLRKNGFRSSEGKFVGWKQDISSARKRMELEPVGYKELKEEREKGKLNHILDFAESYKKVNSSENLDNINSLLDVEDIFFMEGQWDSKPDIILNDKKTFLENEKIKKNDLLKVVKGCYDEEDGELTKKVQIIKLDYTKSMKGYRPETQNFSGGMNDTDVMDTYFMKLEKDETVEVKVTFQAEDSVGNVAEKEGTVCVTYNNPPKLHSQNLAFYQKDIDNNPQTILKEIFENYQVEDIEDDKKGLKVPVSVIDPIPLQIEKLNSVGEHKIVYQAIDSLGKKTKLDSIVYIAENNPFKDSYKYNVRFINKKYLYTLKESSKWKKNEELNAQLTSQLEKTKEDAELKYEFEIKK

SEQ ID NO: 394 - protein, 437 aa, unidentified
  REGION 1..437: note = Description of Unknown:uncultivated organism sequence
  REGION 1..437: note = Category: MG37 effectors
  REGION 1..437: note = Description: MG37-145 effector
MSEAVDPHLGGSAGPRTSSCATELVCRDCGYRTPLLDTAFKCPACGEGLDIDYDYERAKALIAERGLAERPQNVWRFEELLPIVARGAQERVGQFSGQTPLIRADRLGAELGLKNLYLKDDSTNRPTLSYKDRVVSMAIARLLELGKDEVGCVSTGNVGTAVAALAAKAGATAYIFYPGNMEKGKAKACRALGAQVCQLDGNYDQANRACRELSLASGIEFANITLRPFYAEGAKTMAFEVVEQLGWVAPDHFVIPAAGGTLSSRVHKGLNELETVGLAATAATRINIAQAGGCGPIATAILDGGEIEPQTPDTAAHSLAIGAPGDGALVVDAVRSRNGSAATASDQEIFDAIDLLGATEGLLTEPAGGTTIASTARLAAEGKIGAEDTVVAVISGNGLKTLQDHPEKQWPEMVACDVETMGSMLADFRQAAAAALH

SEQ ID NO: 395 - protein, 444 aa, unidentified
  REGION 1..444: note = Description of Unknown:uncultivated organism sequence
  REGION 1..444: note = Category: MG37 effectors
  REGION 1..444: note = Description: MG37-146 effector
MSTPIAESPTQARQRTRSCATALVCHRCENSYPLAQAIFACPDCNKGLDVVYDYEHAAQHFREVPSSERPQNIWHFEELLPIVDASAQARVGQHSGYTPLIRADRLGAELGLSNLYLKDDSSNRPSLSYKDRVVSMSVARLLELGRTEIGCVSTGNVGTAVASLAAKAGVDAYVFYPNRLEDTKARACMALGAKVCQVEGNYDEANKRCREVAETTGMDFANITLRPFYAEGAKTAAFEIVEQLDWQAPDHIVTAAAGGTLSSRLHKGLVELQLLELSETDSTRIHIAQPSGCNPIATAIVAEEAEIHAVTPETAAHSLAIGNPGNGYLVIDAVLKRGGTGGFASDPEIFAGIDLLAATEGLLTEPAGGTTIAVLEKLAATGRFAPDDTVVAIITGNGLKTRDDHPPKPWPAKVDCELDAMVAALDELKQSGTLVDSARELLHP

SEQ ID NO: 396 - protein, 437 aa, unidentified
  REGION 1..437: note = Description of Unknown:uncultivated organism sequence
  REGION 1..437: note = Category: MG37 effectors
  REGION 1..437: note = Description: MG37-148 effector
MSDAVEPHRTEPYGLRTDSCATELVCRDCGYRTPLLDTAFKCPACGEGLDVDYDYELAKRRIAERGLEGRPWNVWRFEELLPILNRRARQRVAQFAGKTPLIHAERLGAELGLSNLYLKDDSTNRPSLSYKDRVVGMAIARLLELGKDEVGCVSTGNVGTAVAALAAQAGARPYIFYPGNMEKGKAKACRGLGAQVIQLDANYDQANRACRELALTTGMEFANITLRPFYAEGAKTMGFEVVEELGWKAPDHFVIPAAGGTLSSRVHKGLLELEKVGLAETAGARINIAQASGCSPIASAITSGGEIEPQTPETAAHSLAIGAPGDGNLVVDAVRSRGGSAAAVSDEEIWEAIDLLGATEGILTEPAGGTTIASTARLAQAGKIGPDEVVVAVISGNGLKTLHEHPDKPWPEMVPCEVGAMEEMLNDFRRAATAALH

SEQ ID NO: 397 - protein, 437 aa, unidentified
  REGION 1..437: note = Description of Unknown:uncultivated organism sequence
  REGION 1..437: note = Category: MG37 effectors
  REGION 1..437: note = Description: MG37-149 effector
MSDAVDPHPGGPKGPRTDSCATELVCRDCGYRTPLLDTAFKCPACGEGLDIDYDYERAQTLIAERGLADRPQNIWRLEELLPIVSRRAQAKVGLFAGQTPLIRADRLGAELGLKNLYLKDDSTNRPTLSYKDRVVGMAIARLLELGKDEVGCVSTGNVGTAVAALAAKAGATAYIFYPGNMEKGKAKACRALGAQVCQLDGNYDQANRACRELSLASGIQFANITLRPFYAEGAKTMAFEVVEQLGWEAPDHFVIPAAGGTLSSRVHKGLNELETVGLAETAATKINIAQAGGCGPIAGAILGGGEIVPQTPDTAAHSLAIGDPGDGSLVVDAVRARGGSAAMPSDEEIFGAIDLLGATEGILTEPAGGTTIAATARLAAEGKLGAEETVVAVISGNGLKTLHEHPDKPWPEMVACDVETMGAMLAEFRQAAAAALH

SEQ ID NO: 398 - protein, 434 aa, unidentified
  REGION 1..434: note = Description of Unknown:uncultivated organism sequence
  REGION 1..434: note = Category: MG37 effectors
  REGION 1..434: note = Description: MG37-150 effector
MSDAHLGGPGGPRTSSCATELVCRDCGYRTPLLDTAFKCPACGEGLDIDYDYERAKSLIAERDLGDRPDNVWRFEELLPIVFKRAQDRVGQFSGQTPLIRADRLGAELGLKNLYLKDDSTNRPTLSYKDRVVSMAVARMLALGKDEIGCVSTGNVGTAVAALAAKAGATAYIFYPGNMEKGKAKACRALGAQVCQLDGNYDQANRACRELSLASGIEFANITLRPFYAEGAKTMAFEVVEQLGWEAPDHFVIPAAGGTLSSRVHKGLNELEIVGLAETGATKINIAQASGCGPIARAILDGGEIEPQTPDTAAHSIAFGAPGDGALVVDAVRTRGGSAATVSDAEIFGAIDLLGATEGILTEPAGGTTVAVTAKLAAEGKLGAEETVVAVISGNGLKTLQDHPEKQWPEMVACDLETMGATLADFRQTAAAAPR

SEQ ID NO: 399 - protein, 437 aa, unidentified
  REGION 1..437: note = Description of Unknown:uncultivated organism sequence
  REGION 1..437: note = Category: MG37 effectors
  REGION 1..437: note = Description: MG37-151 effector
MSDAVEPHLSEPYGLRTRSCATELTCRDCGYRTPLLDKAFKCPACGEGLDVDYDYDLAKERIAERGLAERPWNIWRFEELLPILNRRAQQRTAQFAGKTPLIHAERLGAELGLSNLYLKDDSTNRPSLSYKDRVVGMAIARLLELGKDEVGCVSTGNVGTAVAALAAQAGAEPYIFYPGNMEKGKAKACRAMGAQVIQLDANYDGANRACRELALATGMEFANITLRPFYAEGAKTMGFEVVEELDWNSPDHFVIPAAGGTLSSRVHKGLLELEKVGLAETAGTKINIAQAAGCSPIATAITGGGEIVTQTPETAAHSLAIGAPGDGNLVLDAVRSRGGSAAAVSDEEIWGAIDLLGQTEGILTEPAGGTTIASTARLAQEGKLGPDEVVVAVISGNGLKTLQEHPDKSWPEMVPCEVPAMEEILARLRQDAPTSVR

SEQ ID NO: 400 - protein, 430 aa, unidentified
  REGION 1..430: note = Description of Unknown:uncultivated organism sequence
  REGION 1..430: note = Category: MG37 effectors
  REGION 1..430: note = Description: MG37-152 effector
MTLRVAYARELVAGGHRPAVVARILRISRQAVYRVPRPRKPPDAARRPPVDDVERAIVEVAEANPTDGYRLVTAWVQRKLGRAVNRKRVLRVMRERKLIQRRTHEPKRRRPGFFMVTRPGELWHLDMTSIWLAEHGCVSTGNVGTAVASMAAAAGVDAYVFYPNRLEDMKARACMALGAKVCQVEGNYDEANRRCREVAETTGMDFANITLRPFYAEGAKTAAFEIVEQLDWRSPDHIITAAAGGTLSSRLHKGLLELQHLGLSETDPTRIHIAQPSGCNPIATAIIAEEAEVRPVTPETAAHSLAIGAPGDGYLVIDAVLKRGGTGGFASDPEIFAGIDLLAATEGLLTEPAGGTTVAVLEKLAAAGRFAPDDTVVAIITGNGLKTLDDHPPKPWPAKVDCELDAMLAALSELKSGGSLVDSAREQLHA

SEQ ID NO: 401 - protein, 1379 aa, unidentified
  REGION 1..1379: note = Description of Unknown:uncultivated organism sequence
  REGION 1..1379: note = Category: MG37 effectors
  REGION 1..1379: note = Description: MG37-153 effector
MKKWGKRIISGVIAASLLTAAAISGSEQGTGTVASVVQAGTETSFMGKLLEGGYIDVFTSWTQEEQNKFYDGLSPQQQSVFLEVTNCQITRELIKSERSKEELEQFFDRLQPYFLILKKGNQEKPDDEIVIECINQIEGTDYHSSEQYIKQLVSEKKDHYLEFYDALKLVKDGKLEIESAVDDFYKELGFLKKDRVPANSAEVSRQPVQVQKKAAAKAVSDRYSNFKAVSSLKALKDAVASVKKGEKIAVRVDKGFNVTSVIRTNGRHVKIYADGESGHNLNRTAGYKDVMLEVNGGSLTLGAYDGDGRAKNNLYINGKNIAASAPLIEVTSGHLYLNKYSRIIDGYFLADFAGGAGIALNSGTSCYMFGGRIDNCRAKSSKDVSSSSPKSSHGGGVLVGNGSSFYMFAGSIEHCQAIHGGGIMNYGTLRLYGGAISDCAASNQKKDALGGAVKVQGAIETNGKVSSTKGDLGVWKYTRSAAWIVNGKDGYQQGTTTGVVLKNNQADAGGAICLNNGSNGAIQDCNINGNHSTGNGAGICLSNGSYKKGAALELKTGAVIHGNESKGYGGGIYCADSVKGSLSGGTMYDNSAKYGAGIYHEAEFRMSGGTVRSNHSGNSGGGIYAKGKLSMTGGEISANTAATYGGGAILKTVGGSVSGGSIKGNSASANGGGLQIDGTVSLSNASVSSNSASGKGGGISVSSSGTCNLSSGNVSGNTAKAGGGGIYIDGTCKANGSSFTGNQSSGDGGAVYIASGTFTTFQANQAVNIQGNSASGNGSGIYNRNITVLNNNAHILNNQCKNGTQRGIFHEGSLFSIEGNTEIQQEIYLAKDRFVTASNRYFSNSNSLKAKISLDTANIRNGYAVVKGNVSNSADGNYKTGEALLNNQSAGGRFVYAGSGYVMRPGNLKKSSSGCAPFSIVLSQAYQIRYDKNSKEEVMNMPTAAVKYWEEDIKLSALTPTGGSGAFVAWNTKADGTGDGYQPGNVYTANADATLFALWPHYRVEYLPGIRSAAGTTDSQEQNKSEDILLRKNGFRSSEGKFVGWKQDISSARKRMELEPVGYKELKEEREKGKLNHILDFAESYKKVNSSENLDNINSLLDVEDIFFMEGQWDSKPDIILNDKKTFLENEKIKKNDLLKVVKGCYDEEDGELTKKVQIIKLDYTKSMKGYRPETQNFSGGMNDTDVMDTYFMKLEKDETVEVKVTFQAEDSVGNVAEKEGTVCVTYNNPPKLHSQNLAFYQKDIDNNPQTILKEIFENYQVEDIEDDKKGLKVPVSVIDPIPLQIEKLNSVGEHKIVYQAIDSLGKKTKLDSTVYIAENNPFKDSYKYNVRFINKKYLYTLKESSKWKKNEELNAQLTSQLEKTKEDAELKYEFEIKK

SEQ ID NO: 402 - protein, 437 aa, unidentified
  REGION 1..437: note = Description of Unknown:uncultivated organism sequence
  REGION 1..437: note = Category: MG37 effectors
  REGION 1..437: note = Description: MG37-154 effector
MSPSSTPSSSQGTRRRTRSCATDLVCHRCEHRYPLTDTVFACPDCGKGLDILYDYELAARHFAEVPSSERPQNIWHFEELLPIVSASAQARVGRYAGFTPLIHADRLGAELGLSNLYLKDDSTSRPSLSYKDRVVAMSVARLLELGKGEIGCVSTGNVGTAVASLAAKAGVDAYVFYPNRLEDMKARACAALGAKVCQVEGNYDEANRRCREVAEATGMEFANITLRPFYAEGAKTAAFEIVEQLGWASPDHIVSPAAGGTLSSRLHKGLGELQLLGLSETEHTRIHIAQPSGCNPIATAIIAEEAEIHAITPETAAHSLAIGNPGDGYLVIDAVLKRGGTGGFASDPEIFAGIDLLASTEGILTEPAGGTTIAVLEKLAREGKFAPDETVVALVTGNGLKTLDEHPPKPWPEVDCELDAMLAALEGLGREPSPVAA

SEQ ID NO: 403 - protein, 438 aa, unidentified
  REGION 1..438: note = Description of Unknown:uncultivated organism sequence
  REGION 1..438: note = Category: MG37 effectors
  REGION 1..438: note = Description: MG37-155 effector
MSSSSTASTSQGSWTRTRSCATGLACHRCDRQYSLTDTVFACPDCGKGLDIVYDYELAARHFKEVPSAERPQNIWHFEELLPIVDASAQARVGRYAGYTPLIHADRLGAELGLSNLYLKDDSTSRPSLSYKDRVVSMSIARLLELGREEIGCVSTGNVGTAVASLAAKAGVDAYVFYPNRLEDTKARACAALGAKGCQGGGNYDEANRRCREVAAATGLEFANITLRPFYAEGAKTAAFEIVEQLDWQSPDHIVTAAAGGTLSSRLHKGLGELQLLGLAETDPTRIHIAQPSGCNPIATAILAEEAEVHPVTPETAAHSLAIGAPGDGYLVIDAVRKRGGTGGFASDPEIFAGIDLLAATEGLLTEPAGGTTIAVLEKLAGEGKFAPDDTVVAMITGNGLKTLDDHPEKPWPAKIACELDAMLAALEGLGRKPSPIAA

SEQ ID NO: 404 - protein, 437 aa, unidentified
  REGION 1..437: note = Description of Unknown:uncultivated organism sequence
  REGION 1..437: note = Category: MG37 effectors
  REGION 1..437: note = Description: MG37-156 effector
MSDAVDPHLTGPEGPRTRSCATELVCRDCGYRTPLLDTAFKCPACGEGLDVDYDYERAKEAINARGLEGRPGNVWRFEELLPITNLRAQQQVAQFAGKTPLIHAERLGAELGLSNLYLKDDSTNRPSLSYKDRVVGMAIARLLELGKDEVGCVSTGNVGTAVASLAAQAGARPYIFYPGNMEKGKAKACRAMGAQVIQLDANYDQANRACRELAITNGMEFANITLRPFYAEGAKTMAFEVVEELGWQAPDHFVIPAAGGTLSSRVHKGLVELETVGLAETAGSKINIAQASGCSPIATAIVGGGEIEPQMPETAAHSLAIGAPGDGTLVVDAVRSRGGSAATASDDEIWNAIDLLGATEGILTEPAGGTTIASTARLAQEGKIGPDETVVAVISGNGLKTLHEHPEKDWPEGVPCEVGAMEQILNDFRQAAATALH

SEQ ID NO: 405 - protein, 444 aa, unidentified
  REGION 1..444: note = Description of Unknown:uncultivated organism sequence
  REGION 1..444: note = Category: MG37 effectors
  REGION 1..444: note = Description: MG37-157 effector
MSLQTAPRAAQDSRQRTRSCATALVCHRCDNSYSLEESIFACPDCNKGLDVVYDYEHAAQHFRDVPSSERPQNIWHFEELLPIVDARAQARVGQHTGYTPLIRADRLGAEIGIANLYIKDDSSNRPSLSYKDRVVSMSVARLLERGGTEIGCVSTGNVGTAVASLAAKAGVDAYVFYPNRLEDTKARACMALGAKVCQVEGNYDEANKRCRELAEATGMDFANITLRPFYAEGAKTASFEIVEQLDWQAPDHIITAAAGGTLSSRLHKGLVELQLLELAETDSTRIHIAQPSGCNPIATAIVAEEAEIRAVTPETAAHSLAIGNPGDGYLVIDAVLKRGGTGGFASDPEIFAGIDLLAATEGLLTEPAGGTTIAVLEKLAASGRFGPDETVVAIITGNGLKTLDDHPPKPGPAKVDCELDAMEAALAELKQSGTLVDSARQLLH

SEQ ID NO: 406 - protein, 450 aa, unidentified
  REGION 1..450: note = Description of Unknown:uncultivated organism sequence
  REGION 1..450: note = Category: MG37 effectors
  REGION 1..450: note = Description: MG37-158 effector
MNAHRSRSAELGSAAAAPQQRTRSCATALTCARCAVEFPLEQRVFACPDCGKGLDIAYDYELARQRLQELPRAQRPANIWRFEELLPIRDARAQARVGRTAGCTPLIPADRLGAELGIANLYLKDDSTSRPSLSYKDRVVAMSIARLLELGEDEIGCVSTGNVGTAVASYASKAGVAAYVFYPNRLEDMKARACRALAAKVCQVEGNYDEANRRCRELAQTTGMEFANITLRPFYAEGAKTDAFEIVEQLDWRPPDHIITAAAGGTLSSRLHKGLRELQILELADTDATRIHIAQPSGCNPIASAILAEEAEIHPVTPETAAHSLAIGAPGDGYLVIDAVRKRGGTGGFASDPEIFAGIDLLAATEGILTEPAGGTTVAVLEKLAAAGRFGPDDTVVAIVTGNGLKTLDDHPAKPSPAKIECELDAMLAALEELRRGGEPTQSARERLPA

SEQ ID NO: 407 - protein, 447 aa, unidentified
  REGION 1..447: note = Description of Unknown:uncultivated organism sequence
  REGION 1..447: note = Category: MG37 effectors
  REGION 1..447: note = Description: MG37-159 effector
MNAHGSRSGELGSAVAAPQQRTRSCATALVCNRCAVEFPLEQRVFACPDCGKGLDIAYDYELARQRLQELPRAQRPANIWRFEELLPIVDATAQARVGRTAGYTPLIRADRLGSELGLSNLYLKDDSTSRPSLSYKDRVVAMSVARLLELGGEEIGCVSTGNVGTAVASYAAKAGVDAYVFYPNRLEDMKARACRALGANVCQVQGNYDEANRCCREVAAATGMDFANITLRPFYAEGAKTDAYEIVEQLDWQAPDHIVTAAAGGTLSSRLHKGLHELALLELAPTEGTRIHIAQPSGCNPIASAILAEEAEIQPVMPETAAHSLAIGAPGDGYLVIDAVRKRGGTGGLASDPEIFAGIDLLAATEGLLTEPAGGTTIAVLEKLAAAGRFAADDVIVAIVTGNGLKTLDDHPEKPWPAKIDCELDAMLAALAELRGAGRITAERMPA

SEQ ID NO: 408 - protein, 442 aa, unidentified
  REGION 1..442: note = Description of Unknown:uncultivated organism sequence
  REGION 1..442: note = Category: MG37 effectors
  REGION 1..442: note = Description: MG37-160 effector
MSPQTAQSPIRQRTRSCATGLACHRCGNHYPLESSVFACPDCGKGLDILYDYELAARHFLDVPAAERPHNIWHFEELLPIVDASAQAAVGTHSGYTPLIRADRLGAELGLGNLYLKDDSTSRPSLSYKDRVVSMSIARLLERGGSEIGCVSTGNVGTAVASLAAKAGVDAYVFYPNRLEDMKARACMALGAKVCQVEGNYDEANRRCRELAEATGMDFTNITLRPFYAEGAKTAAFEIVEQLGWQAPEHIITAAAGGTLSSRIHKGLIELQLLGLSETDSTRLHIAQPSGCNPIASAIVAEEAEVHPVVPETAAHSLAIGAPGDGYLVIDAVLKRGGSGGYATDPEIFAGIDLLAATEGLLTEPAGGTTIAVLEKMAAAGTFDTDETVVAIITGNGLKTLDDHPAKPWPAKVACERDAMMAALEQLKEGPSLTESARGRLNI

SEQ ID NO: 409 - protein, 437 aa, unidentified
  REGION 1..437: note = Description of Unknown:uncultivated organism sequence
  REGION 1..437: note = Category: MG37 effectors
  REGION 1..437: note = Description: MG37-162 effector
MSDAVDPHRTEPYGLRTDSCATELTCRDCGYRTPLLDKAFKCPACGEGLDVDYDYDLAKKRISERGLDERPWNIWRFEELLPILNRRAQQRVAQFAGKTPLIHAERLGAELGLSNLYIKDDSTNRPSLSYKDRVVGMAIARLLELGKDEVGCVSTGNVGTAVAALAAQAGARPYIFYPGNMEKGKAKACRAMGAQVIQLDANYDGANRACRELALATGMEFANITLRPFYAEGAKTMAFEVVEELGWQPPDHFVIPAAGGTLSSRVHKGLLELEKVGLAETAGAKIDIAQASGCSPISTAILEGGELVPQTPETAAHSIAIGAPGDGALVVDAVRSRNGSAAMVSDEEIFGAIDLLGATEGILTEPAGGTTIASTARLAQEGKIGPDETVVAVISGNGLKTLHEHPEKTWPEGVPCEVGAMEEVLNDFRRAVAAAPH

SEQ ID NO: 410 - protein, 444 aa, unidentified
  REGION 1..444: note = Description of Unknown:uncultivated organism sequence
  REGION 1..444: note = Category: MG37 effectors
  REGION 1..444: note = Description: MG37-163 effector
MSPSSTASPQGTRQRTRSCATDLVCHRCDHRYPLTDTVFACPDCGKGLDIVYDYELAASHFRDFPSSERPQNIWHFEELLPILDASAQARVGQHSGYTPLIRADRLGAELGVNNLYLKDDSSNRPSLSYKDRVVSMSVARLLERGKTEIGCVSTGNVGTAVASMAATAGVDAFIFYPNRLEETKARVCMALGAKVVQVEGNYDEANRRCREVAAETGMDFANITLRPFYAEGAKTAAFEIVEQLQWASPDHIVSPAAGGTLSSRMHKGLGELQLLGLAETEATQIHIAQPSGCNPIASAILAEEAEVHPVMPETAAHSLAIGAPGDGYLVIDAVHKRGGTAAFASDPEIFAGIDLLAATEGLLTEPAGGTTIAVLEKLAAAGRFAPEDTVVALITGNGLKTLDEHPPKAWPAKIDCELESMLEALDELKRTPTLMQTAHEQLRA

SEQ ID NO: 411 - protein, 437 aa, unidentified
  REGION 1..437: note = Description of Unknown:uncultivated organism sequence
  REGION 1..437: note = Category: MG37 effectors
  REGION 1..437: note = Description: MG37-164 effector
MSDAVDPHRTEPYGLRTRSCATELNCRECGYRTPLLDKAFKCPACGEGLDVDYDYELARERIAERSHDERPWNIWRFEELLPILNRRAQERVAQFAGKTPLIHAERLGAELGLSNLYLKDDSTNRPSLSYKDRVVGMAIARLLELGKKEVGCVSTGNVGTAVAALAAQAGARPYIFDPGNMEKGKAKACRAMGAQVIQLDANYDQANRACRELALATGMEFANITLRPFYAEGAKTMAFEVVEELGWKAPDHFVIPAAGGTLSSRVHKGLVELETVGLAETAAAKINIAQASGCSPIATAITGGGEIVTQTPETAAHSLAIGAPGDGNLVVDAVRSRDGSAATASDEEIWSAIDLLGTTEGILTEPAGGTTIASTARLAQEGKIGPDDVVVAIISGNGLKTLQEHPDKPWPEMVTCEVGPMEEILNDFRQAAAAALH

SEQ ID NO: 412 - protein, 430 aa, unidentified
  REGION 1..430: note = Description of Unknown:uncultivated organism sequence
  REGION 1..430: note = Category: MG37 effectors
  REGION 1..430: note = Description: MG37-165 effector
MSPFAEETRSCATELVCRDCGQRLPLMDTTFKCLGCGQGLDIDYDYELAKARLGELPMSEREINIWRFEELLPILDARAQRRVGFYSGRTPLIHADRLGAELGLRKLYLKDDSTQRPSLSYKDRVVSMAVARLLELGKEEIGCVSTGNVGTAVASLAAKAGVTAYVFYPSNLEPGKARTCRALGAAVIQLDGNYDQANRACRELALASGVQFANITLRPFYAEGAKTVAYEVVEKLDWISPDHFVIPAAGGTLSSRVHKGLQELEKVGLSETAATKIHAAQPDGCGPIAGAILDGSGEIQPQTPHTAAHSLAIGAPGDGPLVVDAVMSRGGSAATVTDEEIFEAIDLLGATEGILTEPAGGTTVASTAKLAAEGKFGPDETVVAVISGNGYKTLDEHPEKPWPSMVSCDVESMGEMLAEFRQHGVGATLS

SEQ ID NO: 413 - protein, 430 aa, unidentified
  REGION 1..430: note = Description of Unknown:uncultivated organism sequence
  REGION 1..430: note = Category: MG37 effectors
  REGION 1..430: note = Description: MG37-166 effector
MLNGEDRTRSCATELVCRDCGRRLPLLDTTFKCLGCGQGLDVDYDYEMATARLAELPPAERPLNIWRFEELLPILDGRAQARVGRNSGRTPLIHADRLGAELGLRNLYLKDDSTARPSLSYKDRVVSMAVARLLELGKEEIGCVSTGNVGTAVASLAAKAGVTAYVFYPSNLEKGKARACRALGAAVCQLDGNYDEANRACRELALTSGIQFANITLRPFYAEGAKTVAYEVVEQLDWRSPDHFVIPAAGGTLSSRVHKGLTELEKVGLAETGATKISVAQADGCGPIAGAILDGSGEIEPQTPHTAAHSLAIGAPGDGPLVVDAVLSRGGSAATATDAEIFDAIDLLGATEGILTEPAGGTTVAATMKLAGEGKLRPDDTVVAVISGNGYKTLDEHPDKPWPEMVACDVESMGEMLAEFRQHGVGAALT

SEQ ID NO: 414 - protein, 445 aa, unidentified
  REGION 1..445: note = Description of Unknown:uncultivated organism sequence
  REGION 1..445: note = Category: MG37 effectors
  REGION 1..445: note = Description: MG37-167 effector
MSSSSTTASSQGTRQRTRSCATELVCHRCDHRYPLTDTVFACPDCGKGLDIAYDYELAGTHFRDFPISERPQNIWHFEELLPILDANAQARVGQYSGYTPLIRADRLGAELGLNNLYLKDDSTSRPSLSYKDRVVSMSVARLLERGKTEIGCVSTGNVGTAVASMAAKAGVDAFIFYPNRLEEMKARACMALGAKVVQVEGNYDEANRRCREVAAETGMDFANITLRPFYAEGAKTAAFEIVEQLQWASPDHIVSPAAGGTLSSRMHKGLGELQLLGLSETEGTQIHIAQPSGCNPIASAILAEEAEVVPVMPETAAHSLAIGAPGDGYLVIDAVHKRGGTAAFASDPEIFAGIDLLAATEGLLTEPAGGTTIAVLEKLAAAGRFAPEDTVVALITGNGLKTLDEHPSKAWPAKIDCELDPMLGALAELKRTPTLMQTAREQLRA

SEQ ID NO: 415 - protein, 437 aa, unidentified
  REGION 1..437: note = Description of Unknown:uncultivated organism sequence
  REGION 1..437: note = Category: MG37 effectors
  REGION 1..437: note = Description: MG37-168 effector
MSDAVEPHQGEAVGPRTTSCATELVCRDCGYRTPLLDTAFKCPACGEGLDIDYDYERATSLIAERGLADRPDNIWRFEELLPILSQRAQAKVGQFAGQTPLIKADRLGAELGLKNLYLKDDSTNRPSLSYKDRVVSMAVARMLALGKNEIGCVSTGNVGTAVAALAAKAGATAYNFYPRNMEKGKAKACRALGAQVCQLDGNYDQANRACRELSLASGIEFANITLRPFYAEGAKTMAFEVVEQLDWAAPDHFVIPAAGGTLSSRVHKGLNELEIVGLAETAGTKINIAQASGCGPIATAILGGGEIEPQTPDTAAHSIAIGAPGDGALVLDAVRTRGGSAATASDAEIFAAIDLLGATEGILTEPAGGTTVAATARLAAEGKIGADDTVVAVISGNGLKTLQDHPEKQWPEMVSCDVETMGELLAEFRQTAAAALR

SEQ ID NO: 416 - protein, 430 aa, unidentified
  REGION 1..430: note = Description of Unknown:uncultivated organism sequence
  REGION 1..430: note = Category: MG37 effectors
  REGION 1..430: note = Description: MG37-169 effector
MSLPADQRTRSCATELVCPDCGIGLPLSDTTFRCPDCDKGLDVVYDYELARQRIAEIGPAQRPQNIWRYEELLPIVDRAASERVGAFAGQTPLIRADRLGAELGLRNLYVKDDSTNRPSLSYKDRVVSMAVARAIELGCTEIGCVSTGNVGTATAALANKAGLTPYIFYPANLERAKARSCRALGAEVCQLNGNYDQANKACRELAEASGMQFANITLRPFYSEGAKTLAYEVVEQLDWVSPDHIVMPAAGGTLSSRVHKGLNELEAVGLAQTAHTRAHIGQPSGCSPIATAIVEDAAEIVHQVPETLAQSLAIGAPGDGPLVVDAVRSRRGSAAAVPDGEIITAMELLAATEGVLTEPAGGTTLAATMKLAQQGVIRPDDTVVVVISGNGLKTLSEQPVRPWPERIPCDPAAMEEVVRGFRRSGVGAAL

SEQ ID NO: 417 - protein, 445 aa, unidentified
  REGION 1..445: note = Description of Unknown:uncultivated organism sequence
  REGION 1..445: note = Category: MG37 effectors
  REGION 1..445: note = Description: MG37-170 effector
MSTVTSQKRAPEPARRTRSCAKALACHRCDLEYPLQERVFACPQCAKGLDVIYDYELAARRFEEVPREARPHNIWHFEELLPIVDAAAQARVGLTAGYTPLIAANRLGAELGLSNLYLKDDSTSRPSLSYKDRVVAMSVARLLELGEQEMGCVSTGNVGTAVASYAAKAGVDAYVFYPNRLEDTKARACRALGAKVCQVEGNYDEANRRCREVAEATGLEFANITLRPFYAEGAKTSAFEICEQLDWRAPDHIVTAAAGGTLSSRMHKGLRELAQLGLADTDPTRIHIAQPSGCNPIASAIIAEEAEIRAVTPETAAHSLAIGAPGDGYLVIDAVLKRGGTGGFASDPEIFAGIDLLAATEGILTEPAGGTTIAVLEKLAAAGRFGADESVVAIVTGNGLKTLDDHPEKPWPAKIDCELDAMLAALEDLRRGGSPSASERERLPA

SEQ ID NO: 418 - protein, 445 aa, unidentified
  REGION 1..445: note = Description of Unknown:uncultivated organism sequence
  REGION 1..445: note = Category: MG37 effectors
  REGION 1..445: note = Description: MG37-171 effector
MSPSSTASPQGTRKRTRSCATDLVCHRCEHRYPLNDTVFACPDCGKGLDIAYDYELAASHFRASPSSERPQNIWHFEELLPILDASAQARVGQHSGYTPLIRADRLGAELGLSNLYLKDDSSNRPSLSYKDRVVSMSLARLLERGKTEIGCVSTGNVGTAVASMAAKAGVDAFIFYPNRLEEMKARACMALGAQVVQVQGNYDEANRRCREVAAETGMDFANITLRPFYAEGAKTAAFEIVEQLQWASPDHIVSPAAGGTLSSRMHKGLGELQLLGLSETDATQIHIAQPSGCNPIASAILAEEAEVHPVMPETAAHSLAIGAPGDGYLVIDAVHKRGGTAAFASDPEIFAGIDLLAATEGLLTEPAGGTTIAVLEKLAAAGRFAPEDTVVALITGNGLKTTDCLQDAYEQNKAIRPRLTDFENFVEERNAVNEALRLVGESYVR

SEQ ID NO: 419 - protein, 445 aa, unidentified
  REGION 1..445: note = Description of Unknown:uncultivated organism sequence
  REGION 1..445: note = Category: MG37 effectors
  REGION 1..445: note = Description: MG37-172 effector
MSTPTAQSPHQGSRQRTRSCATGLVCHRCGHSYPLEDTVFACPDCGKGLDVEYDYELAARRFEEVPRSQRPQNIWRFEELLPIVDATAQARVAQHAGWTPLIRADRLGAELGLANLYLKDDSTSRPSLSYKDRVVSMSVARLLEKGKQEIGCVSTGNVGTAVASMAAKAGVDAYVFYPNRLEDMKARACRALGAKVCQVEGNYDEANKRCREVALATGMDFANITLRPFYAEGAKTAAFEIVGQLEWQAPEHIITAAAGGTLSSRLHKGLGELQLLGLAETDPTRIHIAQPSGCNPIASAILAEEAEVHAVTPETAAHSLAIGAPGDGYLVIDAVLKRGGTAGFASDPEIFAGIDLLAATEGLLTEPAGGTTIAVLEKLAAAGRFDPGDTVVAIITGNGLKTLDDHPAKPWPDKIDCELDAMLEALATLKGSGSLVDDAREQLQA

SEQ ID NO: 420 - protein, 358 aa, unidentified
  REGION 1..358: note = Description of Unknown:uncultivated organism sequence
  REGION 1..358: note = Category: MG37 effectors
  REGION 1..358: note = Description: MG37-173 effector
MSEAVDPRLGGPGGPRTSSCATELVCRECGYRAPLSDTAFRCPTCDAGLDVDYDYERAKASIAARGLAERPWNIWRFEELLPIAGRRAAGTVAQFAGQTPLIPARRLGAELGLRNLYVKDDSTNRPSLSYKDRVVGMAVARALELGAGEIGCVSTGNVGTATASLAAAAGLKPYVFYPANLERAKARGCRALGAQVCQVDGNYDEANRACRELTEATGIPFANISLRPFYAEGAKTLAYELVEGLGWRSPDHVVMPAAGGTLSSRVHKGLLEFEILDLAETAATKLHVGQPTGCSPIVTTIVAGAKETVPQQPETLAHSLAIGAPGDGDLVVEAVRSRGGSAAAVPDGRSPLTTSSSS

SEQ ID NO: 421 - protein, 439 aa, unidentified
  REGION 1..439: note = Description of Unknown:uncultivated organism sequence
  REGION 1..439: note = Category: MG37 effectors
  REGION 1..439: note = Description: MG37-174 effector
MSDAADPHLGEAIGPRTSSCATELVCRDCGYRTPLLDTAFKCPACGEGLDIDYDYERAKSLIAKRGLAERPDNIWRFEELLPILSQRAQGMVGQFSGQTPLIKADRLGAELGLKNLYLKDDSTNRPTLSYKDRVVSMAIARMLALGKDEIGCVSTGNVGTAVAALAAKAGAMAYIFYPGNMEKGKAKACRALGAQVCQLDGNYDEANRACRELSLASGIEFANITLRPFYAEGAKTVAYEVVEKLDWVSPDHFVIPAAGGTLSSRVHKGLVELEKVGLSETAQTKIHAAQADGCGPIAAAILDGSGEIEPQTPHTAAHSLAIGAPGDGPLVVDAVMSRGGSAATASDPEIFEALDLLGATEGILTEPAGGTTVASTAKLAAEGKLGPDDTVVAVISGNGYKTLDEHPEKPWPSMVSCDVESMGVMLAEFRQHGAGATLS

SEQ ID NO: 422 - protein, 444 aa, unidentified
  REGION 1..444: note = Description of Unknown:uncultivated organism sequence
  REGION 1..444: note = Category: MG37 effectors
  REGION 1..444: note = Description: MG37-175 effector
MSTQTAHPTAGPRQRTRSCATGLVCHRCEHSYPLESTVFACPDCGKGLDIVYDYELAASHFRDVPSSERPQNIWHFEELLPIVDASAQARVGQHSGYTPLIRADRLGAELGLSNLYLKDDSSNRPSLSYKDRVVSMSVARLLERGETEMGCVSTGNVGTAVASLAAKAGVAAYVFYPNALEDTKARACMALGAKVCQVEGNYDEANKRCRELAEATGMDFANITLRPFYAEGAKTAAFEIVEQLDWQSPDHIITAAAGGTLSSRLHKGLVELQLLELAETDPTRIHIAQPSGCNPIATAIVAEEAEIHAVTPETAAHSLAIGNPGDGYLVIDAVLKRGGTGGFASDPEIFAGIDLLAATEGLLTEPAGGTTIAVLEKLAASGRFAPDDTVVAIITGNGLKTLDDHPRKPWPAKVDCELDAMMAALSELKSGGTLVESAREQLRF

SEQ ID NO: 423 - protein, 388 aa, unidentified
  REGION 1..388: note = Description of Unknown:uncultivated organism sequence
  REGION 1..388: note = Category: MG37 effectors
  REGION 1..388: note = Description: MG37-176 effector
MLLHADVRERLGEIPPAEREINIWRFEELLPIVDAKAQARVGRYSGRTPLIHADRLGAELGLKKLYLKDDSTSRPSLSYKDRVVSMAVARLLELGEDEIGCVSTGNVGTAVSSLASKAGVRAYVFYPSNMERGKARACRALGAAVCQLDGNYDEANRACRELALASGIQFANITLRPFYAEGAKTVAYEVVEQLEWEAPDHIVIPAAGGTLSSRVHKGLDELETVGLAETSGVKIDVAQAEGCSPIATAISDGSGRIEPQTPHTAAHSIAIGAPGDGRLVVDAVMSRGGSAATASDQEIFEAIDLLGATEGILTEPAGGTTIACTARLANEGKLGPEDTVVAIVSGNGYKTLDEHPDKPWAEGVACDVDAMSEMLEEFRQHGVGATLG

SEQ ID NO: 424 - protein, 445 aa, unidentified
  REGION 1..445: note = Description of Unknown:uncultivated organism sequence
  REGION 1..445: note = Category: MG37 effectors
  REGION 1..445: note = Description: MG37-177 effector
MSTHTAESPARGARQRTRSCATGLACHRCQHSYELADTVFACPDCGKGLDVVYDYELAARHFRDFPSSERPRNIWHFEELLPIVDAGAQARVGQHSGYTPLIRAERLGAELGLSNLYLKDDSTSRPSLSYKDRVVSMSVARLLERGKREIGCVSTGNVGTAVASLAATAGVDAYVVYPNRLEDMKARACRALGAKVFQVEGNYDEANRRCRELAEATGMDFANITLRPFYAEGAKTAAFEIVEQLGWQAPDHIVTAAAGGTLSSRLHKGLGELQLLGLSQTDPTRIHIAQPSGCNPIASAILAEEAEVHPVTPETAAHSLAIGAPGDGYLVVDAVRKRGGTGGFATDPEIFAGIDLLAATEGILTEPAGGTTIAVLEKLAAAGRFAPDDTVVAIVTGNGLKTLDDHPQKPWPDKVDCELDAMLAALAELKSGGTLMDTAREQLHA

SEQ ID NO: 425 - protein, 1341 aa, unidentified
  REGION 1..1341: note = Description of Unknown:uncultivated organism sequence
  REGION 1..1341: note = Category: MG37 effectors
  REGION 1..1341: note = Description: MG37-178 effector
MKKWGKRIISGVIVASLLTAAAISGSEQGTATVSSVVQAGTETSFMGKLLEGGYIDVFTSWTQEEQNKFYDRLSPKEKSVFLEVTNCQIIRELIKSERTKEELERFFDRLEPYFLMLKKGSQEKPDEEIVIECINQIEGKDYESLEQYLKQLVSEKHGYYLDFYTALKRVKDGKSEIESAVNDLYKNLGFLKEDKVPAKPDKVSPLPVQVQKKAAKAVSDGYSNFKAVSSLKALKDAVASVEKGEKIAVRVDKGFNVTSAIRTNGRHVKIYADGESAHNLNRAVGYKDAMLEVNGGSLTLGAYDGDGRAKNNLYINGKNVAASAPMIEVTSGQLYLNKYSRIIDGYFLADFAGGAGIAMNSGTSCYMFGGKIDSCRAKSSKDVSSSSPKSSHGGGVLVGNGASFYMFAGSIEHCQAIHGGGIMNYGTLRLYGGTVSDCAASNKKKDALGGAVKVQGAIETDGKVNSTKGDLGVWKYTRSGTWAVNGKDGYQQKSTTGVVLKNNQADAGGAVCLNNGSNGAIQDCNIYGNHSNGNGAGICLSNGSYKKGAALEIKTGAVIHGNESKGYGGGIYCADSVKGSLRGGSMYDNSAVYGAGVYHEAEFRMTGGTVRNNHSGNSGGGIYAKGKLSMTGGEISSNTAATYGGGAILKNAGGSLSGGSIKNNTASVNGGGLQIDGAVSFSNVSVSSNSASGKGGGISVSSAGTCSFSSGNVSGNTSKAGGGGIYIDGTCKANGSNFTGNQSYGDGGAVYIASGTFTTFQANQAVNIQGNSASGNGSGIYNRNTAILNNNAHILNNQCKNGTQRGIFHEGSLFSIEGHTEIQQEIYLAKDRFITVSNRYFSNSNSLTARISLDAANIRNGYAAVKGNISNSADSNYKTGDALLNNQSVNGRFMYAGSGYVMRPGNLKKSSSGCVPYSIVLSQAYQIRYDKNSKEEVMNMPTAAVKYWEEDIRLSALTPSGGSGVFVAWNTNADGTGDGYQPGNVYTANADATLFALWPHYRVEYLPGIQGAAGTTDSQEQNKSENILLRKNSFRSSEGKFIGWKQDISSARKRRELEPVGYKELKEERERGKSDHILAFAKSYKKVNASVNLDNKNSLLNAEDIFFMEGQWDSKPDIILHDKKTFLENEKIRKNDLLKAVKGCYDDEDGDLTEKVQIIKLDYGTSMEGYRPEPQNFSGGMNDTDVIDTYFMKLEKDETVEVKVIFQVEDSVGNVAEKEGTVYVTYNNPPKLHSQNLAFYQKDLDNNPQTVLKEILENYQVEDLEDDKSGLKVPVSVVDPIPMQIEKLNSVGEHKIVYQAIDSLGKKTKLDSTVYIAENNPFKDSYKYLSLIHISEPTRPY

SEQ ID NO: 426 - protein, 438 aa, unidentified
  REGION 1..438: note = Description of Unknown:uncultivated organism sequence
  REGION 1..438: note = Category: MG37 effectors
  REGION 1..438: note = Description: MG37-179 effector
MSPSTTSSSTQGARKLTRSCATGLICHRCDRRYPLTDAVFACPDCGKGLDIAYDYERAARHFKEVPSSERPQNIWHFEELLPIVDASAQARVGRYAGYTPLIHADRLGAELGLSNLYLKDDSTSRPSLSYKDRVVSMSVARLLELGKDEIGCVSTGNVGTAVASLAAKAGVDAYVFYPNRLEDMKARACRALGAKVCQVEGNYDEANRRCREVAEATGLEFANITLRPFYAEGAKTAAFEIVEQLDWQSPDHIVTAAAGGTLSSRLHKGLGELQLLGLSETDPTRIHIAQPSGCNPIATAILAEEAEIHAVMPETAAHSLAIGNPGDGYLVIDAVRKRGGTGGFASDPEIFAGIDLLAATEGLLTEPAGGTTIAVLEKLAREGKFAPDDTVVAIVTGNGLKTLDEHPAKPWPAKVDCELAAMLAALDGLGRKPSPVAA

SEQ ID NO: 427 - protein, 1004 aa, unidentified
  REGION 1..1004: note = Description of Unknown:uncultivated organism sequence
  REGION 1..1004: note = Category: MG53 effectors
  REGION 1..1004: note = Description: MG53-1 effector
MNRSFTARLSAKTPRRLRDYLWATHRIFNESLAYVLKHYFWMQNLNDRTAEQDRRNRLRNRFDDAQLDRLRMIYRDMMGLDLPKEKRAGRSQSAHAWMEPITFSTESKGSGPGESSKNLLPQVKEAIRQIRRRNTWLFDRELAFPLSPNKGFRRGLFEAAARRILNFEQNQDTHKSYLEEARSQYERWTGGEQRDVTDEEGADERRAGWRRTVLLRAWGKEQNAQREAEIDEIARLNWSDFERARVAFEAYEQERSEKRAREHGQQFDGTKVERINAAMTRGWRDIYERLMPPDAQGAPDRTTAEEVIKGYQMSEPRRIGDVNFFLWLADKPHLWRYVDTMRAYNTHQRKLQQYAKDIQFRYPRYNVRPDWFTFSETSPGYMYTIVSMSPLVVELSVLVPKEDEPILKKHAKGKPLTEDEQARLSQPIDWSTYHLTREALANRLDRYREDLTKKHADLIAKANLGPVHDWTNGMWQQLLDGFFRGDPPLDMARFTRVMVRYALSTDRRLRPFVPQPSEDSDLIGRLEVLSNERKKRHYQGTYEYWFGPLAEARGLLVERRRYLRRIPLTVGGIRLEYRGRLRSDAEPIFTLSCELDERLNGPEGKRVFPAPAHRIPPKSDTAETAEGSAASAANKRRISKKRPKMPVGLRVMAVDLGLRHPGTGAVVEFVDDGHGHGRLPEPLKPVAVEILDVAGTSLVHIQRHQDERRRKQKKACPRGSRRRFEIRGAHLAHGQEFARGLLNHVENLKDDRRKKAAHTILRAALKHKVDYIVFENLAGYRPEMEFGRKVNAALMTWNRRELVEFVKMEAAPLGIHVYEWVPPHHTSRFCHRCGAVGHRFSHIRSIDAKKDALAPAEPLLDNAGNPKLDSYGKPILRRKWTPQARRVRGTPLGLIAGMRQAIDGGRQFCCTECGLIVNADYNAAMNLARKLADEFHAYQRYAYDREKRTWTVNGETLPGRDFWERAKALVQQRLNQRFRQPPETPPAGGWPRSLEPSPIEPTPW

SEQ ID NO: 428 - protein, 1005 aa, unidentified
  REGION 1..1005: note = Description of Unknown:uncultivated organism sequence
  REGION 1..1005: note = Category: MG53 effectors
  REGION 1..1005: note = Description: MG53-2 effector
MNRSFTARLSRKTHRRLRDYLWATHRIFNESLAYLLKHYFWMQNLTDRELEQDKKNRLRQRFDAAQLDQLQLIYRDMMGLDLPKEKRAGRSQSAQAWMEPITFSTRSTGKGPGELSTNILPKVKVAIRTMRQQNLWVFDRELAFPIEPHNGFRRGLFGGAARRILNFEQNQETHRGYLEDAKRAYERWRGGQAREAAEDDTVDARRAGWRRTVLLRAWGEGQEPNREAEIDGIAQLQWADFQRAREEFSQYESQRAADRAREQKRPVTENAVEKINAAMTRGWRDVYQQRLMPPDADGPPDAATAGRLIKDYQAAEPTRIGDINFFLWLADKPHLWRFVDTMKAYNAHQRKLERYGRPIQFTYPRYNRRPEWFTFSETSPGHMYTIVSMTPLKVDLAVFVPNEDVPLLEKLSKGQPLTGEETRRLNEPLDWTAYRLTPERLVERRNAHRTKLTERIPDAIAKYGLDAVHAWTDGVWERLLGGFFREDPPLDMSRFTRVMVRYSLSTDVRLRPFAPEPASEEDLLGRLVVRSNDRQKPHWQGTYQYMFGPLTEPNDSLPDRRRHLRAMPMVVGGIRLEYRDCLRNDADPIFTLSCELDERVAGPEGKQVYPAPQHRIPKKAQPTEAAEEGTPQEGKKRKDAKKRPKMPVGLRVLSVDLGMRHIGTGAVVEFVDDGHGNGRLPHPLKPVGIEFLDAPGIALRHIDRHSDERRRKQRKACPRGSRRAFEIRGAHLPRGQVFARHLLDHTENLKDDRRKKAAHAILRAALKHNVDYIVFENLKGYRPDFEFGRRVNATLMKWNRRELVEFVKMEAQPFGIWVYDFVRPSHTSQFCHRCGAAGYRFSQITRREAAFDTPAPKEPLFDEHGNRKLDSNGKPLFRHRWTPQARRIRGTPLGLIAGMRQAIDGGKHFCCSECGLIVNADYNAAMNLARKLADDFSAYQKYSYNPEDKSWALSGKRMAGKTFWEHIKATVQQRLNTRFGQPVQTPPAGGWPKEFAPESIGLTPW

SEQ ID NO: 429 - protein, 784 aa, unidentified
  REGION 1..784: note = Description of Unknown:uncultivated organism sequence
  REGION 1..784: note = Category: MG54 effectors
  REGION 1..784: note = Description: MG54-1 effector
MGVRALRARIECDRETLLHLWRTHCAFNQRLLSILTKLFGMRRGELGETAARRALYQRVARFLLARDSKDAPYLLNSVSIQGWKPATALKMKVRMPAPDGTLAEVSADTWAPEAAKLSAHGTLAYDKEAVRDGLPDSLFQPMLRDAVAYISGHIELARNWEAEHADWLKAKAEWEEKDEHKKYLALRPRFDAFEQSVGGKAGKRRERWHLYLTWLRENPALAAWRGGPPAVHPLDAKATARVAKAKPWKKRSVEADEFWKANPELRELDKLHGYYEREFVRRRKTKKNPDGFDHRPTFTLPHAVLHPRWTLFNAPQTSPQGYADLRLPQRPGTLGSVKLRLLTGEKAPDGCPNEWVGVQFRADPRLSQFAERAEAQEIRKGKKKGTQKTVRVFRFVDQQLNCERPAQISGAKLIFKNVKLNDDGSLKSATPYLVFACTIDNLPLTEHARAIQWSETGEVTKTGKKRKAKKLPTGLVTCAVDLGLRNLAFLTLATSGEGPQNNTHDGIRVLRSRNQWLALEETAGTHPGRWSAGPDLAHIAAHKREIRRLRRLRGKPVKGQQSHVELQGHIDHMGQDRFKKAARAIVNFALNVDRAAGQSGQPYPRADLLIVEKLEGFIPDAARERGINRALVAWNRGQLVTRIKEVAADAGLKLFPVHPAGTSQCCSRCGALGRRYSIVRDQQTGVPAIRFGWVEKLFACPNRECPGRAPDKPDQPFTCNADHNASLNLHRRFVLDDRAVAAFFAWKNKTNAERERELTQMDQALRPELEKLHRLPLAELATPF

SEQ ID NO: 430 - protein, 784 aa, unidentified
  REGION 1..784: note = Description of Unknown:uncultivated organism sequence
  REGION 1..784: note = Category: MG54 effectors
  REGION 1..784: note = Description: MG54-2 effector
MGVRALRARIECDRETLLHLWRTHCAFNQRLLSILTKLFGMRRGELGETAARRALYQRVARFLLARDSKDAPYLLNSVSIQGWKPATALKMKVRMPAPDGTLAEVSADTWAPEAAKLSAHGTLAYDKEAVRDGLPDSLFQPMLRDAVAYISGHIELARNWEAEHADWLKAKAEWEEKDEHKKYLALRPRFDAFEQSVGGKAGKRRERWHLYLTWLRENPALAAWRGGPPAVHPLDAKATARVAKAKPWKKRSVEADEFWKANPELRELDKLHGYYEREFVRRRKTKKNPDGFDHRPTFTLPHAVLHPRWTLFNAPQTSPQGYADLRLPQRPGTLGSVKLRLLTGEKAPDGCPNEWVGVQFRADPRLSQFAERAEAQEIRKGKKKGTQKTVRVFRFVDQQLNCERPAQISGAKLIFKNVKLNDDGSLKSATPYLVFACTIDNLPLTEHARAIQWSETGEVTKTGKKRKAKKLPTGLVTCAVDLGLRNLAFLTLATSGEGPQNNTHDGIRVLRSRNQWLALEETAGTHPGRWSAGPDLAHIAAHKREIRRLRRLRGKPVKGQQSHVELQGHIDHMGQDRFKKAARAIVNFALNVDRAAGQSGQPYPRADLLIVEKLEGFIPDAARERGINRALVAWNRGQLVTRIKEVAADAGLKLFPVHPAGTSQCCSRCGALGRRYSIVRDQQTGVPAIRFGWVEKLFACPNRECPGRAPDKPDQPFTCNADHNASLNLLRRFVLDDRAVAAFFAWKNKTNAERERELTQMDQALRPELEKLHRLPLAELATPF

SEQ ID NO: 431 - protein, 783 aa, unidentified
  REGION 1..783: note = Description of Unknown:uncultivated organism sequence
  REGION 1..783: note = Category: MG55 effectors
  REGION 1..783: note = Description: MG55-2 effector
GCKLMYELKHRIIDRLEQMFSFKTRGEWFREGVCPQCGKKELYTHAHNPRIVKCGRLNKCGYEEHVKDICEDLFKDWSKEFPKTEAKPHAAADAYLEHGRGFDLTKLKGRFTQEAFHNEQKFPGQVSATVRFELAPGVYWERLIDRPERFGRQKANFKGKYEGLSWTMWQLDDLCHAESIWITEGIFNSIALTLSGVPSIATMSSGNYPVKLLQQITDRCHELKKDKPRLCWAYDNDKEGRKKLKKFHLRALQEKWSSTAALPPNQIKGRSFDWNDLYMHDLLHSEERKKYRHYGELLIAESAEQAGLLIYNFKEGRTRTFFFNHEFRLYYFNLDIDKYNKALDIIEKNENLNHLLDEQKREQALRDSASCTEICNRQIKPLYFQRNEITDEHWYYAQIVSEDTEVNTTFTSSMIRNSDKFAERLLGVNEGAWWTGSTNQLVSYMKPRTEFIKRVKTIDYIGYTKEDKAWLFNDYAVHDGQIIPINEHDYFRIKRLDIKTLSNDPQIQLNPKAKFNPTWWKDFYRVRGNKGIVALAWWMGTYFAEQIRGLNSSYPFMEIVGQAGAGKSRLIEFMWKLSGRKDYEGFDPNKSTSVAVYRNFAKISNLPVVLIEGDRNDINGNAIQKAKFSWDELKDAFNGRAIRSKGVKNAGNDTYEPPFRGAILISQNTQIQASEAILTRTLLLEFDRSGQSLETKRIVDELDRMELEDACTFMTHCLRNEDKILETYASKLQSIEDHYHEIGITHTRIALCHAQVAALIEAMTKHVLPIDLEDMLEAQEMLE

SEQ ID NO: 432 - protein, 788 aa, unidentified
  REGION 1..788: note = Description of Unknown:uncultivated organism sequence
  REGION 1..788: note = Category: MG55 effectors
  REGION 1..788: note = Description: MG55-3 effector
GEWFREGVCPQCGKKELYTHAHNPRIVKCGRLNKCGYEEHVKDICEDLFKDWSKEFPKTEAKPHAAADAYLEHGRGFDLTKLKGRFTQEAFHNEQKFPGQVSATVRFELAPGVYWERLIDRPERFGRQKANFKGKYEGLSWTMWQLDDLCHAESIWITEGIFNSIALTLSGVPSIATMSSGNYPVKLLQQITDRCHELKKDKPRLCWAYDNDKEGRKKLKKFHLRALQEKWSSTAALPPNQIKGRSFDWNDLYMHDLLHSEERKKYRHYGELLIAESAEQAGLLIYNFKEGRTRTFFFNHEFRLYYFNLDIDKYNKALDIIEKNENLNHLLDEQKREQALRDSASCTEICNRQIKPLYFQRNEITDEHWYYAQIVSEDTEVNTTFTSSMIRNSDKFAERLLGVNEGAWWTGSTNQLVSYMKPRTEFIKRVKTIDYIGYTKEDKAWLFNDYAVHDGQIIPINEHDYFRIKRLDIKTLSNDPQIQLNPKAKFNPTWWKDFYRVRGNKGIVALAWWMGTYFAEQIRGLNSSYPFMEIVGQAGAGKSRLIEFMWKLSGRKDYEGFDPNKSTSVAVYRNFAKISNLPVVLIEGDRNDINGNAIQKAKFSWDELKDAFNGRAIRSKGVKNAGNDTYEPPFRGAILISQNTQIQASEAILTRTLLLEFDRSGQSLETKRIVDELDRMELEDACTFMTHCLRNEDKILETYASKLQSIYDHYHEIGITHTRIALCHAQVAALIEAMTKHVLPIDLEDMLEAQDMLEDMARERVAQLTGDHPDEEKFWDAYEYLQGN

SEQ ID NO: 433 - protein, 909 aa, unidentified
  REGION 1..909: note = Description of Unknown:uncultivated organism sequence
  REGION 1..909: note = Category: MG55 effectors
  REGION 1..909: note = Description: MG55-5 effector
MITYQDLLLPFGVKEKKGKKYAKCPFCKNGTLNINSNVFFCSKCGFRGSERDFLKKLNIKTTSDVIVSNTHPQVKINNPERPIFLVFDSELFKYLSDKFSNINLILNPIVSMKEVQNKILYICSEKQNIEYADIFFASAKLLKILNYDELFKCNTEEQLKELVLKSSFYDPYPINGLIISDDKKIVDYINKLKYTAVLAKTVSPSIIEENCNVFFLYKTATIYDIAKVINPLFQKTQNIFLFSAENITVNVFTDILSEKQKFTVQFKKIVYQTYEKIIINSDIFKKIPPNIFEQTMNEFYGCKKLIENMEFNSFLNLVLSKYDFLIKNIPWGKIEMSYLNIYEKYVGSIKKIGKSYMALCPFHPDTNPSMKIDPEKGFFYCFGCNVKGKLNNFLDKLKAECGVEVDKEDYENSKTNKKGFIKKEPINYDEVYTNKTYYSYVDLNGNLAYIKIRYDTPKENSPDVRPKTFVIEFHTQDKRLFFYNLQGLNYIKDEDKKNYEIWFAEGEKCVDVIERVLDPEPEEEYPCIVLGYNNPEREWEYLPESYKAIFKDRDIKIFVDNDEIGQKKALQLIEILKKYAKKISLIQFSDKPSGYDIADFLEEGNPIFDALAISNTVYEVRKFSGNVLDILEYEVPEQKYVLQDNLHIPTGILSIIAGSGGLGKSYLSLYFALELMAEGKNVSMITLEDPIEKIIERIQRLLRKYQKTIDKSVKFTVYEYQEQDLLELTKNILENESDVLFIDPIGSVFEDENDNAETSRFMRKLAQIAISTKKNIFLVHHIRKMMQKPKEKETTKEDLYDMVRGASAIPNTAKHVVYVRRWKEDKNVLEVITVKHNYHRTDIDLRVKNLFDRNVPVEIEKFEFEKKIERPTKELVESEVVAKNIDEQDKDFSLSKRKESKNGRRDKQL

SEQ ID NO: 434 - protein, 853 aa, unidentified
  REGION 1..853: note = Description of Unknown:uncultivated organism sequence
  REGION 1..853: note = Category: MG55 effectors
  REGION 1..853: note = Description: MG55-6 effector
MKTIYITEEQKNNIKNIELLTEARGERALRKYIIDYTNSYVAQFLDIPLTEIPQNLIAICNPGEGESEMFSSVKNNSSGNNKFIDFLRVNFYEQFGMLHNGPTKKYMEGIARIALGELGFYSFDNRLQGSKIVNLGRVIKIISNNEDLLRSNNINLDGNLNNLSYNELMEYLNPVVQEYIDNSKNELNNSVYETPANYVIHEIKDVSVNNYGTPMKTPTRESYDYLESLAPYCDWCIVGNRHPGMYGQYTSNGGKFYICEKEGFKDIPREQGENCPLDEYGLSLICVLVAPDGFPENITTRWNHDFNGENNPNLENAIQLQNILKVKYLDVFKPRNEEEVNSMTRTGIQESEKPAAQDQVDNKVNAGIMDAVTAGGTMEEGAEPESDKYEIGSEKDGDINPYYHVNESDDKEESELKKYCGEIADFMKKIGINVYPYPKLNLDWSEQDGLFIKTGFYAPDEKAITIFCKDRHPKDILRTFSHEMIHHSQNLNGKDLNFSSDDDVKDNDKLKDIEAEAYLKGNIYFRQWTEYKNSERDSLNESKTNKKVINDEGKVVPEKCEKCGGKIGVYICGEPIYKCSECGEYYGTVKFNLKESEIFEETNPDNIDLSSFNIKKELNPKFWKNGLLDSRIRLKLMDIADDFIDFLGIDWVKPDDIIMTGSLANFNWNKKYSDIDLHILIDFSKVDKRKDFVKKYFDSLKNSWNEQHEGLSIFGFPVEVYVQDTNESHTSTGVYSLDKNEWIKEPERKKLATSKVNKSLIRNKVANYINQIDDLEEKYNTNKDNEFKVRKISEKLEKLWDTIKNERKSELNNDKGKEISNGNIIFKCLRRLNYIDKLYDLKTKTYDKMNSLP

SEQ ID NO: 435 - protein, 881 aa, unidentified
  REGION 1..881: note = Description of Unknown:uncultivated organism sequence
  REGION 1..881: note = Category: MG55 effectors
  REGION 1..881: note = Description: MG55-7 effector
MNNDAMEHTLGGGILTTSGSKQRKTSKFVMGKYTLYETKDRMYIVGSNKRETMFRILEIDLTVPRGELTVLEDNVFFTRNEIMNVLASLEEATEDGLHKKITGYGLLGFIKFTCWYYLIMVTKYSQVAVIGGHGIYHIDGIDIIPITNNYKKPEKSSDEARLLNIFKDLDLTKTFYFSYTYDITNTLQTNILREKLKAVDRCDITIPCGITDYNEMFVWNNNLLSPIFACIDTVFDWFQCIIHGFIDQVNVSVLGKSIYITLIARRSHHFAGARFLKRGVNNKGHVANEVETEQIVTDMILTPFHQPGNGFFDSDRYTSFVQHRGSIPLYWTQDASNLTTKPPIRINVVDPFFSPAALHFDNLFQRYGGGTIQILNLIKTKEKTPRETKLLWEFEQCIDYLNEFLPTLKKLDYTSWDMSRASKQDGQGVIEFLEKYAVNTVTTTGIFHNGPDFASTKIQEGICRSNCIDCLDRTNAAQFVIGKRALGCQLKSLGIIDNSYLEYDSDIVNILTELFHDLGDTIALQYGGSHLVNTMETYRKINQWSSHSRDMIESIKRFYSNSFVDAQRQDAINLFLGHYSWREGFPSLWEMNTDFYLHNAYSLNMPKRSYTHWWNDYNIKSIKELINEELIATGNDVTREKIIKNVRGYPGAFDNYWNEYYLPRSVTWIRDLFAYNMNSTRRYHNAVSKQDKAMSPFTSRKQSWLNNKLKMITSSKSLEKAEGRVVETTDLDRDTSPKQELELYEHYLHIISDRSQKLEEKMNSFSYSKYPIFISHESSEIPPMRKVIGEPLVDIAEDFTDVYDDDDDDDGDDENDEMTTEALLIAPDHVSVDEKFYEKVLNVDDYKPALDDYSAVIHIKPDNLQLYRDLCFSKDIQLDFQ

SEQ ID NO: 436 - protein, 996 aa, unidentified
  REGION 1..996: note = Description of Unknown:uncultivated organism sequence
  REGION 1..996: note = Category: MG55 effectors
  REGION 1..996: note = Description: MG55-8 effector
MNRIYQGRVLSWSQAGEGEEAKPIKGMDNPLWVHHELFQAAVNYYYLALGALGQAATEGPFFGLQSRIKESWESDPIHKRKASGLRQLLMPYLKINESTTLDEVYSLVLGQGHAKPKTLFKVGLAVAKDLGGDSSIQMKGREYLPRLCDTKYKGKFPRETTSREKEQMKLLLPHWLHGDDVDNRIHEIIGKLKFHHFANKTGKDLSFDESKALLATGVKFLSEKSLITSSEQVKLVEKIEKLPQDFSIPTYAGGSVNKEALQVRFYAYLITINFWSSKRGLKLLRDAYPKPKTTKIPDVTLSDEETFMLVDEDDPVKMARGKRGYVFRAFTSLPVWGGKSAADIQWKEFDIAAFKEALTTFNLYKQKTEERKDRLAKVEVSLDRMNGGEKYLQADKEIRDEAADLPVMKGDPRVEKLRELLYKKIPGVDGDRFDVGVTLRSLRHYDDLVKVWQSTSRNNSDKGDAEIRDLLIDCVTQSQQKNKRTFGDVNLFRALCEPENWIVWENSDEDFLKQKNAKSWADNVVDAFRIQLKLLDDQEYLQQPIKFRPAHPIDSPRQFRFSDLVTKNHTLHKPENHLQVSVAHRDEASGLFSKQGLSLHYSAPRIYRDAIGSSGEESDHGVWLQPMMKALGIPDLPKVDIKSAAVVLNMKIDRDKTDVRAYVDFPIDLKDAAKALSDYMGKQDLWDKQFNTNKDKEKLGLYWKGMTNAPEKLWHSKKEVKENGMQILGVDLGQRTAFAYSLIDCRGDKDFSKKQNGSKRNIITAIGHDGNNTWEAALLHSGMGRLPGEDSKQFDKNGNWVTERGGKKGRKANADDIVLAKCLLKEMEVDEEGSLSEDLLKVEYAPELWDRMLRYCKCMRNRLGRYYYSAVDLLSEKPDDREKMIQYLKSHPLPGVKENDELSETWKEFAIRCLEKYETDLQKFREILLAITDEILPVRGKRWKWVPHPDFPEHGYHLLINESDESTKGKKIRGQRGLSFDRMEQLENLRKLFQAL

SEQ ID NO: 437 - protein, 912 aa, unidentified
  REGION 1..912: note = Description of Unknown:uncultivated organism sequence
  REGION 1..912: note = Category: MG55 effectors
  REGION 1..912: note = Description: MG55-9 effector
MSEIKHRIINRLENMFSFKTRGEWFREGVCPQCGKKELYTHAHNPRIVKCGRLVKCGYEEHVKDICEDLFKDWSEYHPQTDTNPNAAADAFLSEGRGFDISNLIGKYTQQFYKDSNTGESSATVRFMLDDKNYWERLIDRPERFGNKKARFNFGFKNAGQAWSMHELDEICRLGEKGEAIWITEGIFDAIALSQSGVKAISCLSCVNYPSAFLKQIADRCHELKIDKPRLRWAFDNDSAGKGYTVKWHERSRAEGWSSTAAQPPANGGKKLDWNDLFQWDKLNPDQFPKYKHYGELLIAESAEDAGLLIYNFKQGRLKSFYFEYNYAMYHFNLDIEKYTKKLEKIEEDENQDHLLDKQKREMALRECQSIRQICSSSIQPLYFVRDNITDQSFYYIKVQSEKQQIVVNFTSDQISSPAKLKPRLLGVLSGTNWKGNQNDVDYLIDRMKDLKTVHTVDFIGYSREYQTYLFEKYAIHKGQIIPINEHNFFKVKRKELKTLAVSPAITLNPKQEFKPSWWNDFHRVRGAKGIVALAWWMGSYFAEQIRAMHSSYPFMEIVGEAGAGKSRLIEMMWKLSGRKDYEGFDANKSTNVAVYRNFAQIANLPVVLIEGDRNDVNGNAVQKSKFSWDELKDAFNGRAIRSKGLKTAGNETYEPPFRGAILISQNTAIQASEAILTRTLHLYFDRKGQSLETKRIVDELDRMELEDACAFMTHCLRNEDKILQTYASKLQSIEDHYHEIGITHTRIALCHAQVAALIEAMTKHVLPIDLEDMLEAQEMLEQMARERVEQLNGDHPDVEKFWDVYEYLQGNRSPEWGLNHHPADAQTVAINLNEIYKVAARNYQQLPEINEMKKLLRTSRKYKFIESNKQVYSDRFPADDVAAVNKSREAPGKPSRNVKCWIFTNPNLGAKK

SEQ ID NO: 438 - protein, 909 aa, unidentified
  REGION 1..909: note = Description of Unknown:uncultivated organism sequence
  REGION 1..909: note = Category: MG55 effectors
  REGION 1..909: note = Description: MG55-10 effector
MSELKHRIIERLEKTFNFKKRDEWFREGLCPSCGKKEVFTHAINPRIVKCGRLNKCGYEEHVKDICEDLFKDWSKEFPKTEAKPHAAADAYLQHGRGFDLSKINGLYTQEAFHNEKKFPGLVSATVRFKLAPGIYWERLIDRPERFGRQKANFIGKYEGYSWTMMELDALCNADSIWFTEGIFNAIALTLSNVPAVATMSSGNYPTKLLQQITDRCHELKKDKPRLCWAFDNDKAGKKAIKKFHLRAIQEKWSSTAALPPHQIKDKNFDWNDLYMHDLLHSEERKKYRHYGELLIAETAEQAGLLIYNFKEGRTRTFYYNHDFRLYYFNLDIDKFNKSLEHIEKNEDMDHLLEQQKREQALRDSASCTELCTRQIQPLYFQRNEITDDHWYYVQIISEDSEINTTFTSSMIRNSDKFAERLLGVHEGAWWTGSTNQLISYMKPRTEFIKRVKTIDYVGYTKEDKAWLFNDYAVHDGQIIPINKHDYFRIKRMDIKTLSNDPHIQLNPQGKFTPTWWNDFYRVRGTKGIIALAWWMGSYFAEQIRAEHSSYPFIEIVGEAGAGKSRLIEFMWKLSGRKDYEGFDPNKSTSVSVYRNLSKVSNLPVVLIEGDRNDANGNAVQKAKFSWDELKDAFNGRSIRSKGLKTSGNETYEPPFRGAVLISQNTAIQASEAILTRTLHLYFDRKGQSLETKRIVDELDRMELEDACTFMTHCLRNESKILETYKNSLQEIEAEYHEMGITHTRIALCHAQVASLITAMAQHVLPIDLEEVIKAQNMLQVMARDRVDQLNGDHPDVEKFWDVYEYLEGNRSAAWSLNHHDSDNQTVAINLNEVYKVAARNFQQLPEINEMKKLLRTSRKYKFIESNRQCHSERFPADEVSGVAKDREPTVKPKRNVKCWIFTNPNLGGK

SEQ ID NO: 439 - protein, 909 aa, unidentified
  REGION 1..909: note = Description of Unknown:uncultivated organism sequence
  REGION 1..909: note = Category: MG55 effectors
  REGION 1..909: note = Description: MG55-11 effector
MSELKHRIIERLEKTFNFKKRDEWFREGLCPSCGKKEVFTHAINPRIVKCGRLNKCGYEEHVKDICEDLFKDWSKEFPKTEAKPHAAADAYLQHGRGFDLSKINGLYTQEAFHNEKKFPGLVSATVRFKLAPGIYWERLIDRPERFGRQKANFIGKYEGYSWTMMELDALCNADSIWFTEGIFNAIALTLSNVPAVATMSSGNYPTKLLQQITDRCHELKKDKPRLCWAFDNDKAGKKAIKKFHLRAIQEKWSSTAALPPHQIKDKNFDWNDLYMHELLHSEERKKYRHYGELLIAETAEQAGLLIYNFKEGRTRTFYYNHDFRLYYFNLDIDKFNKSLEHIEKNEDMDHLLEQQKREQALRDSASCTELCTRQIQPLYFQRNEITDEHWYYVQIISEDNEINTTFTSSMIRNSDKFAERLLGVHEGAWWTGSTNQLISYMKPRTEFIKRVKTIDYVGYTKEDKAWLFNDYAVHDGQIIPINKHDYFRIKRMDIKTLSNDPHIQLNPQGKFTPTWWNDFYRVRGTKGIIALAWWMGSYFAEQIRAEHSSYPFIEIVGEAGAGKSRLIEFMWKLSGRKDYEGFDPNKSTSVSVYRNLSKVSNLPVVLIEGDRNDANGNAVQKAKFSWDELKDAFNGRSIRSKGLKTSGNETYEPPFRGAVLISQNTAIQASEAILTRTLHLYFDRKGQSLETKRIVDELDRMELEDACTFMTHCLRNESKILETYKNSLQEIEAEYHEMGITHTRIALCHAQVASLITAMAQHVLPIDLEEVIKAQNMLQVMARDRVDQLNGDHPDVEKFWDVYEYLEGNRSAAWSLNHHDSDNQTVAINLNEVYKVAARNFQQLPEINEMKKLLRTSRKYKFIESNRQCHSERFPADEVSGVAKDREPTVKPKRNVKCWIFTNPNLGGK

SEQ ID NO: 440 - protein, 906 aa, unidentified
  REGION 1..906: note = Description of Unknown:uncultivated organism sequence
  REGION 1..906: note = Category: MG55 effectors
  REGION 1..906: note = Description: MG55-13 effector
MSNIHVLIDEKLNQLFSFKRVGEWYRQGICPNCGKKELYTHAVNPRVVKCARLNKCGYEEHVKEICEDLFKDWSKDFPRTKENPNAAADAYLLHARGFDPNILKGLYTQELFRNDLKYPNEVTATIRFKLANGIYWERFIDRPERFGRQKANFIGKYEGHAWTLEQLDTLCNAQSIWITEGIFNAIALSFSKQPSIATLSTSNYPSLILKQITDRCIELKKDRPRLRWAFDNDKAGKKAIKKFHLRALQEKWNSTAALPSGQLDWNDLYQRDQLHSEYRDQYKHYGELHIAESPEQAGLLIYNYKDARRKTFWFIHNFRLYWFNLDMDKYTKELERIEADPERDLLLDSQKRELALQQCAAVSEICNRQLNPLYFQRNEITDESWYYFQILNPESEAKATFTADQISARGKFAPRLLSVQVGAWWTGNDHQLLTFMKNQTERLREVKTIDFIGYSKEYQAYIFNKHAVYKGQVIDINDHDFYKVGRIELKTLANSPNVQLNPKSTFKPTWWKDFYRVRGAKGLVALAWWTGSYFAEQIRSMHSSFPFIEIVGEAGAGKSRLIEFMWKLSGRPDYEGFDANKSTNVAVYRNFAQISNLPVVLIEGDRNDQNGNSVGKPKFSWDELKDAYNGRAIRSKGLKTAGNETYEPPFRGAIMISQNTAIQASEAILTRTLHLYFDRKGQSLETKRIVDDLDRMNIEEACTYMTHCLRHENAFLKTYAEKLEQTEKEFHNNGITHTRIALCHAQVSALIDAVAKHILHDVIDLEEVCAAQNMLLDMAHERVKQLNGDHPLVEQFWDVYEYLNSSRSTEFSINHFEHDAHQIAINLNEVYKVAAKNYQQLPDIKEMKNLLTASRRYKFVDKSRVVKSHRYPADEVKNALEDKTLREHTVRCWIFQNPAISGSPNS

SEQ ID NO: 441 - protein, 906 aa, unidentified
  REGION 1..906: note = Description of Unknown:uncultivated organism sequence
  REGION 1..906: note = Category: MG55 effectors
  REGION 1..906: note = Description: MG55-14 effector
MSNIHVLIDEKLNQLFSFKRVGEWYRQGICPNCGKKELYTHAVNPRVVKCARLNKCGYEEHVKEICEDLFKDWSKDFPRTKENPNAAADAYLLHARGFDPNILKGLYTQELFRNDLKYPNEVTATIRFKLANGIYWERFIDRPERFGRQKANFIGKYEGHAWTLEQLDTLCNAQSIWITEGIFNAIALSFSKQPSIATLSTSNYPSLILKQITDRCIELKKDRPRLRWAFDNDKAGKKAIKKFHLRALQEKWNSTAALPSGQLDWNDLYQRDQLHSEYRDQYKHYGELHIAESPEQAGLLIYNYKDARRKTFWFIHNFRLYWFNLDMDKYTKELERIEADPERDLLLDSQKRELALQQCAAVSEICNRQLNPLYFQRNEITDESWYYFQILNPESEAKATFTADQISARGKFAPRLLSVQVGAWWTGNDHQLLTFMKNQTERLREVKTIDFIGYSKEYQAYIFNKHAVYKGQVIDINDHDFYKVGRIELKTLANSPNVQLNPKSTFKPTWWKDFYRVRGAKGLVALAWWTGSYFAEQIRTMHSSFPFIEIVGEAGAGKSRLIEFMWKLSGRPDYEGFDANKSTNVAVYRNFAQISNLPVVLIEGDRNDQNGNSVGKPKFSWDELKDAYNGRAIRSKGLKTAGNETYEPPFRGAIMISQNTAIQASEAILTRTLHLYFDRKGQSLETKRIVDDLDRMNIEEACTYMTHCLRHENAFLKTYAEKLEQTEKEFHNNGITHTRIALCHAQVSALIDAVAKHILHDVIDLEEVCAAQNMLLDMAHERVKQLNGDHPLVEQFWDVYEYLNSSRSTEFSINHFEHDAHQIAINLNEVYKVAAKNYQQLPDIKEMKNLLTASRRYKFVDKSRVVKSHRYPADEVKNALEDKTLREHTVRCWIFQNPAISGSPNS

SEQ ID NO: 442 - protein, 769 aa, unidentified
  REGION 1..769: note = Description of Unknown:uncultivated organism sequence
  REGION 1..769: note = Category: MG55 effectors
  REGION 1..769: note = Description: MG55-15 effector
MYELKHRIIDRLEQMFSFKTRGEWFREGLCPSCGKKEVFTHAINPRIVKCGRLNKCGYEEHVKDICEDLFKDWSKEFPKTEAKPHAAADAYLQHGRGFDLSKINGLYTQEAFHNEKKFPGLVSATVRFKLAPGIYWERLIDRPERFGRQKANFIGKYEGYSWTMMELDALCNADSIWFTEGIFNAIALTLSNVPAVATMSSGNYPTKLLQQITDRCHELKKDKPRLCWAFDNDKAGKKAIKKFHLRAIQEKWSSTAALPPHQIKDKNFDWNDLYMHELLHSEERKKYRHYGELLIAETAEQAGLLIYNFKEGRTRTFYYNHDFRLYYFNLDIDKFNKSLEHIEKNEDMDHLLEQQKREQALRDSASCTELCTRQIQPLYFQRNEITDEHWYYVQIISEDNEINTTFTSSMIRNSDKFAERLLGVHEGAWWTGSTNQLISYMKPRTEFIKRVKTIDYVGYTKEDKAWLFNDYAVHDGQIIPINKHDYFRIKRMDIKTLSNDPHIQLNPQGKFTPTWWNDFYRVRGTKGIIALAWWMGSYFAEQIRAEHSSYPFIEIVGEAGAGKSRLIEFMWKLSGRKDYEGFDPNKSTSVSVYRNLSKVSNLPVVLIEGDRNDANGNAVQKAKFSWDELKDAFNGRSIRSKGLKTSGNETYEPPFRGAVLISQNTAIQASEAILTRTLHLYFDRKGQSLETKRIVDELDRMELEDACTFMTHCLRNEDKILETYASKLQSIEDHYHAIGITHTRIALCHAQVAALIEAMTKHVLPIDLE

SEQ ID NO: 443 - protein, 882 aa, unidentified
  REGION 1..882: note = Description of Unknown:uncultivated organism sequence
  REGION 1..882: note = Category: MG55 effectors
  REGION 1..882: note = Description: MG55-16 effector
MYELKHRIIDRLEQMFSFKTRGEWFREGVCPQCGKKELYTHAHNPRIVKCGRLNKCGYEEHVKDICEDLFKDWSKEFPKTEAKPHAAADAYLEHGRGFDLTKLKGRFTQEAFHNEQKFPGQVSATVRFELAPGVYWERLIDRPERFGRQKANFKGKYEGLSWTMWQLDDLCHAESIWITEGIFNSIALTLSGVPSIATMSSGNYPVKLLQQITDRCHELKKDKPRLCWAYDNDKEGRKKLKKFHLRALQEKWSSTAALPPNQIKGRSFDWNDLYMHDLLHSEERKKYRHYGELLIAESAEQAGLLIYNFKEGRTRTFFFNHEFRLYYFNLDIDKYNKALDIIEKNENLNHLLDEQKREQALRDSASCTEICNRQIKPLYFQRNEITDEHWYYAQIVSEDTEVNTTFTSSMIRNSDKFAERLLGVNEGAWWTGSTNQLVSYMKPRTEFIKRVKTIDYIGYTKEDKAWLFNDYAVHDGQIIPINEHDYFRIKRLDIKTLSNEPQIQLNPKAKFNPTWWKDFYRVRGNKGIVALAWWMGTYFAEQIRGLNSSYPFMEIVGQAGAGKSRLIEFMWKLSGRKDYEGFDPNKSTSVAVYRNFAKISNLPVVLIEGDRNDINGNAIQKAKFSWDELKDAFNGRAIRSKGVKNAGNDTYEPPFRGAILISQNTQIQASEAILTRTLLLEFDRSGQSLETKRIVDELDRMELEDACTFMTHCLRNEDKILETYASKLQSIEDHYHEIGITHTRIALCHAQVAALIEAMTKHVLPIDLEDMLEAQEMLEDMARERVEQLNGDHPDVEKFWDAYEYLQGNRSPEWGLNHHDNDAQTIAINLNEIYKVAARNYQQLPEINEMKKLLRTSRKYKFIESNKQVYSDRFPADDVAAV

SEQ ID NO: 444 - protein, 751 aa, unidentified
  REGION 1..751: note = Description of Unknown:uncultivated organism sequence
  REGION 1..751: note = Category: MG55 effectors
  REGION 1..751: note = Description: MG55-17 effector
MYELKHRIIDRLEQMFSVKTRGEWFREGVCPQCGKKELYTHAHNPRIVKCGRLNKCGYEEHVKDICEDLFKDWSKEFPKTEAKPHAAADAYLEHGRGFDLTKLKGRFTQEAFHNEQKFPGQVSATVRFELAPGVYWERLIDRPERFGRQKANFKGKYEGLSWTMWQLDDLCHAESIWITEGIFNSIALTLSGVPSIATMSSGNYPVKLLQQITDRCHELKKDKPRLCWAYDNDKEGRKKLKKFHLRALQEKWSSTAALPPNQIKGRSFDWNDLYMHDLLHSEERKKYRHYGELLIAESAEQAGLLIYNFKEGRTRTFFFNHEFRLYYFNLDIDKYNKALDIIEKNENLNHLLDEQKREQALRDSASCTEICNRQIKPLYFQRNEITDEHWYYAQIVSEDTEVNTTFTSSMIRNSDKFAERLLGVNEGAWWTGSTNQLVNYMKPRTEFIKRVKTIDYIGYTKEDKAWLFNDYAVHDGQIIPINEHDYFRIKRLDIKTLSNDPQIQLNPKAKFNPTWWKDFYRVRGNKGIVALAWWMGTYFAEQIRGLNSSYPFMEIVGQAGAGKSRLIEFMWKLSGRKDYEGFDPNKSTSVAVYRNFAKISNLPVVLIEGDRNDINGNAIQKAKFSWDELKDAFNGRAIRSKGVKNAGNDTYEPPFRGAILISQNTQIQASEAILTRTLLLEFDRSGQSLETKRIVDELDRMELEDACTFMTHCLRNEDKILETYASKLQSIEDHYHAIGITHTRIALCHAQ

SEQ ID NO: 445 - protein, 753 aa, unidentified
  REGION 1..753: note = Description of Unknown:uncultivated organism sequence
  REGION 1..753: note = Category: MG55 effectors
  REGION 1..753: note = Description: MG55-18 effector
NRRNKISGRKLMSELKHRIIDRLENMFSFKTRGEWFREGICPQCGKKELYTHAHNPRIVKCGRLVKCGYEEHVKDICEDLFKDWSEFHPQTDTNPNAAADAFLSEGRGFDISNLIGKYTQQFYKDSNTGESSATVRFMLDDKNYWERLIDRPERFGNKKARFNFGFKNAGQAWSVHELDEICRLGEKGEAIWITEGIFDAIALSQSGVKAISCLSCVNYPSAFLKQIADRCHELKIDKPRLRWAFDNDSAGKGYTVKWHERSRAEGWSSTAAQPPANGGKKLDWNDLFQWDKLNPDQFPKYKHYGELLIAESAEDAGLLIYNFKQGRLKSFYFEHHFSMYHFNLDIEKYTKKLEKIEEDETQDHLLDKQKRELALRECQSIRQICSASIQPLYFVRDSVTDQAFYYFKITSKKQETIVNFTSEQISSPAKLKTRLLSVLSGANWTGNQNDLDHFITRIEDLKTVLTIDFVGYSREHETYIFEKYAVHKGQVIPINEHDFFKVKRKEIKTLASSPEISLNPKKQFDPSWWNDFHKIRGAKGIVALAWWMGSYFAEQIRAMHSSYPFMEIVGEAGAGKSRLIELMWKLSGRKDYEGFDPNKGSFAGIYRNFGKVSNLPTVLIEADRNDVNGNSVQKSKFSWDELKDMFNGRTIRTMGVKTSGNETHEPPFRSSILISQNTQIQASEAILTRTLHLYFDRKGQSLETKRIVDELDRMELEDACTFMTHCLRNEDKILETYASKLQSIEDHYHEIGI

SEQ ID NO: 446 - protein, 777 aa, unidentified
  REGION 1..777: note = Description of Unknown:uncultivated organism sequence
  REGION 1..777: note = Category: MG55 effectors
  REGION 1..777: note = Description: MG55-19 effector
REGVCPQCGKKELYTHAHNPRIVKCGRLVKCGYEEHVKDICDDLFKDWSEYHPQTDTNPNAAADAFLSEGRGFDISNLIGKYTQQFYTDKDSKESSATVRFMLDDKNYWERLIDRPERFGNKKARFNFGFKNAGQAWSVHELDEICRLGEKGEAIWITEGIFDAIALSQSGVKAISCLSCVNYPSAFLKQIADRCHELKIDKPRLRWAFDNDSAGKGYTVKWHERSRAEGWSSTAAQPPANGGKKLDWNDLFQWDKLNPDQFPKYKHYGELLIAETAEDAGLLIYNFKQGRLKSFYFEHHFSMYHFNLDIEKYTKKLEKIEEDETQDHLLDKQKRELALRECQSIRQICSASIQPLYFVRDSVTDQAFYYFKITSKKQETIVNFTSEQISSPAKLKTRLLSVLSGANWTGNQNDLDHFITRIEDLKTVLTIDFVGYSREHETYIFEKYAVHKGQVIPINEHDFFKVKRKEIKTLASSPEISLNPKKQFDPSWWNDFHKVRGAKGIVALAWWMGSYFAEQIRAMHSSYPFMEIVGEAGAGKSRLIELMWKLSGRKDYEGFDPNKGSFAGIYRNFGKVSNLPTVLIEADRNDVNGNSVQKSKFSWDELKDMFNGRTIRTMGVKTSGNETHEPPFRSSILISQNTQIQASEAILTRTLHLYFDRKGQSLETKRIVDELDRMELEDACTFMTHCLRNEDKILETYASKLQSIEDHYHEIGITHTRIALCHAQVAALIEAMTKHVLPIDLEDMLEAQEMLEDMARERVEQLNGDHPDVEKFW

SEQ ID NO: 447 - protein, 793 aa, unidentified
  REGION 1..793: note = Description of Unknown:uncultivated organism sequence
  REGION 1..793: note = Category: MG55 effectors
  REGION 1..793: note = Description: MG55-20 effector
SGCKLMYELKHRIIDRLEQMFSFKTRGEWFREGVCPQCGKKELYTHAHNPRIVKCGRLNKCGYEEHVKDICEDLFKDWSKEFPKTEAKPHAAADAYLEHGRGFDLTKLKGRFTQEAFHNEQKFPGQVSATVRFELAPGVYWERLIDRPERFGRQKANFKGKYEGLSWTMWQLDDLCHAESIWITEGIFNSIALTLSGVPSIATMSSGNYPVKLLQQITDRCHELKKDKPRLCWAYDNDKEGRKKLKKFHLRALQEKWSSTAALPPNQIKGRSFDWNDLYMHDLLHSEERKKYRHYGELLIAESAEQAGLLIYNFKEGRTRTFFFNHEFRLYYFNLDIDKYNKALDIIEKNENLNHLLDEQKREQALRDSASCTEICNRQIKPLYFQRNEITDEHWYYAQIVSEDTEVNTTFTSSMIRNSDKFAERLLGVNEGAWWTGSTNQLVSYMKPRTEFIKRVKTIDYIGYTKEDKAWLFNDYAVHDGQIIPINEHDYFRIKRLDIKTLSNDPQIQLNPKAKFNPTWWKDFYRVRGNKGIVALAWWMGTYFAEQIRGLNSSYPFMEIVGQAGAGKSRLIEFMWKLSGRKDYEGFDPNKSTSVAVYRNFAKISNLPVVLIEGDRNDINGNAIQKAKFSWDELKDAFNGRAIRSKGVKNAGNDTYEPPFRGAILISQNTQIQASEAILTRTLLLEFDRSGQSLETKRIVDELDRMELEDACTFMTHCLRNEDKILETYASKLQSIEDHYHEIGITHTRIALCHAQVAALIEAMTKHVLPIDLEDMLEAQEMLEDMARERVEQ

SEQ ID NO: 448 - protein, 840 aa, unidentified
  REGION 1..840: note = Description of Unknown:uncultivated organism sequence
  REGION 1..840: note = Category: MG55 effectors
  REGION 1..840: note = Description: MG55-21 effector
MIFLLYHVIFIYNYTLMNFRKTLQKCKEKLQNNIINQNDSIWMPLDVRVCDNYHFKTDSFNLIVKYDSEHLEHNNTFHFNNYEHLQAKIVNVFFDKVQKSIIKTWMKLYKYTYDTVIQIFSHVYNLCNIYYKINFYDARKILTNFISYNCKNNYKFNYFYKLNKHTIRKFYFYRNNKLCNKEIKILKKQFTKIKFNNIYNSDNYINLFKILKEYRSEYVKYVKFYSANPIHFLNKLHFTDFYNKLQDEYKQLFINLKCPIEEIILQEKNINIPIFKYDDYNPYMKKYTDFIKNRDNINNYEEHNKIYRLYVNYENKLINKQKRLLEIRSKLIYTKLSVIVKLIDNVINTFYKHIYKIIEEKLPQQVNNFVDQVKLYKTNEQFRNKKNAILQKYGYKTTINYKNTINEMRKSSVGKKIIINEKKLLYKDIIKTNHVSIFEPKYTNSLRNNTNVSRHTIDLAVEKACANYKTCLTNLKNRNIDNFNLREIKLRKMIIDIEPNEFSKEGIRKNILGTTTGFYNGILFDFTTINKATILKYNEKLNKYTLHVPYINKNLSEDEKKEKIKILEKKLKMTKKQKKRNKRRRKEKIKKRNNKNKKKETIKNIKKEIKRIKKNNMEKTGEGTISLDPGVRKYLTGYSSEKKKNIEIRENIKIKKNCYKIYETTKKYGLSSGKKKKVKKKEKKEKKEKKVKREIKVISEKEKEKVKRKLENRSKKVYRQMTDFHNKVIKYLTENYASILIGDMSLKGILNKKTSKLKKKTKYLCTRLRIGMLRTKLKKKCEEKNLKYKLVNEAYTSKTCTKCGTINENLKSKETFNCNECKIIIDRDLNGARNIHLASL

SEQ ID NO: 449 - protein, 719 aa, unidentified
  REGION 1..719: note = Description of Unknown:uncultivated organism sequence
  REGION 1..719: note = Category: MG55 effectors
  REGION 1..719: note = Description: MG55-22 effector
MQVVKRDGKLVDFDQSKIRVAIEKANREVRPRERATKEEINQIIDYVEDLDKKRILVEDIQDIIEEQLMSFGKYLLAKKYITYRYTRELVRKANTTDQSIKELIDGESDYWNNENSNKNARVVTTQRDYLAGITSTDITRRFLLPEDVVKAHDEGIIHFHDADYFAQNALTNCELINLEDMLQNGTIMNGVMIEKPHRFLTAMTIATQIILGVTSSTYGGATVSLTHLAPFVKSSYDRYYKKYKKRGLSEAQCKEYAEQDTKKEVSDGVQTFNYQVNSMTNTNGQAPFLSVCMYLGETDEYKKELAMIIEEFLKQRIEGFKNEKGVYITPAFPKLLYVLEEDNIHKDSKYWYLTELAAKCTAKRLVPDYISEKKMKELKIDKNGNGNCYPCMGCRSFLTPYVDPETNKPKYYGRFNQGVVTINLVDVALSSKQDEEKFWKIFDERLELCHKALQIRHERLSKVTSDVAPILWQHGALARLEKGESIHKLLHDGYSTISLGYAGLYECVKYMTGHSHTDNGEGEEFAIKVMQKLNDKCKEWKEAEKIDYSVYGTPIESTTYKFAKCLKKRFGTVEGITDRSYITNSYHVPVFEDIDAFSKLKLESKFQKLSPGGAISYVETPNLQDNLEVVLQIINFIYDNIMYAELNTKSDYCQKCGFDGEILIDENLEWYCPNCGNRDHNTLNVARRTCGYIGSQFWNKGRTQEIKERVLHIDNKDDE

SEQ ID NO: 450 - protein, 719 aa, unidentified
  REGION 1..719: note = Description of Unknown:uncultivated organism sequence
  REGION 1..719: note = Category: MG55 effectors
  REGION 1..719: note = Description: MG55-23 effector
MQVVKRDGKLVDFDQSKIRVAIEKANREVRPRERATKEEINQIIDYVEDLDKKRILVEDIQDIIEEQLMSFGKYLLAKKYITYRYTRELVRKANTTDQSIKELIDGESDYWNNENSNKNARVVTTQRDYLAGITSTDITRRFLLPEDVVKAHDEGIIHFHDADYFAQNALTNCELINLEDMLQNGTIMNGVMIEKPHRFLTAMTIATQIILGVTSSTYGGATVSLTHLAPFVKSSYDRYYKKYKKRGLSEAQCKEYAEQDTKKEVSDGVQTFNYQVNSMTNTNGQAPFLSVCMYLGETDEYKKELAMIIEEFLKQRIEGFKNEKGVYITPAFPKLLYVLEEDNIHKDSKYWYLTELAAKCTAKRLVPDYISEKKMKELKIDKNGNGNCYPCMGCRSFLTPYVDPETNKPKYYGRFNQGVVTINLVDVALSSKQDEEKFWKIFDERLELCHKALQIRHERLSKVTSDVAPILWQHGALARLKKGESIHKLLHDGYSTISLGYAGLYECVKYMTGHSHTDNGEGEEFAIKVMQKLNDKCKEWKEAEKIDYSVYGTPIESTTYKFAKCLKKRFGTVEGITDRSYITNSYHVPVFEDIDAFSKLKLESKFQKLSPGGAISYVETPNLQDNLEVVLQIINFIYDNIMYAELNTKSDYCQKCGFDGEILIDENLEWYCPNCGNRDHNTLNVARRTCGYIGSQFWNKGRTQEIKERVLHIDNKDDE

SEQ ID NO: 451 - protein, 719 aa, unidentified
  REGION 1..719: note = Description of Unknown:uncultivated organism sequence
  REGION 1..719: note = Category: MG55 effectors
  REGION 1..719: note = Description: MG55-24 effector
MQVVKRDGKLVDFDQSKIRVAIEKANREVRPRERATKEEINQIIDYVEDLDKKRILVEDIQDIIEEQLMSFGKYLLAKKYITYRYTRELVRKANTTDQSIKELIDGESDYWNNENSNKNARVVTTQRDYLAGITSTDITRRFLLPEDVVKAHDEGIIHFHDADYFAQNALTNCELINLEDMLQNGTIMNGVMIEKPHRFLTAMTIATQIILGVTSSTYGGATVSLTHLAPFVKSSYDRYYKKYKKRGLSEAQCKEYAEQDTKKEVSDGVQTFNYQVNSMTNTNGQAPFLSVCMYLGETDEYKKELAMIIEEFLKQRIEGFKNEKGVYITPAFPKLLYVLEEDNIHKDSKYWYLTELAAKCTAKRLVPDYISEKKMKELKIDKNGNGNCYPCMGCRSFLTPYVDPETNKPKYYGRFNQGVVTINLVDVALSSKQDEEKFWKIFDERLELCHKALQIRHERLSKVTSDVAPILWQHGALARLEKGESIHKLLHDGYSTISLGYAGLYECVKYMTGHSHTDNGEGEEFAIKVMQKLNDKCKEWKEAEKIDYSVYGTPIESTTYKFAKCLKKRFGTVEGITDRNYITNSYHVPVFEDIDAFSKLKLESKFQKLSPGGAISYVETPNLQDNLEVVLQIINFIYDNIMYAELNTKSDYCQKCGFDGEILIDENLEWYCPNCGNRDHNTLNVARRTCGYIGSQFWNKGRTQEIKERVLHIDNKDDE

SEQ ID NO: 452 - protein, 719 aa, unidentified
  REGION 1..719: note = Description of Unknown:uncultivated organism sequence
  REGION 1..719: note = Category: MG55 effectors
  REGION 1..719: note = Description: MG55-25 effector
MQVVKRDGKLVDFDQSKIRVAIEKANREVKPRERATKEEINQIIDYVEDLDKKRILVEDIQDIIEEQLMSFGKYLLAKKYITYRYTRELVRKANTTDQSIKELIDGESDYWNNENSNKNARVVTTQRDYLAGITSTDITRRFLLPEDVVKAHDEGIIHFHDADYFAQNALTNCELINLEDMLQNGTIMNGVMIEKPHRFLTAMTIATQIILGVTSSTYGGATVSLTHLAPFVKSSYDRYYKKYKKRGLSEAQCKEYAEQDTKKEVSDGVQTFNYQVNSMTNTNGQAPFLSVCMYLGETDEYKKELAMIIEEFLKQRIEGFKNEKGVYITPAFPKLLYVLEEDNIHKDSKYWYLTELAAKCTAKRLVPDYISEKKMKELKIDKNGNGNCYPCMGCRSFLTPYVDPETNKPKYYGRFNQGVVTINLVDVALSSKQDEEKFWKIFDERLELCHKALQIRHERLSKVTSDVAPILWQHGALARLKKGESIHKLLHDGYSTISLGYAGLYECVKYMTGHSHTDNGEGEEFAIKVMQKLNDKCKEWKEAEKIDYSVYGTPIESTTYKFAKCLKKRFGTVEGITDRSYITNSYHVPVFEDIDAFSKLKLESKFQKLSPGGAISYVETPNLQDNLEVVLQIINFIYDNIMYAELNTKSDYCQKCGFDGEILIDENLEWYCPNCGNRDHNTLNVARRTCGYIGSQFWNKGRTQEIKERVLHIDNKDDE

SEQ ID NO: 453 - protein, 719 aa, unidentified
  REGION 1..719: note = Description of Unknown:uncultivated organism sequence
  REGION 1..719: note = Category: MG55 effectors
  REGION 1..719: note = Description: MG55-26 effector
MQVVKRDGKLVDFDQSKIRVAIEKANREVKPRERATKEEINQIIDYVEDLDKKRILVEDIQDIIEEQLMSFGKYLLAKKYITYRYTRELVRKANTTDQSIKELIDGESDYWNNENSNKNARVVTTQRDYLAGITSTDITRRFLLPEDVVKAHDEGIIHFHDADYFAQNALTNCELINLEDMLQNGTIMNGVMIEKPHRFLTAMTIATQIILGVTSSTYGGATVSLTHLAPFVKSSYDRYYKKYKKRGLSEAQCKEYAEQDTKKEVSDGVQTFNYQVNSMTNTNGQAPFLSVCMYLGETDEYKKELAMIIEEFLKQRIEGFKNEKGVYITPAFPKLLYVLEEDNIHKDSKYWYLTELAAKCTAKRLVPDYISEKKMKEYKIDKNGNGNCYPCMGCRSFLTPYVDPETNKPKYYGRFNQGVVTINLVDVALSSKQDEEKFWKIFDERLELCHKALQIRHERLSKVTSDVAPILWQHGALARLKKGESIHKLLHDGYSTISLGYAGLYECVKYMTGHSHTDNGEGEEFAIKVMQKLNDKCKEWKEAEKIDYSVYGTPIESTTYKFAKCLKKRFGTVEGITDRNYITNSYHVPVFEDIDAFSKLKLESKFQKLSPGGAISYVETPNLQDNLEVVLQIINFIYDNIMYAELNTKSDYCQKCGFDGEILIDENLEWYCPNCGNRDHNTLNVARRTCGYIGSQFWNKGRTQEIKERVLHIDNKDDE

SEQ ID NO: 454 - protein, 719 aa, unidentified
  REGION 1..719: note = Description of Unknown:uncultivated organism sequence
  REGION 1..719: note = Category: MG55 effectors
  REGION 1..719: note = Description: MG55-27 effector
MQVVKRDGKLVDFDQSKIRVAIEKANREVRPRERATKEEINQIIDYVEDLDKKRILVEDIQDIIEEQLMSFGKYLLAKKYITYRYTRELVRKANTTDQSIKELIDGESDYWNNENSNKNARVVTTQRDYLAGITSTDITRRFLLPEDVVKAHDEGIIHFHDADYFAQNALTNCELINLEDMLQNGTIMNGVMIEKPHRFLTAMTIATQIILGVTSSTYGGATVSLTHLAPFVKSSYDRYYKKYKKRGLSEAQCKEYAEQDTKKEVSDGVQTFNYQVNSMTNTNGQAPFLSVCMYLGETDEYKKELAMIIEEFLKQRIEGFKNEKGVYITPAFPKLLYVLEEDNIHKESKYWYLTELAAKCTAKRLVPDYISEKKMKELKIDKNGNGNCYPCMGCRSFLTPYVDPETNKPKYYGRFNQGVVTINLVDVALSSKQDEEKFWKIFDERLELCHKALQIRHERLSKVTSDVAPILWQHGALARLEKGESIHKLLHDGYSTISLGYAGLYECVKYMTGHSHTDNGEGEEFAIKVMQKLNDKCKEWKEAEKIDYSVYGTPIESTTYKFAKCLKKRFGTVEGITDRSYITNSYHVPVFEDIDAFSKLKLESKFQKLSPGGAISYVETPNLQDNLEVVLQIINFIYDNIMYAELNTKSDYCQKCGFDGEILIDENLEWYCPNCGNRDHNTLNVARRTCGYIGSQFWNKGRTQEIKERVLHIDNKDDE

SEQ ID NO: 455 - protein, 719 aa, unidentified
  REGION 1..719: note = Description of Unknown:uncultivated organism sequence
  REGION 1..719: note = Category: MG55 effectors
  REGION 1..719: note = Description: MG55-28 effector
MQVVKRDGKLVDFDQSKIRVAIEKANREVRPRERATKEEINQIIDYVEDLDKKRILVEDIQDIIEEQLMSFGKYLLAKKYITYRYTRELVRKSNTTDQSIKELIDGESDYWNNENSNKNARVVTTQRDYLAGITSTDITRRFLLPEDVVKAHDEGIIHFHDADYFAQNALTNCELINLEDMLQNGTIMNGVMIEKPHRFLTAMTIATQIILGVTSSTYGGATVSLTHLAPFVKSSYDRYYKKYKKRGLSEAQCKEYAEQDTKKEVSDGVQTFNYQVNSMTNTNGQAPFLSVCMYLGETDEYKKELAMIIEEFLKQRIEGFKNEKGVYITPAFPKLLYVLEEDNIHKESKYWYLTELAAKCTAKRLVPDYISEKKMKELKIDKNGNGNCYPCMGCRSFLTPYVDPETNKPKYYGRFNQGVVTINLVDVALSSKQDEEKFWKIFDERLELCHKALQIRHERLSKVTSDVAPILWQHGALARLKKGESIHKLLHDGYSTISLGYAGLYECVKYMTGHSHTDNGEGEEFAIKVMQKLNDKCKEWKEAEKIDYSVYGTPIESTTYKFAKCLKKRFGTIEGITDRSYITNSYHVPVFEDIDAFSKLKLESKFQKLSPGGAISYVETPNLQDNLEVVLQIINFIYDNIMYAELNTKSDYCQKCGFDGEILIDENLEWYCPNCGNRDHNTLNVARRTCGYIGSQFWNKGRTQEIKERVLHIDNKDDE

SEQ ID NO: 456 - protein, 719 aa, unidentified
  REGION 1..719: note = Description of Unknown:uncultivated organism sequence
  REGION 1..719: note = Category: MG55 effectors
  REGION 1..719: note = Description: MG55-29 effector
MQVIKRDGKVVDFDQSKIKIAIEKANKEVKPRERASKDEINQIIGYVEDLDKKRILVEDIQDIIEEQLMSFGKYVLAKKYITYRYTRELVRKANTTDQSIKELIDGESDYWNNENSNKNAQVVTTQRDYLAGITSTDITRRFLLPEDVVKAHDEGIIHFHDADYFAQNALTNCELINLEDMLQNGTIMNGVMIEKPHRFLTAMTIATQIILGVTSSTYGGATVSLTHLAPFVRSSYDRYYKKYKQRGLSEKQCKEYAEQDTKKEVSDGVQTFNYQVNSMTNTNGQAPFLSVCMYLGETDEYKQELAMIIEEFLKQRIEGFKNEKGVYITPAFPKLLYVLEEDNIHKDSKYWYLTELAAKCTAKRLVPDYISEKKMKEYKIDKNGNGNCYPCMGCRSFLTPYVDPETNKPKYYGRFNQGVVTINLVDVALSSKQDEEKFWKIFDERLELCHKALQIRHERLSKVTSDVAPILWQHGALARLKKGESIHKLLHDGYSTISLGYAGLYECVKYMTGNSHTDNGIGEEFALRVMQKLNDKCKEWKEAEKIDYSVYGTPIESTTYKFAKCLKKRFGTIEGITDRSYITNSYHVPVFEDIDAFSKLKLESKFQKLSPGGAISYVETPNLQNNLEVVLQIIHFIYDNIMYAELNTKSDYCQKCGFDGEILIDENLEWYCPNCGNRDHNTLNVARRTCGYIGSQFWNKGRTQEIKERVLHIDNKDDE

SEQ ID NO: 457 - protein, 708 aa, unidentified
  REGION 1..708: note = Description of Unknown:uncultivated organism sequence
  REGION 1..708: note = Category: MG55 effectors
  REGION 1..708: note = Description: MG55-30 effector
MKVIKRDGTTVSYDRNKIKIAIQKANSEVEPAEKVTDETIEYIISCIETKNRSRMLVEDIQDIIEQKLMDEKKFVLAKTYIIYRYSRELVRKANTTDDSILSLIQNRNKDVMEENSNKNATVASTQRDLIAGEVSKDLTKRILLPEKISKAHEEGILHFHDADYFLQPIFNCCLINIGDMLDNGTVMNGKLIESPKSFQVACTVMTQVIAAVASSQYGGQSVDVRHLGKYLRKSYNKFKTKMTAEFGDTVPEEIIEKMVQERLQDELRSGVQTIQYQINTLMTTNGQSPFVTLFLNLDKDDEYIKENAMIIEEILRQRLEGIKNEKGVYVTPAFPKLIYVLDEHNCLKGGKYDYITELAVKCSAKRLYPDYISAKKMRENYEGNVFSCMGCRSFLTPWKDENGNYKFEGRFNQGVVSLNLPQIGIIAAGDEETFWDLLEERLELCYEALMCRHNALMGVTSDVSPVHWQYGAIARLEKGEPIDKLLLDGYSTISLGYIGLYEVTKLMKGCSHTEPAGQDFALRVMNRLRAATDKWKAETGIGFGLYGSPAESLCYRFARIDLERFGSIPDVTDKGYYTNSYHVDVRENIDAFSKFRFESQFQKISSGGAISYVEIPNMRNNLDALAEVVRFIYDNIQYAEFNTKSDYCHVCGYDGEIMINDDNEWECPQCGNKDHAKMNVTRRTCGYLGENFWNVGKTKEIKARVLHL

SEQ ID NO: 458 - protein, 724 aa, unidentified
  REGION 1..724: note = Description of Unknown:uncultivated organism sequence
  REGION 1..724: note = Category: MG55 effectors
  REGION 1..724: note = Description: MG55-31 effector
MKIIKRSGAENTFDKEKIENAVAKANITVEEKDRLSEGEIGEIAQNIEDKCSEMNRAMDVETIQDWVEADIMRHGKYTVAKHYITYRYERSIVRQANTTDKQILSLLNFENEEVKQENSNKNPTVNSVQRDYMAGEVSKDITRRFLLPDDIVEAHEKGLIHFHDADYFAQHMHNCCLVNLEDMLQNGTVISEVMIEKPHSFSTACNIATQSIAQIASSQYGGQSITLSHLAPFVQISRDKYRREVKKEFAELNIPADEDTINKVAEMRVKAEIVQGVQMIQYQVITLMTTNGQAPFVTVFMYLDEVPEGQTRDDLAAIIEEMLRQRIQGVKNEKGVYITPAFPKLIYVLEEDNIREGSKYWELTKLAAKCTAKRMVPDYISEKKMKELKVDKNGNGQCYPCMGCRSFLTTYLDENGKPKYYGRFNQGVVTINLVDVACSSYKDMDKFWKIFDERLELCRRALMLRHERLKGTPSDVAPILWQNGALARLKKGETIDKLLFGGYSTISLGYAGLCECVRYMTGKSHTDPSATPFALEVMQHLNDACTKWRAETNIDFSLYGTPLESTTYKFARCLQKRFGVIEGVTDRNYITNSYHIHVTENIDAFDKLTFESQFQALSPGGAISYVEVPNMQNNIEAVLAVMQHIYDNIMYAELNTKSDYCQKCGFDGEIKIVEDDGKLVWECPNCGNRDQNTLNVARRTCGYIGTQFWNQGRTQEIKERVLHL

SEQ ID NO: 459 - protein, 719 aa, unidentified
  REGION 1..719: note = Description of Unknown:uncultivated organism sequence
  REGION 1..719: note = Category: MG55 effectors
  REGION 1..719: note = Description: MG55-32 effector
MQVIKRDGKVVDFDQSKIKIAIEKANKEVKPRERATKEEINQIISYIEELDKKRILVEDIQDIIEEQLMTFGKYILAKKYITYRYTRELVRKSNTTDQSIKELIDGESDYWNNENSNKNARVVTTQRDYLAGITSTDITRRFLLPEDVVKAHDEGIIHFHDADYFAQNALTNCELINLEDMLQNGTIMNGVMIEKPHRFLTAMTIATQIILGVTSSTYGGATVSITHLAPFVKSSYEKYYKKYKQRGLNEKQCKEYAEQDTRKEVSDGVQTFNYQVNSMTNTNGQAPFLSVCMYLGETDEYKQELAMIIEEFLKQRIEGFKNEKGVYITPAFPKLLYVLEEDNIHKDSKYWYLTELAAKCTAKRLVPDYISEKKMKEYKIDKNGNGNCYPCMGCRSFLTPYVDPETNKPKYYGRFNQGVVTINLVDVALSSKQDEEKFWKIFDERLELCHKALQIRHERLSKVTSDVAPILWQHGALARLKKGESIHKLLHDGYSTISLGYAGLYECVKYMTGNSHTDNGIGEEFALKVMQKLNDKCKEWKEAEKIDYSVYGTPIESTTYKFAKCLRKRFGTIEGITDRSYITNSYHVPVFEDIDAFSKLKLESKFQKLSPGGAISYVETPNLQNNLEVVLQIIHFIYDNIMYAELNTKSDYCQKCGFDGEILIDENLEWYCPNCGNRDHNTLNVARRTCGYIGSQFWNKGRTQEIKERVLHIDNKDDE

SEQ ID NO: 460 - protein, 404 aa, unidentified
  REGION 1..404: note = Description of Unknown:uncultivated organism sequence
  REGION 1..404: note = Category: MG55 effectors
  REGION 1..404: note = Description: MG55-33 effector
MAKVKKANTGLNRTVVFEVSVANNNIKKQVMASIDKYRAVARKMYSSVAMAATAGATIEVKNGDVRVKPYTQNSKDILSKAYNVSGKAQFYELRNFVLKDHANTWQSVIWDSCRLAVAGTWNHADPEFSKGEKKVGRGWLSLQGARAFGFFNRCGIGLPNTKSIQFGSKSMTMKWDKEIDDVTFFVDSKLPGNTFWKFKNIRDGVWERGTCYIGWKYKNIGGGKKVKTLYITMTYKLPENYFNEESGEGVMIVEFTDDPENGIVMYSDDKFHYSDKISVYEAIAWNKQLNVVKDYYKKQRASVGGRDKQWGLNQSLMVISNKSENLTKRRINGKKHRNHIWANRIVARVRQWGMGVVVLKDFPDGLLIDQEWSMFELKEILKYKLREIGCELKTYNTPKEEEAA

SEQ ID NO: 461 - protein, 724 aa, unidentified
  REGION 1..724: note = Description of Unknown:uncultivated organism sequence
  REGION 1..724: note = Category: MG55 effectors
  REGION 1..724: note = Description: MG55-34 effector
MKIIKRSGAENTFDKEKIENAVAKANITVEEKDRLSEGEIGEIAQNIEDKCSEMNRAMDVETIQDWVEADIMRHGKYTVAKHYITYRYERSIVRQANTTDKQILSLLNFENEEVKQENSNKNPTVNSVQRDYMAGEVSKDITRRFLLPDDIVEAHEKGLIHFHDADYFAQHMHNCCLVNLEDMLQNGTVISEVMIEKPHSFSTACNIATQSIAQIASSQYGGQSITLSHLAPFVQISRDKYRREVKKEFAELNIPADEDTINKVAEMRVKAEIVQGVQMIQYQVITLMTTNGQAPFVTVFMYLDEVPKGQTRDDLAAIIEEMLRQRIQGVKNEKGVYITPAFPKLIYVLEEDNIREGSKYWELTKLAAKCTAKRMVPDYISEKKMKELKVDKNGNGQCYPCMGCRSFLTTYLDENGKPKYYGRFNQGVVTINLVDVACSSYKDMDKFWKIFDERLELCRRALMLRHERLKGTPSDVAPILWQNGALARLKKGETIDKLLFGGYSTISLGYAGLCECVRYMTGKSHTDPSATPFALEVMQHLNDACAKWRAETNIDFSLYGTPLESTTYKFARCLQKRFGVIEGVTDRNYITNSYHIHVTENIDAFDKLTFESQFQALSPGGAISYVEVPNMQNNIEAVLAVMQHIYDNIMYAELNTKSDYCQKCGFDGEIKIVEDDGKLVWECPNCGNRDQNTLNVARRTCGYIGTQFWNQGRTQEIKERVLHL

SEQ ID NO: 462 - protein, 719 aa, unidentified
  REGION 1..719: note = Description of Unknown:uncultivated organism sequence
  REGION 1..719: note = Category: MG55 effectors
  REGION 1..719: note = Description: MG55-35 effector
MQVIKRDGKVVDFDQSKIKIAIEKANKEVKPRERATKEEINQIISYIEELDKKRILVEDIQDIIEEQLMTFGKYILAKKYITYRYTRELVRKSNTTDQSIKELIDGESDYWNNENSNKNARVVTTQRDYLAGITSTDITRRFLLPEDVVKAHDEGIIHFHDADYFAQNALTNCELINLEDMLQNGTIMNGVMIEKPHRFLTAMTIATQIILGVTSSTYGGATVSITHLAPFVRSSYDRYYKKYKQRGLSEKQCKEYAEQDTKKEISDGVQTFNYQVNSMTNTNGQAPFLSVCMYLGETDEYKQELAMIIEEFLKQRIEGFKNEKGVYITPAFPKLLYVLEEDNIHKDSKYWYLTELAAKCTAKRLVPDYISEKKMKELKIDKNGNGNCYPCMGCRSFLTPYVDPETNKPKYYGRFNQGVVTINLVDVALSSKQDEEKFWKIFDERLELCHKALQIRHERLSKVTSDVAPILWQHGALARLKKGESIHKLLHDGYSTISLGYAGLYECVKYMTGNSHTDNGIGEEFALKVMQKLNDKCKEWKEAEKIDYSVYGTPIESTTYKFAKCLRKRFGTIEGITDRSYITNSYHVPVFEDIDAFSKLKLESKFQKLSPGGAISYVETPNLQNNLEVVLQIIHFIYDNIMYAELNTKSDYCQKCGFDGEILIDENLEWYCPNCGNRDHNTLNVARRTCGYIGSQFWNKGRTQEIKERVLHIDNKDDE

SEQ ID NO: 463 - protein, 707 aa, unidentified
  REGION 1..707: note = Description of Unknown:uncultivated organism sequence
  REGION 1..707: note = Category: MG55 effectors
  REGION 1..707: note = Description: MG55-36 effector
MQVIKRDGSVVEYDRTKIAIAIGKANAEVEKKERASKEEIETILAAVEEKKKKRMLVEDIQDIIEEKLMELGHYELAKTYIIYRYNRALVRKANTTDEAILSLISNSNKDVMEENSNKNALAAATQRDLIAGEVSKDLTRRILLPEKISKAHDEGILHFHDADYFIQPIFNCCLINIGDMLDNGTVMNGKLIESPKSFQVACTVVTQIIAAVACSQYGGQSVDIRHLGKYLRKSRVKFEKHFRETCPELAEEEVKKLVDDRIQDELKSGVQTIQYQINTLMTTNGQSPFVTLFLYLDKDDEYLEENAQIVMEILRQRYEGIKNEKGVYVTPAFPKLVYVLDEINCLKGGKYDYITEFAVKCSAKRLYPDYISAKKMRETYEGNVFSPMGCRSFLSPWKDENGNYKFEGRFNQGVVSINLPQIGIIAKGDEEKFWKLFDERLDLCREALMCRHRALLGTKSDVSPIHWQYGAIARLDKGEVIDKLLFNGYSTLSLGYIGLYEVTKLMTGVTQTDPKGEEFALRVMQHMRDKTDEWKMETGLGFALYGTPAESLCYRFARIDKEKFGTIEDVTDKGYYTNSYHVDVREHIDAFSKFSFEAQFQRISSGGCISYVEIPNMQNNLEAMQEIVRFIYDNIQYAEFNTKSDYCHVCGWDGEIIINDDNEWECPNCHNKDHRKMNVTRRTCGYLGENFWNLGKTKEIKARVLHL

SEQ ID NO: 464 - protein, 719 aa, unidentified
  REGION 1..719: note = Description of Unknown:uncultivated organism sequence
  REGION 1..719: note = Category: MG55 effectors
  REGION 1..719: note = Description: MG55-37 effector
MQVIKRDGKVVDFDQSKIKIAIEKANKEVKPRERASKDEINQIIGYVEDLDKKRILVEDIQDIIEEQLMSFGKYVLAKKYITYRYTRELVRKANTTDQSIKELIDGESDYWNNENSNKNAQVVTTQRDYLAGITSTDITRRFLLPEDVVKAHDEGIIHFHDADYFAQNALTNCELINLEDMLQNGTIMNGVMIEKPHRFLTAMTIATQIILGVTSSTYGGATVSLTHLAPFVRSSYDRYYKKYKQRGLSEKQCKEYAEQDTKKEVSDGVQTFNYQVNSMTNTNGQAPFLSVCMYLGETDEYKQELAMIIEEFLKQRIEGFKNEKGVYITPAFPKLLYVLEEDNIHKDSKYWYLTELAAKCTAKRLVPDYISEKKMKEYKIDKNGNGNCYPCMGCRSFLTPYVDPETNKPKYYGRFNQGVVTINLVDVALSSKQDEEKFWKIFNERLELCHKALQIRHERLSKVTSDVAPILWQHGALARLKKGESIHKLLHDGYSTISLGYAGLYECVKYMTGNSHTDNGIGEEFALRVMQKLNDKCKEWKEAEKIDYSVYGTPIESTTYKFAKCLKKRFGTIEGITDRSYITNSYHVPVFEDIDAFSKLKLESKFQKLSPGGAISYVETPNLQNNLEVVLQIIHFIYDNIMYAELNTKSDYCQKCGFDGEILIDENLEWYCPNCGNRDHNTLNVARRTCGYIGSQFWNKGRTQEIKERVLHIDNKDDE

SEQ ID NO: 465 - protein, 730 aa, unidentified
  REGION 1..730: note = Description of Unknown:uncultivated organism sequence
  REGION 1..730: note = Category: MG55 effectors
  REGION 1..730: note = Description: MG55-38 effector
MQVIKRDGRIVDFDRQKIAAAIGKANAEVKPRERASKEDIKGIIEYVEGLDKKRILVEDIQDIIEEKLMECEKYLLAKKYITYRYTRELVRKANTTDQSIKELIDGESDYWNNENSNKNARVVTTQRDYLAGITSTDITRRFLLPKDVVEAHDEGIIHFHDADYFAQNALTNCELINLDDMLQNGTIMNGVMIEKPHRFLTAMTIATQIILAVTSSTYGGATVSLTHLAPFVRSSYERYYKKYKERGLSEKQCKEYAEQDTKKEIADGVQTFNYQVNSMTNTNGQAPFLSVNMYLGETKEYKKELAMVIEEFLKQRIEGFKNEKGVYITPAFPKLLYVLEKDNITEDSPYWYLTELAAKCTAKRMVPDYISEKKMLELKIDKNGNGNCYPCMGCRSFLTPYVDPKTNKPKYYGRFNQGVVTINLVDVALSSDKDMDKFWKIFDERLELCHRALQVRHERLSKVTSDVAPILWQNGALARLKKGESIHPLLHGGYSTISLGYAGLYECVKYMTDHSHTDNGEGKDFGIKVMQKLNDKCKEWKAAEDIDYSVYGTPIESTTYKFAKCLKKRFGVIEGITDRDYITNSYHIPVFEEIDAFSKLSIESQFQQLSPGGAISYIETPNLQNNIESVLQIIKFIYDNIMYAELNTKSDYCQVCGFDGEILIDDNLEWYCPNCGNRNHDTLNVARRTCGYIGSQFWNKGRTQEIKERVLHIDNKDAEMPKKEKTKVAV

SEQ ID NO: 466 - protein, 719 aa, unidentified
  REGION 1..719: note = Description of Unknown:uncultivated organism sequence
  REGION 1..719: note = Category: MG55 effectors
  REGION 1..719: note = Description: MG55-39 effector
MQVVKRDGKLVDFDQSKIRVAIEKANREVKPRERATKEEINQIIDYVEDLDKKRILVEDIQDIIEEQLMSFGKYLLAKKYITYRYTRELVRKANTTDQSIKELIDGESDYWNNENSNKNARVVTTQRDYLAGITSTDITRRFLLPEDVVKAHDEGIIHFHDADYFAQNALTNCELINLEDMLQNGTIMNGVMIEKPHRFLTAMTIATQIILGVTSSTYGGATVSLTHLAPFVKSSYDRYYKKYKKRGLSEAQCKEYAEQDTKKEVSDGVQTFNYQVNSMTNTNGQAPFLSVCMYLGETDEYKKELAMIIEEFLKQRIEGFKNEKGVYITPAFPKLLYVLEEDNIHKDSKYWYLTELAAKCTAKRLVPDYISEKKMKEYKIDKNGNGNCYPCMGCRSFLTPYVDPETNKPKYYGRFNQGVVTINLVDVALSSKQDEEKFWKIFDERLELCHKALQIRHERLSKVTSDVAPILWQHGALARLEKGESIHKLLHDGYSTISLGYAGLYECVKYMTGHSHTDNGEGEEFAIKVMQKLNDKCKEWKEAEKIDYSVYGTPIESTTYKFAKCLKKRFGTVEGITDRNYITNSYHVPVFEDIDAFSKLKLESKFQKLSPGGAISYVETPNLQDNLEVVLQIINFIYDNIMYAELNTKSDYCQKCGFDGEILIDENLEWYCPNCGNRDHNTLNVARRTCGYIGSQFWNKGRTQEIKERVLHIDNKDDE

SEQ ID NO: 467 - protein, 724 aa, unidentified
  REGION 1..724: note = Description of Unknown:uncultivated organism sequence
  REGION 1..724: note = Category: MG55 effectors
  REGION 1..724: note = Description: MG55-40 effector
MKIIKRNGAEATFDISKIIMAITKANAAVEECDRMTPRQIQRIAESVELACQELGRSAAVEEIQDMVEKQIMAHGAFEVAKAYITYRYTRSLVRRANTTDDRILSLIECNNEEAKQENSNKNPIVNSTQRDYMAGEVSRDITSRLLLPKDIVEAHEEGIIHFHDADYYAQHMHNCDLVNLEDMLENGTVITGTLIERPHSFSTACNIATQIIAQVASNQYGGQSISLTHLAPFVQVSRERIRREVEAEMQAIDAHPGEEKLAELVENRVREEIRRGVQTIQYQVVTLLTTNGQAPFVTVFMYLGEAKNEQERHDLAMIIEETLRQRYQGVKNEKGVWVTPAFPKLIYVLEEDNIHEDSPYWYLTELAARCTAKRMVPDYISEKKMLELKVDKNGEGHCYTCMGCRSFLTPYVDENGKPKYYGRFNQGVVTINLPDVALSSGGNMEKFWKIFDERLELCHRALMCRHERLKGTLSDAAPILWQYGALARLKKGEPIDKLLYGGYSTISLGYAGLYECVKYMTGKSHTDPSATPFALEIMQHMNDACAKWKQMHNIDFSLYGTPLESTTYKFAKCLQKRFGIIPGVTDKGYITNSYHIHVTEHIDAFSKLAFESKFQALSPGGAISYVEVPNMQNNIPAVLEVMKFIYDNIMYAELNTKSDYCQVCGYDGEIEIVEHDGKLIWRCPNCGNTDQDKMNVARRTCGYIGTQFWNQGRTQEIKERVLHL

SEQ ID NO: 468 - protein, 712 aa, unidentified
  REGION 1..712: note = Description of Unknown:uncultivated organism sequence
  REGION 1..712: note = Category: MG55 effectors
  REGION 1..712: note = Description: MG55-41 effector
MISKVRKRDGRIKDFDSRRIIEALRKAFEELGYTSSYEYINVAGSVVSELSKLDSEICDVEAIQDIVVKVLQESHPEVAKKYEEYRLKRTEIREENSKLIKSVEGLLNFSNDEVMLENSNKQAQLISTTRDLMAGEVSKFIVRKMIPKDILELHDRGVIHIHDMDYGANDMFNCELVNLQDMLDNGTVINKKMIHSPHTLRTAMTIATQISAQVASYQYGGQTMTLSHLAPYVRKSESVIRREIESDYPELSKERKDKIVERRLRKEIKDSVQLFNYQISTIQSTNGQAPFISLAIYLSERPGYEREVAMLAEEFFNQRIEGIENENGVKATQTFPKLLYFLDENNTYEGSEYFWLTQLAVKSTSLRMNPDYISAKKMKENVGHVFSCMGCRAFLSPFQDKDGNWIFYGRGNLGVCTINLPHVALSAKGDINKFWEILDERLEACRWVGEWRYNKMKGVKAKEAPILWQHGAISRLNPEDDVIKAIDERGFTVTLGYSGIYETVKVLIGKSHTTDNGFDLAEKIMIHLRDKCTEWKTEKPWLRFALYGTPQESTTETFSKALIRDFGEIEGICGKGKLWVTNSYHVDIQEEINAFDKLAIEGELQKYSTGGAVSYVETYNMSKNQEALLQVVQYMYETIMYAEINFESDVCGECGYSGVMDNDPKTLEWVCPNCGNRNQDTLSVVRRTCGYLAETKWTPGRLLDILNRVKHL

SEQ ID NO: 469 - protein, 724 aa, unidentified
  REGION 1..724: note = Description of Unknown:uncultivated organism sequence
  REGION 1..724: note = Category: MG55 effectors
  REGION 1..724: note = Description: MG55-42 effector
MKIIKRSGAENTFDKEKIENAVAKANITVEEKDRLSEGEIGEIAQNIEDKCSEMNRAMDVETIQDWVEADIMRHGKYTVAKHYITYRYERSIVRQANTTDKQILSLLNFENEEVKQENSNKNPTVNSVQRDYMAGEVSKDITRRFLLPDDIVEAHEKGLIHFHDADYFAQHMHNCCLVNLEDMLQNGTVISEVMIEKPHSFSTACNIATQSIAQIASSQYGGQSITLSHLAPFVQISRDKYRREVKKEFAELNIPADEDTINKVAEMRVKAEIVQGVQMIQYQVITLMTTNGQAPFVTVFMYLDEVPEGQTRDDLAAIIEEMLRQRIQGVKNEKGVYITPAFPKLIYVLEEDNIREGSKYWELTKLAAKCTAKRMVPDYISEKKMKELKVDKNGNGQCYPCMGCRSFLTTYLDENGKPKYYGRFNQGVVTINLVDVACSSYKDMDKFWKIFDERLELCRRALMLRHERLKGTPSDVAPILWQNGALARLKKGETIDKLLFGGYSTISLGYAGLCECVRYMTGKSHTDPSATPFALEVMQHLNDACAKWRAETNIDFSLYGTPLESTTYKFARCLQKRFGVIEGVTDRNYITNSYHIHVTENIDAFDKLTFESQFQALSPGGAISYVEVPNMQNNIEAVLAVMQHIYDNIMYAELNTKSDYCQKCGFDGEIKIVEDDGKLVWECPNCGNRDQNTLNVARRTCGYIGTQFWNQGRTQEIKERVLHL

SEQ ID NO: 470 - protein, 463 aa, unidentified
  REGION 1..463: note = Description of Unknown:uncultivated organism sequence
  REGION 1..463: note = Category: MG55 effectors
  REGION 1..463: note = Description: MG55-43 effector
MEQITLTRKIELFVNEEGNKKNECYDLLHYLNNNLYKIANDSVNYLHIKKNLPEFILKHNKEDYEKYVNNLNKMSEIKNFKSTEFIELKNQNRDIINKYSNNEEYKKMIYNDSKETTLVYHNINKRLPKGLSSISASLSKKIENDYKIKEKEYFLGKSTLNIYKRGLPIPFNISGKLVKDPSLFFKFDNGKYYINLFGYNFGLFFGPDRSNNKAIIEHIINDTDKYKLCDSAIQFKDKKIFLLLSFKQPLDNTIKLDDNKVLGVDLGVNAPVYLAINDNDYYKKQIGDIHHFDSHKLQYKKRYTSLIKNLEISNGGRGRKKKLSALDKLKKVEKNWTNTEQHKISNSVIKEALNNNCKYINIENLENYKENLTENKKYIMRIWGYYGIQEKIMYKAKKHNIVVRKINPAYTSQKCHKCGNIEKTARNKQIFTCLNEKCSIFGKEIHADFNGAKNISLSTEFKK

SEQ ID NO: 471 - protein, 1231 aa, unidentified
  REGION 1..1231: note = Description of Unknown:uncultivated organism sequence
  REGION 1..1231: note = Category: MG55 effectors
  REGION 1..1231: note = Description: MG55-44 effector
MSVFSKYRNFFPVKKSISLGAIPTPVTVSNMKKDRILENDIIREERASRMEDVYDEEYKKLIEKILSSMDNKKELKELISAYEKRKEDRNGYADAENDFVESISKALSESEEYKNLCNAEYFSKELPKKVSSEIADLISKLNFGSFETHRKTRTTLFGVKDGSVAKRIGHDNFLIYMDNCAKLENALSILGKETLEKYVAEMGDASDITEELIYGYAEKENYISLFSQKAIDDYNLLINGYTVGKRTKIKGINELINEHNQQEKEKEMKLAFLSKLQKLPLFDATSYSVIPESFSSDSELIESIDMLYNKDIGERKSLKSVIENAAKIFLGFSEVYDLSHIYINPKKNNAFSKNFLGKWNILERLFKEDFAKKNESPKLKGKKLDKLVEDAYKNKVFSFTDVEKIADMCDGFEEFSIEKAYIRDILDKALAVSNAYNEYKAYMEEREKMENAPAIKRDNRAAAVIRELCLAVKECERSLIYILHGEELIEVGAEGDAVFYEKFNSLAETIKDSDRLYNKIRNFVSQTKVSEDKTRLMFNNDEFLKGWSDSSKKGGAIIRDGKEYYLICIMKGFKGIENIQSDGNDLDLMEYNFTGDVSKCLGKNLMYTGMKNKSGAGSKYVYNENSKIVADYGLTEDVFNAYQNGIHTKGYADQGYTEEEHKDALRKIIRYFNKALPLAYSGFDAEGLRDDYETFNEYCNELNKRNFTLGFRKASRTKIDEYEKAGYIYKFRIWCRDFSEKAYGIKQNYALIFNALFNEKNEYYSKIRLCGSAKLIFVKASIKDEDKVVHKAGQPIRNKNPKSGKPTSTYSYDIIKDRRKLKDHYIIQLPYEINRQALGNPVNLNAVVLDDIRNGNLKSIVSIKTGQDNLLWVCVTDMEGNIKKQYPLNVIDNNDYREKISARQNEMKSGNKEWRPGADIKSLKEGYLTLAIRKIVDAVFENDAILLLESSNGNKKEKTFGVDTRLYDRLADMLQVKLHYCFSKRKPFLEEGGLLNAYQLCGALPTGDKKKKVFQNGIVFFTNTAYTKNTDPITGFVPPVIGEYLNLKSAISIISNIKEIGYEKGQYYLLIDKKMYKNNYEGKTDWKCYIAGERIVAIRDDSLARGRRYEKADIGKIFADFLKENGIDANKNIKEQILERDDKPFFASLLEILNNVFRMNNGHGDENFFVSPVKNDKGLFFDSRISKEIPCTDANAAYNMARKMVISIEKIKNEETKTIPTTAEYLERIQK

SEQ ID NO: 472 - protein, 724 aa, unidentified
  REGION 1..724: note = Description of Unknown:uncultivated organism sequence
  REGION 1..724: note = Category: MG55 effectors
  REGION 1..724: note = Description: MG55-45 effector
MKIIKRSGAENTFDREKIENAVAKANITVEEKDRLSEGEIEEIAQNIENKCSEMNRAMDVETIQDWVEADIMRHGKYTVAKHYITYRYERSIVRQANTTDKQILSLLNFENEEVKQENSNKNPTVNSVQRDYMAGEVSKDITRRFLLPDDIVEAHEKGMIHFHDADYFAQHMHNCCLVNLEDMLQNGTVISEVMIEKPHSFSTACNIATQSIAQIASSQYGGQSITLSHLAPFVQISRDKYRREVKKEFAELNIPADEDTINKVAEMRVKAEIVQGVQMIQYQVITLMTTNGQAPFVTVFMYLDEVPEGQTRDDLAAIIEEMLRQRIQGVKNEKGVYITPAFPKLIYVLEEDNIREGSKYWELTKLAAKCTAKRMVPDYISEKKMKELKVDENGNGQCYPCMGCRSFLTTYLDENGKPKYYGRFNQGVVTINLVDVACSSYKDMDKFWKIFDERLELCRRALMLRHERLKGTPSDVAPILWQNGALARLKKGETIDKLLYGGYSTISLGYAGLCECVRYMTGKSHTDPSATPFALKVMQHLNDACAKWRAETNIDFSLYGTPLESTTYKFARCLQKRFGIIEGVTDRNYITNSYHIHVTENIDAFDKLTFESQFQALSPGGAISYVEVPNMQNNIEAVLAVMQHIYENIMYAELNTKSDYCQKCGFDGEIKIAEDDGKLVWECPNCGNRDQNTMNVARRTCGYIGTQFWNQGRTQEIKERVLHL

SEQ ID NO: 473 - protein, 730 aa, unidentified
  REGION 1..730: note = Description of Unknown:uncultivated organism sequence
  REGION 1..730: note = Category: MG55 effectors
  REGION 1..730: note = Description: MG55-46 effector
MQVIKRDGRIIDFDRQKIVSAIGKANAEVKPKERASKDDIKSIIEYIEGLGKKRILVEDIQDIIEEKLMELDKYSLAKKYITYRYTRELVRKANTTDQSIKELIDGESEYWNNENSNKNAKVVTTQRDYLAGITSTDITRRFLLPKDIVEAHDEGIIHFHDADYFAQNALTNCELINLEDMLQNGTIMNGVMIEKPHRFLTAMTIATQIILAVTSSTYGGATVSLAHLAPFVRSSYDRYYKKYKDRGLKEEQCKEFAMQDTKKEVADGVQTFNYQVNSMTNTNGQAPFLSVCMYLGETKEYKKELAMVIEEFLKQRIEGFKNEKGVYITPAFPKLLYVLEKDNVTEDSKYWYLTELAAKCTAKRMVPDYISEKKMLELKIDKNGNGNCYPCMGCRSFLTPYVDPKTNKPKYYGRFNQGVVTINLVDVALSSDKDMDKFWKIFDERLELCHRALQVRHERLSKVTSDVAPILWQHGALARLKKGESIHPLLHGGYSTISLGYAGLYECVKYMTEHSHTDNGEGKDFGIQVMQRLNDKCKEWKAAEDIDYSVYGTPIESTTYKFAKCLKKRFGVIKGITDRDYITNSYHIPVFEEIDAFSKLSIESQFQQLSPGGAISYVETPNLQNNIEAVIQIIKFIYDNIMYAELNTKSDYCQECGFDGEILIDDNLEWYCPNCGNRNHDTLNVARRTCGYIGSQFWNKGRTQEIKERVLHIDNKDAEMPKKEKTKVAV

SEQ ID NO: 474 - protein, 724 aa, unidentified
  REGION 1..724: note = Description of Unknown:uncultivated organism sequence
  REGION 1..724: note = Category: MG55 effectors
  REGION 1..724: note = Description: MG55-47 effector
MKIIKRSGAENTFDKEKIENAVAKANITVEEKDRLSEGEIGEIAQNIEDKCSEMNRAMDVETIQDWVEADIMRHGKYTVAKHYITYRYERSIVRQANTTDKQILSLLNFENEEVKQENSNKNPTVNSVQRDYMAGEVSKDITRRFLLPDDIVEAHEKGLIHFHDADYFAQHMHNCCLVNLEDMLQNGTVISEVMIEKPHSFSTACNIATQSIAQIASSQYGGQSITLSHLAPFVQISRDKYRREVKKEFAELNIPTDEDTINKVAEMRVKAEIVQGVQMIQYQVITLMTTNGQAPFVTVFMYLDEVPEGQTRDDLAAIIEEMLRQRIQGVKNEKGVYITPAFPKLIYVLEEDNIREGSKYWELTKLAAKCTAKRMVPDYISEKKMKELKVDKNGNGQCYPCMGCRSFLTTYLDENGKPKYYGRFNQGVVTINLVDVACSSYKDMDKFWKIFDERLELCRRALMLRHERLKGTPSDVAPILWQNGALARLKKGETIDKLLFGGYSTISLGYAGLCECVRYMTGKSHTDPSATPFALEVMQHLNDACAKWRAETNIDFSLYGTPLESTTYKFARCLQKRFGVIEGVTDRNYITNSYHIHVTENIDAFDKLTFESQFQALSPGGAISYVEVPNMQNNIEAVLAVMQHIYDNIMYAELNTKSDYCQKCGFDGEIKIVEDDGKLVWECPNCGNRDQNTLNVARRTCGYIGTQFWNQGRTQEIKERVLHL

SEQ ID NO: 475 - protein, 724 aa, unidentified
  REGION 1..724: note = Description of Unknown:uncultivated organism sequence
  REGION 1..724: note = Category: MG55 effectors
  REGION 1..724: note = Description: MG55-48 effector
MKIIKRNGAEENFDISKIIMAVTKANAAVEECDRMTPRQIQRIAESVELACQELGRSAAVEEIQDMVEKQIMAHGAFEVAKAYITYRYTRSLVRRANTTDDRILSLIECNNEEAKQENSNKNPIVNSTQRDYMAGEVSRDITSRLLLPKDIVEAHEEGIIHFHDADYYAQHMHNCDLVNLEDMLENGTVITGTLIERPHSFSTACNIATQIIAQVASNQYGGQSISLTHLAPFVQVSRERIRREVEAEMQAIDAHPGEEKLAELVENRVREEIRRGVQTIQYQVVTLLTTNGQAPFVTVFMYLGEAKNEQERHDLAMIIEETLRQRYQGVKNEKGVWVTPAFPKLIYVLEEDNIHEDSPYWYLTELAARCTAKRMVPDYISEKKMLELKVDKNGEGHCYTCMGCRSFLTPYVDENGKPKYYGRFNQGVVTINLPDVALSSGGNMEKFWKIFDERLELCHRALMCRHERLKGTLSDAAPILWQYGALARLKKGEPIDKLLYGGYSTISLGYAGLYECVKYMTGKSHTDPSATPFALEIMQHMNDACAKWKQMHNIDFSLYGTPLESTTYKFAKCLQKRFGIIPGVTDKGYITNSYHIHVTEKIDAFSKLAFESKFQALSPGGAISYVEVPNMQNNIPAVLEVMKFIYDNIMYAELNTKSDYCQVCGYDGEIEIVEHDGKLIWRCPNCGNTDQDKMNVARRTCGYIGTQFWNQGRTQEIKERVLHL

SEQ ID NO: 476 - protein, 712 aa, unidentified
  REGION 1..712: note = Description of Unknown:uncultivated organism sequence
  REGION 1..712: note = Category: MG55 effectors
  REGION 1..712: note = Description: MG55-49 effector
MISKVRKRDGRIKDFDSRRIIEALRKAFEELGYTSSYEYINVAGSVVSELSKLDSEICDVEAIQDIVVKVLQESHPEVAKKYEEYRLKRTEIREENSKLIKSVEGLLNFSNDEVMLENSNKQAQLISTTRDLMAGEVSKFIVRKMIPKDILELHDRGVIHIHDMDYGANDMFNCELVNLQDMLDNGTVINKKMIHSPHTLRTAMTIATQISAQVASYQYGGQTMTLSHLAPYVRKSESVIRREIESDYPELSKERKDKIVERRLKKEIKDSVQLFNYQISTIQSTNGQAPFISLAIYLSERPGYEREVAMLAEEFFNQRIEGIENENGVKATQTFPKLLYFLDENNTYEGSEYFWLTQLAVKSTSLRMNPDYISAKKMKENVGHVFSCMGCRAFLSPFQDKDGNWIFYGRGNLGVCTINLPHVALSAKGDINKFWEILDERLEACRWVGEWRYNKMKGVKAKEAPILWQHGAISRLNPEDDVIKAIDERGFTVTLGYSGIYETVKVLIGKSHTTDNGFDLAEKIMIHLRDKCTEWKTEKPWLRFALYGTPQESTTETFSKALIRDFGEIEGICGKGKLWVTNSYHVDIQEEINAFDKLAIEGELQKYSTGGAVSYVETYNMSKNQEALLQVVQYMYETIMYAEINFESDVCGECGYSGVMDNDPKTLEWVCPNCGNRNQDTLSVVRRTCGYLAETKWTPGRLLDILNRVKHL

SEQ ID NO: 477 - protein, 724 aa, unidentified
  REGION 1..724: note = Description of Unknown:uncultivated organism sequence
  REGION 1..724: note = Category: MG55 effectors
  REGION 1..724: note = Description: MG55-50 effector
MKIIKRNGAEATFDISKIIMAITKANAAVEEGDRMTPRQIQRIAESVELACQELGRSAAVEEIQDMVEKQIMAHGAFEVAKAYITYRYTRSLVRRANTTDDRILSLIECNNEEAKQENSNKNPIVNSTQRDYMAGEVSRDITSRLLLPKDIVEAHEEGIIHFHDADYYAQHMHNCDLVNLEDMLENGTVITGTLIERPHSFSTACNIATQIIAQVASNQYGGQSISLTHLAPFVQVSRERIRREVAAEMQAINADPGEEKLAELVENRVREEIRRGVQTIQYQVVTLLTTNGQAPFVTVFMYLGEAKNEQERHDLAMIIEETLRQRYQGVKNEKGVWVTPAFPKLIYVLEEDNIHEDAPYWYLTELAARCTAKRMVPDYISEKKMLELKVDKNGEGHCYTCMGCRSFLTPYVDENGKPKYYGRFNQGVVTINLPDVALSSGGNMEKFWKIFDERLELCHRALMCRHERLKGTLSDAAPILWQYGALARLKKGEPIDKLLYGGYSTISLGYAGLYECVKYMTGKSHTDPSATPFALEVMQHMNDACKHWKQMHNIDFSLYGTPLESTTYKFAKCLQKRFGIIPGVTDKGYITNSYHIHVTENIDAFSKLAFESKFQALSPGGAISYVEVPNMQNNIPAVLEVMKFIYDNIMYAELNTKSDYCQVCGYDGEIEIVERDGKLIWRCPNCGNTDQDKMNVARRTCGYIGTQFWNQGRTQEIKERVLHL

SEQ ID NO: 478 - protein, 463 aa, unidentified
  REGION 1..463: note = Description of Unknown:uncultivated organism sequence
  REGION 1..463: note = Category: MG55 effectors
  REGION 1..463: note = Description: MG55-51 effector
MARRIKNVASNNYTLGIDIGSTTAKLALMCDGKIVYSKYQRHRSRIISTTLDMLREMKEIYPVDKVRVTISGSAGMGMAEKAGIDFIQEVYATGEVVYKLAPDTGVVIELGGEDAKVIFFKGGVDERMNGSCAGGTGAFIDQMAVLLNMSVDDMDKASLEAKRIYPIASRCGVFAKTDIQPLLNQGASKSDIAASIFQAVVNQTITGLIQGRKIEGKVMFLGGPLYYCEGLKKRFYETLSLTEETAVFPEYALYAVAMGASMYAQNSEEISFEELEKRIENSAKCESRGLDTLPPLFASKEEYDYFVQRHNKATVPQKDINTYIGNAWLGIDCGSTTTKLVLISDDRSILYSFYSSNKGNPVKLVKEQLEIIYSLCQNRIKICGSSVTGYGEELIRHAFRTDEGVVETIAHYTAAKYFRPDVDFILDIGGQDIKCFKIRNGAIDSIIFRVRFFCRDIRKGNGI

SEQ ID NO: 479 - protein, 420 aa, unidentified
  REGION 1..420: note = Description of Unknown:uncultivated organism sequence
  REGION 1..420: note = Category: MG55 effectors
  REGION 1..420: note = Description: MG55-52 effector
MVTSSMKIKIIPVDVISKNWIFDIFNVSYKILNRAYDISRMLHQYPVIMSPVTPPKSQVYNLTTQEFPKVITTYLRDWVYQAENNYKSDVKAGLLSGKRSPRLYKKYGATRFQFLKNSNPKLIKENGDFFILINSRTNIKFKIIFDKKTGHLKTMLNRFLDLENKKYNLNSTFLIKYTNRKELMLILSYEQDIQGYVGIDNRVMGIDMGVRRFISLRINDIPSYQKSIHSEKLVQQKYGIAMKNKRVQESSVLAKSGHGRTRKMQVYNKVKDSETSFTDNVLDKLSKEVIESAAKLKVQQINMERLDKNSMKEQNSYLGRYWGVMTLMNLIEQKAIKRGIIIKYIDPYHTSQICSCCGSIGERNGAEFKCLSSKCDDFNKVIDSDYNAAMNIATSVDYLDDASKGKYYLNKTEKVLEEVL

SEQ ID NO: 480 - protein, 724 aa, unidentified
  REGION 1..724: note = Description of Unknown:uncultivated organism sequence
  REGION 1..724: note = Category: MG55 effectors
  REGION 1..724: note = Description: MG55-53 effector
MKIIKRNGAEVGFDITKIIIAITKANEAVEEADRMTPMQIQRIAESVELQCQKMNRAPTVEEIQDMVEHYIMAHGAFEVAKHYITYRYTRSLVRKSNTTDDKILSLIECNNEEAKQENSNKNPVVNSTQRDYMAGEVSRDLSERILLPQDIVEAHREGIIHFHDSDYYAQHMHNCDLVNLEDMLQNGTVITGTLIEKPHSFATACNIATQIVAQVASNQYGGQSISLTHLAPFVQVSRDKIRASVRSEFDAVGVAVTEDDINAIAEKRLREEIRRGVQTIQYQVVTLLTTNGQAPFVTVFMYLGEAKNQQEKDDLALIIEETLLQRYQGVKNEKGVWVTPAFPKLIYVLEEDNVHEDSKYWYLTKLAAKCTAKRMVPDYISEKKMLELKVDKNGNGHCYPCMGCRSFLTPYVDENGQPKYYGRFNQGVVTVNLPDIALSSGGNIEKFWRIFDERMELCHRALLCRHERLKGTLSDAAPILWQYGACARLKKGEPIDKLLYGGYSTISLGYAGLYECVKYMTGKSHTDPAATPFALEIMNALNAACKKWKAQHNIDFSLYGTPLESTTYKFAKCLQKRFGVIKGITDKGYITNSYHVHVTEPIDAFKKLEFEAQFQHLSPGGAISYVEVPDMQNNLDAVLEVMKFIYDHIIYAELNTKSDYCQVCGWDGEIEVVEEDGKLIWKCPQCGNTDQDKMNVARRTCGYIGTQFWNQGRTQEIKDRVLHL

SEQ ID NO: 481 - protein, 719 aa, unidentified
  REGION 1..719: note = Description of Unknown:uncultivated organism sequence
  REGION 1..719: note = Category: MG55 effectors
  REGION 1..719: note = Description: MG55-54 effector
MQVVKRDGKLVDFDQSKIRVAIEKANREVRPRERATKEEINQIIDYVEDLDKKRILVEDIQDIIEEQLMSFGKYLLAKKYITYRYTRELVRKANTTDQSIKELIDGESDYWNNENSNKNARVVTTQRDYLAGITSTDITRRFLLPEDVVKAHDEGIIHFHDADYFAQNALTNCELINLEDMLQNGTIMNGVMIEKPHRFLTAMTIATQIILGVTSSTYGGATVSLTHLAPFVKSSYDRYYKKYKKRGLSEAQCKEYAEQDTKKEVSDGVQTFNYQVNSMTNTNGQAPFLSVCMYLGETDEYKKELAMIIEEFLKQRIEGFKNEKGVYITPAFPKLLYVLEEDNIHKDSKYWYLTELAAKCTAKRLVPDYISEKKMKEYKIDKNGNGNCYPCMGCRSFLTPYVDPETNKPKYYGRFNQGVVTINLVDVALSSKQDEEKFWKIFDERLELCHKALQIRHERLSKVTSDVAPILWQHGALARLEKGESIHKLLHDGYSTISLGYAGLYECVKYMTGHSHTDNGEGEEFAIKVMQKLNDKCKEWKEAEKIDYSVYGTPIESTTYKFAKCLKKRFGTVEGITDRNYITNSYHVPVFEDIDAFSKLKLESKFQKLSPGGAISYVETPNLQDNLEVVLQIINFIYDNIMYAELNTKSDYCQKCGFDGEILIDENLEWYCPNCGNRDHNTLNVARRTCGYIGSQFWNKGRTQEIKERVLHIDNKDDE

SEQ ID NO: 482 - protein, 724 aa, unidentified
  REGION 1..724: note = Description of Unknown:uncultivated organism sequence
  REGION 1..724: note = Category: MG55 effectors
  REGION 1..724: note = Description: MG55-55 effector
MKIIKRSGAENTFDKEKIENAVAKANITVEEKDRLSEGEIGEIAQNIEDKCSEMNRAMDVETIQDWVEADIMRHGKYTVAKHYITYRYERSIVRQANTTDKQILSLLNFENEEVKQENSNKNPTVNSVQRDYMAGEVSKDITRRFLLPDDIVEAHEKGLIHFHDADYFAQHMHNCCLVNLEDMLQNGTVISEVMIEKPHSFSTACNIATQSIAQIASSQYGGQSITLSHLAPFVQISRDKYRREVKKEFAELNIPADEDTINKVAEMRVKAEIVQGVQMIQYQVITLMTTNGQAPFVTVFMYLDEVPEGQTRDDLAAIIEEMLRQRIQGVKNEKGVYITPAFPKLIYVLEEDNIREGSKYWELTKLAAKCTAKRMVPDYISEKKMKELKVDKNGNGQCYPCMGCRSFLTTYLDENGKPKYYGRFNQGVVTINLVDVACSSYKDMDKFWKIFDERLELCRRALMLRHERLKGTPSDVAPILWQNGALARLKKGETIDKLLFGGYSTISLGYAGLCECVRYMTGKSHTDPSATPFALEVMQHLNDACTKWRAETNIDFSLYGTPLESTTYKFARCLQKRFGVIEGVTDRNYITNSYHIHVTEDIDAFDKLTFESQFQALSPGGAISYVEVPNMQNNIEAVLAVMQHIYDNIMYAELNTKSDYCQKCGFDGEIKIVEDDGKLVWECPNCGNRDQNTLNVARRTCGYIGTQFWNQGRTQEIKERVLHL

SEQ ID NO: 483 - protein, 711 aa, unidentified
  REGION 1..711: note = Description of Unknown:uncultivated organism sequence
  REGION 1..711: note = Category: MG55 effectors
  REGION 1..711: note = Description: MG55-56 effector
MGIIVEKRDGVSRVAFDSNRIRNAVMKANEQVGEEDRASEAEIDLIVDEVIEKFGGLGYASVEEIQDVVEENLLSMKRKVGIKYHDFRRARAKTRNAAKESILQLVGGANKDVMEENSNKKATVASTQRDLIAGEVSKDITMSDILPTKIAKAHKEGVIHFHDMDYFIQPMFNCCLVNIKDMLDNGTVMNGKMIESPKSFQVACTVTTQIIASVASNQYGGQSVNVKHLAKYIRVSEKKYRKRFEALGMTGETLENLVEAELKAEISAGIQTMQYQINTLMTTNGQTPFVTLFLELEEGSEYEVEQAKLIEEILKQRLEGIKNNKGVYVTPAFPKLIYVLDEHNCLKGGKYDYLTKLAVKCSAKRMYPDYISAKKMRENHEGEVFSCMGCRSFLSEWKDEDGNYKWEGRFNQGVVSINLPQIAILSQTEEGADELRFWQLLDERLAICFEALMLRHKRLLGTKSDVSPIHWQDGAIARLKPGEVIDPLLKDGYSTISLGYIGIYETTKLMTGESNTTEKGRAFALKVMKYLRDTCDRWKSVTGLGFGLYGTPAESLCYRFARIDKKRFGEIKDVTDKGYYTNSYHVDVREPIDAFAKLQYEAEFQKISSGGAISYIEIPNMSKNLDALEAVVSYIYDNIQYAEVNTKSDYCQECGYDGEIIINDDNEWECPCCGNKNHETMNVVRRTCGYLGENFWNVGKTKEIKARVTHL

SEQ ID NO: 484 - protein, 724 aa, unidentified
  REGION 1..724: note = Description of Unknown:uncultivated organism sequence
  REGION 1..724: note = Category: MG55 effectors
  REGION 1..724: note = Description: MG55-57 effector
MKVIKRNGTEVVFDISKILVAVGKANNNVKEEHRMTPMQIQRIAESVELNCIELGRSPSVEEIQDMVEHQIMAHGAFEVAKEYITYRYTRSLVRRSNTTDDKILSLIECSNEEAKQENSNKNPIVNSTQRDYMAGEVSRDITNRLLLPKDIVQAHEEGIIHFHDADYYAQHMHNCDLVNLEDMLQNGTVITGTLIERPHSFSTACNIATQIIAQVASNQYGGQSISLAHLAPFVQVSREKIRRIVRTEMEKIHATPSEEEFNDLVESRLRDEVARGVQTIQYQVLTLLTTNGQAPFVTVFMYLNEARNEQEKKDLALIIEETLKQRYQGVKNEAGVWITPAFPKLIYVLEEDNIHDDSPYYYLTKLAAKCTAKRMVPDYISEKMMFQLKIDKNGEGHCYPCMGCRSFLTPYVDENGKPKYYGRFNQGVVTINLPDVALSSGGDIEKFWQIFDERLELCHRALMERHNRLKGTPSDVAPILWQYGACARLKKGEPIDKLLYGGYSTISLGYAGLYECVKYMTGKSHTDPAATPFALQIMNTMNAACKKWKEMHNIDFSLYGTPLESTTYKFAKCLQKRFGVIPGITDKGYITNSYHVHVTEKINAFDKLAFEAQFQHLSPGGAISYVEVPDMQNNLDAVLEVMKFIYDHIIYAELNTKSDYCQVCGWDGEIKIEEEDGKLIWKCPNCGNTDQNKMNVARRTCGYIGTQFWNQGRTQEIRDRVLHL

SEQ ID NO: 485 - protein, 719 aa, unidentified
  REGION 1..719: note = Description of Unknown:uncultivated organism sequence
  REGION 1..719: note = Category: MG55 effectors
  REGION 1..719: note = Description: MG55-58 effector
MQVVKRDGKLVDFDQSKIRVAIEKANREVRPRERATKEEINQIIDYVEDLDKKRILVEDIQDIIEEQLMSFGKYLLAKKYITYRYTRELVRKANTTDQSIKELIDGESDYWNNENSNKNARVVTTQRDYLAGITSTDITRRFLLPEDVVKAHDEGIIHFHDADYFAQNALTNCELINLEDMLQNGTIMNGVMIEKPHRFLTAMTIATQIILGVTSSTYGGATVSLTHLAPFVKSSYDRYYKKYKKRGLSEAQCKEYAEQDTKKEVSDGVQTFNYQVNSMTNTNGQAPFLSVCMYLGETDEYKKELAMIIEEFLKQRIEGFKNEKGVYITPAFPKLLYVLEEDNIHKDSKYWYLTELAAKCTAKRLVPDYISEKKMKELKIDKNGNGNCYPCMGCRSFLTPYVDPETNKPKYYGRFNQGVVTINLVDVALSSKQDEEKFWKIFDERLELCHKALQIRHERLSKVTSDVAPILWQHGALARLKKGESIHKLLHDGYSTISLGYAGLYECVKYMTGHSHTDNGEGEEFAIKVMQKLNDKCKEWKEAEKIDYSVYGTPIESTTYKFAKCLKKRFGTIEGITDRSYITNSYHVPVFEDIDAFSKLKLESKFQKLSPGGAISYVETPNLQDNLEVVLQIINFIYDNIMYAELNTKSDYCQKCGFDGEILIDENLEWYCPNCGNRDHNTLNVARRTCGYIGSQFWNKGRTQEIKERVLHIDNKDDE

SEQ ID NO: 486 - protein, 724 aa, unidentified
  REGION 1..724: note = Description of Unknown:uncultivated organism sequence
  REGION 1..724: note = Category: MG55 effectors
  REGION 1..724: note = Description: MG55-59 effector
MKVIKRNGTEVVFDISKILIAVGKANNNVKEEHRMTPMQIQRIAESVELNCIELGRSPSVEEIQDMVEHQIMAHGAFEVAKEYITYRYTRSLVRRSNTTDDKILSLIECSNEEAKQENSNKNPIVNSTQRDYMAGEGSRDITNRLLLPKDIVQAHEEGIIHFHDADYYAQHMHNCDLVNLEDMLQNGTVITGTLIERPHSFSTACNIATQIIAQVASNQYGGQSISLAHLAPFVQVSREKIRRIVRTEMEKIHATPSEEEFNDLVESRLRDEVARGVQTIQYQVLTLLTTNGQAPFVTVFMYLNEARNEQEKKDLALIIEETLKQRYQGVKNEAGVWITPAFPKLIYVLEEDNIHDDSPYYYLTKLAAKCTAKRMVPDYISEKMMFQLKIDKNGEGHCYPCMGCRSFLTPYVDENGKPKYYGRFNQGVVTINLPDVALSSGGDIEKFWQIFDERLELCHRALMERHNRLKGTPSDVAPILWQYGACARLKKGEPIDKLLYGGYSTISLGYAGLYECVKYMTGKSHTDPAATPFALQIMNTMNAACKKWKEMHNIDFSLYGTPLESTTYKFAKCLQKRFGVIPGITDKGYITNSYHVHVTEKINAFDKLAFEAQFQHLSPGGAISYVEVPDMQNNLDAVLEVMKFIYDHIIYAELNTKSDYCQVCGWDGEIKIEEEDGKLIWKCPNCGNTDQNKMNVARRTCGYIGTQFWNQGRTQEIRDRVLHL

SEQ ID NO: 487 - protein, 712 aa, unidentified
  REGION 1..712: note = Description of Unknown:uncultivated organism sequence
  REGION 1..712: note = Category: MG55 effectors
  REGION 1..712: note = Description: MG55-60 effector
MISKVRKRDGRIKDFDSRRIIEALRKAFEELGYTSSYEYINVAGSVVSELSKLDSEICDVEAIQDIVVKVLQESHPEVAKKYEEYRLKRTEIREENSKLIKSVEGLLNFSNDEVMLENSNKQAQLISTTRDLMAGEVSKFIVRKMIPKDILELHDRGVIHIHDMDYGANDMFNCELVNLQDMLDNGTVINKKMIHSPHTLRTAMTIATQISAQVASYQYGGQTMTLSHLAPYVRKSESVIRREIESDYPELSKERKDKIVERRLRKEIKDSVQLFNYQISTIQSTNGQAPFISLAIYLSERPGYEREVAMLAEEFFNQRIEGIENENGVKATQTFPKLLYFLDENNTYEGSEYFWLTQLAVKSTSLRMNPDYISAKKMKENVGHVFSCMGCRAFLSPFQDKDGNWIFYGRGNLGVCTINLPHVALSAKGDINKFWEILDERLEACRWVGEWRYNKMKGVKAKEAPILWQHGAISRLNPEDDVIKAIDERGFTVTLGYSGIYETVKVLTGKSHTTDNGFDLAEKIMIHLRDKCTEWKTEKPWLRFALYGTPQESTTETFSKALIRDFGEIEGICGKGKLWVTNSYHVDIQEEINAFDKLAIEGELQKYSTGGAVSYVETYNMSKNQEALLQVVQYMYETIMYAEINFESDVCGECGYSGVMDNDPKTLEWVCPNCGNRNQDTLSVVRRTCGYLAETKWTPGRLLDILNRVKHL

SEQ ID NO: 488 - protein, 722 aa, unidentified
  REGION 1..722: note = Description of Unknown:uncultivated organism sequence
  REGION 1..722: note = Category: MG55 effectors
  REGION 1..722: note = Description: MG55-61 effector
MEVIKRDGSKVAFDGSKIENAILKAMRYGSGIVKPEIASKISHEIEDWHKSSGAASISIYRIEGQVFEKLIEKGEVLTAKAYEGYRKVREFQRETNTIDNAIYGIVNQTNKEAMDENSNKDATVLATQRDLIAGEFSRDYCRRLLLPPKIVQAHDDGIIHFHDMDYYIQKMHNCDLVNLKDMFANGTVINDKLIETPKSLQTACTVATQIVQQVANGQYGGQTISISHLAPYVRVSYKKHLKAVRKEGKEVGIDYTEEQIEKIAKSRLHEEIKAGVQTIQYQINTFSTTNGQAPFLSIFMYLREEPDYIEETALLIEEILKQRYIGMKNPVGAYVTPAFPKLLYVLDDNNVPDDSQYRYLTDLAVKCVSKRMMPDFISAKIMRENYEGQVFPCMGCRSFLSPWKNEKGEYQWYGRFNQGVVTLNLTDVGLSANKNMDSFWKILDERLDLCYEALMLRHESLKGTPSDISPIHWQYGAIARLKPGEKIDSLLDTCYSTLSLGYIGLYECVVALIGQSHTTEEGDALALEIMQKLRNTCDKWKKDTGLGFALYGTPAESTTYTLARALKKRFGIVPGVTDKDYITNSYHVNVREHIDAFSKLGFEAKFQKISSGGAISYVEVTNMTNNFDAMKELINYMYETIQYAEINTKSDYCQECGFSGEILLDENNEWYCPNCGNRNHKTLNVCRRTCGYLGDNFWNKGRTQEIKERFVHLDNRVYQENN

SEQ ID NO: 489 - protein, 724 aa, unidentified
  REGION 1..724: note = Description of Unknown:uncultivated organism sequence
  REGION 1..724: note = Category: MG55 effectors
  REGION 1..724: note = Description: MG55-62 effector
MKIIKRNGAEENFDISKIIMAVTKANAAVEECDRMTPRQIQRIAESVELACQELGRSAAVEEIQDMVEKQIMAHGAFEVAKAYITYRYTRSLVRRANTTDDRILSLIECNNEEAKQENSNKNPIVNSTQRDYMAGEVSRDITSRLLLPKDIVEAHEEGIIHFHDADYYAQHMHNCDLVNLEDMLENGTVITGTLIERPHSFSTACNIATQIIAQVASNQYGGQSISLTHLAPFVQVSRERIRREVEAEMQAIDAHPGEEKLAELVENRVREEIRRGVQTIQYQVVTLLTTNGQAPFVTVFMYLGEAKNEQERHDLAMIIEETLRQRYQGVKNEKGVWVTPAFPKLIYVLEEDNIHEDSPYWYLTELAARCTAKRMVPDYISEKKMLELKVDKNGDGHCYTCMGCRSFLTPYVDENGKPKYYGRFNQGVVTINLPDVALSSGGNMEKFWKIFDERLELCHRALMCRHERLKGTLSDAAPILWQYGALARLKKGEPIDKLLYGGYSTISLGYAGLYECVKYMTGKSHTDPSATPFALEIMQHMNDACAKWKQMHNIDFSLYGTPLESTTYKFAKCLQKRFGIIPGVTDKGYITNSYHIHVTEHIDAFSKLAFESKFQALSPGGAISYVEVPNMQNNIPAVLEVMKFIYDNIMYAELNTKSDYCQVCGYDGEIEIVEHDGKLIWRCPNCGNTDQDKMNVARRTCGYIGTQFWNQGRTQEIKERVLHL

SEQ ID NO: 490 - protein, 724 aa, unidentified
  REGION 1..724: note = Description of Unknown:uncultivated organism sequence
  REGION 1..724: note = Category: MG55 effectors
  REGION 1..724: note = Description: MG55-63 effector
MKIIKRNGAEATFDISKIIMAITKANAAVEEGDRMTPRQIQRIAESVELACQELGRSAAVEEIQDMVEKQIMAHGAFEVAKAYITYRYTRSLVRRANTTDDRILSLIECNNEEAKQENSNKNPIVNSTQRDYMAGEVSRDITSRLLLPKDIVEAHEEGIIHFHDADYYAQHMHNCDLVNLEDMLENGTVITGTLIERPHSFSTACNIATQIIAQVASNQYGGQSISLTHLAPFVQVSRERIRREVAAEMQAINADPGEEKLAELVENRVREEIRRGVQTIQYQVVTLLTTNGQAPFVTVFMYLGEAKNEQERHDLAMIIEETLRQRYQGVKNEKGVWVTPAFPKLIYVLEEDNIHEDAPYWYLTELAARCTAKRMVPDYISEKKMLELKVDKNGEGHCYTCMGCRSFLTPYVDENGKPKYYGRFNQGVVTINLPDVALSSGGNMEKFWKIFDERLELCHRALMCRHERLKGTLSDAAPILWQYGALARLKKGEPIDKLLYGGYSTISLGYAGLYECVKYMTGKSHTDPSATPFALEIMQHMNDACKHWKQMHNIDFSLYGTPLESTTYKFAKCLQKRFGIIPGVTDKGYITNSYHIHVTENIDAFSKLAFESKFQALSPGGAISYVEVPNMQNNIPAVLEVMKFIYDNIMYAELNTKSDYCQVCGYDGEIEIVERDGKLIWRCPNCGNTDQDKMNVARRTCGYIGTQFWNQGRTQEIKERVLHL

SEQ ID NO: 491 - protein, 341 aa, unidentified
  REGION 1..341: note = Description of Unknown:uncultivated organism sequence
  REGION 1..341: note = Category: MG55 effectors
  REGION 1..341: note = Description: MG55-64 effector
MAATMKDIARRTGLGLATISSYFNGGNVREKNRVKIEEAIQELHYEVNEVARGLKTNATKTIGVVIPELNNTFCAEIITGMEDVLRSHGYATIVCDCRTDKKLERDAVEFLSRKRVDGIISMPVDAEGNHLKKFQKTGKPIVLIDRRIRELFCDSVLVDNEKAAEDAMRVFFQAGHRKIGIIGGPEEISTAQERLQGYRNAYEKENIPVRESLIYHGDYTIQGGVQGIEKLVADNPDMTAVFVTNYEMTMGAVIGMNELGLKIPEQLSMIGFDNLQFARACNPKLTIVAQPTQGIAGEVAGIMLKRLEGAASEETEPITEKLGAEIIMGKSVRVLDEKEKL

SEQ ID NO: 492 - protein, 724 aa, unidentified
  REGION 1..724: note = Description of Unknown:uncultivated organism sequence
  REGION 1..724: note = Category: MG55 effectors
  REGION 1..724: note = Description: MG55-65 effector
MKIIKRNGAEVGFDITKIIIAITKANEAVEEADRMTPMQIQRIAESVELQCQKMNRAPTVEEIQDMVEHYIMAHGAFEVAKHYITYRYTRSLVRKSNTTDDKILSLIECNNEEAKQENSNKNPVVNSTQRDYMAGEVSRDLSERILLPQDIVEAHREGIIHFHDSDYYAQHMHNCDLVNLEDMLQNGTVITGTLIEKPHSFATACNIATQIVAQVASNQYGGQSISLTHLAPFVQVSRDKIRASVRSEFDAVGVAVTEDDINAIAEKRLREEIRRGVQTIQYQVVTLLTTNGQAPFVTVFMYLGEAKSQQEKDDLALIIEETLLQRYQGVKNEKGVWVTPAFPKLIYVLEEDNIHEDSKYWYLTKLAAKCTAKRMVPDYISEKKMLELKVDKNGNGHCYPCMGCRSFLTPYVDENGQPKYYGRFNQGVVTVNLPDIALSSGGNIEKFWRIFDERMELCHRALLCRHERLKGTLSDAAPILWQYGACARLKKGEPIDKLLYGGYSTISLGYAGLYECVKYMTGKSHTDPAATPFALEIMNALNAACKKWKAQHNIDFSLYGTPLESTTYKFAKCLQKRFGVIKGITDKGYITNSYHVHVTEPIDAFKKLEFEAQFQHLSPGGAISYVEVPDMQNNLDAVLEVMKFIYDHIIYAELNTKSDYCQVCGWDGEIEVVEEDGKLIWKCPQCGNTDQDKMNVARRTCGYIGTQFWNQGRTQEIKDRVLHL

SEQ ID NO: 493 - protein, 707 aa, unidentified
  REGION 1..707: note = Description of Unknown:uncultivated organism sequence
  REGION 1..707: note = Category: MG55 effectors
  REGION 1..707: note = Description: MG55-66 effector
MQVIKRDGSVVDYDRAKIAIAIGKANAEVEKGERASKEEIGAILDHIESKKKKRMLVEDIQDIIEEKLMEQGHYELAKTYIIYRYNRALVRKANTTDEAILSLISNSNKDVMEENSNKNALAAATQRDLIAGEVSKDLTRRILLPEKISKAHDDGILHFHDADYFIQPIFNCCLINIGDMLDNGTVMNGKLIESPKSFQVACTVVTQIIAAVACSQYGGQSVDIRHLGKYLRKSRTKFENHYREACPELSDDEVKKLVDDRIQDELKSGVQTIQYQINTLMTTNGQSPFVTLFLYLDKDDEYLEENAQIVMEILRQRYEGIKNEKGVYVTPAFPKLVYVLDEINCLKGGKYDYITEFAVKCSAKRLYPDYISAKEMRETYEGNVFSPMGCRSFLSPWKDENGNYKFEGRFNQGVVSINLPQIGIIAQGDEEKFWKLFDERLDLCREALMCRHRALLGTKSDVSPIHWQYGAIARLDKGETIDKLLMGGYSTLSLGYIGLYEVTKLMTGVTQTDPKGEEFAVRVMQHMRDKTDQWKKETGLGFALYGTPAESLCYRFARIDKERFGTIEDVTDKGYYTNSYHVDVREHIDAFSKFSFEAQFQKISSGGCISYVEIPNMQNNLEAMQEIVRFIYDNIQYAEFNTKSDYCHVCGWDGEIIINDDNEWECPNCHNKDHKKMNVTRRTCGYLGENFWNLGKTKEIKARVLHL

SEQ ID NO: 494 - protein, 720 aa, unidentified
  REGION 1..720: note = Description of Unknown:uncultivated organism sequence
  REGION 1..720: note = Category: MG55 effectors
  REGION 1..720: note = Description: MG55-67 effector
MKIMKRSGIEADFDVTKISAAIKKANCEVAAVDQLSEEQIEEISTNVEKICSDIGRTLGVEEIQDLVEDQIMNKRAFVLARKYITYRYTRALVRKSNSTDKQILSLLECNNEEAKQENSNKNPTVNSVQRDYMAGEVSKDITKRFLLPEDIVAAHEQGIIHFHDSDYFAQHMHNCCLVNLEDMLQNGTVISETMIERPKSFSTACNIATQSIAQIASSQYGGQSISLAHLAPFVDVSRQKFRLQVRDEFEKANIAASEEQINNVAEQRVRDEIKRGVQMIQYQVITLMTTNGQAPFVTVFMYLDEVPEGRLRDDLALVTEEILRQRIQGVKNEKGVYITPAFPKLIYVLEEDNITEGSKYWELTKLAAKCTAKRMVPDYISEKIMRKLKDGNCYPCMGCRSFLTVYHDENDKPKFYGRFNQGVVTINLVDVACSSGKDMDKFWQIFDERLDLCYRALMCRHKRLLDTPSDVAPILWQYGALARLKKGETINKLLYNGYSTISLGYAGLCECTRYMTGHSHTDPESTPFALQVMQHMNDACAKWREETNIDFSLYGTPLESTTYKFAKCLQKRFGIIEGVTDRGYITNSYHVHVTEEINAFDKLKFEAQFQELSPGGAISYVEVPNMENNIEAVLNVMKYIYDNIMYAELNTKSDYCQCCGYTGQIQIVTDEHGKLIWECPNCGNTDQNKMNVARRTCGYIGTQFWNQGRTQEIKERVLHL

SEQ ID NO: 495 - protein, 732 aa, unidentified
  REGION 1..732: note = Description of Unknown:uncultivated organism sequence
  REGION 1..732: note = Category: MG55 effectors
  REGION 1..732: note = Description: MG55-68 effector
MKVIKRDGKIVEYDREKIRIAIGKANNEVSKKYRATEEEIKDIIEYIEELKKSRILVEDIQDIIEQKLMEMGKYELAKEYITYRYTRALVRKANTTDQSIKELIEGESEYWNNENSNKNAKVVTTQRDYLAGITSTDITRRFLLPDDVVKAHDEGIIHFHDADYFAQNALHNCDLINLEDMLQNGTNINGVLIEKPHKFLTAMTIATQIITAVTSSQYGGATVTMTHLAPFVRDSYNAYLKKYRERHLSKEQCEKFAKEDLKKEIQDGVQTFQYQINSMTTTNGQSPFLSVCMYLGETTEYKEELAMIIEEILKQRILGMKNEKGVYVTPAFPKLLYVLEEDNIHEDSKYYYLTKLAAKCTAKRMVPDYISEKIMKELKVDKNGNGQCYPCMGCRSFLTPYIDPETNKPKYYGRFNQGVVTINLVDVALSSGKDMNKFWKIYEERLELCHKALKVRHERLAKATSDVAPILWQYGALARLKKGESIHKLLHGGYSTISLGYAGLYECVKYMTGNSHTDGAKGEEFGLEVMQKLNDKCKEWKEAEDIDYSVYGTPIESTTYKFAKCLQRRFGKIKGITDRNYITNSYHVPVFEEIDAFSKLKLESKFQRLSPGGAISYVETPNLQDNLEVVLQIIKFIYDNIMYAELNTKSDYCQKCGFDGEILLDDNLEWYCPNCGNRDHSTLNVARRTCGYIGSNFWNKGRTQEIKERVLHIDNKDDTKKVEKEAKKDEIQ

SEQ ID NO: 496 - protein, 724 aa, unidentified
  REGION 1..724: note = Description of Unknown:uncultivated organism sequence
  REGION 1..724: note = Category: MG55 effectors
  REGION 1..724: note = Description: MG55-69 effector
MKIIKRNGAEVGFDITKIIIAITKANEAVEEADRMTPMQIQRIAESVELQCQKMNRAPTVEEIQDMVEHYIMAHGAFEVAKHYITYRYTRSLVRKSNTTDDKILSLIECNNEEAKQENSNKNPVVNSTQRDYMAGEVSRDLSERILLPQDIVEAHREGIIHFHDSDYYAQHMHNCDLVNLEDMLQNGTVITGTLIEKPHSFATACNIATQIVAQVASNQYGGQSISLTHLAPFVQVSRDKIRASVRSEFDAVGVAVTEDDINAIAEKRLREEIRRGVQTIQYQVVTLLTTNGQAPFVTVFMYLGEAKSQQEKDDLALIIEETLLQRYQGVKNEKGVWVTPAFPKLIYVLEEDNVHEDSKYWYLTKLAAKCTAKRMVPDYISEKKMLELKVDKNGNGHCYPCMGCRSFLTPYVDENGQPKYYGRFNQGVVTVNLPDIALSSGGNIEKFWRIFDERMELCHRALLCRHERLKGTLSDAAPILWQYGACARLKKGEPIDKLLYGGYSTISLGYAGLYECVKYMTGKSHTDPAATPFALEIMNALNAACKKWKAQHNIDFSLYGTPLESTTYKFAKCLQKRFGVIKGITDKGYITNSYHVHVTEPIDAFKKLEFEAQFQHLSPGGAISYVEVPDMQNNLDAVLEVMKFIYDHIIYAELNTKSDYCQVCGWDGEIEVVEEDGKLIWKCPQCGNTDQDKMNVARRTCGYIGTQFWNQGRTQEIKDRVLHL

SEQ ID NO: 497 - protein, 719 aa, unidentified
  REGION 1..719: note = Description of Unknown:uncultivated organism sequence
  REGION 1..719: note = Category: MG55 effectors
  REGION 1..719: note = Description: MG55-70 effector
MQVIKRDGKVVDFDQSKIKIAIEKANKEVKPRERATKEEINQIISYIEELDKKRILVEDIQDIIEEQLMTFGKYILAKKYITYRYTRELVRKSNTTDQSIKELIDGESDYWNNENSNKNARVVTTQRDYLAGITSTDITRRFLLPEDVVKAHDEGIIHFHDADYFAQNALTNCELINLEDMLQNGTIMNGVMIEKPHRFLTAMTIATQIILGVTSSTYGGATVSITHLAPFVKSSYEKYYKKYKQRGLNEKQCKEYAEQDTRKEVSDGVQTFNYQVNSMTNTNGQAPFLSVCMYLGETDEYKQELAMIIEEFLKQRIEGFKNEKGVYITPAFPKLLYVLEEDNIHKDSKYWYLTELAAKCTAKRLVPDYISEKKMKELKIDKNGNGNCYPCMGCRSFLTPYVDPETNKPKYYGRFNQGVVTINLVDVALSSKQDEEKFWKIFDERLELCHKALQIRHERLSKVTSDVAPILWQHGALARLKKGESIHKLLHDGYSTISLGYAGLYECVKYMTGNSHTDNGIGEEFALKVMQKLNDKCKEWKEAEKIDYSVYGTPIESTTYKFAKCLRKRFGTIEGITDRSYITNSYHVPVFEDIDAFSKLKLESKFQKLSPGGAISYVETPNLQNNLEVVLQIIHFIYDNIMYAELNTKSDYCQKCGFDGEILIDENLEWYCPNCGNRDHNTLNVARRTCGYIGSQFWNKGRTQEIKERVLHIDNKDDE

SEQ ID NO: 498 - protein, 722 aa, unidentified
  REGION 1..722: note = Description of Unknown:uncultivated organism sequence
  REGION 1..722: note = Category: MG55 effectors
  REGION 1..722: note = Description: MG55-71 effector
MEVIKRDGSKVAFDGTKIENAILKAMRYGSGIVKPEIASKISHEIEDWHKSSGAASISIYRIEGQVFEKLIEKGEVLTAKAYEGYRKVREFQRETNTIDNAIYGIVNQTNKEAMDENSNKDATVLATQRDLIAGEFSRDYCRRLLLPPKIVQAHDDGIIHFHDMDYYIQKMHNCDLVNLKDMFANGTVINDKLIETPKSLQTACTVATQIVQQVANGQYGGQTISISHLAPYVRVSYKKHLKAVRKEGEEVGIDYTEEQIEKIAKSRLHEEIKAGVQTIQYQINTFSTTNGQAPFLSIFMYLREEPDYIEETALLIEEILKQRYIGMKNPVGAYVTPAFPKLLYVLDDNNVPDGSQYRYLTDLAVKCVSKRMMPDFISAKIMRENYEGQVFPCMGCRSFLSPWKNEKGEYQWYGRFNQGVVTLNLTDVGLSANKNMDSFWKILDERLDLCYEALMLRHESLKGTPSDISPIHWQYGAIARLKPGEKIDSLLDTCYSTLSLGYIGLYECVVALIGQSHTSEEGDALALEIMQKLRNACDKWKKDTGLGFALYGTPAESTTYTLARALKKRFGVVPGVTDKDYITNSYHVNVREQIDAFAKLGFEAKFQKISSGGAISYVEVTNMTNNFDAMKELINYMYETIQYAEINTKSDYCQECGFSGEILLDENNEWYCPNCGNRNHKTLNVCRRTCGYLGDNFWNKGRTQEIKERFVHLDNRVYQENN

SEQ ID NO: 499 - protein, 724 aa, unidentified
  REGION 1..724: note = Description of Unknown:uncultivated organism sequence
  REGION 1..724: note = Category: MG55 effectors
  REGION 1..724: note = Description: MG55-72 effector
MKIIKRSGAENTFDKEKIENAVAKANITVEEKDRLSEGEIGEIAQNIEDKCSEMNRAMDVETIQDWVEADIMRHGKYTVAKHYITYRYERSIVRQANTTDKQILSLLNFENEEVKQENSNKNPTVNSVQRDYMAGEVSKDITRRFLLPDDIVEAHEKGLIHFHDADYFAQHMHNCCLVNLEDMLQNGTVISEVMIEKPHSFSTACNIATQSIAQIASSQYGGQSITLSHLAPFVQISRDKYRREVKKEFAELNIPADEDTINKVAEMRVKAEIVQGVQMIQYQVITLMTTNGQAPFVTVFMYLDEVPEGQTRDDLAAIIEEMLRQRIQGVKNEKGVYITPAFPKLIYVLEEDNIREGSKYWELTKLAAKCTAKRMVPDYISEKKMKELKVDKNGNGQCYPCMGCRSFLTTYLDENGKPKYYGRFNQGVVTINLVDVACSSYKDMDKFWLIFDERLELCRRALMLRHERLKGTPSDVAPILWQNGALARLKKGETIDKLLFGGYSTISLGYAGLCECVRYMTGKSHTDPSATPFALEVMQHLNDACAKWRAETNIDFSLYGTPLESTTYKFARCLQKRFGVIEGVTDRNYITNSYHIHVTENIDAFDKLTFESQFQALSPGGAISYVEVPNMQNNIEAVLAVMQHIYDNIMYAELNTKSDYCQKCGFDGEIKIVEDDGKLVWECPNCGNRDQNTLNVARRTCGYIGTQFWNQGRTQEIKERVLHL

SEQ ID NO: 500 - protein, 1253 aa, unidentified
  REGION 1..1253: note = Description of Unknown:uncultivated organism sequence
  REGION 1..1253: note = Category: MG55 effectors
  REGION 1..1253: note = Description: MG55-73 effector
MGIFENYTNLYAVKKSIQIGAIPTERTKKTLATMGIVEKDRQRVENISKFCQVFDRFHKERAGKILEETSFKTLPAYESAYDAYHKALVEKAEDADAIRDELVNRTDEVLKEISDAFLKNDSITELFTGDFLNKEMPALLTDKKEKKLAEELSKSAGGFIRYHQARSLLYSVKHGSIAFRLINDNYPFFYKNCEIIEKFRAVSGRTEEFLEGMRKLDWFRDSYLDEISDRDNYGSCFTQAAIDRYNVMLNGFTMPDRVKIKGLNEYINEYNHTLSAAEKREKGLRLLDPLYKLPLFNDNSFSVIPEKFETDGELLDTVDRIFNDTIYTKALGEAIDEACRLFDKDLGEYDASGIYIAPRQLTAFSLMAFDKWNAIEKLFNLDYDNKNYKKLVLDNPKANEDKYEKDRRNVLNRNIFSLEDIRKLALLDEEESGDAVEALCRNVREKKAEVLAAYNEYTEARKERKEKEEREEEVVSVRRDVRLRSAIKGLCDSIKEFERSLNFILSGRSLTETGLAGDADFINAFNELHDIIREYDAAYNKIRNFISRTKTKSDSVELLFGNSSFLGGWSDMSVKGGTFIKDGDKIFFVAASHGATKLLDDEYLTYEDGEETVEVMDYYLLADAAKSIGRIFIYNGMKNKDGGPAKYKYNPDAVPAKEYGLTEELFNAYAKGMHKSNYKENGFTDEDNRKTLDALTEYLGKAMPKYFTKLDFQLEKHYDTYRDICDDLKKKASFALSFKKVSKDYIQKLENNGDICLFRLWCKDFSEHSSGREGNYTVILKNLFNTDKDAVSTIRLSGNAALRFEKASLKKEDLVVHKAGTWVENKNPNSENRKRKLEYDIIKDRRFHHDRFRLMLPYALNYTEGDFCPVNEKVREDIKAGKFKYITSVKGGMDNLLWVCVTDLKGNIVEQFPINTIGNTDWREKISIRQQEMKEGNKNWTPGTDIRTLKEGYLSLAIKLVYDTIMKYESLVVLEDNAPNFKGNKFGIDTRLYEVFTEALRQKLRYAFSRTEGERDYGGVLKGFQLVNPEKPKGMQDGIIFLINPAYTSNIDPATGFISYIRPRYENITRTKNMIEKIDGFAVKNGMFCMDIDFSRFGDVLKGTRSEWTVWANGSRIIWKRDEDLAKGGKFVEISINEAFLDFFKKNRIDIKGDIKAQLLSNNSKAFYSEFCELFGALLKLSNGKNDDNFIISPVKNKKGQFFNSKTSDTVTCSDSNSAYNLCRKMAICVRNISNDVKKPVPKSEEFIKEIQG

SEQ ID NO: 501 - protein, 573 aa, unidentified
  REGION 1..573: note = Description of Unknown:uncultivated organism sequence
  REGION 1..573: note = Category: MG55 effectors
  REGION 1..573: note = Description: MG55-74 effector
MPFNIEKLRPDYRTKNFQIPITSINLPEEFWTEAKTYKNCWNEIVAEFISFGEEHDALIVRYRELKTEKADLTGIKEELEALRDKRRDAVKAKWKAQSEHLFNNDLEVMLTGVEKSLKENSFRFKRGLDSIIFTKRYGKGGVKFSDLFTVEDSRSDSLKRKPFIVRKGIKRDSKRAEHKTPLHGSFLVGKNRVRLNFYGLWTYADFLDDCFIKRVSLNGKRDFQGWKWYLTVAAEMPPTEHLINRTLPVAGLDLGYRIFPEYIRFGVVSDSAGNIFEFRLPHGNMENQYLRRKNVFLEKNYGRKIDFVRDLYDYFAKDSAQGKTLEEAKQAVKKIYDTAQSEKINLPEEYKQAFTGFVKMRNHGLLKIKRVCGELIENLPDDKNQEVLIALTETKILIEEWSEKNDQFEQEKYFFRQKFIGRRKQLYRNIAVWLSTNYSKVIFEKDLNLAKLATKSKKSSRVTDAALLESNKFRQWTSLSELVRYLGETDQDFVGNWLTAGTTAYSTYFCDECGAGRASVPEDLIAVCDNGHRRDQDVKASRNLLAEAEIKPEKNSVKIPDYLKKNIVRITEK

SEQ ID NO: 502 - protein, 720 aa, unidentified
  REGION 1..720: note = Description of Unknown:uncultivated organism sequence
  REGION 1..720: note = Category: MG55 effectors
  REGION 1..720: note = Description: MG55-75 effector
MKIMKRSGIEADFDVTKISAAIKKANCEVAAVDQLSEEQIEEISTNVEKICSDIGRTLGVEEIQDLVEDQIMNKRAFVLARKYITYRYTRALIRKSNSTDKQILSLLECNNEEAKQENSNKNPTVNSVQRDYMAGEVSKDITKRFLLPEDIVAAHEQGIIHFHDSDYFAQHMHNCCLVNLEDMLQNGTVISETMIERPKSFSTACNIATQSIAQIASSQYGGQSISLAHLAPFVDVSRQKFRLQVRDEFEKANIAASEEQINNVAEQRVRDEIKRGVQMIQYQVITLMTTNGQAPFVTVFMYLDEVPEGRLRDDLALVTEEILRQRIQGVKNEKGVYITPAFPKLIYVLEEDNITEGSKYWELTKLAAKCTAKRMVPDYISEKIMRKLKDGNCYPCMGCRSFLTVYHDENDKPKFYGRFNQGVVTINLVDVACSSGKDMDKFWQIFDERLDLCYRALMCRHKRLLDTPSDVAPILWQYGALARLEKGETINKLLYNGYSTISLGYAGLCECTRYMTGHSHTDPESTPFALQVMQHMNDACAKWREETNIDFSLYGTPLESTTYKFAKCLQKRFGIIEGVTDRGYITNSYHVHVTEEINAFDKLKFEAQFQELSPGGAISYVEVPNMENNIEAVLNVMKYIYDNIMYAELNTKSDYCQCCGYTGQIQIVTDEHGKLIWECPNCGNTDQNKMNVARRTCGYIGTQFWNQGRTQEIKERVLHL

SEQ ID NO: 503 - protein, 724 aa, unidentified
  REGION 1..724: note = Description of Unknown:uncultivated organism sequence
  REGION 1..724: note = Category: MG55 effectors
  REGION 1..724: note = Description: MG55-76 effector
MKIIKRSGAENTFDKEKIENAVAKANITVEEKDRLSEGEIGEIAQNIEDKCSEMNRAMDVETIQDWVEADIMRHGKYTVAKHYITYRYERSIVRQANTTDKQILSLLNFENEEVKQENSNKNPTVNSVQRDYMAGEVSKDITRRFLLPDDIVEAHEKGLIHFHDADYFAQHMHNCCLVNLEDMLQNGTVISEVMIEKPHSFSTACNIATQSIAQIASSQYGGQSITLSHLAPFVQISRDKYRREVKKEFAELNIPADEDTINKVAEMRVKAEIVQGVQMIQYQVITLMTTNGQAPFVTVFMYLDEVPEGQTRDDLAAIIEEMLRQRIQGVKNEKGVYITPAFPKLIYVLEEDNIREGSKYWELTKLAAKCTAKRMVPDYISEKKMKELKVDKNGNGQCYPCMGCRSFLTTYLDENGKPKYYGRFNQGVVTINLVDVACSSYKDMDKFWKIFNERLELCRRALMLRHERLKGTPSDVAPILWQNGALARLKKGETIDKLLFGGYSTISLGYAGLCECVRYMTGKSHTDPSATPFALEVMQHLNDACAKWRAETNIDFSLYGTPLESTTYKFARCLQKRFGVIEGVTDRNYITNSYHIHVTENIDAFDKLTFESQFQALSPGGAISYVEVPNMQNNIEAVLAVMQHIYDNIMYAELNTKSDYCQKCGFDGEIKIVEDDGKLVWECPNCGNRDQNTLNVARRTCGYIGTQFWNQGRTQEIKERVLHL

SEQ ID NO: 504 - protein, 723 aa, unidentified
  REGION 1..723: note = Description of Unknown:uncultivated organism sequence
  REGION 1..723: note = Category: MG55 effectors
  REGION 1..723: note = Description: MG55-77 effector
MKVIKRDKKEVEFDSTKIEAAIKKARNACTSSNLSDENIADIADYITYKCKKLDHSVSVEDIQDMVEDQLMAHGEFALAKEYVKYRYNRQLVRKSNTTDEKILSLIELQNEEVKQENSNKNPTINSTQRDYMAGEVSRDLTNRILLPKDIVEAHEKGIIHFHDSDYFAQHMHNCDLVNLEDMLQNGTVISGTLIEKPHSFHTACNVATQIVAQVASAQYGGQSISLAHLAPFVDISRKKIYNKFRKNFEELGINVTEDKLSELVEKEVKEEINRGVQTIQYQVVTLMTTNGQTPFVTVFMYLGEAKNEREKADLALIIEEVLRQRIQGVKNEKGAWITPAFPKLIYVLEEQNITEDAPYFYLTELAAKCTAKRMVPDYISEKIMLELKKDKNGEGHCYTCMGCRSFLTPYLDKNGKPKYYGRFNQGVVTINLVDVACSSHKDINKFWEIFDERLELCHRALMCRHKRLKGTPSDVAPILWQHGALARLKKGEAIDKLLYGGYSTISLGYAGLCECTRYMTGKSHTDPSATPFALEVMKHMNDACAKWKEEENIDFSLYGTPLESTTYKFAKCLQKRFGIIKGVTDKAYITNSYHVHVTEEIDAFTKLAFESQFQKLSPGGAISYVEVPNMQNNIPAVIQVIQFIYDNIMYAELNTKSDYCQKCGYDGEIKLFKEDGKYVWKCPNCGNTDQNFLNIARRTCGYIGVNFWNFGRTEEIAERKLHL

SEQ ID NO: 505 - protein, 730 aa, unidentified
  REGION 1..730: note = Description of Unknown:uncultivated organism sequence
  REGION 1..730: note = Category: MG55 effectors
  REGION 1..730: note = Description: MG55-78 effector
MQVIKRDGRIVDFDRQKIAAAIGKANAEVKPRERASKEDIKGIIEYVEGLDKKRILVEDIQDIIEEKLMECEKYLLAKKYITYRYTRELVRKANTTDQSIKELIDGESDYWNNENSNKNARVVTTQRDYLAGITSTDITRRFLLPKDVVEAHDEGIIHFHDADYFAQNALTNCELINLDDMLQNGTIMNGVMIEKPHRFLTAMTIATQIILAVTSSTYGGATVSLTHLAPFVRSSYERYYKKYKERGLSEKQCKEYAEQDTKKEIADGVQTFNYQVNSMTNTNGQAPFLSVNMYLGETKEYKKELAMVIEEFLKQRMEGFKNEKGVYITPAFPKLLYVLEKDNITEDSPYWYLTELAAKCTAKRMVPDYISEKKMLELKIDKNGNGNCYPCMGCRSFLTPYVDPKTNKPKYYGRFNQGVVTINLVDVALSSDKDMDKFWKIFDERLELCHRALQVRHERLSKVTSDVAPILWQNGALARLKKGESIHPLLHGGYSTISLGYAGLYECVKYMTDHSHTDNGEGKDFGIKVMQKLNDKCKEWKAAEDIDYSVYGTPIESTTYKFAKCLKKRFGVIEGITDRDYITNSYHIPVFEEIDAFSKLSIESQFQQLSPGGAISYVETPNLQNNIESVLQIIKFIYDNIMYAELNTKSDYCQVCGFDGEILIDDNLEWYCPNCGNRNHDTLNVARRTCGYIGSQFWNKGRTQEIKERVLHIDNKDAEMPKKEKTKVAV

SEQ ID NO: 506 - protein, 736 aa, unidentified
  REGION 1..736: note = Description of Unknown:uncultivated organism sequence
  REGION 1..736: note = Category: MG55 effectors
  REGION 1..736: note = Description: MG55-79 effector
MENRDHMDVIHVKTNVIKRNGQEVSFDISKIINAIGKANKEVESIHQMNEFQIRAVADNIARKIASYPHAVNVEDIQDMVETGIMEMRGYEVAQKYVRYRYKREISRKSNTTDDGILSLIDLSNEEVKQENSNKNPVINSTQRDYMAGEVSKDLTKRLLLPEEIVKAHEEGIIHFHDADYFAQREHNCDLINLEDMLQNGTVISQTLIEKPHSFFTACNVTTQIVAQVASNQYGGQSFTLAHLAPFVDISRKKITKEVIEERKETGESMDESIIEKIVERRLKEEIKSGIQTIQYQLITLMTCNGQAPFVTMFMYLDEVPDGQTRKDLAMIIEEVLRQRMQGVKNEKGVWITPAFPKLIYVLDEDNIHDDSPYYYLTKLAAECTAKRMVPDYISAKIMKSLKNGDVYPCMGCRSFLTPDTEGLGPHGEHKYYGRFNQGVVTINLVDVACSSDGDMDRFWKILEDRLELCHRALRCRHERLLGTVSDVAPILWQYGALARLKKGETIDKLLFNNYSTISLGYAGLYEMCVRMLGVSHTTEEGRKFALAVMQKLNDKCAEWRKAENISYSVYGTPMESTTYKFAKCLQKRFGIIPGVTDKNYITNSYHVHVAEKIDAFHKLKFESDFQKLSPGGAISYIEVPNMQTNIPAVLTVMKYIYENIMYAELNTKSDYCMVCGYDGEIKIVEDENGKLVWECPNCGNRDQHKMSVARRTCGYIGTQFWNQGRTQEIKDRVLHL

SEQ ID NO: 507 - protein, 734 aa, unidentified
  REGION 1..734: note = Description of Unknown:uncultivated organism sequence
  REGION 1..734: note = Category: MG55 effectors
  REGION 1..734: note = Description: MG55-80 effector
MIYNKCILKQGEDMEMKIIKRDGSIVDYNPEKIRIAIKKANNEVSRKERATETEIEEIITYIEDLKKSRILVEDIQDIIEQKLMSLEKYQLAKTYITYRYTRALVRKANTTDQSIKELIEGESEYWNNENSNKNATVVTTQRDYLAGITSTDITRRFLLPEDIVKAHDEGIIHFHDADYFAQNALTNCELINLEDMLQNGTIMNGVMIEKPHRFITACTIATQIILAVTSSTYGGATISLSHLAPFVKSSYDKYYKKYKDRGLTEKQCEEYAKQDTRKEVSDGVQTFNYQVNSMTNTNGQAPFLSVCMYLGETEEYKEELAMIIEEFLKQRIEGFKNEKGVYVTPAFPKLLYVLEEDNVHEDSKFWYLTELAAKCTAKRMVPDYISEKKMLELKVDKNGEGHCYPCMGCRSFLTPYVDPETNKPKYYGRFNQGVVTINLVDVALTSGKDKNKFWKIYDERLELCHRALQARHERLSKVTSDVAPILWQNGAFARLPKGAPIHPLLHGGYSTISLGYAGLYECVKYMTDKSHTDNGEGKEFAIEVMKKLNEKCKEWKEKEDIDYSVYGSPIESTTYKFAKCLKERFGVVEGITDKNYITNSYHVPVFEEIDAFSKLKLESEFQVLSPGGAISYVETPNLQDNLEVVLQIIRFIYDNIMYAELNTKSDYCQKCGFDGEILIDDNLEWYCPNCGNRDHNTLNVARRTCGYIGSNFWNKGRTQEIKERVLHIDNKDDE

SEQ ID NO: 508 - protein, 420 aa, unidentified
  REGION 1..420: note = Description of Unknown:uncultivated organism sequence
  REGION 1..420: note = Category: MG55 effectors
  REGION 1..420: note = Description: MG55-81 effector
MNKYISAVKIRIVPLNKNTFDYINNLMYQTNKIYNDAYSHEWVFIKQKLSESIIPVKSAKTTKVYHSVRDLHPTFPTAILSNICHRVKKDFSNDIKNGLFKGKRTPRLYKYGAPIIYQFNSGGINPNFHNVNDDIILRIKNGLDFKLLFGKDKSGNKKLLERLMDKNDKSLNINRVFNVTYNKRDKHYYIIFTYETESEDYEKVKGRVCGIDLGVRRFVSIRLNDNIHVQKSIHSDDLIRVKMDINKKRREYQKSMVMAKGGHGRNRKLKYLDTIRKKEINFTNTALHKLSKQVIDFCIKYKVEQINMELLNRNIDKNSFFSRYWPISNFIDKLKYKVDSYGINLKFVDPYHTSQICSICGEIGERNGDTFICQNDKCKIHNENIDSDYNAAYNIAKSKLYVDKYENTQYYKLKNKEKVL

SEQ ID NO: 509 - protein, 739 aa, unidentified
  REGION 1..739: note = Description of Unknown:uncultivated organism sequence
  REGION 1..739: note = Category: MG55 effectors
  REGION 1..739: note = Description: MG55-82 effector
MNIIKRDGSVVEYDANKIRTAIGKANAEVQKNEKASKEEIEEIIKYIQELNKKRMLVEDIQDIIEEKLMSYNHYQLAKAYITYRYTRSLVRQANTTDQSIKELIDGTSEYWNTENSNKNARVVTTQRDYLAGITSTDISRRFLIPKEVVDAHDEGLIHFHDMDYFAQNALHNCDLIDLEDMLQNGTCINGVMIEKPHRFITAMTIATQIITAVNSSQYGGVTITLTHLAPFVRDSYLRYVKKYEERGFSKEDVEKYAKEDLQKEVVDGVQTFQYQINSMTTTNGQAPFLSVCMYLGETEEYKPELAMIIEEVLRQRTEGMKNEKGIYVTPAFPKLLYVLEEDNIKEGSKYYYLTKLAAKCTAKRLVPDYISEKKMKEYKIDSNGDGQCYPCMGCRSFLTPYVDPKTKKAKYYGRFNQGVVTINLPDVALSSGKDVEKFWKIMDERLELCHRGLKTRYERLSHATSDVAPILWQNGALARLPKGASIKPLLHGGYSTISLGYAGLYECVKYMTGDSHTDGAKGEEFGLAVMQYLNDKCAQWKKEENMDYSVYGTPIESTTYKFSKCLQKRFGKIEGITDRGYITNSYHVPVFEKIDAFKKLSIESKFQRLSPGGAISYIETPNLQNNLDAVMQVIQYIYDNIVYAELNTKSDYCQKCGFDGEILLGDDLEWHCPNCGNKDHNTLNVARRTCGYIGTNFWNKGRTQEIKERVLHLENTDDENDKTKVTKAEAKVRVANQQQ

SEQ ID NO: 510 - protein, 724 aa, unidentified
  REGION 1..724: note = Description of Unknown:uncultivated organism sequence
  REGION 1..724: note = Category: MG55 effectors
  REGION 1..724: note = Description: MG55-83 effector
MKIIKRSGAENTFDKEKIENAVAKANITVEEKDRLSEGEIGEIAQNIEDKCSEMNRAMDVETIQDWVEADIMRHGKYTVAKHYITYRYERSIVRQANTTDKQILSLLNFENEEVKQENSNKNPTVNSVQRDYMAGEVSKDITRRFLLPDDIVEAHEKGLIHFHDADYFAQHMHNCCLVNLEDMLQNGTVISEVMIEKPHSFSTACNIATQSIAQIASSQYGGQSITLSHLAPFVQISRDKYRREVKKEFAELNIPADEDTINKVAEMRVKAEIVQGVQMIQYQVITLMTTNGQAPFVTVFMYLDEVPEGQTRDDLAAIIEEMLRQRIQGVKNEKGVYITPAFPKLIYVLEEDNIREGSKYWELTKLAAKCTAKRMVPDYISEKKMKELKVDKNGNGQCYPCMGCRSFLTTYLDENGKPKYYGRFNQGVVTINLVDVACSSYKDTDKFWKIFDERLELCRRALMLRHERLKGTPSDVAPILWQNGALARLKKGETIDKLLFGGYSTISLGYAGLCECVRYMTGKSHTDPSATPFALEVMQHLNDACAKWRAETNIDFSLYGTPLESTTYKFARCLQKRFGVIEGVTDRNYITNSYHIHVTENIDAFDKLTFESQFQALSPGGAISYVEVPNMQNNIEAVLAVMQHIYDNIMYAELNTKSDYCQKCGFDGEIKIVEDDGKLVWECPNCGNRDQNTLNVARRTCGYIGTQFWNQGRTQEIKERVLHL

SEQ ID NO: 511 - protein, 724 aa, unidentified
  REGION 1..724: note = Description of Unknown:uncultivated organism sequence
  REGION 1..724: note = Category: MG55 effectors
  REGION 1..724: note = Description: MG55-84 effector
MKIIKRSGAENTFDKEKIENAVAKANITVEEKDRLSEGEIGEIAQNIEDKCSEMNRAMDVETIQDWVEADIMRHGKYTVAKHYITYRYERSIVRQANTTDKQILSLLNFENEEVKQENSNKNPTVNSVQRDYMAGEVSKDITRRFLLPDDIVEAHEKGLIHFHDADYFAQHMHNCCLVNLEDMLQNGTVISEVMIEKPHSFSTACNIATQSIAQIASSQYGGQSITLSHLAPFVQISRDKYRREVKKEFAELNIPADEDTINKVAEMRVKAEIVQGVQMIQYQVITLMTTNGQAPFVTVFMYLDEVPEGQTRDDLAAIIEEMLRQRIQGVKNEKGVYITPAFPKLIYVLEEDNIREGSKYWELTKLAAKCTAKRMVPDYISEKKMKELKVDKNGNGQCYPCMGCRSFLTTYLDENGKPKYYGRFNQGVVTINLVDVACSSYKDMDKFWKIFDERLELCRRALMLRHERLKGTPSDVAPILWQNGALARLKKGETIDKLLFGGYSTISLGYAGLCECVRYMTGKSHTDPSATPFALEVMQHLNDACAKWRAETNIDFSLYGTPLESTTYKFARCLQKRFGVIEGVTDRSEVTNSYHIHVTENIDAFDKLTFESQFQALSPGGAISYVEVPNMQNNIEAVLAVMQHIYDNIMYAELNTKSDYCQKCGFDGEIKIVEDDGKLVWECPNCGNRDQNTLNVARRTCGYIGTQFWNQGRTQEIKERVLHL

SEQ ID NO: 512 - protein, 327 aa, unidentified
  REGION 1..327: note = Description of Unknown:uncultivated organism sequence
  REGION 1..327: note = Category: MG55 effectors
  REGION 1..327: note = Description: MG55-85 effector
MITAIQRLKEENERLNHRAGHDWLTGLYDREGAEEKINRLIRERGCGVMILLDVDRFRRINSRHGHIVGDHVLSSIAAVLDSMVFRHDVVGRVDDDEFVVFMPVDQDEKFLQQRCRQIRDRLKTMELPGGAEISISLSTGGAICGKDDTYRSLFARAYGELDKDKVSAREQTADSEARKGNFMVDLKQVRGELAEQSLIPGAYCQDYETFKHIYRFVERRLRRAEISSYILLITLTDGNGDFPPLTRREEQMAVLKDEIQISLRSGDVFTQYSSCQYLVMISDASAENVEMIADRICTAFYKAIGGACQGVLLHHCYPMWPAGEKEP

SEQ ID NO: 513 - protein, 722 aa, unidentified
  REGION 1..722: note = Description of Unknown:uncultivated organism sequence
  REGION 1..722: note = Category: MG55 effectors
  REGION 1..722: note = Description: MG55-87 effector
MEVIKRDGSKVAFDGSKIENAILKAMRYGSGIVKPEIASKISHEIEDWHKSSGAASISIYRIEGQVFEKLIEKGEVLTAKAYEGYRKVREFQRETNTIDNAIYGIVNQTNKEAMDENSNKDATVLATQRDLIAGEFSRDYCRRLLLPPKIVQAHDDGIIHFHDMDYYIQKMHNCDLVNLKDMFANGTVINDKLIETPKSLQTACTVATQIVQQVANGQYGGQTISISHLAPYVRVSYKKHLKAVRKEGKEVGIDYTEEQIEKIAKSRLHEEIKAGVQTIQYQINTFSTTNGQAPFLSIFMYLREEPDYIEETALLIEEILNQRYIGMKNPVGAYVTPAFPKLLYVLDDNNVPDDSQYRYLTDLAVKCVSKRMMPDFISAKIMRENYEGQVFPCMGCRSFLSPWKNEKGEYQWYGRFNQGVVTLNLTDVGLSANKNMDSFWKILDERLDLCYEALMLRHESLKGTPSDISPIHWQYGAIARLKPGEKIDSLLDTCYSTLSLGYIGLYECVVALIGQSHTTEEGDALALEIMQKLRNTCDKWKKDTGLGFALYGTPAESTTYTLARALKKRFGIVPGVTDKDYITNSYHVNVREHIDAFSKLGFEAKFQKISSGGAISYVEVTNMTNNFDAMKELINYMYETIQYAEINTKSDYCQECGFSGEILLDENNEWYCPNCGNRNHKTLNVCRRTCGYLGDNFWNKGRTQEIKERFVHLDNRVYQENN

SEQ ID NO: 514 - protein, 309 aa, unidentified
  REGION 1..309: note = Description of Unknown:uncultivated organism sequence
  REGION 1..309: note = Category: MG55 effectors
  REGION 1..309: note = Description: MG55-88 effector
MTTIINQFNSGGINPNFHNVNDDIILRIKNGLDFKLLFGKDKSGNKKLLERLMDKNDKSLNINRVFNVTYNKRDKHYYIIFTYETESEDYEKVKGRVCGIDLGVRRFVSIRLNDNIHVQKSIHSDDLIRVKMDINKKRREYQKSMVMAKGGHGRNRKLKYLDTIRKKEINFTNTALHKLSKQVIDFCIKYKVEQINMELLNRNIDKNSFFSRYWPISNFIDKLKYKVDSYGINLKFVDPYHTSQICSICGEIGERNGDTFICQNDKCKIHNENIDSDYNAAYNIAKSKLYVDKYENTQYYKLKNKEKVL

SEQ ID NO: 515 - protein, 724 aa, unidentified
  REGION 1..724: note = Description of Unknown:uncultivated organism sequence
  REGION 1..724: note = Category: MG55 effectors
  REGION 1..724: note = Description: MG55-89 effector
MKIIKRNGAEENFDISKIIMAVTKANAAVEECDRMTPRQIQRIAESVELACQELGRSAAVEEIQDMVEKQIMAHGAFEVAKAYITYRYTRSLVRRANTTDDRILSLIECNNEEAKQENSNKNPIVNSTQRDYMAGEVSRDITSRLLLPKDIVEAHEEGIIHFHDADYYAQHMHNCDLVNLEDMLENGTVITGTLIERPHSFSTACNIATQIIAQVASNQYGGQSISLTHLAPFVQVSRERIRREVEAEMQAIDAHPGEEKLAELVENRVREEIRRGVQTIQYQVVTLLTTNGQAPFVTVFMYLGEAKNEQERHDLAMIIEETLRQRYQGVKNEKGVWVTPAFPKLIYVLEEDNIHEDSPYWYLTELAARCTAKRMVPDYISEKKMLELKVDKNGEGHCYTCMGCRSFLTPYVDENGKPKYYGRFNQGVVTINLPDVALSSGGNMEKFWKIFDERLELCHRALMCRHERLKGTLSDAAPILWQYGALARLKKGEPIDKLLYGGYSTISLGYAGLYECVKYMTGKSHTDPSATPFALEIMQHMNDACAKWKQMHNIDFSLYGTPLESTTYKFAKCLQKRFGIIPGVTDKGYITNSYHIHVTEHIDAFSKLAFESKFQALSPGGAISYVEVPNMQNNIPAVLEVMKFIYDNIMYAELNTKSDYCQVCGYDGEIEIVEHDGKLIWRCPNCGNTDQDKMNVARRTCGYIGTQFWNQGRTQEIKERVLHL

SEQ ID NO: 516 - protein, 99 aa, unidentified
  REGION 1..99: note = Description of Unknown:uncultivated organism sequence
  REGION 1..99: note = Category: MG55 effectors
  REGION 1..99: note = Description: MG55-90 effector
MMSLIKRSYKYRMYPNKTQEELLAKTFGCVRVIWNACVDSFNSYDKETNPNPKFPTKSDLVIEKLWLNEVSAATLQQKQRDFIEFSKQYFNKNRKEKNR

SEQ ID NO: 517 - protein, 405 aa, unidentified
  REGION 1..405: note = Description of Unknown:uncultivated organism sequence
  REGION 1..405: note = Category: MG55 effectors
  REGION 1..405: note = Description: MG55-91 effector
MRLGVRMQRTNVIQLMPNKKQERILRECMLLSSCVYNSANYIVRQQFFNKESVSNFRDLQVKLQKSDDYRLLGRSYALPRLQIYGETNSARFKLIKANVQDKVGLPKYLKNRKTNTTIPSYLVIDGCQYSLSKTKATIPLSRAMRKKYDIKYFKIAYNGILKHKGKQQRGQIHYKNKKFYLYQSVEVTTPIMKSGNIAGLDLGIKNLLTVTTNTNQEKIIGSKRFFKQWQHYTDLIAQEQEKLSKINRKASNNLSRLYYKRSVYQDNLFNNVVAKMFRFLKRNNISTLVIGDIKGIREHNDKGKKLNTMMHNYWSFDKLLHKIENNAEASGIEIVMTTEEYTSRTCPICYDNSKENVKDRIFQCTFCGYIDHRDIIGARNIMIKGMHDQSNQSVHRQEILPLEVL

SEQ ID NO: 518 - protein, 724 aa, unidentified
  REGION 1..724: note = Description of Unknown:uncultivated organism sequence
  REGION 1..724: note = Category: MG55 effectors
  REGION 1..724: note = Description: MG55-92 effector
MKIIKRNGAEATFDISKIIMAVTKANAAVEEGDRMTPRQIQRIAESVELACQELGRSAAVEEIQDMVEKQIMAHGAFEVAKAYITYRYTRSLVRRANTTDDRILSLIECNNEEAKQENSNKNPIVNSTQRDYMAGEVSRDITSRLLLPKDIVEAHEEGIIHFHDADYYAQHMHNCDLVNLEDMLENGTVITGTLIERPHSFSTACNIATQIIAQVASNQYGGQSISLTHLAPFVQVSRERIRREVAAEMQAIDAHPGEEKLAELVENRVREEIRRGVQTIQYQVVTLLTTNGQAPFVTVFMYLGEAKNEQERHDLAMIIEETLRQRYQGVKNEKGVWVTPAFPKLIYVLEEDNIHEDSPYWYLTELAARCTAKRMVPDYISEKKMLELKVDKNGEGHCYTCMGCRSFLTPYVDENGKPKYYGRFNQGVVTINLPDVALSSGGNMEKFWKIFDERLELCHRALMCRHERLKGTLSDAAPILWQYGALARLKKGEPIDKLLYGGYSTISLGYAGLYECVKYMTGKSHTDPSATPFALEVMQHMNDACKQWKQMHNIDFSLYGTPLESTTYKFAKCLQKRFGIIPGVTDKGYITNSYHIHVTENIDAFSKLAFESKFQALSPGGAISYVEVPNMQNNIPAVLEVMKFIYDNIMYAELNTKSDYCQVCGYDGEIEIVEHDGKLIWRCPNCGNTDQDKMNVARRTCGYIGTQFWNQGRTQEIKERVLHL

SEQ ID NO: 519 - protein, 509 aa, unidentified
  REGION 1..509: note = Description of Unknown:uncultivated organism sequence
  REGION 1..509: note = Category: MG55 effectors
  REGION 1..509: note = Description: MG55-93 effector
MGQTITLAHLSPFIEDTRKDIKAHFPNFNDDEIEELVKRDIEVGVQTLQYQILTLLTTNGQTPFITIFANLAEVPEGKERTNLALVIEEVLRQRIQGVKNEKGVYITPAFPKIIYGLDECNINDDSKYFYLTKLAAECTSKRMVPDYQSNKIQRELKDGDIYPCMGCRSFLSKDGTKKNYARALNYSKHKGHKYYGRFNKGVVTINLPDVALSSKKDKDAFWKIFNERLELCHRALQYRYKRLAGTKSDIAPILWQYGAYARLNKDEKIDELLRHGYSTLSLGYAGLYECVKYMTGVSHTDENGKDFALAVMKYMNDCCDKWNKEENLGYSVYGSPIESTTYSFAKCLRKRFGKIKDITDHDYITNSYHVNVREDIDAFSKLKLESEFQKLSQGGAISYIEVPDLHKNIPAVIDILRFIYNNIMYAELNCKFDYCQKCGYSGEIQIKGEPGNLYWECPNCGNTDQKTMNIARRTCGYIGTNFWNQGRTEEIKDRVLHMDTLSKLKDRKK

SEQ ID NO: 520 - protein, 331 aa, unidentified
  REGION 1..331: note = Description of Unknown:uncultivated organism sequence
  REGION 1..331: note = Category: MG55 effectors
  REGION 1..331: note = Description: MG55-94 effector
MCRSFLTPYVDANGEPKYYGRFNQGVVTINLPDIALSSNGDIETFWDIFDERTELCHKALQMRHKRLEGTPSDVAPILWRYGALARLEKGETIDRLLHNGYSTLSLGYAGLYECVKYMTGKSHTDGDNGEKFGLEVMQALNDKCNKWKNEENIDYSLYGSPIESTTYKFAKCLKKRFGVIEGITDRDYITNSYHVPVFEKIDPFTKLSIESKFQKLSPGGAISYIECTDLTYNIDAVLEVMQFIYNNIMYAELNTKSDYCQVCGYDGEIKIVDEDGELIWECPNCGNRDKNKMNVARRTCGYIGSNFWNKGRTEEIAERYVHLDDHEYKEK

SEQ ID NO: 521 - protein, 707 aa, unidentified
  REGION 1..707: note = Description of Unknown:uncultivated organism sequence
  REGION 1..707: note = Category: MG55 effectors
  REGION 1..707: note = Description: MG55-95 effector
MKVIKRDGSTVEFNKSKIRDAITKSMKNGSGILLPDIARLIANDAEKYFAKEEDVATIYKIEKYVYDRLVHYGQAETARAYEGYRAVQEFKRNTNTTDDSILELLSKKNEDVMKENSNKNPVVSATQRDLIAGEVSKDIARRKLIPAHIVQAHDEGAIHWHDMDYTISPMFNCCLINLEDMFTNGTVINEKLVEEPKSFGTACTVATQIIAQVSSNQYGGQSITIKHLSKYLKVTEEKAFNHYMEMFNDESLATKLAKDIKMKELKDGVQTIRYQLSTLQTTNGQAPFSTIYLEIEDGNPYEEEMAMICEEMIRQRLEGMKNYKGQEIGEAFPKLVYLLDEHNCLEGGKYDYITKLAAKCTAKRLVPDYQSAKIMRENYEGNTFPPMGCRSHLSPWKDEKGNYKFYGRFNQGVVSLNLPQIAIMADKDMEMFWEMLDRRLELCKDALMTRHKMLLGVTSDSSPIHWQHGAIARLKKGEKIDKLLKDGYSTISLGYVGIAEMVQAMLGVTHTSKEGEKFALEVMNYMKEKCDKWKAETGLGFGLYGTPAESLIYRFCRIDKARFGEIQNVTDKLYYTNSYHVHVCEEIDAFSKLKFESQFHSISNGGCISYIEVPDMNKNVEAVEDIINFIYHNIQYAEINTKSDVCYKCGFNGEMELDRESLTWHCPSCGNDDESELQVMRRTCGYIGSSYWNKGRTAEIGDRVLHL

SEQ ID NO: 522 - protein, 729 aa, unidentified
  REGION 1..729: note = Description of Unknown:uncultivated organism sequence
  REGION 1..729: note = Category: MG55 effectors
  REGION 1..729: note = Description: MG55-96 effector
MKIVKRDGHIVDYDPEKIRVAIGKANEEVRGREKATKEEIKEIIKYIEDLNKKRILVEDIQDIIEQKLMEFDKYQLAKKYITYRYTRELVRKANTTDKSIKELIEGENEYWNSENSNKNAEVVTTQRDYLAGITSTDITRRFLLPEDIVEAHDAGIIHFHDADYFAQNALHNCELINLDDMLQNGTVINGVMIEKPHRFLTAATIATQIILAVTSSSYGGATVSLTHLAPFVRLSYEKYLKKYQARNFSKKDCEKYAMQDTKKEVEDGVQTFNYQVNSMTNTNGQAPFLSVNMYLGETEEYKDELAMIIEEFLKQRMLGFKNEKGVYITPAFPKLLYVLEEDNIHEGSKYWYLTKLAAECTAKRMVPDYISEKMMLKYKKNILGDGDCYPCMGCRSFLTPDRMLNIGNISKAKNYVEGKGKYYGRFNQGVVTINLPDVALSADGDMDEFWKIFDERLELCHRALQIRHKRLSNVTSDVAPILWQHGALARLEKGESIHELLHHGYSTISLGYAGLYECVKVMTGHSHTDNGPGKEFGIKVMQHLNDATNKWKKEEDIDYSVYGTPIESTTYKFAKCLKERFGTVKGITDRGYITNSYHVPVFEEIDAFSKLKLESEFQVLSPGGAISYVETPNLQGNIDAVIEVIQFIYDNIMYAELNTKSDYCQNCGYTGEILIDDDLEWYCPNCGNRDHNTLNVARRTCGYIGTNFWNKGRTQEIKERVLHIDNKEA

SEQ ID NO: 523 - protein, 707 aa, unidentified
  REGION 1..707: note = Description of Unknown:uncultivated organism sequence
  REGION 1..707: note = Category: MG55 effectors
  REGION 1..707: note = Description: MG55-97 effector
MKVIKRDGSTVEFNKSKIRDAITKSMKNGSGILLPDIARLIANDAEKYFAKEEDVATIYKIEKYVYDRLVHYGQAETARAYEGYRAVQEFKRNTNTTDDSILELLSKKNEDVMKENSNKNPVVSATQRDLIAGEVSKDIARRKLIPAHIVQAHDEGAIHWHDMDYTISPMFNCCLINLEDMFTNGTVINEKLVEEPKSFGTACTVATQIIAQVSSNQYGGQSITIKHLSKYLKVTEEKAFNHYMEMFNDESLATKLAKDIKIKELKDGVQTIRYQLSTLQTTNGQAPFSTIYLEIEDGNPYEEEMAMICEEMIRQRLEGMKNYKGQEIGEAFPKLVYLLDEHNCLEGGKYDYITKLAAKCTAKRLVPDYQSAKIMRENYEGNTFPPMGCRSHLSPWKDEKGNYKFYGRFNQGVVSLNLPQIAIMADKDMEMFWEMLDRRLELCKDALMTRHKMLLGVTSDSSPIHWQHGAIARLKKGEKIDKLLKDGYSTISLGYVGIAEMVQAMLGVTHTSKEGEKFALEVMNYMKEKCDKWKAETGLGFGLYGTPAESLIYRFCRIDKARFGEIQNVTDKLYYTNSYHVHVCEEIDAFSKLKFESQFHSISNGGCISYIEVPDMNKNVEAVEDIINFIYHNIQYAEINTKSDVCYKCGFNGEMELDRESLTWHCPSCGNDDESELQVMRRTCGYIGSSYWNKGRTAEIGDRVLHL

SEQ ID NO: 524 - protein, 318 aa, unidentified
  REGION 1..318: note = Description of Unknown:uncultivated organism sequence
  REGION 1..318: note = Category: MG55 effectors
  REGION 1..318: note = Description: MG55-98 effector
MCRSFLSNWKDPETGKYKWAGRFNCGVVSLNLPQIAILADKDLNKFWSLLDERLEMCHKALKFRHDLLLGTVSDVSPIHWQYGAIARLKPGEVIDKYLKDGYSTLSLGFVGVYEAVLALTGETHTKHQNLALEIVRRMKQKTIDWNIEENLGYGLYGSPAESLISRFAKIDKEKFGNIKGVTDKGYYTNSYHVFVGEEIDAFKKLTFEAPFHQYASGGCLSYIEMPNMEHNLDAVETLIQFIYDNVRYAEFNTKSDYCKACGFEGEIGFDKNHKWTCPKCGNQDQSKMTVTRRSCGYLGSNFWNEGRTKEIQSRVLHI

SEQ ID NO: 525 - protein, 724 aa, unidentified
  REGION 1..724: note = Description of Unknown:uncultivated organism sequence
  REGION 1..724: note = Category: MG55 effectors
  REGION 1..724: note = Description: MG55-99 effector
MKIIKRNGAEATFDISKIIMAITKANAAVEECDRMTPRQIQRIAESVELACQELGRSAAVEEIQDMVEKQIMAHGAFEVAKAYITYRYTRSLVRRANTTDDRILSLIECNNEEAKQENSNKNPIVNSTQRDYMAGEVSRDITSRLLLPKDIVEAHEEGIIHFHDADYYAQHMHNCDLVNLEDMLENGTVITGTLIERPHSFSTACNIATQIIAQVASNQYGGQSISLTHLAPFVQVSRERIRREVEAEMKAIDAHPGEEKLAELVENRVREEIRRGVQTIQYQVVTLLTTNGQAPFVTVFMYLGEAKNEQERHDLAMIIEETLRQRYQGVKNEKGVWVTPAFPKLIYVLEEDNIHEDSPYWYLTELAARCTAKRMVPDYISEKKMLELKVDKNGEGHCYTCMGCRSFLTPYVDENGKPKYYGRFNQGVVTINLPDVALSSGGNMEKFWKIFDERLELCHRALMCRHERLKGTLSDAAPILWQYGALARLKKGEPIDKLLYGGYSTISLGYAGLYECVKYMTGKSHTDPSATPFALEIMQHMNDACAKWKQMHNIDFSLYGTPLESTTYKFAKCLQKRFGIIPGVTDKGYITNSYHIHVTEHIDAFSKLAFESKFQALSPGGAISYVEVPNMQNNIPAVLEVMKFIYDNIMYAELNTKSDYCQVCGYDGEIEIVEHDGKLIWRCPNCGNTDQDKMNVARRTCGYIGTQFWNQGRTQEIKERVLHL

SEQ ID NO: 526 - protein, 722 aa, unidentified
  REGION 1..722: note = Description of Unknown:uncultivated organism sequence
  REGION 1..722: note = Category: MG55 effectors
  REGION 1..722: note = Description: MG55-100 effector
MEVIKRDGSKVAFDGSKIENAILKAMRYGSGIVKPEIASKISHEIEDWHKSSGAASISIYRIEGQVFEKLIEKGEVLTAKAYEGYRKVREFQRETNTIDNAIYGIVNQTNKEAMDENSNKDATVLATQRDLIAGEFSRDYCRRLLLPPKIVQAHDDGIIHFHDMDYYIQKMHNCDLVNLKDMFANGTVINDKLIETPKSLQTACTVATQIVQQVANGQYGGQTISISHLAPYVRVSYKKHLKAVRKEGEEVGIDYTEEQIEKIAKSRLHEEIKAGVQTIQYQINTFSTTNGQAPFLSIFMYLREEPDYIEETALLIEEILKQRYIGMKNPVGAYVTPAFPKLLYVLDDNNVPDDSQYRYLTDLAVKCVSKRMMPDFISAKIMRENYEGQVFPCMGCRSFLSPWKNEKGEYQWYGRFNQGVVTLNLTDVGLSANKNMDSFWKILDERLDLCYEALMLRHESLKGTPSDISPIHWQYGAIARLKPGEKIDSLLDTCYSTLSLGYIGLYECVVALIGQSHTTEEGDALALEIMQKLRNTCDKWKKDTGLGFALYGTPAESTTYTLARALKKRFGVVPGVTDKDYITNSYHVNVREHIDAFSKLGFEAKFQKISSGGAISYVEVTNMTNNFDAMKELINYMYETIQYAEINTKSDYCQECGFSGEILLDENNEWYCPNCGNRNHKTLNVCRRTCGYLGDNFWNKGRTQEIKERFVHLDNRVYQGNN

SEQ ID NO: 527 - protein, 722 aa, unidentified
  REGION 1..722: note = Description of Unknown:uncultivated organism sequence
  REGION 1..722: note = Category: MG55 effectors
  REGION 1..722: note = Description: MG55-101 effector
MEVIKRDGSKVAFDGSKIENAILKAMRYGSGIVKPEIASKISHEIEDWHKSSGAASISIYRIEGQVFEKLIEKGEVLTAKAYEGYRKVREFQRETNTIDNAIYGIVNQTNKEAMDENSNKDATVLATQRDLIAGEFSRDYCRRLLLPPKIVQAHDDGIIHFHDMDYYIQKMHNCDLVNLKDMFANGTVINDKLIETPKSLQTACTVATQIVQQVANGQYGGQTISISHLAPYVRVSYKKHLKAVRKEGKEVGIDYTEEQIEKIAKSRLHEEIKAGVQTIQYQINTFSTTNGQAPFLSIFMYLREEPDYIEETALLIEEILKQRYIGMKNPVGAYVTPAFPKLLYVLDDNNVPDDSQYRYLTDLAVKCVSKRMMPDFISAKIMRENYEGQVFPCMGCRSFLSPWKNEKGEYQWYGRFNQGVVTLNLTDVGLSANKNMDSFWKILDERLDLCYEALMLRHESLKGTPSDISPIHWQYGAIARLKPGEKIDSLLDTCYSTLSLGYIGLYECVVALIGQSHTTEEGDALALEIMQKLRNTCDKWKKDTGLGFALYGTPAESTTYTLARALKKRFGIVPGVTDKDYITNSYHVNVREQIDAFSKLGFEAKFQKISSGGAISYVEVTNMTNNFDAMKELINYMYETIQYAEINTKSDYCQECGFSGEILLDENNEWYCPNCGNRNHKTLNVCRRTCGYLGDNFWNKGRTQEIKERFVHLDNRVYQENN

SEQ ID NO: 528 - protein, 378 aa, unidentified
  REGION 1..378: note = Description of Unknown:uncultivated organism sequence
  REGION 1..378: note = Category: MG55 effectors
  REGION 1..378: note = Description: MG55-102 effector
MIAHKVLLYPNQEAEAFLQKQFEYARRDYNRQLETIVRGIQSGKVDLFNLKKWMDAVCAQAKKAPDFYDGESYHYPDIIGWNKKRVQAAAEDYLANPLNKPKYLKHSRYRKIFRLTSAPLDAQRFSVSEDHHLLLGGMHRIKMAEPLRFQTRPIACEISLRNDRYYASFLFAENLKPYLLTGKTAGVTVGSASLVAVADSDGKKVRFALDAKKRTRIHKRIRHLEKVLSHKEIGSAQYEKTRAKLMRAKRKEEDVIRNFVEQTSHTLVKAYDRIGIDDASTQIRLIQHAYAKPYLQEPFSALSNRLQSKAKSHGKTVVKVKDRRSSAPICSQCGERNRKTKGLSNRRWACPHCGAVHDSDLEGAERLCKEALKQERRI

SEQ ID NO: 529 - protein, 722 aa, unidentified
  REGION 1..722: note = Description of Unknown:uncultivated organism sequence
  REGION 1..722: note = Category: MG55 effectors
  REGION 1..722: note = Description: MG55-103 effector
MEVIKRDGSKVAFDGSKIENAILKAMRYGSGIVKPEIASKISHEIEDWHKSSGAASISIYRIEGQVFEKLIEKGEVLTAKAYEGYRKVREFQRETNTIDNAIYGIVNQTNKEAMDENSNKDATVLATQRDLIAGEFSRDYCRRLLLPPKIVQAHDDGIIHFHDMDYYIQKMHNCDLVNLKDMFANGTVINDKLIETPKSLQTACTVATQIVQQVANGQYGGQTISISHLAPYVRVSYKKHLKAVRKEGKEVGIDYTEEQIEKIAKSRLHEEIKAGVQTIQYQINTFSTTNGQAPFLSIFMYLREEPDYIEETALLIEEILKQRYIGMKNPVGAYVTPAFPKLLYVLDDNNVPDDSQYRYLTDLAVKCVSKRMMPDFISAKIMRENYEGQVFPCMGCRSFLSPWKNEKGEYQWYGRFNQGVVTLNLTDVGLSANKNMDSFWKILDERLDLCYEALMLRHESLKGTPSDISPIHWQYGAIARLKPGEKIDSLLDTCYSTLSLGYIGLYECVVALIGQSHTTEEGDALALEIMQKLRNTCDKWKKDTGLGFALYGTPAESTTYTLARALKKRFGVVPGVTDKDYITNSYHVNVREHIDAFSKLGFEAKFQKISSGGAISYVEVTNMTNNFDAMKELINYMYETIQYAEINTKSDYCQECGFSGEILLDENNEWYCPNCGNRNHKTLNVCRRTCGYLGDNFWNKGRTQEIKERFVHLDNRVYQENN

SEQ ID NO: 530 - protein, 335 aa, unidentified
  REGION 1..335: note = Description of Unknown:uncultivated organism sequence
  REGION 1..335: note = Category: MG55 effectors
  REGION 1..335: note = Description: MG55-104 effector
MNIWGCRSFLTPDRIKGNPARALNYKEGKGKYYGRFNMGVATINLVDVALSSGGDFDKFWELFEERTELCHQGLLVRIKRLEHMTTDVAPILWQHGAFARLEKGEHITDLIYGGYATASLGYAGLYECVRYMTGKSHTDNGEGCDFGIQVMQALNNKCNQWKAEENIDYSVYGTPIESTTYKFAKCLKKRFGEIEEVTNHDYITNSYHVNVREEIDAFTKLTLESKFQKLSPGGAISYVEVANLQNNIDAVLAIMKHIYDNIMYAEINTKSDYCQVCGYEGEIQIVEDENHKLVWECPNCKNRNQDKMNVARRTCGYIGTKFWNRAICSITMLFK

SEQ ID NO: 531 - protein, 724 aa, unidentified
  REGION 1..724: note = Description of Unknown:uncultivated organism sequence
  REGION 1..724: note = Category: MG55 effectors
  REGION 1..724: note = Description: MG55-105 effector
MKIIKRNGAEATFDISKIIMAVTKANAAVEEGDRMTPRQIQRIAESVELACQELGRSAAVEEIQDMVEKQIMAHGAFEVAKAYITYRYTRSLVRRANTTDDRILSLIECNNEEAKQENSNKNPIVNSTQRDYMAGEVSRDITSRLLLPKDIVEAHEEGIIHFHDADYYAQHMHNCDLVNLEDMLENGTVITGTLIERPHSFSTACNIATQIIAQVASNQYGGQSISLTHLAPFVQVSRERIRREVAAEMRAINADPGEEKLAELVENRVREEIRRGVQTIQYQVVTLLTTNGQAPFVTVFMYLGEAKNEQERHDLAMIIEETLRQRYQGVKNEKGVWVTPAFPKLIYVLEEDNIHEDSPYWYLTELAARCTAKRMVPDYISEKKMLELKVDKNGEGHCYTCMGCRSFLTPYVDENGKPKYYGRFNQGVVTINLPDVALSSGGNMEKFWKIFDERLELCHRALMCRHERLKGTLSDAAPILWQYGALARLKKGEPIDKLLYGGYSTISLGYAGLYECVKYMTGKSHTDPSATPFALEVMQHMNDACKQWKQMHNIDFSLYGTPLESTTYKFAKCLQKRFGIIPGVTDKGYITNSYHIHVTENIDAFSKLAFESKFQALSPGGAISYVEVPNMQNNIPAVLEVMKFIYDNIMYAELNTKSDYCQVCGYDGEIEIVEHDGKLIWRCPNCGNTDQDKMNVARRTCGYIGTQFWNQGRTQEIKERVLHL

SEQ ID NO: 532 - protein, 729 aa, unidentified
  REGION 1..729: note = Description of Unknown:uncultivated organism sequence
  REGION 1..729: note = Category: MG55 effectors
  REGION 1..729: note = Description: MG55-106 effector
MKIVKRDGHIVDYDSDKIRVAIGKANNEVKGKEKATKDEIEGIIKYIEDLNKKRILVEDIQDIIEEKLMELDRYQLAKKYITYRYTRELVRKANTTDQTIKELIEGENEYWNSENSNKNARVVTTQRDYLAGITSTDITRRFLLPDDIVKAHDEGIIHFHDADYFAQNALHNCELINLEDMLQNGTILNGVMIEKPHRFLTAATIATQIILAVSSSSYGGATVSLTYLAPFVRDSYNYYYKKYKAMNMSESDCKKYAEIDTKKEVADGVQTFNYQVNSMTSTNGQAPFLSVCMYLGETDEYKEELALIIEEFLNQRILGFKNEAGVYITPAFPKLLYILEEDNIREDSKYWYLTVLAAKCTAKRMVPDYISEKIMKQLKVNEKGVSECYPCMGCRSFLTPDRTMSLGNIAHAKNYVEGKGKYYGRFNQGVVTINLPDIALSSKRDMDKFWKIFDERLELCHRALQIRHKRLSNATSDVAPILWQHGALARLKEGESIHELLHHGYSTISLGYAGLYECVKYMTGHSHTDNGEGKKLGLEVMQHLNDAANKWKVEEDIDYSVYGSPIESTTYKFARCLKERFGVVKGITDRDYITNSYHVPVFEEIDAFEKLKLESEFQRLSPGGAVSYIETPNLQNNIESITEVMKFIYDNIMYAELNTKSDYCQKCGYTGEILVDDDMQWYCPNCGNRDHNSLNVARRTCGYIGTNFWNRGRTQEIKERVLHLDNKEA

SEQ ID NO: 533 - protein, 722 aa, unidentified
  REGION 1..722: note = Description of Unknown:uncultivated organism sequence
  REGION 1..722: note = Category: MG55 effectors
  REGION 1..722: note = Description: MG55-107 effector
MEVIKRDGSKVAFDGSKIENAILKAMRYGSGIVKPEIASKISHEIEDWHKSSGAASISIYRIEGQVFEKLIEKGEVLTAKAYEGYRRVREFQRETNTIDNAIYGIVNQTNKEAMDENSNKDATVLATQRDLIAGEFSRDYCRRLLLPPKIVQAHDDGIIHFHDMDYYIQKMHNCDLVNLKDMFANGTVINDKLIETPKSLQTACTVATQIVQQVANGQYGGQTISISHLAPYVRVSYKKHLKAVRKEGKEVGIDYTEEQIEKIAKSRLHEEIKAGVQTIQYQINTFSTTNGQAPFLSIFMYLREEPDYIEETALLIEEILKQRYIGMKNPVGAYVTPAFPKLLYVLDDNNVPDDSQYRYLTDLAVKCVSKRMMPDFISAKIMRENYEGQVFPCMGCRSFLSPWKNEKGEYQWYGRFNQGVVTLNLTDVGLSANKNMDSFWKILDERLDLCYEALMLRHESLKGTPSDISPIHWQYGAIARLKPGEKIDSLLDTCYSTLSLGYIGLYECVVALIGQSHTTEEGDALALEIMQKLRNACDKWKKDTGLGFALYGTPAESTTYTLARALKKRFGVVPGVTDKDYITNSYHVNVREHIDAFSKLGFEAKFQKISSGGAISYVEVTNMTNNFDAMKELINYMYETIQYAEINTKSDYCQECGFSGEILLDENNEWYCPNCGNRNHKTLNVCRRTCGYLGDNFWNKGRTQEIKERFVHLDNRVYQENN

SEQ ID NO: 534 - protein, 491 aa, unidentified
  REGION 1..491: note = Description of Unknown:uncultivated organism sequence
  REGION 1..491: note = Category: MG55 effectors
  REGION 1..491: note = Description: MG55-108 effector
MQVSRERIRREVEAEMKAIDAHPGEEKLAELVENRVREEIRRGVQTIQYQVVTLLTTNGQAPFVTVFMYLGEAKNEQERHDLAMIIEETLRQRYQGVKNEKGVWVTPAFPKLIYVLEEDNIHEDSPYWYLTELAARCTAKRMVPDYISEKKMLELKVDKNGEGHCYTCMGCRSFLTPYVDENGKPKYYGRFNQGVVTINLPDVALSSGGNMEKFWKIFDERLELCHRALMCRHERLKGTLSDAAPILWQYGALARLKKGEPIDKLLYGGYSTISLGYAGLYECVKYMTGKSHTDPSATPFALEIMQHMNDACAKWKQMHNIDFSLYGTPLESTTYKFAKCLQKRFGIIPGVTDKGYITNSYHIHVTEHIDAFSKLAFESKFQALSPGGAISYVEVPNMQNNIPAVLEVMKFIYDNIMYAELNTKSDYCQVCGYDGEIEIVEHDGKLIWRCPNCGNTDQDKMNVARRTCGYIGTQFWNQGRTQEIKERVLHL

SEQ ID NO: 535 - protein, 729 aa, unidentified
  REGION 1..729: note = Description of Unknown:uncultivated organism sequence
  REGION 1..729: note = Category: MG55 effectors
  REGION 1..729: note = Description: MG55-110 effector
MKIVKRDGHIVDYDSDKIRVAIGKANNEVKGKEKATKDEIEGIIKYIEDLNKKRILVEDIQDIIEEKLMELDRYQLAKKYITYRYTRELVRKANTTDQTIKELIEGENEYWNSENSNKNARVVTTQRDYLAGITSTDITRRFLLPDDIVKAHDEGIIHFHDADYFAQNALHNCELINLEDMLQNGTILNGVMIEKPHRFLTAATIATQIILAVSSSSYGGATVSLTYLAPFVRDSYNYYYKKYKAMNMSESDCKKYAEIDTKKEVADGVQTFNYQVNSMTSTNGQAPFLSVCMYLGETDEYKEELALIIEEFLNQRILGFKNEAGVYITPAFPKLLYILEEDNIREDSKYWYLTVLAAKCTAKRMVPDYISEKIMKQLKVNEKGVSECYPCMGCRSFLTPDRTMSLGNIAHAKNYVEGKGKYYGRFNQGVVTINLPDIALSSKRDMDKFWKIFDERLELCHRALQIRHKRLSNATSDVAPILWQHGALARLKEGESIHELLHHGYSTISLGYAGLYECVKYMTGHSHTDNGEGKKLGLEVMQHLNDAANKWKAEEDIDYSVYGSPIESTTYKFARCLKERFGVVKGITDRDYITNSYHVPVFEEIDAFEKLKLESEFQRLSPGGAVSYIETPNLQNNIESITEVMKFIYDNIMYAELNTKSDYCQKCGYTGEILVDEDMQWYCPNCGNRDHNSLNVARRTCGYIGTNFWNRGRTQEIKERVLHLDNKEA

SEQ ID NO: 536 - protein, 417 aa, unidentified
  REGION 1..417: note = Description of Unknown:uncultivated organism sequence
  REGION 1..417: note = Category: MG55 effectors
  REGION 1..417: note = Description: MG55-111 effector
MIRALVLRHEFDLQKLLSASIEVARKGFEWRQLPGRFSDKPRLGCKEVKNISTGNARTDETILRYYKTANVNMKEFHPSNVKVLINKQSIKVNDNNVITIVPFKLTIKNTDGRYNLAEKLCGDTIYVKKKQAKISIPEGSWQIIQAKLDETNIYLTLEKENCSVLNSNYFLGIDCNASGWAAIAASPKRIDSSGNEIKGIVKKFGSGIDHVHKKYRDLNRSFQQKDLLNKLTDRAADIVLDIQRKEAVVIVQCALDNKLAIKMENLTGILSRANSKIYSKELRARLNSWGYYQMQQLIVLQAEEMGVPVFFVNPAFTSQTCSVCGKLGVRESKSVFKCSDENCRYHKGTDADVNAAYNISKSELIVSPGEKGVKEMQGWWKQYWIDNPPLPKPVKIRKSRKKKDPKVENNQEFEAIN

SEQ ID NO: 537 - protein, 729 aa, unidentified
  REGION 1..729: note = Description of Unknown:uncultivated organism sequence
  REGION 1..729: note = Category: MG55 effectors
  REGION 1..729: note = Description: MG55-112 effector
MKIVKRDGHIVDYDPEKIRVAIGKANEEVRGREKATKEEIKEIIKYIEDLNKKRILVEDIQDIIEQKLMEFDKYQLAKKYITYRYTRELVRKANTTDKSIKELIEGESEYWNSENSNKNAEVVTTQRDYLAGITSTDITRRFLLPEDIVEAHDAGIIHFHDADYFAQNALHNCELINLDDMLQNGTVINGVMIEKPHRFLTAATIATQIILAVTSSSYGGATVSLTHLAPFVRLSYEKYLKKYQARNFSKKDCEKYAMQDTKKEVEDGVQTFNYQVNSMTNTNGQAPFLSVNMYLGETEEYKDELAMIIEEFLKQRMLGFKNEKGVYITPAFPKLLYVLEEDNIHEGSKYWYLTKLAAECTAKRMVPDYISEKMMLKYKKNILGDGDCYPCMGCRSFLTPDRMLNIGNISKAKNYVEGKGKYYGRFNQGVVTINLPDVALSADGDMDEFWKIFDERLEICHRALQIRHKRLSNVTSDVAPILWQHGALARLEKGESIHELLHHGYSTISLGYAGLYECVKVMTGHSHTDNGPGKEFGIKVMQHLNDATNKWKKEEDIDYSVYGTPIESTTYKFAKCLKERFGTVKGITDRGYITNSYHVPVFEEIDAFSKLKLESEFQVLSPGGAISYVETPNLQGNIDAVIEVIQFIYDNIMYAELNTKSDYCQNCGYTGEILIDDDLEWYCPNCGNRDHNTLNVARRTCGYIGTNFWNKGRTQEIKERVLHIDNKEA

SEQ ID NO: 538 - protein, 707 aa, unidentified
  REGION 1..707: note = Description of Unknown:uncultivated organism sequence
  REGION 1..707: note = Category: MG55 effectors
  REGION 1..707: note = Description: MG55-113 effector
MKVIKRDGSTVEFNKSKIRDAITKSMKNGSGILLPDIARLIANDAEKYFAKEEDVATIYKIEKYVYDRLVHYGQAETARAYEGYRAVQEFKRNTNTTDDSILELLSKKNEDVMKENSNKNPVVSATQRDLIAGEVSKDIARRKLIPAHIVQAHDEGAIHWHDMDYTISPMFNCCLINLEDMFTNGTVINEKLVEEPKSFGTACTVATQIIAQVSSNQYGGQSITIKHLSKYLKVTEEKAFNHYMEMFNDESIATKLAKDIKMKELKDGVQTIRYQLSTLQTTNGQAPFSTIYLEIEDGNPYEEEMAMICEEMIRQRLEGMKNYKGQEIGEAFPKLVYLLDEHNCLEGGKYDYITKLAAKCTAKRLVPDYQSAKIMRENYEGNTFPPMGCRSHLSPWKDEKGNYKFYGRFNQGVVSLNLPQIAIMADKDMEMFWEMLDRRLELCKDALMTRHKMLLGVTSDSSPIHWQHGAIARLKKGEKIDKLLKDGYSTISLGYVGIAEMVQAMLGVTHTSKEGEKFALEVMNYMKEKCDKWKAETGLGFGLYGTPAESLIYRFCRIDKARFGEIQNVTDKLYYTNSYHVHVCEEIDAFSKLKFESQFHSISNGGCISYIEVPDMNKNVEAVEDIINFIYHNIQYAEINTKSDVCYKCGFNGEMELDRESLTWHCPSCGNDDESELQVMRRTCGYIGSSYWNKGRTAEIGDRVLHL

SEQ ID NO: 539 - protein, 724 aa, unidentified
  REGION 1..724: note = Description of Unknown:uncultivated organism sequence
  REGION 1..724: note = Category: MG55 effectors
  REGION 1..724: note = Description: MG55-114 effector
MKIIKRNGAEENFDISKIIMAVTKANAAVEECDRMTPRQIQRIAESVELACQELGRSAAVEEIQDMVEKQIMAHGAFEVAKAYITYRYTRSLVRRANTTDDRILSLIECNNEEAKQENSNKNPIVNSTQRDYMAGEVSRDITSRLLLPKDIVEAHEEGIIHFHDADYYAQHMHNCDLVNLEDMLENGTVITGTLIERPHSFSTACNIATQIIAQVASNQYGGQSISLTHLAPFVQVSRERIRREVAAEMQAIDAHPGEEKLAELVENRVREEIRRGVQTIQYQVVTLLTTNGQAPFVTVFMYLGEAKNEQERHDLAMIIEETLRQRYQGVKNEKGVWVTPAFPKLIYVLEEDNIHEDSPYWYLTELAARCTAKRMVPDYISEKKMLELKVDKNGEGHCYTCMGCRSFLTPYVDENGKPKYYGRFNQGVVTINLPDVALSSGGNMEKFWKIFDERLELCHRALMCRHERLKGTLSDAAPILWQYGALARLKKGEPIDKLLYGGYSTISLGYAGLYECVKYMTGKSHTDPSATPFALEVMQHMNDACKHWKQMHNIDFSLYGTPLESTTYKFAKCLQKRFGIIPGVTDKGYITNSYHIHVTEHIDAFSKLAFESKFQALSPGGAISYVEVPNMQNNIPAVLEVMKFIYDNIMYAELNTKSDYCQVCGYDGEIEIVEHDGKLIWRCPNCGNTDQDKMNVARRTCGYIGTQFWNQGRTQEIKERVLHL

SEQ ID NO: 540 - protein, 729 aa, unidentified
  REGION 1..729: note = Description of Unknown:uncultivated organism sequence
  REGION 1..729: note = Category: MG55 effectors
  REGION 1..729: note = Description: MG55-115 effector
MKIVKRDGHIVDYDPQKIRIAIGKANNEVRGKEKVSKEQIDEIIKYIEELNKKRILVEDIQDIIEEKLMSYGKYTLAKKYITYRYTRELVRKANTTDKSIKELIEGENEYWNSENSNKNAEVVTTQRDYLAGITSTDITRRFLLPEDIVEAHDKGIIHFHDADYFAQNALHNCELINLDDMLQNGTVINGVMIEKPHRFITAATIATQIILAVTSSSYGGATVSLTHLAPFVRLSYEKYLKKYQSRNLSKKDCEKFAMQDTRKEVEDGVQTFNYQVNSMTNTNGQAPFLSVCMYLGETDEYKEELAMIIEEFLKQRILGFKNEKGVYITPAFPKLLYVLEEDNIHEDSKYWYLTKLAAECTAKRMVPDYISEKVMKELKKNELGNGECYPCMGCRSFLTPDRTMSLGNIAHAKNYVEGKGKYYGRFNQGVVTINLPDVALSADGDMDKFWKIFDERLELCHRALQIRHKRLSNATSDVAPILWQHGALARLKKGESIHELLHHGYSTISLGYAGLYECVKVMTGHSHTDNGEGKEFGLKVMQHLNDATAKWKAEEDIDYSVYGSPIESTTYKFAKCLKERFGTIKGITDRGYVTNSYHVPVFEEIDAFSKLKLESEFQRLSPGGAISYIETPNLQNNLDAVLEVIQFIYDNIMYAELNTKSDYCQKCGYTGEILIDDNLEWYCPNCGNRDHNTLNVARRTCGYIGTNFWNKGRTQEIKERVLHLDNKNA

SEQ ID NO: 541 - protein, 399 aa, unidentified
  REGION 1..399: note = Description of Unknown:uncultivated organism sequence
  REGION 1..399: note = Category: MG55 effectors
  REGION 1..399: note = Description: MG55-116 effector
MESRAWCNFILVQKKKIDRREAYPPRYLKGYPGFPGSQRYAAAAVLADSLTKLEQAAREQSAKTPVRFANLSSEDWTAIQERFSPATPNEANEKLRPRTARQTVSRRFAALRKANPQWSPAQLSEEILAGIFRCAEKLKTHLVAKGFDDRRAVIKLANLYNVAVALALEPVRAAGDYVSFYQEEAPKRKAFGDVRGGLHQPSDDSAAIQITGFSVGEDGTPNYNGLLVCKQADDRKEDSWVFLYCHQEGQAFQLADPNAKPRGKLLTDWIGFASRGGSRKKAQASVKQLVRGQVWVSEKTPPTVLPLAFGSRQGREYLWHFDRNLRSEGEWVLGNPADGVLLNAEGRKEFFGKWFPFMHEEKRSLPGFVVGLTFREAIFAHTRTFAKWLRGEADNWPPE

SEQ ID NO: 542 - protein, 729 aa, unidentified
  REGION 1..729: note = Description of Unknown:uncultivated organism sequence
  REGION 1..729: note = Category: MG55 effectors
  REGION 1..729: note = Description: MG55-117 effector
MKIVKRDGHIVDYDQQKIRIARGKSNNEVRGKEKVSKEQIDEIIKYIEELNKKRILVEDIQDIIEEKLMSYGKYTLAKKYITYRYTRELVRKANTTDKSIKELIEGENEYWNSENSNKNAEVVTTQRDYLAGITSTDITRRFLLPEDIVEAHDKGIIHFHDADYFAQNALHNCELINLDDMLQNGTVINGVMIEKPHRFITAATIATQIILAVTSSSYGGATVSLTHLAPFVRLSYEKYLKKYQSRNLSKKDCEKFAMQDTRKEVEDGVQTFNYQVNSMTNTNGQAPFLSVCMYLGETDEYKEELAMIIEEFLKQRILGFKNEKGVYITPAFPKLLYVLEEDNIHEDSKYWYLTKLAAECTAKRMVPDYISEKVMKELKKNELGNGECYPCMGCRSFLTPDRTMSLGNIAHAKNYVEGKGKYYGRFNQGVVTINLPDVALSADGDMDKFWKIFDERLELCHRALQIRHKRLSNATSDVAPILWQHGALARLKKGESIHELLHHGYSTISLGYAGLYECVKVMTGHSHTDNGEGKEFGLKVMQHLNDATAKWKAEEDIDYSVYGSPIESTTYKFAKCLKERFGTIKGITDRGYVTNSYHVPVFEEIDAFSKLKLESEFQRLSPGGAISYIETPNLQNNLDAVLEVIQFIYDNIMYAELNTKSDYCQKCGYTGEILIDDNLEWYCPNCGNRDHNTLNVARRTCGYIGTNFWNKGRTQEIKERVLHLDNKNA

SEQ ID NO: 543 - protein, 729 aa, unidentified
  REGION 1..729: note = Description of Unknown:uncultivated organism sequence
  REGION 1..729: note = Category: MG55 effectors
  REGION 1..729: note = Description: MG55-118 effector
MKIVKRDGHIVDYDPEKIRVAIGKANEEVRGREKATKEEIKEIIKYIEDLNKKRILVEDIQDIIEQKLMEFDKYQLAKKYITYRYTRELVRKANTTDKSIKELIEGENEYWNSENSNKNAEVVTTQRDYLAGITSTDITRRFLLPEDIVEAHDAGIIHFHDADYFAQNALHNCELINLDDMLQYGTVINGVMIEKPHRFLTAATIATQIILAVTSSSYGGATVSLTHLAPFVRLSYEKYLKKYQARNFSKKDCEKYAMQDTKKEIEDGVQTFNYQVNSMTNTNGQAPFLSVCMYLGETEEYKDELAMIIEEFLKQRILGFKNEKGVYITPAFPKLLYVLEEDNIREGSKYWYLTKLAAECTAKRMVPDYISEKMMLKYKKNILGDGDCYPCMGCRSFLTPDRMLNIGNIAKAKNYVEGKGKYYGRFNQGVVTINLPDVALSADGDMDEFWKIFDERLELCHRALQIRHKRLSNVTSDVAPILWQHGALARLEKGESIHELLHHGYSTISLGYAGLYECVKVMTGHSHTDNGPGKEFGLKVMQHLNDATSKWKAEEDLDYSVYGTPIESTTYKFAKCLKERFGTVKGITDRNYITNSYHVPVFEEIDAFSKLKLESEFQVLSPGGAISYVETPNLQGNIDAVIEIIQFIYDNIMYAELNTKSDYCQQCGYTGEILIDDNLEWYCPNCGNRDHNTLNVARRTCGYIGTNFWNKGRTQEIKERVLHIDNKEA

SEQ ID NO: 544 - protein, 724 aa, unidentified
  REGION 1..724: note = Description of Unknown:uncultivated organism sequence
  REGION 1..724: note = Category: MG55 effectors
  REGION 1..724: note = Description: MG55-119 effector
MKIIKRNGAEATFDISKIIMAITKANAAVEECDRMTPRQIQRIAESVELACQELGRSAAVEEIQDMVEKQIMAHGAFEVAKAYITYRYTRSLVRRANTTDDRILSLIECNNEEAKQENSNKNPIVNSTQRDYMAGEVSRDITSRLLLPKDIVEAHEEGIIHFHDADYYAQHMHNCDLVNLEDMLENGTVITGTLIERPHSFSTACNIATQIIAQVASNQYGGQSISLTHLAPFVQVSRERIRREVEAEMQAIDAHPGEEKLAELVENRVREEIRRGVQTIQYQVVTLLTTNGQAPFVTVFMYLGEAKNEQERHDLAMIIEETLRQRYQGVKNEKGVWVTPAFPKLIYVLEEDNIHEDSPYWYLTELAARCTAKRMVPDYISEKKMLELKVDKNGEGHCYTCMGCRSFLTPYVDENGKPKYYGRFNQGVVTINLPDVALSSGGNMEKFWKIFDERLELCHRALMCRHERLKGTLSDAAPILWQYGALARLKKGEPIDKLLYGGYSTISLGYAGLYECVKYMTGKSHTDPSATPFALEIMQHMNDACAKWKQMHNIDFSLYGTPLESTTYKFAKCLQKRFGIIPGVTDKGYITNSYHIHVTEKIDAFSKLAFESKFQALSPGGAISYVEVPNMQNNIPAVLEVMKFIYDNIMYAELNTKSDYCQVCGYDGEIEIVEHDGKLIWRCPNCGNTDQDKMNVARRTCGYIGTQFWNQGRTQEIKERVLHL

SEQ ID NO: 545 - protein, 722 aa, unidentified
  REGION 1..722: note = Description of Unknown:uncultivated organism sequence
  REGION 1..722: note = Category: MG55 effectors
  REGION 1..722: note = Description: MG55-120 effector
MRMKIIKRSGSEDTFDARKITAAVTKANYEVPTKERLSKEQIESITADVENICLDMNRALSVEEIQDLVEEQIMDRRAFAVARKYITYRYNRALLRKANSTDKQILSLLECNNEMVKQENSNKNPTVNSVQRDYMAGEVSKDITKRFLLPSEIVRAHEQGIIHFHDSDYFAQHMHNCCLVNLEDMLQNGTVISETMIEKPKSFSTACNIATQSIAQIASSQYGGQSISLTHLAPFVDISRQKYKKQVENELKEAGLSYNSKQVDEIAEIRVRDEIKRGVQMIQYQVITLMTTNGQAPFVSVFMYLDEAPEGRLREDLALIMEEILRQRMQGVKNEKGVYITPAFPKLLYVLEEDNVREGSKYWYLTQLAAKCTAKRMVPDYISEKIMKKMKDGNCYPCMGCRSFLTVYHDEKDRPKFYGRFNQGVVTINLVDVACSSDGDEEAFWKILDKRLELCKKALMYRHNRLKGTPSDVAPILWQYGALARLKKGEVIDKLLYNGYSTISLGYAGLCECTRYMTGKSHTDPSATPFALKVMEKLNDACSRWREEENIDFSLYGTPLESTTYKFAKCLQKRFGIIKGVTDKNYITNSYHVHVTEEINAFDKLKFEAQFQNLSPGGAVSYVEVPNMENNIDAVLQVMQFIYDNIMYAELNTKSDYCQVCDYSGQIEIVNDEHGKLIWKCPNCGNTDQDKMNVARRTCGYIGTQFWNQGRTQEIKERVLHL

SEQ ID NO: 546 - protein, 708 aa, unidentified
  REGION 1..708: note = Description of Unknown:uncultivated organism sequence
  REGION 1..708: note = Category: MG55 effectors
  REGION 1..708: note = Description: MG55-121 effector
MKVIKRDGSTADFDSSKIIVAIQKANQVVEPEDRIDQERIEAIAHYVESKNRMRLLVEDIQDMVEHQLMDEGKFNLAKSYIIYRYTRALVRKANTTDESILSLIRNSNKDVMEENSNKNAVMASTQRDLIAGEVSKDLTRRLILPEKISKAHDEGAIHFHDADYFVQPIFNCCLINVGDMLDNGTVMNGKLIESPKSFQVACTVMTQIIASVASSQYGGQSVDIRHLGKYLRRSYEKFKLTIKAEVGDSVADEVVERLTKRRLQDELRSGVQTIQYQINTLMTTNGQSPFVTIFLNLQADDEYLEENAMIVEEILRQRLEGIKNDKGVFVTPAFPKLVYVLDEHNCLKGGKYDYITKLAVKCSAKRLYPDYISAKKMRENYEGNVFAPMGCRSFLAAWKDDEGNYKFEGRFNQGVVSLNLPQVAILAHGDEEKFWPLLDERLQLCYEALMCRHNSLKGIRSDVSPVHWQYGAIARLEKGEVIDKYLEKGYSTISLGYIGLYEMTKLMKDVSHTTPEGEEFALRVMKYLRAACDKWKKETGLGFALYGTPAESLCYRFARIDKERFGTIADVTDKGYYTNSYHVDVREDIDAFSKFNFESQFQRISSGGAISYVEIPNMRHNLEAMEDVVRFIYDNIQYAEFNTKSDYCHVCGFDGEIIINDDLEWECPNCGNKNQTLMNVTRRTCGYLGENFWNVGKTKEIKSRVLHL

SEQ ID NO: 547 - protein, 708 aa, unidentified
  REGION 1..708: note = Description of Unknown:uncultivated organism sequence
  REGION 1..708: note = Category: MG55 effectors
  REGION 1..708: note = Description: MG55-122 effector
MRVIKRDGRTVEYDRNKILIAIRKANAEVDTFERVNDDMIDGIVAGIENMKRDTMQVEDIQDIIEQKLMAAGKFDLAKKYIIYRYTRELVRKANTTDDSIMSLLQNSNKDVMEENSNKNAYVASTQRDLIAGEVSKDLTKRILLPEKITKAHEDGVLHFHDMDYFIQPIFNCCLINIGDMLDNGTVMNGKLIESPKSFQVACTVMTQIISAVASSQYGGQSVDTRHLGKYLRKSADKYRKHYTERYAGKIAPDVIEEFVKERVNDELRSGVQTIQYQINTLMTTNGQSPFVTLFLNLDPKDEYIKENAMIIEEILRQRLEGIKNEKGVYVTPAFPKLIYVLDEHNALKGGEYDYITKLAVRCSAKRMYPDYISAKKMRENYEGNVFSCMGCRSFLTPWKDENGNYKFEGRFNQGVVSLNLPQIGILAKGDMEYFWQLLEERLSLCFEALMCRHRALEGVTSDVSPIHWQYGAIARLQKGEKIDKLLHGGYSTISLGYIGLYEVTKLMTGESQTTEKGSQFAKALMNRLRRATDTWKEETGIHFGLYGTPAESLCYRFAEIDKKRFGEIEDVTDKGYYTNSYHVDVREKIDAFSKFEFEAQFQVISSGGAISYVEVPNMQNNLPALEEVVKYIYEHIQYAEFNTKSDYCHVCGYDGEIIINDNLEWECPNCGNKDHDKMNVTRRTCGYLGENFWNVGKTKEINARVLHL

SEQ ID NO: 548 - protein, 708 aa, unidentified
  REGION 1..708: note = Description of Unknown:uncultivated organism sequence
  REGION 1..708: note = Category: MG55 effectors
  REGION 1..708: note = Description: MG55-123 effector
MRVIKRDGRTVEYDRNKILIAIRKANAEVDTFERVNDDMIDGIVAGIENMKRDTMQVEDIQDIIEQKLMAAGKFDLAKKYIIYRYTRELVRKANTTDDSIMSLLQNSNKDVMEENSNKNAYVASTQRDLIAGEVSKDLTKRILLPEKITKAHEEGVLHFHDMDYFIQPIFNCCLINIGDMLDNGTVMNGKLIESPKSFQVACTVMTQIISAVASSQYGGQSVDTRHLGKYLRKSADKYRKHYTERYAGKIAPDIIEEFVKERVNDELRSGVQTIQYQINTLMTTNGQSPFVTLFLNLDPKDEYIKENAMIIEEILRQRLEGIKNEKGVYVTPAFPKLIYVLDEHNALKGGEYDYITKLAVRCSAKRMYPDYISAKKMRENYEGNVFSCMGCRSFLTPWKDENGNYKFEGRFNQGVVSLNLPQIGILAKGDMEYFWQLLEERLSLCFEALMCRHRALEGVTSDVSPIHWQYGAIARLQKGEKIDKLLHGGYSTISLGYIGLYEVTKLMTGESQTTEKGSQFAKALMNRLRRATDTWKEETGIHFGLYGTPAESLCYRFAEIDKKRFGEIEDVTDKGYYTNSYHVDVREKIDAFSKFEFEAQFQVISSGGAISYVEVPNMQNNLPALEEVVKYIYEHIQYAEFNTKSDYCHVCGYDGEIIINDNLEWECPNCGNKDHDKMNVTRRTCGYLGENFWNVGKTKEINARVLHL

SEQ ID NO: 549 - protein, 720 aa, unidentified
  REGION 1..720: note = Description of Unknown:uncultivated organism sequence
  REGION 1..720: note = Category: MG55 effectors
  REGION 1..720: note = Description: MG55-124 effector
MKIIKRSGAEAVFDISKIIIAINKANHEVVEAERLTADQIKEIAQYIEDSCKDANHALNVEDIQDLVEDQLMDKRAFSVARKYITYRYKRALVRKSNSTDEQILSLIECNNEEVKQENSNKDSTVNSVQRDYMAGEVSKDITRRFLLPEDIVEAHEQGIIHFHDADYFAQHMHNCDLVNLEDMLQNGTVISGTRIDKPHSFSTACNIATQIIAQVASSQYGGQSISLAHLVPFVQISREKIHAELVQTLKESDVELSEEKINSIVERRLHAEIERGVQVIQYQVVTLMTTNGQSPFVTVFMYLNEAKNEQEKKDLAMIIEEVLDQRYQGVKNEDGVWITPAFPKLIYVLEEDNIHEDSEYYYLTKKAAKCTAKRMVPDYISEKKMKELKDGNCYTCMGCRSFLTVYHDEDGKPKFYGRFNQGVVTLNLVDLACSSGGDFEKFWKLFDERLDLCYRALMARHNRLKGTPSDVAPILWQYGALARLKKGETIDKLLYGGYSTISLGYAGLCECTRYMTGKPHTDPAATPFALKVMQRLNDACKEWKEKENIDFSVYGTPLESTTYKFAKCLQKRFGVIPGVTDKNYITNSYHVHVTENIDAFTKLKFESQFQALSPGGAISYVEVPNMQDNLDAVLSVMKFIYENIMYAELNTKSDYCQVCGYDGEIQIVKDDDGKLVWECPHCHNRDQDKMNVARRTCGYIGSQFWNQGRTQEIKERVLHL

SEQ ID NO: 550 - protein, 720 aa, unidentified
  REGION 1..720: note = Description of Unknown:uncultivated organism sequence
  REGION 1..720: note = Category: MG55 effectors
  REGION 1..720: note = Description: MG55-125 effector
MKIIKRSGTEAVFDISKIIIAINKANHEVVEAERLTADQIKEIAQYIEDSCKDANHALNVEDIQDLVEDQLMDKRAFSVARKYITYRYKRALVRKSNSTDEQILSLIECNNEEVKQENSNKDSTVNSVQRDYMAGEVSKDITRRFLLPEDIVEAHEQGIIHFHDADYFAQHMHNCDLVNLEDMLQNGTVISGTRIDKPHSFSTACNIATQIIAQVASSQYGGQSISLAHLVPFVQISREKIHAELVQTLKESDVELSEEKINSIVERRLHAEIERGVQVIQYQVVTLMTTNGQSPFVTVFMYLNEAKNEQEKKDLAMIIEEVLDQRYQGVKNEDGVWITPAFPKLIYVLEEDNIHEDSEYYYLTKKAAKCTAKRMVPDYISEKKMKELKDGNCYTCMGCRSFLTVYHDEDGKPKFYGRFNQGVVTLNLVDLACSSGGDFEKFWKLFDERLDLCYRALMARHNRLKGTPSDVAPILWQYGALARLKKGETIDKLLYGGYSTISLGYAGLCECTRYMTGKPHTDPAATPFALKVMQRLNDACKEWKEKENIDFSVYGTPLESTTYKFAKCLQKRFGVIPGVTDKNYITNSYHVHVTENIDAFTKLKFESQFQALSPGGAISYVEVPNMQDNLDAVLSVMKFIYENIMYAELNTKSDYCQVCGYDGEIQIVKDDDGKLVWECPHCHNRDQDKMNVARRTCGYIGSQFWNQGRTQEIKERVLHL

SEQ ID NO: 551 - protein, 720 aa, unidentified
  REGION 1..720: note = Description of Unknown:uncultivated organism sequence
  REGION 1..720: note = Category: MG55 effectors
  REGION 1..720: note = Description: MG55-126 effector
MKIIKRSGAEAVFDISKIIIAINKANHEVVEAERLTADQIKEIAQYIEDSCKDANHALNVEDIQDLVEDQLMDKRAFSVARKYITYRYKRALVRKSNSTDEQILSLIECNNEEVKQENSNKDSTVNSVQRDYMAGEVSKDITRRFLLPEDIVAAHEQGIIHFHDADYFAQHMHNCDLVNLEDMLQNGTVISGTRIDKPHSFSTACNIATQIIAQVASSQYGGQSISLAHLVPFVQISREKIHAELVQTLKESDVELSEEKINSIVERRLHAEIERGVQVIQYQVVTLMTTNGQSPFVTVFMYLNEAKNEQEKKDLAMIIEEVLDQRYQGVKNEDGVWITPAFPKLIYVLEEDNIHEDSEYYYLTKKAAKCTAKRMVPDYISEKKMKELKDGNCYTCMGCRSFLTVYHDEDGKPKFYGRFNQGVVTLNLVDLACSSGGDFEKFWKLFDERLDLCYRALMARHNRLKGTPSDVAPILWQYGALARLKKGETIDKLLYGGYSTISLGYAGLCECTRYMTGKPHTDPAATPFALKVMQRLNDACKEWKEKENIDFSVYGTPLESTTYKFAKCLQKRFGVIPGVTDKNYITNSYHVHVTENIDAFTKLKFESQFQALSPGGAISYVEVPNMQDNLDAVLSVMKFIYENIMYAELNTKSDYCQVCGYDGEIQIVKDDDGKLVWECPHCHNRDQDKMNVARRTCGYIGSQFWNQGRTQEIKERVLHL

SEQ ID NO: 552 - protein, 720 aa, unidentified
  REGION 1..720: note = Description of Unknown:uncultivated organism sequence
  REGION 1..720: note = Category: MG55 effectors
  REGION 1..720: note = Description: MG55-127 effector
MKIIKRSGAEAVFDISKIIIAINKANHEVVEAERLTADQIKEIAQYIEDSCKDANHALNVEDIQDLVEDQLMDKRAFSVARKYITYRYKRALVRKSNSTDEQILSLIECNNEEVKQENSNKDSTVNSVQRDYMAGEVSKDITRRFLLPEDIVAAHEQGIIHFHDADYFAQHMHNCDLVNLEDMLQNGTVISGTRIDKPHSFSTACNIATQIIAQVASSQYGGQSISLAHLVPFVQISREKIHAELVQTLKESDVELSEEKINSIVERRLHAEIERGVQVIQYQVVTLMTTNGQSPFVTVFMYLNEAKNEQEKKDLAMIIEEVLDQRYQGVKNEDGVWITPAFPKLIYVLEEDNIHEDSEYYYLTKKAAKCTAKRMVPDYISEKKMKELKEGNCYTCMGCRSFLTVYHDEDGKPKFYGRFNQGVVTLNLVDLACSSGGDFEKFWKLFDERLDLCYRALMARHNRLKGTPSDVAPILWQYGALARLKKGETIDKLLYGGYSTISLGYAGLCECTRYMTGKPHTDPAATPFALKVMQRLNDACKEWKEKENIDFSVYGTPLESTTYKFAKCLQKRFGVIPGVTDKNYITNSYHVHVTENIDAFTKLKFESQFQALSPGGAISYVEVPNMQDNLDAVLSVMKFIYENIMYAELNTKSDYCQVCGYDGEIQIVKDDDGKLVWECPHCHNRDQDKMNVARRTCGYIGSQFWNQGRTQEIKERVLHL

SEQ ID NO: 553 - protein, 720 aa, unidentified
  REGION 1..720: note = Description of Unknown:uncultivated organism sequence
  REGION 1..720: note = Category: MG55 effectors
  REGION 1..720: note = Description: MG55-128 effector
MKIIKRSGAEAVFDISKIIIAINKANHEVVEAERLTADQIKAIAQYIEDSCKDANHALNVEDIQDLVEDQLMDKRAFSVARKYITYRYKRALVRKSNSTDEQILSLIECNNEEVKQENSNKDSTVNSVQRDYMAGEVSKDITRRFLLPEDIVEAHEQGIIHFHDADYFAQHMHNCDLVNLEDMLQNGTVISGTRIDKPHSFSTACNIATQIIAQVASSQYGGQSISLAHLVPFVQISREKIHAELVQTLKESDVELSEEKINSIVERRLHAEIERGVQVIQYQVVTLMTTNGQSPFVTVFMYLNEAKNEQEKKDLAMIIEEVLDQRYQGVKNEDGVWITPAFPKLIYVLEEDNIHEDSEYYYLTKKAAKCTAKRMVPDYISEKKMKELKDGNCYTCMGCRSFLTVYHDEDGKPKFYGRFNQGVVTLNLVDLACSSGGDFEKFWKLFDERLDLCYRALMARHNRLKGTPSDVAPILWQYGALARLKKGETIDKLLYGGYSTISLGYAGLCECTRYMTGKPHTDPAATPFALKVMQRLNDACKEWKEKENIDFSVYGTPLESTTYKFAKCLQKRFGVIPGVTDKNYITNSYHVHVTENIDAFTKLKFESQFQALSPGGAISYVEVPNMQDNLDAVLSVMKFIYENIMYAELNTKSDYCQVCGYDGEIQIVKDDDGKLVWECPHCHNRDQDKMNVARRTCGYIGSQFWNQGRTQEIKERVLHL

SEQ ID NO: 554 - protein, 720 aa, unidentified
  REGION 1..720: note = Description of Unknown:uncultivated organism sequence
  REGION 1..720: note = Category: MG55 effectors
  REGION 1..720: note = Description: MG55-129 effector
MKIIKRSGTEAVFDISKIIIAINKANHEVVEAERLTADQIKEIAQYIEDSCKDANHALNVEDIQDLVEDQLMDKRAFSVARKYITYRYKRALVRKSNSTDEQILSLIECNNEEVKQENSNKDSTVNSVQRDYMAGEVSKDITRRFLLPEDIVEAHEQGIIHFHDADYFAQHMHNCDLVNLEDMLQNGTVISGTRIDKPHSFSTACNIATQIIAQVASSQYGGQSISLAHLVPFVQISREKIHAELVQTLKESDVELSEEKINSIVERRLHAEIERGVQVIQYQVVTLMTTNGQSPFVTVFMYLNEAKNEQEKKDLAMIIEEVLDQRYQGVKNEDGVWITPAFPKLIYVLEEDNIHEDSEYYYLTKKAAKCTAKRMVPDYISEKKMKELKDGNCYTCMGCRSFLTVYHDEDGKPKFYGRFNQGVVTLNLVDLACSSGGDFEKFWKLFDERLDLCYRALMARHNRLKGTPSDVAPILWQYGALARLKKGETIDKLLYGGYSTISLGYAGLCECTRYMTGKPHTDPAAAPFALKVMQRLNDACKEWKEKENIDFSVYGTPLESTTYKFAKCLQKRFGVIPGVTDKNYITNSYHVHVTENIDAFTKLKFESQFQALSPGGAISYVEVPNMQDNLEAVLSVMKFIYENIMYAELNTKSDYCQVCGYDGEIQIVKDDDGKLVWECPHCHNRDQDKMNVARRTCGYIGSQFWNQGRTQEIKERVLHL

SEQ ID NO: 555 - protein, 972 aa, unidentified
  REGION 1..972: note = Description of Unknown:uncultivated organism sequence
  REGION 1..972: note = Category: MG55 effectors
  REGION 1..972: note = Description: MG55-130 effector
MQIGLDIGSTTIKIAVLDDAGQLQFSKYERHYSQIAEKMQQLLAELHIKMPLLKTARLAISGSAGIGIADSCGLQFVQEVFAEKVCTERLNPGTEAVIELGGEDAKLLFLGRHFDARMNDSCAGGTGAFIDQMASLLSVPTEAMNELAQQASTRYTIASRCGVFAKSDIQPLLNQGAAKADLAASIFDAVASQAVTGLAKGRPITGKVLYLGGPLTFMSELRHSFDKILKIEGYCPENSLYYVAMGAAFCAENKVDLTELPAKLAAVGAQRDFDHLEPLFANPAEYDEFMERHSKERIEPGDISAATEAYIGMDAGSTTIKIAVISPSGQLLDSSYQGNKGNPVIAIKEYLQNFYIKYPHCRILGSAVTGYGEDLIRNGFSVDYGIVETMAHFIAAKTLQPDVDFILDIGGQDIKCLKIHNGCIDNIFLNEACSSGCGSFLQTFAEILGYSAEEFARIGLFADKPVDLGSRCTVFMNSSVKQAQKDGATVANISAGLSLSIVKNALYKVIRPGSKESIGKHIVVQGGTFLNDCVLRAFEKEMGLKVVRPNIAGLMGAYGAAIYARSRHQETGHVSTLADAAALENFVHEVKAVTCGLCSNHCHLTVNTFASGKRFISGNRCERPVTHCAPDDTFNLYRQKLQLLESLKGVPGKRGKIGLPMGLNMYELLPFWHAFFTRLGFEVITSPIYDKTIFQKGQNTIPSDTVCYPAKLMHGHIKWLLENGINTIFYPCMTYNVDENSAENCYNCPVVAYYPEVLHANMHDLDNATYIFDYLGLGHKKVLLKKLQQICKEHFPDIGSSELKAALQEAYAAYNKFEAQVKELGQTIINTARSQHKPIVVLAGRPYHIDPKVNHSIDRLITTMGAALVSEDAVSSHISMQELNEDLQVLNQWTYHSRLYAAAKYVSRSSDMYMVHLVSFGCGCDAITADECRRILEEHGQIYTQIKIDDIDNLGAAKIRLRSLFAAAGLES

SEQ ID NO: 556 - protein, 708 aa, unidentified
  REGION 1..708: note = Description of Unknown:uncultivated organism sequence
  REGION 1..708: note = Category: MG55 effectors
  REGION 1..708: note = Description: MG55-131 effector
MRVIKRDGRTVEYDRNKILIAIRKANAEVDTFERVNDDMIDGIVAGIENMKRDTMQVEDIQDIIEQKLMAAGKFDLAKKYIIYRYTRELVRKANTTDDSIMSLLQNSNKDVMEENSNKNAYVASTQRDLIAGEVSKDLTKRILLPEKITKAHEEGVLHFHDMDYFIQPIFNCCLINIGDMLDNGTVMNGKLIESPKSFQVACTVMTQIISAVASSQYGGQSVDTRHLGKYLRKSADKYRKHYTERYAGKIAPDVIEEFVKERVNDELRSGVQTIQYQINTLMTTNGQSPFVTLFLNLDPKDEYIKENAMIIEEILRQRLEGIKNEKGVYVTPAFPKLIYVLDEHNALKGGEYDYITKLAVRCSAKRMYPDYISAKKMRENYEGNVFSCMGCRSFLTPWKDENGNYKFEGRFNQGVVSLNLPQIGILAKGDMEYFWQLLEERLSLCFEALMCRHRALEGVTSDVSPIHWQYGAIARLQKGEKIDKLLHGGYSTISLGYIGLYEVTKLMTGESQTTEKGSQFAKALMNRLRRATDTWKEETGIHFGLYGTPAESLCYRFAEIDKKRFGEIEDVTDKGYYTNSYHVDVREKIDAFSKFEFEAQFQVISSGGAISYVEVPNMQNNLPALEEVVKYIYEHIQYAEFNTKSDYCHVCGYDGEIIINDNLEWECPNCGNKDHDKMNVTRRTCGYLGENFWNVGKTKEINARVLHL

SEQ ID NO: 557 - protein, 723 aa, unidentified
  REGION 1..723: note = Description of Unknown:uncultivated organism sequence
  REGION 1..723: note = Category: MG55 effectors
  REGION 1..723: note = Description: MG55-132 effector
MRIIKRNGSEEDFNIEKIINAVKKANGSGEHKFLTDEQIEDVADYVEYKCNKIRRAVSVEEIQDMVEDQLMAKGAFELARRYVRYRYNRSLVRKANTTDNRILSLIECNNEEVKQENSNKNPTVNSVQRDYMAGEVSRDLTRRMLLPADIVEADKEGIIHFHDSDYFAQHMHNCDLVNLEDMLQNGTVISDTLIERPHSFSTACNIATQIIAQVASNQYGGQSISLAHLAPFVQVSREKIRRETLAEIEELGVHPTEEKINDIVEQRLRKEVNRGVQTIQYQVVTLLTTNGQAPFVTVFMYLNEAKNEQEKHDLAMIIEETLKQRHKGVKNEKGVWITPAFPKLIYVLEEDNITEDSKYWYLTELAAKCTAKRMVPDYISEKVMLQSKIDKNGEGHCFTCMGCRSFLTPYVDENGKPKYYGRFNQGVVTVNLIDIGLSAGKDLDKFWKIFDERMELCHRALQCRHERLTGTLSDAAPILWQYGALARLKKGEKIDKLLHGGYSTLSLGYAGLWECVYSLIGKKLTEKEGKELGLEIMQKLNDYCAKWKKEEDIDYSIYGTPLESTTYKFAKCLQKRFGIIKGVTDKNYITNSYHVHVTENIDAFSKLKLESEFQALSPGGAISYVEVPNMQDNIPAVLQVIKFIYDNIMYAELNTKSDYCQVCGYDGEIKIVHDDGKLVWECPNCGNRDQDKMNVARRTCGYIGTQFWNQGRTQEIEERVLHL

SEQ ID NO: 558 - protein, 708 aa, unidentified
  REGION 1..708: note = Description of Unknown:uncultivated organism sequence
  REGION 1..708: note = Category: MG55 effectors
  REGION 1..708: note = Description: MG55-133 effector
MKVIKRDGSTADFDSSKIIVAIQKANQVVEPEDRIDQERIEAIAHYVESKNRMRLLVEDIQDMVEHQLMDEGKFNLAKSYIIYRYTRALVRKANTTDESILSLIRNSNKDVMEENSNKNAVMASTQRDLIAGEVSKDLTRRLILPEKISKAHDEGAIHFHDADYFVQPIFNCCLINVSDMLDNGTVMNGKLIESPKSFQVACTVMTQIIASVASSQYGGQSVDIRHLGKYLRRSYEKFKLTIKAEVGDSVADEVVERLTKRRLQDELRSGVQTIQYQINTLMTTNGQSPFVTIFLNLQADDEYLEENAMIVEEILRQRLEGIKNDKGVFVTPAFPKLVYVLDEHNCLKGGKYDYITKLAVKCSAKRLYPDYISAKKMRENYEGNVFAPMGCRSFLAAWKDDEGNYKFEGRFNQGVVSLNLPQVAILAHGDEEKFWPLLDERLQLCYEALMCRHNSLKGIRSDVSPVHWQYGAIARLEKGEVIDKYLEKGYSTISLGYIGLYEMTKLMKDVSHTTPEGEEFALRVMKYLRAACDKWKKETGLGFALYGTPAESLCYRFARIDKERFGTIADVTDKGYYTNSYHVDVREDIDAFSKFNFESQFQRISSGGAISYVEIPNMRHNLEAMEDVVRFIYDNIQYAEFNTKSDYCHVCGFDGEIIINDDLEWECPNCGNKNQTLMNVTRRTCGYLGENFWNVGKTKEIKSRVLHL

SEQ ID NO: 559 - protein, 1416 aa, unidentified
  REGION 1..1416: note = Description of Unknown:uncultivated organism sequence
  REGION 1..1416: note = Category: MG55 effectors
  REGION 1..1416: note = Description: MG55-134 effector
MKLDFNTLGIDIGSTTVKIAILNKDGEIIFSDYQRHYANIQETLAKIIDEAYEEFGDIPVSPMITGSGGLTLSKHMEIPFVQEVVAVATSLKDYAPRTDVAIELGGEDAKIIYFTGGIDQRMNGICAGGTGSFIDQMATLLKTDAAGLNEYAKNYKAIYPIAARCGVFAKTDIQPLINEGATKEDLSASIFQAVVNQTISGLACGKPIKGNVAFLGGPLHFLTELKQAFIRTLGLEGDAIIAPEHSHLFAASGAAMNAHADVQSSLGELKEKLSHKIELEFEVTRMEPLFASEKEYEDFTERHNKHNVRKGDFASYKGDLFLGIDAGSTTTKVAVIGDDGSLLYSFYSSNNGSPLKTALKAMKDIYSKMPEGARIVRSCSTGYGEALLKSALLLDEGEVETVAHYTAAAFFDPNVDCILDIGGQDMKCIKIKNNSVDKVQLNEACSSGCGSFIETFAKSLNYEVADFAKIALFAENPIDLGSRCTVFMNSKVKQAQKEGASVADISAGLAYSVIKNALLKVIKLTDPKDLGKQVVVQGGTFYNDAVLRSFERISGCEAIRPDIAGIMGAFGAALIAKDRYTGQKSTMLSFKEINELRFKTSMTRCQGCINHCLLTVNEFTGDRKFISGNRCEKGLGLEKNKEQIPNLFEYKNERVFRHYKPLKKADAPRGVVGIPRVLNMYENYPFWFTFFTKLGYSVKLSPVSSRKIYELGIESIPSESECYPAKLAHGHVTWLIRQGLEYIFYPCIPYERVEVPDAGNHYNCPIVTSYGENIKNNIEELRDDKIKYQNPFISLESEEILTKRLVDFFRKENGIPAAEIKAAAHEGWLEMQAVREDMTKKGKEVLQYLKETGRHGIVLAGRPYHSDPEINHGIPDLITSYGVAVLTEDSISELSEVDRPTIVMDQWMYHSRLYKAASFVAKNDNLDLIQLNSFGCGLDAVTTDQVNDILTKQNKIYTVLKIDEVNNLGAARIRIRSLLAAVKDRERKKIEAKRVDTAHHRVIFTEQMRKDYTILVPDMSPIHFEILESALASCGYNVEVLKADSKCIDYGLKYVNNDACYPSLIVVGQFMQALLSGKYDLHKVALIITQTGGGCRATNYIGFIRRALEKAGMGYIPVISMSAGIEKNPGLKVNLEMANKALQALIYGDVFMRVLYKTRPYEKVKGSANALHEKWKKIAIESVKKANKKQFKKNIQNIVKEFDELELVDIKKPKVGIVGEILVKFMPLANNFIVELLEEEGAEAVCPDLIDFFMYSLYNANFKAEYLGKKKSSAKINNFLIWFIERYRKCANDALAASKRFHPTVPIQKLAEYASPIVSCGNQTGEGWFLTGEMIELIKSGVPNIVCTQPFGCLPNHVVGKGVIKELRHQYPDSNIVAVDYDPGASEVNQLNRIKLMLSTAGKNLIAESKDNEETA

SEQ ID NO: 560 - protein, 972 aa, unidentified
  REGION 1..972: note = Description of Unknown:uncultivated organism sequence
  REGION 1..972: note = Category: MG55 effectors
  REGION 1..972: note = Description: MG55-135 effector
MQIGLDIGSTTIKIAVLDDAGQLQFSKYERHYSQIAEKMQQLLAELHVKMPLLKTARLAISGSAGIGIADSCGLQFVQEVFAEKVCTERLNPGTEAVIELGGEDAKLLFLGRHFDARMNDSCAGGTGAFIDQMASLLSVPTEAMNELAQQASTRYTIASRCGVFAKSDIQPLLNQGAAKADLAASIFDAVASQAVTGLAKGRPITGKVLYLGGPLTFMSELRHSFDKILKIEGYCPENSLYYVAMGAAFCAENKVDLTELPAKLAAVGAQRDFDHLEPLFASTAEYDEFMERHSKERIEPGDISAATEAYIGMDAGSTTIKIAVISPSGQLLDSSYQSNKGNPVIAIKEYLQNFYIKYPHCRILGSAVTGYGEDLIRNGFSVDYGIVETMAHFIAAKTLQPDVDFILDIGGQDIKCLKIHNGCIDNIFLNEACSSGCGSFLQTFAEILGYSAEEFARIGLFADKPVDLGSRCTVFMNSSVKQAQKDGATVANISAGLSLSIVKNALYKVIRPGSKESIGKHIVVQGGTFLNDCVLRAFEKEMGLKVVRPNIAGLMGAYGAAIYARSRHQETGHASTLADAAALENFVHEVKAVTCGLCSNHCHLTVNTFASGKRFISGNRCERPVTHCAPDDTFNLYRQKLQLLESLKGVPGKRGKIGLPMGLNMYELLPFWHAFFTRLGFEVITSPIYDKTIFQKGQNTIPSDTVCYPAKLMHGHIKWLLENGINTIFYPCMTYNVDENSAENCYNCPVVAYYPEVLHANMHDLDNATYIFDYLGLGHKKVLLKKLQQICKEHFPDIGSSELKAALQEAYAAYNKFEAQVKELGQTIINTARSQHKPIVVLAGRPYHIDPKVNHSIDRLITTMGAALVSEDAVSSHISMQELNDDLQVLNQWTYHSRLYAAAKYVSRSSDMYMVHLVSFGCGCDAITADECRRILEDHGQIYTQIKIDDIDNLGAAKIRLRSLFAAAGLES

SEQ ID NO: 561 - protein, 978 aa, unidentified
  REGION 1..978: note = Description of Unknown:uncultivated organism sequence
  REGION 1..978: note = Category: MG55 effectors
  REGION 1..978: note = Description: MG55-136 effector
MRVGLDIGSTTIKCVVLDDADKIVYSTYERHYSHILEKGQELLRRVAEQYLPGGRALLAISGSAGMGLADSCQVPFVQEVFATRVAANRLAPGTDCIIELGGEDAKILFLTHGTEVRMNGSCAGGTGAFIDQMATLLKMSADEMDKAAQGAQRTYTIASRCGVFAKSDIQPLINQGAQAGDIAASIYQAVVNQTIAGLAQGRPIEGKVLYLGGPLTFSSVLRQSFDNTLHLKGTCPENSLLYVALGAAFYADQECDLNAVIDRLGRYSATATYVSLPPLFATKQEYEEFHARHMKAAVPCVPFGAECGPVHIGIDSGSTTIKLAVIDQNDNILFTSYQPNLGNPIPLVRKVLTDLYKNHPNLEIASVTTTGYGEELVKNAFHCDRGLVETVAHFTAAKHFMPNVDFIIDIGGQDMKCFKIEDGAISNIFLNEACSSGCGSFLQTFAQALGYDVKKFAALGLFADRPVDLGSRCTVFMNSSVKQAQKDGATIENISAGLSISVVKNALYKVIRASSPEELGRNIVVQGGTFYNEAVLRAFEKEMGVEVIRPDIAGLMGAYGAALFGKAHARPGARSTVLTLPELEAFTQKVNTVQCQGCGNHCQLTVNIFADGKRFISGNRCDKPVTGKATDEDLDLYAYKLGLLLDYKPQNLENSRGTIGLPLCLNMYELLPFWHTLFTRLGFTVKTSPVSSRALYQEGQATIPSDTACFPAKLAHGHIAELVKMGVDAVFYPCMSYNVDEHLGDNHYNCPVVAYYPEVLAGNCHELANTTFIYDYLNLARRKDFTRRFPAVLDKYFPGLPRKAVAAAIDAAYAEYARHMEQVRAKGAEIIARARAEGRHIIVLAGRPYHVDPEVNHGIDKLIVRQGAAVVTEDAVSHLVERFPTSVLNQWTYHSRLYAAAKYCTTQPDMDLVQLVSFGCGLDAITTDETREILQEGGKLYTQLKIDEITNLGAVNIRLRSLFAALEERREEAEKRRN

SEQ ID NO: 562 - protein, 723 aa, unidentified
  REGION 1..723: note = Description of Unknown:uncultivated organism sequence
  REGION 1..723: note = Category: MG55 effectors
  REGION 1..723: note = Description: MG55-137 effector
MRIIKRNGSEEDFNIEKIINAVKKANGSGEHKFLTDEQIEDVADYVEYKCNKIRRAVSVEEIQDMVEDQLMAKGAFELARRYVRYRYNRSLVRKANTTDNRILSLIECNNEEVKQENSNKNPTVNSVQRDYMAGEVSRDLTRRMLLPADIVEADKEGIIHFHDSDYFAQHMHNCDLVNLEDMLQNGTVISDTLIERPHSFSTACNIATQIIAQVASNQYGGQSISLAHLAPFVQVSREKIRRETLAEIEELGVHPTEEKINDIVEQRLRKEVNRGVQTIQYQVVTLLTTNGQAPFVTVFMYLNEAKNEQEKHDLAMIIEETLKQRHKGVKNEKGVWITPAFPKLIYVLEEDNITEDSKYWYLTELAAKCTAKRMVPDYISEKVMLQSKIDKNGEGHCFTCMGCRSFLTPYVDENGKPKYYGRFNQGVVTVNLIDIGLSAGKDLDKFWKIFDERMELCHRALQCRHERLTGTLSDAAPILWQYGALARLKKGEKIDKLLHGGYSTLSLGYAGLWECVYSLIGKKLTEKEGKELGLEIMQKLNDYCAKWKKAENIDYSLYGTPLESTTYKFAKCLQKRFGIIKGVTDKNYITNSYHVHVTENIDAFSKLKLESEFQALSPGGAISYVEVPNMQDNIPAVLQVIKFIYDNIMYAELNTKSDYCQVCGYDGEIKIVHDDGKLVWECPNCGNRDQDKMNVARRTCGYIGTQFWNQGRTQEIEERVLHL

SEQ ID NO: 563 - protein, 720 aa, unidentified
  REGION 1..720: note = Description of Unknown:uncultivated organism sequence
  REGION 1..720: note = Category: MG55 effectors
  REGION 1..720: note = Description: MG55-138 effector
MKIIKRSGTEAVFDISKIIIAINKANHEVVEAERLTADQIKEIAQYIEDSCKDANHALNVEDIQDLVEDQLMDKRAFSVARKYITYRYKRALVRKSNSTDEQILSLIECNNEEVKQENSNKDSTVNSVQRDYMAGEVSKDITRRFLLPEDIVAAHEQGIIHFHDADYFAQHMHNCDLVNLEDMLQNGTVISGTRIDKPHSFSTACNIATQIIAQVASSQYGGQSISLAHLVPFVQISREKIHAELVQTLKESDVELSEEKINSIVERRLHAEIERGVQVIQYQVVTLMTTNGQSPFVTVFMYLNEAKNEQEKKDLAMIIEEVLDQRYQGVKNEDGVWITPAFPKLIYVLEEDNIHEDSEYYYLTKKAAKCTAKRMVPDYISEKKMKELKDGNCYTCMGCRSFLTVYHDEDGKPKFYGRFNQGVVTLNLVDLACSSGGDFEKFWKLFDERLDLCYRALMARHNRLKGTPSDVAPILWQYGALARLKKGETIDKLLYGGYSTISLGYAGLCECTRYMTGKPHTDPAATPFALKVMQRLNDACKEWKEKENIDFSVYGTPLESTTYKFAKCLQKRFGVIPGVTDKNYITNSYHVHVTENIDAFTKLKFESQFQALSPGGAISYVEVPNMQDNLDAVLSVMKFIYENIMYAELNTKSDYCQVCGYDGEIQIVKDDDGKLVWECPHCHNRDQDKMNVARRTCGYIGSQFWNQGRTQEIKERVLHL

SEQ ID NO: 564 - protein, 1438 aa, unidentified
  REGION 1..1438: note = Description of Unknown:uncultivated organism sequence
  REGION 1..1438: note = Category: MG55 effectors
  REGION 1..1438: note = Description: MG55-139 effector
MNKILHVGLDVGSTTVKIIVMDDNQNLIYENYQRHFSDTKNTVCQVLSDFANKYPDYVYTIALTGSGAMSATKFLDLPFIQEVVACKRAVEKYIPQTDVVIELGGEDAKIIYFGKSIEQRMNGTCAGGTGAFIDQMASLLNTDAAGLNELAKNYKMIYPIASRCGVFAKTDVQPLINEGANKEDIAASIFQAVVNQTISGLACGRPIRGNIAFLGGPLNYLSELRNRFIETLNLDDNSAIIPQDAHLLVAKGAALDSVNNSAISNEKLKAKIEVLKASHDTTSTPLAPLFVTNAEYEAFKERHDKDTVPKKDLKTYKGDCFIGIDAGSTTTKLVVTDCDDNLLYSLYQSNEGNPLKSVINMLKELYEIIPQTATIRYSGVTGYGEQLIQSALNVDLNEIETIAHYTAAKRFMPNVTSIVDIGGQDMKYIKIKNGTINNIMLNEACSSGCGSFIETFAKSLNISINDFVESALDSRSPVDLGSRCTVFMNSKIKQAQKEGATVGDISAGLSYSVIKNAIQKVMKVRDISTLGDHIVVQGGTFYNDAVLRAFELIVGKDVVRPDIAGLMGAYGVAILARKQYEANLDMEYISKLSTLDEIENLQIETSHVRCGGCENHCLLTINKFNNGQKHISGNRCEKGAGITSKSKDLPNIYKYKNERLFSYKPLSEKSAIRGTIGIPRVLNMYEDYPFWFTFLTNLGFRVIISEKSTRKTYEKGMESMPSESVCYPAKLAHGHIMSLINQGIKTIFYPCIPYSRKEYKQADNHYNCPIVISYSEVLKNNVEELKNVKFLNPFLPFEPKKLAEAILSLPEFDEYHFTKKELIKAAQEAEKEYQNFKTDIRNKGQEALNYMKENNLRGIVLAGRPYHVDPEINHGIDTLITSLGLCVLSEDSISNQVTLDKKLRVVNQWVYHSRLYAAADFVGRHANLELVQLNSFGCGVDAVTTDQVEEILSSYDKMYTLIKIDEVNNLGAVRIRIRSLLASMNKRIEKNSNNSDSLGNYELQRKIFTKEMRNDYTILIPQMAPIHFELLESAVQACGYNVHLLRECTPHTVEVGLKYVNNDACYPSILTTGQMIEALESGKYDLNKTALIMSQTGGGCRATNYIGFIRKALKDAGYSDIPVISFNVVGMEKMPGFKLSPKMAEGLLKSVVYGDLLQKMLTKNRAYEKNKGETQKKYEYWLEKCKKLVSKSSLKEFNQSIYDMVNDFEKIELDTTVEKPKVGIVGEVLIKYHPFGNNFVADKLEQEGAEVILPDFMGFIKFIATHKITFNQLIKTDSGKAKIFKFAIKLIDLLEKNEINALKNSKKGYLLPCNIFELEENVKDILSIGNQTGEGWFLTAEMVEYMQHDIPNIVCVQPFACLPNHVVGKGVIKTIRDKYPEANIAAIDYDPGASEANQTNRIKLLMAVAKDNLKIKNSKNKLLLKENNKINSKNKIYQ

SEQ ID NO: 565 - protein, 708 aa, unidentified
  REGION 1..708: note = Description of Unknown:uncultivated organism sequence
  REGION 1..708: note = Category: MG55 effectors
  REGION 1..708: note = Description: MG55-140 effector
MKVIKRDGSTADFDSSKIIVAIQKANQVVEPEDRIDQERIEAIAHYVESKNRMRLLVEDIQDMVEHQLMDEGKFNLAKSYIIYRYTRALVRKANTTDESILSLIRNSNKDVMEENSNKNAVMASTQRDLIAGEVSKDLTRRLILPEKISKAHDEGAIHFHDADYFVQPIFNCCLINVGDMLDNGTVMNGKLIESPKSFQVACTVMTQIIASVASSQYGGQSVDIRHLGKYLRRSYEKFKLTIKAEVGDSVADEVVERLTKRRLQDELRSGVQTIQYQINTLMTTNGQSPFVTIFLNLQADDEYLEENAMIVEEILRQRLEGIKNDKGVFVTPAFPKLVYVLDEHNCLKGGKYDYITKLAVKCSAKRLYPDYISAKKMRENYEGNVFAPMGCRSFLAAWKDDEGNYKFEGRFNQGVVSLNLPQVAILAHGDEEKFWPLLDERLHLCYEALMCRHNSLKGIRSDVSPVHWQYGAIARLEKGEVIDKYLEKGYSTISLGYIGLYEMTKLMKDVSHTTPEGEEFALRVMKYLRAACDKWKKETGLGFALYGTPAESLCYRFARIDKERFGTIADVTDKGYYTNSYHVDVREDIDAFSKFNFESQFQRISSGGAISYVEIPNMRHNLEAMEDVVRFIYDNIQYAEFNTKSDYCHVCGFDGEIIINDDLEWECPNCGNKNQTLMNVTRRTCGYLGENFWNVGKTKEIKSRVLHL

SEQ ID NO: 566 - protein, 724 aa, unidentified
  REGION 1..724: note = Description of Unknown:uncultivated organism sequence
  REGION 1..724: note = Category: MG55 effectors
  REGION 1..724: note = Description: MG55-141 effector
MKIIKRNGAEENFDISKIIMAVTKANAAVEESARMTPRQIQRIAESVELACQELGRSAAVEEIQDMVEKQIMAHGAFEVAKAYITYRYTRSLVRRANTTDDRILSLIECNNEEAKQENSNKNPIVNSTQRDYMAGEVSRDITNRILLPKDIVEAHEEGIIHFHDADYYAQHMHNCDLVNLEDMLQNGTVITGTLIERPHSFSTACNIATQIIAQVASNQYGGQSISLTHLAPFVQVSRERIRREVAAEMQAIDAHPGEEKLAELVENRVREEIRRGVQTIQYQVVTLLTTNGQAPFVTVFMYLGEAKNEQERHDLAMIIEETLRQRYQGVKNEKGVWVTPAFPKLIYVLEEDNIHEDSPYWYLTELAARCTAKRMVPDYISEKKMLELKVDKNGEGHCYTCMGCRSFLTPYVDENGKPKYYGRFNQGVVTINLPDVALSSGGNMEKFWQIFDERLELCHRALMCRHERLKGTLSDAAPILWQYGALARLKKGEPIDKLLYGGYSTISLGYAGLYECVKYMTGKSHTDPSATPFALEVMQHMNDACKHWKQMHNIDFSLYGTPLESTTYKFAKCLQQRFGIIPGVTDKGYITNSYHIHVTENIDAFSKLAFESKFQALSPGGAISYVEVPNMQNNIPAVLEVMKFIYDNIMYAELNTKSDYCQVCGFDGEIEIVEHDGKLIWRCPNCGNTDQDKMNVARRTCGYIGTQFWNQGRTQEIKERVLHL

SEQ ID NO: 567 - protein, 1005 aa, unidentified
  REGION 1..1005: note = Description of Unknown:uncultivated organism sequence
  REGION 1..1005: note = Category: MG55 effectors
  REGION 1..1005: note = Description: MG55-142 effector
MSEIKLQQKAAYTLGIDVGSTTVKTVILDADHHVLHSTYQRHFSKVKEAVSEQLQAIIKEHPATLFSVHMTGSAGLGLATAAKIPFVQEVHAAFLAVKERYPEADAVIELGGEDAKIIFLTGGVEQRMNGSCAGGTGAFIDQMATLLDVTVDELDQMALQADRTYPIAARCGVFAKSDIQPLLNQGAKRENVAASIYQAVVDQTVSGLAQGRKIQGYVLFLGGPLSFLQGLRNAFMQTLHLDAEHAIFPVDGRTFVAYGCALAAENSADKPVTGEALLKQIESAETNHTVIADKPLFGYQEEYDRFRERHAQNDVVHGDLHTYQGNAYLGVDAGSTTTKVALIGEDNSLLYSFYETNKGQPLECVKRALETLYQKKNPNLKICGSAVTGYGEEMLKAGLGIDFGIVETVAHFRAAAFFCPDVDFIIDIGGQDIKCFQIKNGAIDSIMLNEACSSGCGSFIQAFANALGYDVAEFAKLGLFAERPVDLGSRCTVFMNSSVKQAQKDGATVADISAGLSGSIVKNAIYKVIRAKSPEDLGKHIVVQGGTFLNDAVLRCFEREMGRDVIRPAISGLMGAFGAAIYAKEHTSGSSTLLSLMDLHTLTYRTQNTTCNGCTAHCNLQILRFSNGKRFIAGNRCERGAGVSKKDQIPNLVDWKYETLRSLTDRQPEQPKATVGLPMALHYYDQLPLWHTFFTDLGFAVKLSEESTRKTYYKGQSTIPSDTVCYPAKLAHGHIESLLEQNVDFIFYPCMTYNLDEGDSDNHYNCPVVAYYPELLLANNEKLNEQNFLHPFLDLNRRKHLITVLYACLSDYATKKEIAAALEHGFAALEQYHNQIAQTAQEIVRQARAAGKTILVLAGRPYHIDPEINHGIHKLISSLGMAVITEDSIAGLAHTPELQALNQWTYHSRMYRAAQYVTTQPDFQLVQLVSFGCGIDAITTDEVRRILEQSGKLYTQLKIDEISNLGAAKIRLRSLKAAIGADVPPKPTAAPSEVAPKNEKEPVSV

SEQ ID NO: 568 - protein, 972 aa, unidentified
  REGION 1..972: note = Description of Unknown:uncultivated organism sequence
  REGION 1..972: note = Category: MG55 effectors
  REGION 1..972: note = Description: MG55-143 effector
MQIGLDIGSTTIKIAVLDDAGQLQFSKYERHYSQIAEKMQQLLAELHVKMPLLKTARLAISGSAGIGIADSCGLQFVQEVFAEKVCTERLNPGTEAVIELGGEDAKLLFLGRHFDARMNDSCAGGTGAFIDQMASLLSVPTEAMNELAQQASTRYTIASRCGVFAKSDIQPLLNQGAAKADLAASIFDAVASQAVTGLAKGRPITGKVLYLGGPLTFMSELRHSFDKILKIEGYCPENSLYYVAMGAAFCAENKVDLTELPAKLAAVGAQRDFDHLEPLFASTAEYDEFMERHSKERIEPGDISAATEAYIGMDAGSTTIKIAVISPSGQLLDSSYQSNKGNPVIAIKEYLQNFYIKYPHCRILGSAVTGYGEDLIRNGFSVDYGIVETMAHFIAAKTLQPDVDFILDIGGQDIKCLKIHNGCIDNIFLNEACSSGCGSFLQTFAEILGYSAEEFARIGLFADKPVDLGSRCTVFMNSSVKQAQKDGATVANISAGLSLSIVKNALYKVIRPGSKESIGKHIVVQGGTFLNDCVLRAFEKEMGLKVVRPNIAGLMGAYGAAIYARSRHQETGHASTLADAAALENFVHEVKAVTCGLCSNHCHLTVNTFASGKRFISGNRCERPVTHCAPDDTFNLYRQKLQLLENLKGVPGKRGKIGLPMGLNMYELLPFWHAFFTRLGFEVITSPIYDKTIFQKGQNTIPSDTVCYPAKLMHGHIKWLLENGINTIFYPCMTYNVDENSAENCYNCPVVAYYPEVLHANMHDLDNATYIFDYLGLGHKKVLLKKLQQICKEHFPDIGSSELKAALQEAYAAYNKFEAQVKELGQTIINTARSQHKPIVVLAGRPYHIDPKVNHSIDRLITTMGAALVSEDAVSSHVSMQELNDDLQVLNQWTYHSRLYAAAKYVSRSSDMYMVHLVSFGCGCDAITADECRRILEEHGQIYTQIKIDDIDNLGAAKIRLRSLFAAAGLES

SEQ ID NO: 569 - protein, 720 aa, unidentified
  REGION 1..720: note = Description of Unknown:uncultivated organism sequence
  REGION 1..720: note = Category: MG55 effectors
  REGION 1..720: note = Description: MG55-144 effector
MKIIKRSGTEAVFDISKIIIAINKANHEVVEAERLTADQIKEIAQYIEDSCKDANHALNVEDIQDLVEDQLMDKRAFSVARKYITYRYKRALVRKSNSTDEQILSLIECNNEEVKQENSNKDSTVNSVQRDYMAGEVSKDITRRFLLPEDIVEAHEQGIIHFHDADYFAQHMHNCDLVNLEDMLQNGTVISGTRIDKPHSFSTACNIATQIIAQVASSQYGGQSISLAHLVPFVQISREKIHAELVQTLKESDVELSEEKINSIVERRLHAEIERGVQVIQYQVVTLMTTNGQSPFVTVFMYLNEAKNEQEKKDLAMIIEEVLDQRYQGVKNEDGVWITPAFPKLIYVLEEDNIHEDSEYYYLTKKAAKCTAKRMVPDYISEKKMKELKDGNCYTCMGCRSFLTVYHDEDGKPKFYGRFNQGVVTLNLVDLACSSGGDFEKFWKLFDERLDLCYRALMARHNRLKGTPSDVAPILWQYGALARLKKGETIDKLLYGGYSTISLGYAGLCECTRYMTGKPHTDPAATPFALKVMQRLNDACKEWKEKENIDFSVYGTPLESTTYKFAKCLQKRFGVIPGVTDKNYITNSYHVHVTENIDAFTKLKFESQFQALSPGGAISYVEVPNMQDNLEAVLSVMKFIYENIMYAELNTKSDYCQVCGYDGEIQIVKDDDGKLVWECPHCHNRDQDKMNVARRTCGYIGSQFWNQGRTQEIKERVLHL

SEQ ID NO: 570 - protein, 1416 aa, unidentified
  REGION 1..1416: note = Description of Unknown:uncultivated organism sequence
  REGION 1..1416: note = Category: MG55 effectors
  REGION 1..1416: note = Description: MG55-145 effector
MKLDFNTLGIDIGSTTVKIAILNKDGEIIFSDYQRHYANIQETLAKIIDEAYEEFGDIPVSPMITGSGGLTLSKHMEIPFVQEVVAVATSLKDYAPRTDVAIELGGEDAKIIYFTGGIDQRMNGICAGGTGSFIDQMATLLKTDAAGLNEYAKNYKAIYPIAARCGVFAKTDIQPLINEGATKEDLSASIFQAVVNQTISGLACGKPIKGNVAFLGGPLHFLTELKQAFIRTLGLEGDAIIAPEHSHLFAASGAAMNAHADVQSSLGELKEKLSHKIELEFEVTRMEPLFASEKEYEDFTERHNKHNVRKGDFASYKGDLFLGIDAGSTTTKVAVIGDDGSLLYSFYSSNNGSPLKTALKAMKDIYSKMPEGARIVRSCSTGYGEALLKSALLLDEGEVETVAHYTAAAFFDPNVDCILDIGGQDMKCIKIKNNSVDKVQLNEACSSGCGSFIETFAKSLNYEVADFAKIALFAENPIDLGSRCTVFMNSKVKQAQKEGASVADISAGLAYSVIKNALLKVIKLTDPKDLGKQVVVQGGTFYNDAVLRSFERISGCEAIRPDIAGIMGAFGAALIAKDRYTGQKSTMLSFKEINELRFKTSMTRCQGCINHCLLTVNEFTGDRKFISGNRCEKGLGLEKNKEQIPNLFEYKNERVFRHYKPLKKADAPRGVVGIPRVLNMYENYPFWFTFFTKLGYSVKLSPVSSRKIYELGIESIPSESECYPAKLAHGHVTWLIRQGLEYIFYPCIPYERVEVPDAGNHYNCPIVTSYGENIKNNIEELRDDKIKYQNPFISLESEEILTKRLVDFFRKENGIPAAEIKAAAHEGWLEMQAVREDMTKKGKEVLQYLKETGRHGIVLAGRPYHSDPEINHGIPDLITSYGVAVLTEDSISELSEVDRPTIVMDQWMYHSRLYKAASFVAKNDNLDLIQLNSFGCGLDAVTTDQVNDILTKQNKIYTVLKIDEVNNLGAARIRIRSLLAAVKDRERKKIEAKRVDTAHHRVIFTEQMRKDYTILVPDMSPIHFEILESALASCGYKVEVLKADSKCIDYGLKYVNNDACYPSLIVVGQFMQALLSGKYDLHKVALIITQTGGGCRATNYIGFIRRALEKAGMGYIPVISMSAGIEKNPGLKVNLEMANKALQALIYGDVFMRVLYKTRPYEKVKGSANALHEKWKKIAIESVKKANKKQFKKNIQNIVKEFDELELVDIKKPKVGIVGEILVKFMPLANNFIVELLEEEGAEAVCPDLIDFFMYSLYNANFKAEYLGKKKSSAKINNFLIWFIERYRKCANDALAASKRFHPTVPIQKLAEYASPIVSCGNQTGEGWFLTGEMIELIKSGVPNIVCTQPFGCLPNHVVGKGVIKELRHQYPDSNIVAVDYDPGASEVNQLNRIKLMLSTAGKNLIAESKDNEETA

SEQ ID NO: 571 - protein, 1439 aa, unidentified
  REGION 1..1439: note = Description of Unknown:uncultivated organism sequence
  REGION 1..1439: note = Category: MG55 effectors
  REGION 1..1439: note = Description: MG55-146 effector
MIKTLHVGLDVGSTTVKIIVMDENLNTIYTDYKRHFSDTKNTICNVLENLIIMYPDTEFTIALTGSGAISAAKFLDLPFIQEVVSCKRAVEKYIPETDVVIELGGEDAKIIYFDKFIEQRMNGTCAGGTGAFIDQMASLLNTDPTGLNELAKSHKLIYPIASRCGVFAKTDIQPLLNEGAAKEDIAASIFQAVVNQTISGLACGRPIRGNVAFLGGPLNYLSELRNRFIETLNLKDNEIIVPNEAHLLVAKGAALDSLNSHTITIEKLKSKIEVLKSSHDDTSNPLNPLFSIDAEYDEFKKRHEKDKVKRADFKTFKGNCFLGIDAGSTTTKLVVISEDGTLLYSLYGSNEGNPLQSVINMLKKLYAEKPSEAIIRFSGVTGYGEKLIQTALNVDLNEIETIAHYTAAKEFMPNVTSIVDIGGQDMKYIKMKNGAIDNIMLNEACSSGCGSFIETFAKSLGLSIQDFVQSALEARRPVDLGSRCTVFMNSKIKQAQKEGYSVGDISAGLSYSVIKNAIQKVMKVRDVKKLGAHIVVQGGTFYNDAVLRAFELIVGRNVVRPDIAGLMGAYGVALLAKEQYENNLDMDYVSSISNINELDKLEINITHIRCQGCENHCLLTINKFSNGTKYISGNRCEKGAGIVDKTLDRPNLIKYKFERTFNYTPLEEKNAPRGTIGIPRVLNMYEDYPFWFTFLTNLGFRVILSEKSNRKTYEKGMESMPSESVCFPAKLSHGHIIGLINSGIKTIFYPCIPYSRKEYQKADNHYNCPIVISYSEVLKNNVEELKDKNIKFLNPFLPFEPDKLAEIIMNLPEFKEYNFTKKELLSAAKKAETEYQNYKSDIHNKGQETLKFMEENNLKGIVLAGRPYHVDPEVNHGIDTLITSLGLCVLTEDSISNLTEAKRPLRVVDQWVFHARLYAAADFVGKHDNLELVQLNSFGCGVDAVTTDQVEEILTSYEKMYTLIKIDEINNLGAIRIRIRSLLASMNKRIKDNNSSMCNGNYEVNKKIFTKEMRKDYTILMPQMAPIHFEFLESAMKNSGYKMELLKDCTQHTVETGLKYVNNDACYPSILVTGQMIEALESGKYDLNKTALIMSQTGGGCRATNYIGFIRKALKDAGFENVPVISFNVVGMEKMPGFKLTIPLIERLIKSCIYADLLQKMLTKNRAYEINKGKTKELFDYWMEKCKKLVNKSSIKEFKQSIFDIVSDFEKIEIDTSVIKPKVGIVGEVLIKYHPFGNNFVADKLEQEGAEVILPDFMGFIKFIATHKITFNKLIKTDAIKAKLFKTAIKLIDLLEKPVISALNNSKKGYLLPCNIWDLEEKVNDILSIGNQTGEGWFLTAEMIEYIEHDIPNIVCVQPFACLPNHVVGKGVIKTIRSKFPEANIAPIDYDPGASEANQTNRIKLMMTVAKDNLKNKNNINKAIKKENYIIDEKNKISN

SEQ ID NO: 572 - protein, 727 aa, unidentified
  REGION 1..727: note = Description of Unknown:uncultivated organism sequence
  REGION 1..727: note = Category: MG55 effectors
  REGION 1..727: note = Description: MG55-147 effector
MKVIKRDGHMVDYCPEKIEQAIMKANNEVEEEDQASSTQIKNIIKYIEKLGKKRILVEDIQDIIEMKLMSQGKYELAKHYITYRYTRELVRRSNTTDQSIKELIDGESEYWNTENSNKNAKVVTTQRDYLAGITSTDITRRFLLPEDIVEAHDAGIIHFHDADYFAQNALHNCDLVNLEDMLQNGTSINGVMIEKPHRFLTAMTIATQIITAVSSSQYGGVTITLTHLAPFVRESYNRYLDKYKKRKLSKEQCEKFAMEDTKKEIVDGVQTFQYQVNSMTTTNGQAPFLSVCMYLGETTEYKEELSWIIEEFLKQRILGMKNEQGVYITPAFPKLLYVLEEDNINKNGKYYYLTKLAAECTAKRMVPDYISEKIMKELKIDKNGNGNCYPCMGCRSFLTPYVDENGKPKYYGRFNQGVVTINLVDAALSSDKDMDTFWQIFEERLELCHKALQIRHKRLSKATSDVAPILWQHGALARLKKGESIHELLHNGYSTISLGYAGLYECVKYMTGHSHTDNGKGKEFALEVMEKMNAKCKEWKEVENIDYSVYGTPIESTTYKFAKCLKDRFGVVKGITDRDYITNSYHVPVFEEIDAFTKLKLESEFQKLSPGGAISYIETPNLCNNLDAVMEVITFIYNNIMYAELNTKSDYCQECGYTGEILIDDNMEWYCPNCGNRDHNKLNVARRTCGYIGTNFWNKGRTQEIKERVLHIDNKEEKDTKKDKEEK

SEQ ID NO: 573 - protein, 720 aa, unidentified
  REGION 1..720: note = Description of Unknown:uncultivated organism sequence
  REGION 1..720: note = Category: MG55 effectors
  REGION 1..720: note = Description: MG55-148 effector
MFFVKENGTIVVFDKNKIKKAIVSAMKDGGIYLPDIARLISIDTEKYFLKEGGDQNVVTREQVDKYIFDRLIHYGQSLTAKSYEDFKVLRKYQKQTMDSDESILSLIGGNNEELQMENSNKAPSLAPTQRDLIAGEISKSIARRKMIPAHLIHAHDEGLIHIHDLDYFIQSINNCCLINLKDMLDNGTVINETLIETPHSFRTAATITTQIVAQVASCQYGGQTFSTSHLAPYVRKSYDNYIKEVASELYDCSFGNIDSEIFKENVEKIARKRLKKEIADGVQTIQYQLNTLMTTNGQSPFLSIAMWINEDPEYEKENAMIIEEILKQRITGVKDKEGHYISPAFPKLLYFLDDNNAYEGSKYFYLTELAAKCSAKRLVPDYISVKAMKENIGEVFPCMGCRSFLSPWYDENGKNKAYGRFNMGVVSLNLVDVGLSANGDLDLFWDILDERLNLCYEALMLRINKLKGTTTETAPILWEHGAFARLPKGSKIDSLLENGYATVSLGYHGLYECVYSLIEESHTSEAGQELALEIMKKLKDTCDKWKKETGYGFGLYGTPAESLTYRFARTTKNRFGVIPHVTDKLYLTNSYHVHVTEPIDAFSKLKFESQFQKLSSGGCISYVEVPNMNDNIPAVIQLIQFIYENIQYAEINTKSDLCENCGYEGEILINPDTLDWYCPNCGCTDHSKLHVTRRVCGYIGSNFFNRGKTQEINERVVHLD

SEQ ID NO: 574 - protein, 727 aa, unidentified
  REGION 1..727: note = Description of Unknown:uncultivated organism sequence
  REGION 1..727: note = Category: MG55 effectors
  REGION 1..727: note = Description: MG55-149 effector
MKVIKRDGHMVDYCPEKIEQAIMKANNEVEEEDQASSTQIKNIIKYIEKLGKKRILVEDIQDIIEMKLMSQGKYELAKHYITYRYTRELVRRSNTTDQSIKELIDGESEYWNTENSNKNAKVVTTQRDYLAGITSTDITRRFLLPEDIVEAHDAGIIHFHDADYFAQNALHNCDLVNLEDMLQNGTSINGVMIEKPHRFLTAMTIATQIITAVSSSQYGGVTITLTHLAPFVRESYNRYLDKYKNRKLSKEQCEKFAMEDTKKEIVDGVQTFQYQVNSMTTTNGQAPFLSVCMYLGETTEYKEELSWIIEEFLKQRILGMKNEQGVYITPAFPKLLYVLEEDNINKNGKYYYLTKLAAECTAKRMVPDYISEKIMKELKIDKNGNGNCYPCMGCRSFLTPYVDENGKPKYYGRFNQGVVTINLVDAALSSDKDMDTFWQIFEERLELCHKALQIRHKRLSKATSDVAPILWQHGALARLKKGESIHELLHNGYSTISLGYAGLYECVKYMTGHSHTDNGKGKEFALEVMEKMNAKCKEWKEVENIDYSVYGTPIESTTYKFAKCLKDRFGVVKGITDRDYITNSYHVPVFEEIDAFTKLKLESEFQKLSPGGAISYIETPNLSNNLDAVLEVITFIYNNIMYAELNTKSDYCQECGYTGEILIDDNMEWYCPNCGNRDHNKLNVARRTCGYIGTNFWNKGRTQEIKERVLHIDNKEEKDTKKDKEEK

SEQ ID NO: 575 - protein, 983 aa, unidentified
  REGION 1..983: note = Description of Unknown:uncultivated organism sequence
  REGION 1..983: note = Category: MG55 effectors
  REGION 1..983: note = Description: MG55-150 effector
MALRIGIDIGSTTVKVVVLDAQNKLLFRSYERHYSKTRERTCETLRGLRGLLGGQQVQLLITGSAGLGVAKAAGLDFVQEVYATAAAVREFIPGTDAVIELGGEDAKIIFFGNTLEERMNGSCAGGTGAFIDQMATLLNVSVDELDELSLRHEKIYPIASRCGVFAKSDIQPILNQGGRKEDVAASIFQAVVDQTVAGLTQGRELKGTIVFLGGPLHFLAGLRQRFVETLHLDQDHAIFPEDGDCFAAIGAALCTEDSQPRPFEELLDLLEHAATVSTPVDTMDPLFTSQADYEAFSARHQAMAVPTVDLATYTGPAYLGIDAGSTTTKMVLIDPDCNLLYSFYHSNQGNPVSIVLPQLREIYAQCGDRVTIQGAAVTGYGEDLIKNAFSCDLGLVETVAHLNAARHFTPDVDFIIDIGGQDMKCFKIRNGAVDSILLNEACSSGCGSFIETFAKALGYTIADFSKMGLFARHPVNLGSRCTVFMNSSVKQAQKDGASVEDISAGLSISVVKNAIYKVIRAASADDLGQHIVVQGGTFLNDAVLRSFELEIGREVTRPTISGMMGAYGAALAAKDAGLTRSALLSAEALAAFTHEARPATCKLCTNHCSLTINRFDGGRKFISGNRCSRPLGQEKVDIPDLLKFKYQYLRSLQGKGEGDGSRGKIGIPFGLNMYENLPFWFTLFTTLNFEVVLSPESTRSLYLKGQQTIPSDTVCYPAKLLHGHIMALLEEGIDTIFYPCMSYNFDEHLSDNHYNCPVVAYYPDLLGVNIPALEDIKYLHPNLGLHRPKDFEKKGAQLLETEFGIPKRASVKAIRKAYAAYEDFRRLVQKKGEEYISFARETGRKILVVAGRPYHMDPEINHGINDLITSFGFVLITEDAVFQHMDKQPRRVLNQWTYHARMYNAARYVCTQPDMAFIQLVSFGCGVDAITTDELRSILEEAGELYTQLKIDDISNLGAVKIRIRSLMAALDARDARNQKGGQ

SEQ ID NO: 576 - protein, 972 aa, unidentified
  REGION 1..972: note = Description of Unknown:uncultivated organism sequence
  REGION 1..972: note = Category: MG55 effectors
  REGION 1..972: note = Description: MG55-151 effector
MQIGLDIGSTTIKIAVLDDAGKLQFAKYERHYSQIAEKMQQLLAELHAKMPLLRTARLAISGSAGIGIAENCGLQFVQEVFAEKICTERLNPGTEAVIELGGEDAKLLFLGRHFDARMNDSCAGGTGAFIDQMASLLNVATEDMNELARQASTRYTIASRCGVFAKSDIQPLLNQGAAKADLAASIFDAVASQAVTGLAKGRPITGSILYLGGPLTFMSELRHSFDKILKITGVCPENSLYYVAMGAAFCAENKVDLTELPAKLAAAGAHRDFDHLEPLFKNKAEYEEFIARHSRERIEPGDIAAAAEAYIGIDAGSTTIKIAVISPDGQLLDSFYQSNKGNPVIAVKEYLQSFYQKYPGCRLLGSAVTGYGEDLIRNGFGVDYGIVETMAHFIAAKTLQPDVDFILDIGGQDIKCLKIHNGCIDNIFLNEACSSGCGSFLQTFAEILGYSAEEFAHIGLSADKPVNLGSRCTVFMNSSVKQAQKDGASVANISAGLSLSIVKNALYKVIRPGSKEAIGKHIVVQGGTFLNDCVLRAFEKEMGLEVVRPNIAGLMGAYGAALYARQRQQETGRVSSLADAKALKDFFHEVKAVTCGLCSNHCHLTVNTFASGKRFISGNRCERPVTHCAPDDTFNLYRQKLQLLEKLRGVPGKRGKIGLPMGLNMYELLPFWHAFFTSLGFEVVTSPINDKTIYQKGQNTIPSDTVCYPAKLMHGHIKWLLEHDITTIFYPCMTYNVDENSAENCYNCPVVAYYPEVLHANMHDLDNATYIFDYLGLTHKKVLLKKLQQIFRDKFPDVRGSEIKSALEEAFTAYHQFENKVKELGQTIINSARAEHKPIVVLAGRPYHIDPKVNHSIDRLITTMGAALVSEDAVSSHISMKELNEDLQVLNQWTYHSRLYAAAKYVSQSSDLYMVQLVSFGCGCDAITADECRRILEENGHIYTQIKIDDIDNLGAAKIRLRSLFAAEGLES

SEQ ID NO: 577 - protein, 708 aa, unidentified
  REGION 1..708: note = Description of Unknown:uncultivated organism sequence
  REGION 1..708: note = Category: MG55 effectors
  REGION 1..708: note = Description: MG55-152 effector
MQVIKRDGRAVTYDRNKIMVAIRKANAEVEPCEKISDEKIEEIVEGIEAKHRKRMLVEDIQDIIEQKLMEDGKFVLAKTYIIYRYSRELIRKANTTDDSILSLIQNRNKDVMEENSNKNATVASTQRDLIAGEVSKDLTKRMLLPEKISKAHEEGAIHFHDADYFLQPIFNCCLINIGDMLDNGTVMNGKLIESPKSFQVACTIVTQIIASVASSQYGGQSVDIRHLGKYLRKSHDKYQKKISAAVGDTIDQETIDTLVRERVNDELRSGVQTIQYQINTLMTTNGQSPFVTLFLNLDENDEYVEENAMIIEEILRQRIEGIKNEVGVYVTPAFPKLIYVLDEHNCLKGGKYDYLTKLAIKCSAKRMYPDYISAKKMRENYEGNVFSCMGCRSFLSPWKDENGNYKWEGRFNQGVVSLNLPQIAILSKGNEDKFWSLLDERLQLCYDALMCRHRALEGVTSDVSPVHWQYGAIARLKKGEVIDPLLHNGYSTISLGYIGVYEMTKLMTGVSHTDPKGEEFALKVMKHLRAACDKWKADTGLGFGLYGTPAESLCYRFARIDKERFGTIKDVTDKGYYTNSYHVDVREKIDAFSKFRFESQFQNISSGGAISYVEIPNMRNNLDALAEVVRYIYDNIQYAEFNTKSDYCHVCGYDGEIIINNEGEWECPQCGNKDHAKMNVTRRTCGYLGENFWNVGKTKELGARVLHL

SEQ ID NO: 578 - protein, 803 aa, unidentified
  REGION 1..803: note = Description of Unknown:uncultivated organism sequence
  REGION 1..803: note = Category: MG55 effectors
  REGION 1..803: note = Description: MG55-153 effector
MENNNQQTEKNNMEETKMHEEEIVTIAFIPEEEGRHVIKRNGQEVDFSIEKPIACIQKANATVPAVKQLSEVQILAIAESVKNKVFAHKHATSVEEIQDWIELGLMEMRGYEVAQSYTHYRAAKAEKRKTNTIDDKVIALIGNQNEEDKQENANKDPEINSTQRDYIAGHVSKDLTFRTILPDFNSFKELSPKGKEIIKKGDGEKIVTANAEGLIHFHDADYFIQPMTNCCLINADDMLQNGTMISGVKIDKPRSFLTAANVLTQIIAQVASSQYGGQTFTLSHLAPFVDVSRKKLTKEVIAEREELGESLDEDIIKKIVERRLRKEIKQGIQTIQYQLITLMTTNGQSPFVTMFLYINEVPDGQIKDDLIMLIEEVFEQRIKGVKNSSGVYVSPTFPKLIYVLDEDNIEEGSKYYHVTELAAKTSAKRLVPDYISAKIMKEQRNGDVYPCMGCRSFLTVDDGTTNAGNKAKALNYEEGAHQYYGRFNQGVVTINLVDVACTSGGNLEEFWKVFDERLELCHKALRLRHERLLGTKSDVAPILWQHGAYARLERGEVIDPLLYGNYSTLSLGYAGLYECVFRMLEKSHTTEEGRELGLKIMQYMSDKCTAWKKDEDISYSLYGTPLESTTYKFAKALQKRFGIIPEVTDRNYITNSYHINVRENIDAFSKIEQESSFQHLSPGGSISYVEVPNMQNNISAVVAILQCIYDNITYAEINTKSDYCHVCHYEGEAVLVDNGSGKLVWECPNCKNQDARKMTVVRRVCGYLGEAARGMNQGRLGDIHDRVLHVSQRIDPMSKKTIS

SEQ ID NO: 579 - protein, 724 aa, unidentified
  REGION 1..724: note = Description of Unknown:uncultivated organism sequence
  REGION 1..724: note = Category: MG55 effectors
  REGION 1..724: note = Description: MG55-154 effector
MKIIKRNGAEVAFDIEKIINAIKKANDEVTESSNRLTDEQIVDIAEKVSALAGDLKRAVSVEEIQDFVENQLMDQKAFVVARKYITYRYTRALVRQSNTTDAQILTLIECNNEEVKQENSNKNPTVNSVQRDYMAGEVSKDLTRRVLLPHDIVEAHDEGIIHFHDADYFAQHMHNCDLVNLEDMLQNGTVISGTFIEKPHSFSTACNIATQIIAQVASNQYGGQSISLTHLAPFVDISRQKIRSEVAEELSQVGISDEEHIARIAEKRLRDEIKKGIQTIQYQVVTLLTTNGQAPFVTVFMYLGEARNERERDDLAMIIEETLNQRIQGVKNEAGVWVTPAFPKLIYVLEEDNIREGSRYWYLTELSARCTAKRMVPDYISEKKMLEFKVDKNGEGHCYTCMGCRSFLTPYVDENGKPKYYGRFNQGVVTINLVDVALSSHGDMEAFWKIFDERLELCHRALMERHKRLKGTLSDAAPILWQYGALARLKKGETIDKLLYGGYSTISLGYAGLYECTKYMTGKSHTDAQAKPFALSVMQHMNDMCKKWKQEHNIDFSLYGTPLESTTYKFAKCLQKRFGIIEGVTDKNYITNSYHVHVSEPIDAFTKLKFESEFQQLSPGGAISYVEVPNMQGNIPAVLAVMQYIYDNIMYAELNTKSDYCQVCGYDGEIAIVEEDGKLLWECPHCHNRDQSKMNVARRTCGYIGTQYWNQGRTQEIRDRVLHL

SEQ ID NO: 580 - protein, 971 aa, unidentified
  REGION 1..971: note = Description of Unknown:uncultivated organism sequence
  REGION 1..971: note = Category: MG55 effectors
  REGION 1..971: note = Description: MG55-155 effector
MRIGLDIGSTTVKCVVLDEKNELVYKTYERHYSQITQKIADILNTVRKEVPGSDSALVALSGSAGMGVADSCGLDFIQEVYATRVAANTFIPGTDVIIELGGEDAKILFLSGGMEVRMNGSCAGGTGAFIDQMATLLNVPLEEMNDLAAQHEKTYTIASRCGVFAKTDIQPLLNQGARKSDVAESIFAAVVNQTVAGLAQGREITGKVVYLGGPLTFMPRLRLRFDKVLHTEGVCPENSLYYVAAGAALCAEKVIDFNAVVKKVEHYSGSGNFAFNPPLFESKADYEQFKERHEMAYVPKKEIKDYKGRVYIGMDAGSTTVKSVVMGENGELLYSKYLPNSGNPVPIIKQFLEELYELCPEIDIASSAVTGYGEEIIKNAFCADFGIVETVAHFTAAKSFMPQVEFVIDIGGQDIKCFKIHNGTIDNIFLNEACSSGCGSFLQTFANALGYSIEDFSKLGLLAKQPVDLGSRCTVFMNSSVKQAQKDGATIEDISAGLSISVVKNALYKVIRASSPKELGSHIVVQGGTFLNDAVLRAFEREMGVEVVRPTIAGLMGAYGAALYAKSRCKGGKSTLLDREALKTFTHEIQVVNCGLCSNNCRLTVNKFSDGRRFIGGNRCERPITKKTPDKTLDIYDYKLELLQSYKPKPGPRGKIGIPMGLNMYELLPFWHSFFTALGFEVVYSPVSDKKLYARGQQTIPSDTVCYPAKLMHGHVQALIDDGVQTVFYPCLSYNLDEGLGDNHYNCPVVAYYPEVISANMKDVKNITFIKDYLGIHRHKDFPVKAHEMLCKYFDGITLKEVKAAAKAAYSEYGEYFKKVRARGETIMEQAEKEGREIIVLSGRPYHVDPEINKGIDKLITSFHCAIISEDVVSCRVKKFRTSVLNQWTYHSRLYAAAKYIAGRDDMNLVQLVSFGCGVDAITTDEVREILESEGKIYTQIKIDEITNLGAVKIRIRSLLAAIAEQREDRK

SEQ ID NO: 581 - protein, 716 aa, unidentified
  REGION 1..716: note = Description of Unknown:uncultivated organism sequence
  REGION 1..716: note = Category: MG55 effectors
  REGION 1..716: note = Description: MG55-156 effector
MICTVIKRDGSLVPYDRSKISNAIYMANREVVESNRATDIEISQIIEEVEEKYRKEGIVQVEEIQDIIERNLISMHYELGKRFMVYRHTHSMMRRATQTNESVLAICRNENEEVGRENSNKNAVLCSTQRDLIAGEISKELTFDLLLPGKIAKAHREGAIHFHDADYFIQSMFNCCLVDIGDMLRNGTVMNGKLIEPPKSFQVACTVTTQIIASVSSNQYGGQSINLRHLAPFVEVSRKKITEKLSSFGLNGKQLKDAVDYELKKEIAAGCQTIQYQVNTLMTTNGQSPFVTLFMELHEDIENGETIADEAMIYEEILSQRLQGIKNENGVYITPPFPKLIYVLDDCNCLKGGDYDYLTELAIKCTAKRMYPDYISAKKMRENYDGNVFSCMGCRSFLSPWKDENGKYKWEGRFNQGVVSLNLPQIAILSCQTGKPDFNTFWSILDERCSIAFEALLCRHKHLIGTNADVSPIHFRHGAIARLASGEKIDKLLKDGYSTLSLGYIGIYETVKLMTGFSHTKEGVPKEFAIQIMEYLRSKCDSWKKITGLGFGLYGTPAESLCYRFAKIDKERFGNIKDVTDKGYYTNSYHVDVREHISAFEKLSFESEFQKISSGGAISYVEIPNMEHNLDALAEVVKFGYENIQYFEFNTKSDNCLVCGYSGEILLDDKCEWYCPNCGNRDHNKMSVVRRTCGYLGERFWNRGKTAEIKDRVTHL

SEQ ID NO: 582 - protein, 971 aa, unidentified
  REGION 1..971: note = Description of Unknown:uncultivated organism sequence
  REGION 1..971: note = Category: MG55 effectors
  REGION 1..971: note = Description: MG55-157 effector
MRIGLDIGSTTVKCVVLDEKNELVYKTYERHYSQITQKIADILNTVRKEVPGSDSALVALSGSAGMGVADSCGLDFIQEVYATRVAANTFIPGTDVIIELGGEDAKILFLSGGMEVRMNGSCAGGTGAFIDQMATLLNVPLEEMNDLAAQHEKTYTIASRCGVFAKTDIQPLLNQGARKSDVAESIFAAVVNQTVAGLAQGREITGKVVYLGGPLTFMPRLRLRFDKVLHTEGVCPENSLYYVAAGAALCAEKVIDFNAVVKKVEHYSGSGNFAFNPPLFESKADYEQFKERHEMAYVPKKEIKDYKGRVYIGMDAGSTTVKSVVMGENGELLYSKYLPNSGNPVPIIKQFLEELYELCPEIDIASSAVTGYGEEIIKNAFCADFGIVETVAHFTAAKSFMPQVEFVIDIGGQDIKCFKIHNGTIDNIFLNEACSSGCGSFLQTFANALGYSIEDFSKLGLLAKQPVDLGSRCTVFMNSSVKQAQKDGATIEDISAGLSISVVKNALYKVIRASSPKELGSHIVVQGGTFLNDAVLRAFEREMGVEVVRPTIAGLMGAYGAALYAKSRCKGGKSTLLDREALKTFTHEIQVVNCGLCSNNCRLTVNKFSDGRRFIGGNRCERPITKKTPDKTLDIYDYKLELLQSYKPKPGPRGKIGIPMGLNMYELLPFWHSFFTALGFEVVYSPVSDKKLYARGQQTIPSDTVCYPAKLMHGHVQALIDDGVQTVFYPCLSYNLDEGLGDNHYNCPVVAYYPEVISANMKDVKNITFIKDYLGIHRHKDFPVKAHEMLCKYFDGITLKEVKAAAKAAYSEYGEYFKKVRTRGETIMEQAEKEGREIIVLSGRPYHVDPEINKGIDKLITSFHCAIISEDVVSCRVKKFRTSVLNQWTYHSRLYAAAKYIAGRDDMNLVQLVSFGCGVDAITTDEVREILESEGKIYTQIKIDEITNLGAVKIRIRSLLAAIAEQREDRK

SEQ ID NO: 583 - protein, 983 aa, unidentified
  REGION 1..983: note = Description of Unknown:uncultivated organism sequence
  REGION 1..983: note = Category: MG55 effectors
  REGION 1..983: note = Description: MG55-158 effector
MALRIGIDIGSTTVKVVVLDAQNKLLFRSYERHYSKTRERTCETLRGLRGLLGGQQVQLLITGSAGLGVAKAAGLDFVQEVYATAAAVREFIPGTDAVIELGGEDAKIIFFGNTLEERMNGSCAGGTGAFIDQMATLLNVSVDELDELSLRHEKIYPIASRCGVFAKSDIQPILNQGGRKEDVAASIFQAVVDQTVAGLTQGRELKGTIVFLGGPLHFLAGLRQRFVETLHLDQDHAIFPEDGDCFAAIGAALCTEDSQPRPFEELLDLLEHAATVSTPVDTMDPLFTSQADYEAFSARHQAMAVPTVDLATYTGPAYLGIDAGSTTTKMVLIDPDCNLLYSFYHSNQGNPVSIVLPQLREIYAQCGGRVTIQGAAVTGYGEDLIKNAFSCDLGLVETVAHLNAARHFTPDVDFIIDIGGQDMKCFKIRNGAVDSILLNEACSSGCGSFIETFAKALGYTIADFSKMGLFARHPVNLGSRCTVFMNSSVKQAQKDGASVEDISAGLSISVVKNAIYKVIRAASADDLGQHIVVQGGTFLNDAVLRSFELEIGREVTRPTISGMMGAYGAALAAKDAGLTQSTLLSAEALASFTHEARPATCKLCTNHCSLTINRFDGGRKFISGNRCSRPLGQEKVDIPDLLKFKYQYLRSLQGKGEGDGSRGKIGIPFGLNMYENLPFWFTLFTTLNFEVVLSPESTRSLYLKGQQTIPSDTVCYPAKLLHGHIMALLEEGIDTIFYPCMSYNFDEHLSDNHYNCPVVAYYPDLLGVNIPALEDIKYLHPNLGLHRPKDFEKKGAQLLETEFGIPKRASVKAIRKAYAAYEDFRRLVQKKGEEYISFARETGRKILVVAGRPYHMDPEINHGINDLITSFGFVLITEDAVFQHMDKQPRRVLNQWTYHARMYNAARYVCTQPDMAFIQLVSFGCGVDAITTDELRSILEEAGELYTQLKIDDISNLGAVKIRIRSLMAALDARDAQNQKGGQ

SEQ ID NO: 584 - protein, 1409 aa, unidentified
  REGION 1..1409: note = Description of Unknown:uncultivated organism sequence
  REGION 1..1409: note = Category: MG55 effectors
  REGION 1..1409: note = Description: MG55-159 effector
MREFHIGMDVGSTTIKIVCLDEKDNIIYSIYQRHLSNVRETTKKMFDDFLEHMKNNFGEDIKYKISITGSSGMGISSWIGIDFVQEVIACIKSIETLIPETDVAIELGGEDAKITFLKNDMDQRMNGSCAGGTGAFIDQIATLLDTDASGLNELAKGFDSIYPIAARCGVFAKTDIQPLINEGVRKENIAVSVFQAVVNQTITGLACGKKITGKVAFLGGPLFFLSELRNRFIDTLKLAPEDVVFPENSQLFVAQGAAFLSKENDAVFSYEDLKTKVERLNEKDTSDTSRLQPLFETEDELNEFLERHEKEKIETRDLNTYEGNAYLGIDAGSTTIKVVLISEEKEILFSHYSHNKGNPLDNIIATLKELYSKMNKNIIIKGSCVTGYGETLIKAALRVDIGIVETMAHYKGSQFFQPDVDFILDIGGQDMKCLKIQDGIITSILLNEACSSGCGSFLETFAHSLGMDILEFSRLGMESKSPADLGTRCTVFMNSKVKQAQKDGVEVADISAGLSYSVVKNTLFKVIKIKNKDELGKNIVVQGGTFLNNSVLRAFELVSERSVIRPNVAGLMGAFGAALIAMEQAGESSSIMTLDELNNFSCTTNLTRCKLCNNHCLLTIHKFKNGENFISGNRCDNPLGKMKKNTAPNMFDYKYNRLFNYTPLEPSKAVRGEIGIPRVLNFYDSYPFWFTLLTNLGFRVIISDDSSKKLYEKGIDTISSDSICYPAKLVHGHIVDLIEKGVKRIFYPCVIFEEKEDEKSSNQFNCPIVMSYPEVINNNMDILKEKHIDLILPFFSFESKEILYKTVFEEFERFGISKSEAKIAVDAAWEEKYNFRKDMRNKALEIIADLEKTGKTGVVLCGRPYHCDKEIHHGIPNIINSFGIAVLTGDAVASLASLDEELRVIDQWTYHSRLYRAAAYVGKSKCLELIELNSFSCGIDAVTTDQVEEILANYGKVHTLLKIDEISNLGAVKIRIRSLLAALDYKKNALRSSIKKKIEYKRAQFTKKMKKEYTILAPQMAPMHFKLLKTAFKAEGYNLEVLDETQEALDCGLQYVNNDACYPSILVIGELIAALKSGKYDLDKTAVMISQTGGSCRATNYLGFLKKAIKDSGFEKIPILSLNASGFEKQEGFSITLPFAHKCLIAVSYGDILMKLLYHVRPYEKIKGSAFELYEKWNEKVKENIYNGKFSQFKNNINAIVNDFSKIEVSDEKKIRVGIVGEILVKFSPFANNNLADFIEAEGGEVYTSSLMSFVKYCIYSDIFITERFKGKIAAMKLKAALWIIDQYTKVLNNALQKNPRFGHEDSIQDLAKKTSQYISIGNQSGEGWFLMGEMIEFIEKDVPNIVCVQPFGCLPNHITGKGMIKKLRSEYSNVNIAPIDYDPAYSEVNQLNRIKLMLSVARKNLKNS

SEQ ID NO: 585 - protein, 983 aa, unidentified
  REGION 1..983: note = Description of Unknown:uncultivated organism sequence
  REGION 1..983: note = Category: MG55 effectors
  REGION 1..983: note = Description: MG55-160 effector
MALRIGIDIGSTTVKVVVLDAQNKLLFRSYERHYSKTRERTCETLRGLRGLLGGQQVQLLITGSAGLGVAKAAGLDFVQEVYATAAAVREFIPGTDAVIELGGEDAKIIFFGNTLEERMNGSCAGGTGAFIDQMATLLNVSVDELDELSLRHEKIYPIASRCGVFAKSDIQPILNQGGRKEDVAASIFQAVVDQTVAGLTQGRELKGTIVFLGGPLHFLAGLRQRFVETLHLDQDHAIFPEDGDCFAAIGAALCTEDSQPRPFEELLDLLEHAATVSTPVDTMDPLFTSQADYEAFSARHQAMAVPTVDLATYTGPAYLGIDAGSTTTKMVLIDPDCNLLYSFYHSNQGNPVSIVLPQLREIYAQCGGRVTIQGAAVTGYGEDLIKNAFSCDLGLVETVAHLNAARHFTPDVDFIIDIGGQDMKCFKIRNGAVDSILLNEACSSGCGSFIETFAKALGYTIADFSKMGLFARHPVNLGSRCTVFMNSSVKQAQKDGASVEDISAGLSISVVKNAIYKVIRAASADDLGQHIVVQGGTFLNDAVLRSFELEIGREVTRPTISGMMGAYGAALAAKDAGLTQSTLLSAEALASFTHEARPATCKLCTNHCSLTINRFDGGRKFISGNRCSRPLGQEKVDIPDLLKFKYQYLRSLQGKGEGDGSRGKIGIPFGLNMYENLPFWFTLFTTLNFEVVLSPESTRSLYLKGQQTIPSDTVCYPAKLLHGHIMALLEEGIDTIFYPCMSYNFDEHLSDNHYNCPVVAYYPDLLGVNIPALEDIKYLHPNLGLHRPKDFEKKGAQLLETEFGIPKRASVKAIRKAYAAYEDFRRLVQKKGEEYISFARETGRKILVVAGRPYHMDPEINHGINDLITSFGFVLITEDAVFQHMDKQPRRVLNQWTYHARMYNAARYVCTQPDMAFIQLVSFGCGVDAITTDELRSILEEAGELYTQLKIDDISNLGAVKIRIRSLMAALDARDARNQKGGQ

SEQ ID NO: 586 - protein, 731 aa, unidentified
  REGION 1..731: note = Description of Unknown:uncultivated organism sequence
  REGION 1..731: note = Category: MG55 effectors
  REGION 1..731: note = Description: MG55-161 effector
MAAAIEVNTRVIKRNGQEVTFDITKIINAIKKANVEVSGIYQLNEYQINAIADKIARKVSDAPHAVNVEDIQDMVEKGIMEMRGYEVAQKYVRYRYKRELSRKSNTTDNGILALINQENEEVKQENSNKNPVINSTQRDYMAGEVSKDLTKRILLPEDIVKAHEEGIIHFHDSDYYAQKEHNCDLINLEDMLQNGTVISQTMIEKPHSFFTACNVTTQIVAQVASNQYGGQSFTLSHLAPFVDVSRQKIRKSVIEERKECGEALDDAIIDKIVASRLQEEIRSGIQTIQYQLITLMTCNGQAPFVTMFMYLDEVPEGRTRDDLAMVIEEALKQRMQGVKNEKGVWITPAFPKIIYVLDEDNIYPDSKYYYLTELAAKCTAKRMVPDYISAKKMKEYKNGDVYPCMGCRSFLTPDTEGLGPNGQHKYYGRFNQGVVTINLVDVACSAHGDMDQFWKIFDERLELCHRALRCRHERLLGTPSDVAPILWQYGALARLKKGEKIDKLLYNNYSTISLGYAGLYEMCMRMLGVSHTDPKGKEFALKVMQHMDDKCAEWRKAENISYSLYGTPMESTTYKFAKCLQKRFGIIKNVTDHNYITNSYHVNVREKIDAFTKLKFEADFQKLSPGGAISYVEVPNMQQNIPAVLAVMRYIYDNIMYAELNTKSDYCEVCGYDGEIKIVEDKSGKLVWECPNCGNRDQSKMSVARRTCGYIGTQFWNQGRTQEIKDRVLHL

SEQ ID NO: 587 - protein, 1416 aa, unidentified
  REGION 1..1416: note = Description of Unknown:uncultivated organism sequence
  REGION 1..1416: note = Category: MG55 effectors
  REGION 1..1416: note = Description: MG55-162 effector
MKLDFNTLGIDIGSTTVKIAILNKDGEIIFSDYQRHYANIQETLAKIIDEAYEEFGDIPVSPMITGSGGLTLSKHMEIPFVQEVVAVATSLKDYAPRTDVAIELGGEDAKIIYFTGGIDQRMNGICAGGTGSFIDQMATLLKTDAAGLNEYAKNYKAIYPIAARCGVFAKTDIQPLINEGATKEDLSASIFQAVVNQTISGLACGKPIKGNVAFLGGPLHFLTELKQAFIRTLGLEGDAIIAPEHSHLFAASGAAMNAHADVQSSLGELKEKLSHKIELEFEVTRMEPLFASEKEYEDFTERHNKHNVRKGDFASYKGDLFLGIDAGSTTTKVAVIGDDGSLLYSFYSSNNGSPLKTALKAMKDIYSKMPEGARIVRSCSTGYGEALLKSALLLDEGEVETVAHYTAAAFFDPNVDCILDIGGQDMKCIKIKNNSVDKVQLNEACSSGCGSFIETFAKSLNYEVADFAKIALFAENPIDLGSRCTVFMNSKVKQAQKEGASVADISAGLAYSVIKNALLKVIKLTDPKDLGKQVVVQGGTFYNDAVLRSFERISGCEAIRPDIAGIMGAFGAALIAKDRYTGQKSTMLSFKEINELRFKTSMTRCQGCINHCLLTVNEFTGDRRFISGNRCEKGLGLEKNKEQIPNLFEYKNERVFRHYKPLKKADAPRGVVGIPRVLNMYENYPFWFTFFTKLGYSVKLSPVSSRKIYELGIESIPSESECYPAKLAHGHVTWLIRQGLEYIFYPCIPYERVEVPDAGNHYNCPIVTSYGENIKNNIEELRDDKIKYQNPFISLESEEILTKRLVDFFRKENGIPAAEIKAAAHEGWLEMQAVREDMNKKGKEVLQYLKETGRHGIVLAGRPYHSDPEINHGIPDLITSYGVAVLTEDSISELSEVDRPTIVMDQWMYHSRLYKAASFVAKNDNLDLIQLNSFGCGLDAVTTDQVSDILTKQNKIYTVLKIDEVNNLGAARIRIRSLLAAVKDRERKKIEAKRVDTAHHRVIFTEQMRKDYTILVPDMSPIHFEILESALASCGYNVEVLKADSKCIDYGLKYVNNDACYPSLIVVGQFMQALLSGKYDLHKVALIITQTGGGCRATNYIGFIRRALEKAGMGYIPVISMSAGIEKNPGLKVNLEMANKALQALIYGDVFMRVLYKTRPYEKVKGSANALHEKWKKIAIESVKKANKKQFKKNIQNIVKEFDELELVDIKKPKVGIVGEILVKFMPLANNFIVELLEEEGAEAVCPDLIDFFMYSLYNANFKAEYLGKKKSSAKINNFLIWFIERYRKCANDALAASKRFHPTVPIQKLAEYASPIVSCGNQTGEGWFLTGEMIELIKSGVPNIVCTQPFGCLPNHVVGKGVIKELRHQYPDSNIVAVDYDPGASEVNQLNRIKLMLSTAGKNLIAESKDNEETA

SEQ ID NO: 588 - protein, 1416 aa, unidentified
  REGION 1..1416: note = Description of Unknown:uncultivated organism sequence
  REGION 1..1416: note = Category: MG55 effectors
  REGION 1..1416: note = Description: MG55-163 effector
MKLDFNTLGIDIGSTTVKIAILNKDGEIIFSDYQRHYANIQETLAKIIDEAYEEFGDIPVSPMITGSGGLTLSKHMEIPFVQEVVAVATSLKDYAPRTDVAIELGGEDAKIIYFTGGIDQRMNGICAGGTGSFIDQMATLLKTDAAGLNEYAKNYKAIYPIAARCGVFAKTDIQPLINEGATKEDLSASIFQAVVNQTISGLACGKPIKGNVAFLGGPLHFLTELKQAFIRTLGLEGDAIIAPEHSHLFAASGAAMNAHADVQSSLGELKEKLSHKIELEFEVTRMEPLFASEKEYEDFTERHNKHNVKKGDFASYKGDLFLGIDAGSTTTKVAVIGDDGSLLYSFYSSNNGSPLKTALKAMKDIYSKMPEGARIVRSCSTGYGEALLKSALLLDEGEVETVAHYTAAAFFDPNVDCILDIGGQDMKCIKIKNNSVDKVQLNEACSSGCGSFIETFAKSLNYEVADFAKIALFAENPIDLGSRCTVFMNSKVKQAQKEGASVADISAGLAYSVIKNALLKVIKLTDPKDLGKQVVVQGGTFYNDAVLRSFERISGCEAIRPDIAGIMGAFGAALIAKDRYTGQKSTMLSFKEINELRFKTSMTRCQGCINHCLLTVNEFTGDRKFISGNRCEKGLGLEKNKEHIPNLFEYKNERVFKHYKPLKKADAPRGVVGIPRVLNMYENYPFWFTFFTKLGYSVKLSPVSSRKIYELGIESIPSESECYPAKLAHGHVTWLIRQGLEYIFYPCIPYERVEVPDAGNHYNCPIVTSYGENIKNNIEELRDDKIKYQNPFISLESEEILTKRLVDFFRKENGIPAAEIKAAAHEGWLEMQAVREDMNKKGKEVLQYLKETGRHGIVLAGRPYHSDPEINHGIPDLITSYGVAVLTEDSISELSEVDRPTIVMDQWMYHSRLYKAASFVAKNDNLDLIQLNSFGCGLDAVTTDQVSDILTKQNKIYTVLKIDEVNNLGAARIRIRSLLAAVKDRERKKIEAKRVDTAHHRVIFTEQMRKDYTILVPDMSPIHFEILESALASCGYNVEVLKADSKCIDYGLKYVNNDACYPSLIVVGQFMQALLSGKYDLHKVALIITQTGGGCRATNYIGFIRRALEKAGMGYIPVISMSAGIEKNPGLKVNLEMANKALQALIYGDVFMRVLYKTRPYEKVKGSANALHEKWKKIAIESVKKANKKQFKKNIQNIVKEFDELELVDIKKPKVGIVGEILVKFMPLANNFIVELLEEEGAEAVCPDLIDFFMYSLYNANFKAEYLGKKKSSAKINNFLIWFIERYRKCANDALAASKRFHPTVPIQKLAEYASPIVSCGNQTGEGWFLTGEMIELIKSGVPNIVCTQPFGCLPNHVVGKGVIKELRHQYPDSNIVAVDYDPGASEVNQLNRIKLMLSTAGKNLIAESKDNEETA

SEQ ID NO: 589 - protein, 979 aa, unidentified
  REGION 1..979: note = Description of Unknown:uncultivated organism sequence
  REGION 1..979: note = Category: MG55 effectors
  REGION 1..979: note = Description: MG55-164 effector
MSLRIGIDIGSTTVKVVVLDEQNKLLFRSYERHYSKTRERACETLRSISDMLAGRQVKMVITGSAGLGVANASGIDFVQEVYATAAAVNTYIPGTDAVIELGGEDAKIIFFGGALEERMNGSCAGGTGAFIDQMATLMNVSVDELDALSLKHEKIYPIASRCGVFAKSDIQPILNQGGRKEDVAASIFQAVVDQTVAGLTQGRELKGKIVFLGGPLHFLMGLRERFVETLKLDEEHAIFPEDGDCFAAMGAALCSSDYDTILFEDALKKLEESVDTTTLVDTMPPLFQDVAEYGAFCARHNAKRPPEVDIKTYEGPAWLGIDAGSTTTKLALITGDGGLLYTYYHSNLGNPVAIVLEQLREIYAQCGDRIEIRGVAVTGYGEDLIKNAFSCDLGLVETMAHYKAAAHFEPDVDFIIDIGGQDMKCFKIRNGAVDSIMLNEACSSGCGSFIETFAKALGYTIADFAKLGLFAQKPVNLGSRCTVFMNSSVKQAQKDGASVEEISAGLSISIVKNAIYKVIRAASADDLGKHIVVQGGTFLNDAVLRAFEQELGRDVTRPTISGIMGAFGAALAARDLHLEKSAVLTAQALEKFTHTAKPATCGLCTNHCALTVNTFDGGRRFVSGNRCSRPLGEEPTHLPDLMRYKYAKLRALQGKGQGDGSRGRIGIPFGLNMYENLPFWFELFTRLNFEVVLSPESSRKLYVKGQRTIPSDTVCYPAKLLHGHMEALVEQGVDAIFYPCMPYNFNEGVSDNNYNCPVVAYYPELLAANVPELKKTRYLYPYFGLHRPKDFEKHAAKWFEEEFGVPRKETVAAARAAYGAYDAYKNDLRATAQQYIAQARAEGRPILVVAGRPYHMDPEINHGINDLITNYGFILITEDAVAYLEDKAPRHVLNQWTYHARMYNAARYVCTQPDMELIQLVSFGCGIDAITGDEMRSILEEGGKLYTQLKIDDISNLGAVKIRIRSLMAAIEARKQSEE

SEQ ID NO: 590 - protein, 1439 aa, unidentified
  REGION 1..1439: note = Description of Unknown:uncultivated organism sequence
  REGION 1..1439: note = Category: MG55 effectors
  REGION 1..1439: note = Description: MG55-165 effector
MIKTLHVGLDVGSTTVKIIVMDENLNTIYTDYKRHFSDTKNTICNVLENLIIMYPNTEFTIALTGSGAISAAKFLDLPFIQEVVSCKRAVEKYIPETDVVIELGGEDAKIIYFDKFIEQRMNGTCAGGTGAFIDQMASLLNTDPTGLNELAKSHKLIYPIASRCGVFAKTDIQPLLNEGAAKEDIAASIFQAVVNQTISGLACGRPIRGNVAFLGGPLNYLSELRNRFIETLNLKDNEIIVPNEAHLLVAKGAALDSLNSHTITIEKLKSKIEVLKSSHDDTSNPLNPLFSIDAEYDEFKKRHEKDKVKRADFKTFKGNCFLGIDAGSTTTKLVVISEDGTLLYSLYGSNEGNPLQSVINMLKKLYAEKPSEAVIRFSGVTGYGEKLIQTALNVDLNEIETIAHYTAAKEFMPNVTSIVDIGGQDMKYIKMKNGAIDNIMLNEACSSGCGSFIETFAKSLGLSIQDFVQSALEARRPVDLGSRCTVFMNSKIKQAQKEGYSVGDISAGLSYSVIKNAIQKVMKVRDVKKLGAHIVVQGGTFYNDAVLRAFELIVGRNVVRPDIAGLMGAYGVALLAKEQYENNLDMDYVSSISNINELDKLEINITHIRCQGCENHCLLTINKFSNGAKYISGNRCEKGAGIVDKTLDRPNLIKYKFERTFNYTPLEEKNAPRGTIGIPRVLNMYEDYPFWFTFLTNLGFRVILSEKSNRKTYEKGMESMPSESVCFPAKLSHGHIIGLINSGIKTIFYPCIPYSRKEYQKADNHYNCPIVISYSEVLKNNVEELKDKNIKFLNPFLPFEPDKLAEIIMNLPEFKEYNFTKKELLSAAKKAETEYQNYKSDIHNKGQETLKFMEENNLKGIVLAGRPYHVDPEVNHGIDTLITSLGLCVLTEDSISNLTEAKRPLRVVDQWVFHARLYAAADFVGKHDNLELVQLNSFGCGVDAVTTDQVEEILTSYEKMYTLIKIDEINNLGAIRIRIRSLLASMNKRIKDNNSSMCNGNYEVNKKIFTKEMRKDYTILMPQMAPIHFEFLESAMKNSGYKMELLKDCTQHTVETGLKYVNNDACYPSILVTGQMIEALESGKYDLNKTALIMSQTGGGCRATNYIGFIRKALKDAGFENVPVISFNVVGMEKMPGFKLTIPLIERLIKSCIYADLLQKMLTKNRAYEINKGKTKELFDYWMEKCKKLVNKSSIKEFKQSIFDIVSDFEKIEIDTSVIKPKVGIVGEVLIKYHPFGNNFVADKLEQEGAEVILPDFMGFIKFIATHKITFNKLIKTDAIKAKLFKTAIKLIDLLEKPVISALNNSKKGYLLPCNIWDLEEKVNDILSIGNQTGEGWFLTAEMIEYIEHDIPNIVCVQPFACLPNHVVGKGVIKTIRSKFPEANIAPIDYDPGASEANQTNRIKLMMTVAKDNLKNKNNINKAIKKENYIIDEKNKISN

SEQ ID NO: 591 - protein, 983 aa, unidentified
  REGION 1..983: note = Description of Unknown:uncultivated organism sequence
  REGION 1..983: note = Category: MG55 effectors
  REGION 1..983: note = Description: MG55-166 effector
MALRIGIDIGSTTVKVVVLDAQNKLLFRSYERHYSKTRERTCETLRGLRGLLGGQQVQLLITGSAGLGVAKAAGLDFVQEVYATAAAVREFIPGTDAVIELGGEDAKIIFFGNTLEERMNGSCAGGTGSFIDQMATLLNVSVDELDELSLRHEKIYPIASRCGVFAKSDIQPILNQGGRKEDVAASIFQAVVDQTVAGLTQGRELKGTIVFLGGPLHFLAGLRQRFVETLHLDQDHAIFPEDGDCFAAIGAALCTEDSQPRPFEELLDLLEHAATVSTPVDTMDPLFTSQADYEAFSARHQAMAVPTVDLATYTGPAYLGIDAGSTTTKMVLIDPDCNLLYSFYHSNQGNPVSIVLPQLREIYAQCGGRVTIQGAAVTGYGEDLIKNAFSCDLGLVETVAHLNAARHFTPDVDFIIDIGGQDMKCFKIRNGAVDSILLNEACSSGCGSFIETFAKALGYTIADFSKMGLFARHPVNLGSRCTVFMNSSVKQAQKDGASVEDISAGLSISVVKNAIYKVIRAASADDLGQHIVVQGGTFLNDAVLRSFELEIGREVTRPTISGMMGAYGAALAAKDAGLTQSTLLSAEALASFTHEARPATCKLCTNHCSLTINRFDGGRKFISGNRCSRPLGQEKVDIPDLLKFKYQYLRSLQGKGEGDGSRGKIGIPFGLNMYENLPFWFTLFTTLNFEVVLSPESTRSLYLKGQQTIPSDTVCYPAKLLHGHIMALLEEGIDTIFYPCMSYNFDEHLSDNHYNCPVVAYYPDLLGVNIPALEDIKYLHPNLGLHRPKDFEKKGAQLLETEFGIPKRASVKAIRKAYAAYEDFRRLVQKKGEEYISFARETGRKILVVAGRPYHMDPEINHGINDLITSFGFVLITEDAVFQHMDKQPRRVLNQWTYHARMYNAARYVCTQPDMAFIQLVSFGCGVDAITTDELRSILEEAGELYTQLKIDDISNLGAVKIRIRSLMAALDARDARNQKGGQ

SEQ ID NO: 592 - protein, 747 aa, unidentified
  REGION 1..747: note = Description of Unknown:uncultivated organism sequence
  REGION 1..747: note = Category: MG55 effectors
  REGION 1..747: note = Description: MG55-167 effector
MEEKENVSVKINVIKRNGQEVDFDISKIVNAIRKANAEVSGIYQMNDYQINAVADNIAKKVQNSSHAVNVEDIQDMVETGIMEMRGYEVAQKYVRYRYKREISRKSNTTDNGILALINQQNEEVKQENSNKNPVINSTQRDYMAGEVSKDLTKRVLLPEDIVKAHEEGIIHFHDSDYYAQKEHNCDLINLEDMLQNGTVISETLIEKPHSFFTACNVTTQIVAQVASNQYGGQSFTLSHLAPFVDVSRKKLTKQVLEERRLTGETQDADIISKIVENRLDEEIKSGIQTIQYQLITLMTCNGQAPFVTMFMYLDEVPEGQTRDDLARIIREVLLQRMQGVKNEKGVWITPAFPKLIYVLDEDNIRPDSKYYSLTELAAKCTSRRMVPDYISAKKMKEYKNGDVYPCMGCRSFLTPDTEGLDPNGKHKYYGRFNQGVVTINLVDVACSSYGDMEAFWKIFDERLELCHRALRCRHERLLGTISDVAPILWQYGALARLGKGEKIDRLLYNNYSTISLGYAGLYEMCMRMLGVSHTDPKGKEFALQVMQHLNDKCAEWRKAENISYSLYGTPMESTTYKFAKCLQKRFGIIKDVTDHNYITNSYHVNVRENIDAFTKLRFEADFQKLSPGGAISYVEVPNMQNNIPAVLSVMQYIYDNIMYAELNTKSDYCEVCGYDGEIRIVEDENGKLVWECPNCGNRDQSKMSVARRTCGYIGTQFWNQGRTQEIKDRVLHLSNKSFGSEVSGVQS

SEQ ID NO: 593 - protein, 720 aa, unidentified
  REGION 1..720: note = Description of Unknown:uncultivated organism sequence
  REGION 1..720: note = Category: MG55 effectors
  REGION 1..720: note = Description: MG55-168 effector
MKIIKRSGAEAVFDISKIIIAINKANHEVVEAERLTADQIKEIAQYIEDSCKDANHALNVEDIQDLVEDQLMDKRAFSVARKYITYRYKRALVRKSNSTDEQILSLIECNNEEVKQENSNKDSTVNSVQRDYMAGEVSKDITRRFLLPEDIVEAHEQGIIHFHDADYFAQHMHNCDLVNLEDMLQNGTVISGTRIDKPHSFSTACNIATQIIAQVASSQYGGQSISLAHLVPFVQISREKIHAELVQTLKESDVELSEEKINSIVERRLHAEIERGVQVIQYQVVTLMTTNGQSPFVTVFMYLNEAKNEQEKKDLAMIIEEVLDQRYQGVKNEDGVWITPAFPKLIYVLEEDNIHEDSEYYYLTKKAAKCTAKRMVPDYISEKKMKELKDGNCYTCMGCRSFLTVYHDEAGKPKFYGRFNQGVVTLNLVDLACSSGGDFEKFWKLFDERLDLCYRALMARHNRLKGTPSDVAPILWQYGALARLKKGETIDKLLYGGYSTISLGYAGLCECTRYMTGKPHTDPAATPFALKVMQRLNDACKEWKEKENIDFSVYGTPLESTTYKFAKCLQKRFGVIPGVTDKNYITNSYHVHVTENIDAFTKLKFESQFQALSPGGAISYVEVPNMQDNLDAVLSVMKFIYENIMYAELNTKSDYCQVCGYDGEIQIVKDDDGKLVWECPHCHNRDQDKMNVARRTCGYIGSQFWNQGRTQEIKERVLHL

SEQ ID NO: 594 - protein, 1416 aa, unidentified
  REGION 1..1416: note = Description of Unknown:uncultivated organism sequence
  REGION 1..1416: note = Category: MG55 effectors
  REGION 1..1416: note = Description: MG55-169 effector
MKLDFNTLGIDIGSTTVKIAILNKDGEIIFSDYQRHYANIQETLAKIIDEAYEEFGDIPVSPMITGSGGLTLSKHMEIPFVQEVVAVATSLKDYAPRTDVAIELGGEDAKIIYFTGGIDQRMNGICAGGTGSFIDQMATLLKTDAAGLNEYAKNYKAIYPIAARCGVFAKTDIQPLINEGATKEDLSASIFQAVVNQTISGLACGKPIKGNVAFLGGPLHFLTELKQAFIRTLGLEGDAIIAPEHSHLFAASGAAMNAHADVQSSLGELKEKLSHKIELEFEVTRMEPLFASEKEYEDFTERHNKHNVRKGDFSSYKGDLFLGIDAGSTTTKVAVIGDDGSLLYSFYSSNNGSPLKTALKAMKDIYSKMPEGARIVRSCSTGYGEALLKSALLLDEGEVETVAHYTAAAFFDPNVDCILDIGGQDMKCIKIKNNSVDKVQLNEACSSGCGSFIETFAKSLNYEVADFAKIALFAENPIDLGSRCTVFMNSKVKQAQKEGASVADISAGLAYSVIKNALLKVIKLTDPKDLGKQVVVQGGTFYNDAVLRSFERISGCEAIRPDIAGIMGAFGAALIAKDRYTGQKSTMLSFKEINELRFKTSMTRCQGCINHCLLTVNEFTGDRKFISGNRCEKGLGLEKNKEQIPNLFEYKNERVFRHYKPLKKADAPRGVVGIPRVLNMYENYPFWFTFFTKLGYSVKLSPVSSRKIYELGIESIPSESECYPAKLAHGHVTWLIRQGLEYIFYPCIPYERVEVPDAGNHYNCPIVTSYGENIKNNIEELRDDKIKYQNPFISLESEEILTKRLVDFFRKENGIPAAEIKAAAHEGWLEMQAVREDMTKKGKEVLQYLKETGRHGIVLAGRPYHSDPEINHGIPDLITSYGVAVLTEDSISELSEVDRPTIVMDQWMYHSRLYKAASFVAKNDNLDLIQLNSFGCGLDAVTTDQVSDILTKQNKIYTVLKIDEVNNLGAARIRIRSLLAAVKDRERKKIEAKRVDTAHHRVIFTEQMRKDYTILVPDMSPIHFEILESALASCGYNVEVLKADSKCIDYGLKYVNNDACYPSLIVVGQFMQALLSGKYDLHKVALIITQTGGGCRATNYIGFIRRALEKAGMGYIPVISMSAGIEKNPGLKVNLEMANKALQALIYGDVFMRVLYKTRPYEKVKGSANALHEKWKKIAIESVKKANKKQFKKNIQNIVKEFDELELVDIKKPKVGIVGEILVKFMPLANNFIVELLEEEGAEAVCPDLIDFFMYSLYNANFKAEYLGKKKSSAKINNFLIWFIERYRKCANDALAASKRFHPTVPIQKLAEYASPIVSCGNQTGEGWFLTGEMIELIKSGVPNIVCTQPFGCLPNHVVGKGVIKELRHQYPDSNIVAVDYDPGASEVNQLNRIKLMLSTAGKNLIAESKDNEETA

SEQ ID NO: 595 - protein, 708 aa, unidentified
  REGION 1..708: note = Description of Unknown:uncultivated organism sequence
  REGION 1..708: note = Category: MG55 effectors
  REGION 1..708: note = Description: MG55-170 effector
MKVIKRDGSTADFDSSKIIVAIQKANQVVEPEDRIDQERIEAIAHYVESKNRMRLLVEDIQDMVEHQLMDEGKFNLAKSYIIYRYTRALVRKANTTDESILSLIRNSNKDVMEENSNKNAVMASTQRDLIAGEVSKDLTRRLILPEKISKAHDEGAIHFHDADYFVQPIFNCCLINVGDMLDNGTVMNGKLIESPKSFQVACTVMTQIIASVASSQYGGQSVDIRHLGKYLRRSYEKFKLTIKAEVGDSVADEVVERLTKRRLQDELRSGVQTIQYQINTLMTTNGQSPFVTIFLNLQADDEYLEENAMIVEEVLRQRLEGIKNDKGVFVTPAFPKLVYVLDEHNCLKGGKYDYITKLAVKCSAKRLYPDYISAKKMRENYEGNVFAPMGCRSFLAAWKDDEGNYKFEGRFNQGVVSLNLPQVAILAHGDEEKFWPLLDERLQLCYEALMCRHNSLKGIRSDVSPVHWQYGAIARLEKGEVIDKYLEKGYSTISLGYIGLYEMTKLMKDVSHTTPEGEEFALRVMKYLRAACDKWKKETGLGFALYGTPAESLCYRFARIDKERFGTIADVTDKGYYTNSYHVDVREDIDAFSKFNFESQFQRISSGGAISYVEIPNMRHNLEAMEDVVRFIYDNIQYAEFNTKSDYCHVCGFDGEIIINDDLEWECPNCGNKNQTLMNVTRRTCGYLGENFWNVGKTKEIKSRVLHL

SEQ ID NO: 596 - protein, 722 aa, unidentified
  REGION 1..722: note = Description of Unknown:uncultivated organism sequence
  REGION 1..722: note = Category: MG55 effectors
  REGION 1..722: note = Description: MG55-171 effector
MKIIKRNGAEVSFDVEKILNAVRKANNEVSEDNRLSEEQIEEIAKRVTALAGDLNRAVNVEEVQDFVENQIMDQKAFAVARKYITYRYTRALIRRANTTDAQILTLIECNNEEVKQENSNKNPTVNSVQRDYMAGEVSKDLTRRLLLPRDIVEAHDEGLIHFHDADYFAQHMHNCDLVNLEDMLQNGTVISGTFIEKPHSFSTACKIATQIIAQVASNQYGGQSISLTHLAPFVDISRQKIRAEVKEELADVGVMEDTIARIAEKRLREEIKKGIQTIQYQVVTLLTTNGQAPFVTVFMYLGEARNERERADLAMIIEETLNQRIQGVKNESGVWVTPAFPKLIYVLEEDNIREGSKYWYLTELAARCTAKRMVPDYISEKKMLEYKIDKNGEGHCYTCMGCRSFLTPYVDAEGKPKYYGRFNQGVVTINLVDVALSSGGDMDEFWKIFDERLELCHRALLERHNRLKGTLSDAAPILWQYGALARLKKGETIDKLLYGGYSTISLGYAGLYECTKYMTGKSHTDAAAKPFALSVMQHMNDKCKEWKGMHNIDFSLYGTPLESTTYKFAKALQKRFGINEGVTDKNYITNSYHGHVTEPIDAFTKLKFESEFQQLSPGGAISYVEVPNMQDNIPAVLSVMQYIYDNIMYAELNTKSDYCQVCGYDGEIGIVEEDGKLLWECPYCHNRDQSKMNVARRTCGYIGTQFWNQGRTQEIKDRVLHL

SEQ ID NO: 597 - protein, 1410 aa, unidentified
  REGION 1..1410: note = Description of Unknown:uncultivated organism sequence
  REGION 1..1410: note = Category: MG55 effectors
  REGION 1..1410: note = Description: MG55-172 effector
MKLDFNTLGIDIGSTTVKIAILNKDGEIIFSDYQRHYANIQETLAKIIDEAYEEFGDIPVSPMITGSGGLTLSKHMEIPFVQEVVAVATSLKDYAPRTDVAIELGGEDAKIIYFTGGIDQRMNGICAGGTGSFIDQMATLLKTDAAGLNEYAKNYKAIYPIAARCGVFAKTDIQPLINEGATKEDLSASIFQAVVNQTISGLACGKPIKGNVAFLGGPLHFLTELKQAFIRTLGLEGDAIIAPEHSHLFAASGAAMNAHADVQSSLGELKEKLSHKIELEFEVTRMEPLFASEKEYEDFTERHNKHNVRKGDFSSYKGDLFLGIDAGSTTTKVAVIGDDGSLLYSFYSSNNGSPLKTALKAMKDIYSKMPEGARIVRSCSTGYGEALLKSALLLDEGEVETVAHYTAAAFFDPNVDCILDIGGQDMKCIKIKNNSVDKVQLNEACSSGCGSFIETFAKSLNYEVADFAKIALFAENPIDLGSRCTVFMNSKVKQAQKEGASVADISAGLAYSVIKNALLKVIKLTDPKDLGKQVVVQGGTFYNDAVLRSFERISGCEAIRPDIAGIMGAFGAALIAKDRYTGQKSTMLSFKEINELRFKTSMTRCQGCINHCLLTVNEFTGDRKFISGNRCEKGLGLEKNKEQIPNLFEYKNERVFRHYKPLKKADAPRGVVGIPRVLNMYENYPFWFTFFTKLGYSVKLSPVSSRKIYELGIESIPSESECYPAKLAHGHVTWLIRQGLEYIFYPCIPYERVEVPDAGNHYNCPIVTSYGENIKNNIEELRDDKIKYQNPFISLESEEILTKRLVDFFRKENGIPAAEIKAAAHEGWLEMQAVREDMTKKGKEVLQYLKETGRHGIVLAGRPYHSDPEINHGIPDLITSYGVAVLTEDSISELSEVDRPTIVMDQWMYHSRLYKAASFVAKNDNLDLIQLNSFGCGLDAVTTDQVSDILTKQNKIYTVLKIDEVNNLGAARIRIRSLLAAVKDRERKKIEAKRVDTAHHRVIFTEQMRKDYTILVPDMSPIHFEILESALASCGYNVEVLKADSKCIDYGLKYVNNDACYPSLIVVGQFMQALLSGKYDLHKVALIITQTGGGCRATNYIGFIRRALEKAGMGYIPVISMSAGIEKNPGLKVNLEMANKALQALIYGDVFMRVLYKTRPYEKVKGSANALHEKWKKIAIESVKKANKKQFKKNIQNIVKEFDELELVDIKKPKVGIVGEILVKFMPLANNFIVELLEEEGAEAVCPDLIDFFMYSLYNANFKAEYLGKKKSSAKINNFLIWFIERYRKCANDALAASKRFHPTVPIQKLAEYASPIVSCGNQTGEGWFLTGEMIELIKSGVPNIVCTQPFGCLPNHVVGKGVIKELRHQYPDSNIVAVDYDPGASEVNQLNRIKLMLSTAGKNLQIENL

SEQ ID NO: 598 - protein, 708 aa, unidentified
  REGION 1..708: note = Description of Unknown:uncultivated organism sequence
  REGION 1..708: note = Category: MG55 effectors
  REGION 1..708: note = Description: MG55-173 effector
MKIQKRDGRIVPYEEEKIIDAIHKANQEVEEKDRADDTLIEQILEAVKAEGKKQQTVEHVQDVIEQHLVEANKYVLSKKYMVYRYQRSLLRKSNTTDESILKLIRNENKELAEENSNKNTRLASTQRDYIAGEVSRDVTRRMLLPEHISMAHDNGVLHFHDADYFIQPIFNCCLINIQDMLDNGTSINGKMIESPKSFQVACTVTTQIIAAVASNQYGGQSVNIKHLGKYLRKSKEKFTKQLEDEFGDSLDAAMKEKIVQMRLKDELKSGVQTIQYQINTLMTTNGQSPFVTLFLHIDENDEYVEETVQIIGEILRQRIEGTKNEKGVYVTPAFPKLVYVLDENNCLKGGKYDYVTRLAAKCSAKRMYPDYISAKKMRENYEGNVFSCMGCRSFLSPWKDENGNYKWEGRFNQGVVSLNLPQIGIIADGNEEVFWKLLDERLELCYEALMCRHKALLGTVSDVSPIHWQYGAIARLKKGEKIDRLLLNGYSTMSLGYIGLYELTYLMKGCSHTAPKGKEFALRVMDHLREAAARWKEETGIGFSLYGTPAETLCYRFARIDREKYGDIPNVTDKGYYTNSYHVDVREKMDAFTKFTFESEFQNKSLGGAISYVEIPNLNNNLEAIEELIRFIYDNIQYGEFNTKSDYCHVCGYDGEIIVNDDNEWECPQCHNKDHAKMNVTRRTCGYLGENFWNTGKTKEIKARVLHL

SEQ ID NO: 599 - protein, 973 aa, unidentified
  REGION 1..973: note = Description of Unknown:uncultivated organism sequence
  REGION 1..973: note = Category: MG55 effectors
  REGION 1..973: note = Description: MG55-174 effector
MRIGMDIGSTTIKCVVLDENDQIIYSAYERHYSHILEKTRELLTSLNDTYLKGKKAYFAISGSAGMGLADSCGVSFVQEVFADRVAANRLNPGTDCIIELGGEDAKILFLTNGTEVRMNGSCAGGTGAFIDQMATLLKMSADEMDKTAQQATRKYTIAARCGVFAKSDVQPLINQGALSSDIAASIYQAVVNQTIAGLAQGRPISGKILYLGGPLTFSKCLRDSFNETLKIEGICPENSLLYVALGAAYYADKEVVFDDVVKGLANYGKTATYASLPPLFNNVEEYNEFKKRHAKASVPRVDFDENTGPVHIGIDSGSTTIKVAVIDDHANLLFTDYQSNSGNPLPIVIDVLKGLYEQHPNLKIQSVTTTGYGEALMTHALHTDFGLVETVAHFTAAKHFMPDVDFIIDIGGQDMKCFKIENGAISDIFLNEACSSGCGSFLQTFSAALGYSVKNFAQEALFAKQPVDLGSRCTVFMNSSVKQAQKDGADFDCISAGLSISVVKNALYKVIRTSSPEQLGKKIVVQGGTFYNEAVLRAFEKEMGVDVVRPDIAGLMGAYGAALHGKEHSKPGTISSILTLEELNNFTQKVQNVQCGLCGNHCQMTVSVFQDGKRFITGNRCDRPITGKSNDDTLNLYAYKQQQLSQLMKNPGNGTRGKIGIPMVLNMYELLPFWHAFFTSLGFQVIVSPFSNRKLYQAGQGSIPSDTVCFPAKLTHGHIMALLKKDVDAIFYPCMSYNIDEGLGDNHYNCPVVAYYPEVLAGNIRELEDTKFIYEYLNLEQRKDFVRLMPKIMQKYFPDLKTADIHNAIEVAYTAYRKHMEDTRNEAQRMMTEARNEGKRIIVLAGRPYHVDPEVNHGIDKLIVQHGACVITEDSISNLVQKFDTSVLNQWSYHSRLYAAAKYCVNHADMDLVQLVSFGCGLDAVTSDETKEILQEGNKLYTQLKIDEITNLGAINIRIRSLFAALDERKEQA

SEQ ID NO: 600 - protein, 708 aa, unidentified
  REGION 1..708: note = Description of Unknown:uncultivated organism sequence
  REGION 1..708: note = Category: MG55 effectors
  REGION 1..708: note = Description: MG55-175 effector
MKVIKRDGSTADFDSSKIIVAIQKANQVVEPEDRIDQERIEAIAHYVESKNRMRLLVEDIQDMVEHQLMDEGKFNLAKSYIIYRYTRALVRKANTTDESILSLIRNSNKDVMEENSNKNAVMASTQRDLIAGEVSKDLTRRLILPEKISKAHDEGAIHFHDADYFVQPIFNCCLINVGDMLDNGTVMNGKLIESPKSFQVACTVMTQIIASVASSQYGGQSVDIRHLGKYLRRSYEKFKLTIKAEVGDSVADEVVERLTKRRLQDELRSGVQTIQYQINTLMTTNGQSPFVTIFLNLQADDEYLEENAMIVEEILRQRLEGIKNDKGVFVTPAFPKLVYVLDEHNCLKGGKYDYITKLAVKCSAKRLYPDYISAKKMRENYEGNVFAPMGCRSFLAAWKDDEGNYKFEGRFNQGVVSLNLPQVAILAHGDEEKFWPLLDERLQLCYEALMCRHNSLKGIRSDVSPVHWQYGAIARLEKGEVIDKYLEKGYSTISLGYIGLYEMTKLMKDVSHTTPEGEEFALRVMKYLRAACDKWKKETGLGFALYGTPAESLCYRFARIDKERFGTIANVTDKGYYTNSYHVDVREDIDAFSKFNFESQFQRISSGGAISYVEIPNMRHNLEAMEDVVRFIYDNIQYAEFNTKSDYCHVCGFDGEIIINDDLEWECPNCGNKNQTLMNVTRRTCGYLGENFWNVGKTKEIKSRVLHL

SEQ ID NO: 601 - protein, 1410 aa, unidentified
  REGION 1..1410: note = Description of Unknown:uncultivated organism sequence
  REGION 1..1410: note = Category: MG55 effectors
  REGION 1..1410: note = Description: MG55-176 effector
MKKFLVGIDVGSTTVKIVCLDDKFNIVYSIYQRHLSNVRETTKLLFNNFLKYMEEHYGKNVSIKLNITGSSGMGIASCIEIDFIQEVIACIKAIETVIPQTDVAIELGGEDAKITFLKNDMDQRMNGSCAGGTGAFIDQIAALLNTDATGLNEMAKNYDTIYPIAARCGVFAKTDIQPLINEGAKKGNIAVSVFQAVVNQTITGLACGKKISGKIAFLGGPLFFLSELRKRFIETLNIKDEDVIFPDNSQIFVAQGAAFAAQENKTSYILEELATKFENLTKKGNDETSRLDSLFKDKIEYDEFINRHANEKIDTVDINEYEGDAFLGIDAGSTTIKLVLISDDNKILYSFYSHNKGNPLDNIIENLKTLYKKMGDKIKIKGSCVTGYGENLIKAALQVDNGIVETIAHYKGALFFQPKVDFILDIGGQDMKCLKINDGVISSILLNEACSSGCGSFLETFANSLGMDIKEFAKLGLNSKSPADLGTRCTVFMNSKVKQAQKDGVDVGDISAGLSYSVVKNTLFKVIKIKNKEELGKYIVVQGGTFLNDCVLRAFEKIANRNVIRPNIAGLMGAFGAAIVAKERSGAKSTLLSLKELEDFSCSTNLTRCGMCTNRCLLTIHKFKSGENFISGNRCDNPINKVKKEQAPNMFEYKYNRLFNYTPLELSKAYRGEIGIPRVLNFYDSYPFWFTLLTNLGFRVVISDDSSKKLYESGIDTITSDSICYPAKLVHGHITNLVNKGIKRIFYPCVIFEEKEDKNSQNQYNCPIVMSYPEVIKNNMDILKDNNIDMMIPVFSFENTEVLYKRVSEIFARFGVSKNEAKIAVDKALEEKYRFRKDMQNKAKEIITNLETTGNIGVVLCGRPYHCDKEIHHGIPNIINSFGIAVLTGDAVASLGSLDDELRVIDQWTYHSRLYRAATVVGKHPNLELVELNSFSCGIDAVTTDQVNEILTNYGKVHTLLKIDEISNLGAIKIRIRSLLAALEYKKSSITNKIKHTIKYKKAEFTKSMKSEYTILAPQMAPMHFDLIKHAFRAQGYNLVVLPETKEALDCGLKYVNNDACYPSILVIGELISALQSGKYDLDKTAVIISQTGGSCRATNYLGFLRKAIRDAGFEKIPIISLNTAGFEKQPGFSLSLPFIHKALIAVSYGDLLMKLLYRTRPYEVNYGESDKIYKKWNQLVIPNIYNGKISQFKKNIKSIINDFSNIEITNEEKIKVGIVGEILVKFSPFANNNLAAFIEQEGGEVYTSSLMNFIKYCIYSDIYLNEKFKGKLSSIFLRSALWVLDKYTNIVNSALSENSRFSKETSIQKTAEKTSRFISIGHQSGEGWFLMGEMIEFIEEGIPNIVCVQPFGCLPNHITGKGMIKRLKEEYENVNITPIDYDPAYSEVNQLNRIKLMLSVAKKNLKKSS

SEQ ID NO: 602 - protein, 708 aa, unidentified
  REGION 1..708: note = Description of Unknown:uncultivated organism sequence
  REGION 1..708: note = Category: MG55 effectors
  REGION 1..708: note = Description: MG55-177 effector
MKVTKRDGRVVDYDRNKIIVAIQKANAEVDRYEQVSEEKIDAIVAGIENKHVDNLQVEDIQDMIEQKLMSEHKYALAKKYIIYRYTREMVRRANTTDDSIMSLIQNSNKDVMEENSNKNAYIASTQRDLIAGEVSKDLTKRVLLPEKIVKAHEDGVLHFHDMDYYLQSIFNCCLINIGDMFEHGTVMNGKLIESPKSFQVACTVMTQIISAVASSQYGGQSVDVRHLGKYLRMTREKYERHYEEKYGDKVPAEVRKAFADDRIADELRSGVQTIQYQINTLMTTNGQSPFVTLFLNLDKDDPYIEENAMIIEEILNQRIEGIKNEKGVYVTPAFPKLIYVLDEHNCLRGGKYDYLTRLAVKCSAKRMYPDYISAKKMRENYEGNVFSCMGCRSFLTPWKDENGNYKFEGRFNQGVVSLNLPQIGILAEGDEEKFWSLLEERLALCFEALMCRHHALEGTMSNVSPIHWQYGAIARLKPGETIDKLLHNGYSTISLGYIGLYEVTKLMTGVSHTDPKGTDFALRLMKRLRLACDTWKLETGIGFGLYGTPAESLCYRFAEIDKKRFGVIPDVTDKGYYTNSYHVDVREKIDAFEKFTFESQFQNISSGGAISYVEIPNMRHNLEALEDVVRFIYDNIQYAEFNTKSDYCHVCGFDGEIIINDDLEWECPQCHNKDRNRMNVTRRTCGYLGENFWNVGKTKEINARVLHL

SEQ ID NO: 603 - protein, 731 aa, unidentified
  REGION 1..731: note = Description of Unknown:uncultivated organism sequence
  REGION 1..731: note = Category: MG55 effectors
  REGION 1..731: note = Description: MG55-178 effector
MDKELLIMTNVIKRNGKEVKFDIYKIIHAMEKANKEVAPVYQMNEYQIQAAAETVAKKIQASSHAVNVEDIQDMVETAIMEMRAYEVAQKYVRYRYKREMARKANSTDEDILALIDQANEELKQENSNKNPVINSTQRDYMAGEVSKDLTRRLLLPEDIVKAHEEGVIHFHDSDYYAQKEHNCDLINLEDMLQNGTVISETMIEKPHSFFTACNVTTQIVAQVASNQYGGQSFTLSHLAPFVDISRQKIREAVIAERKETGESMDEDIIAKIVNRRLKEEIKSGIQTIQYQLITLMTCNGQAPFVTMFMYLDEVPEGKTREDLALIIEEVLHQRMQGVKNEKGVWITPAFPKLIYVLDEDNITEDAPYYHLTKLAAQCTAKRMVPDYISAKIMREYKGGDVYPCMGCRSFLTEDKEGLGENGAHKYYGRFNQGVVTINLVDVACSSEGNMDSFWQILEERLELCHKALRLRHERLLGTVSDVAPILWQHGALARLKKGEKIDKLLYNNYSTISLGYAGLYEMCVRMLGKSHTTEEGRAFSLKVMEKLNDSCKKWREEEKISYSVYGTPMESTTYKFAKALKKRFGTIPGVTDKNYITNSYHVHVSEKIDAFSKLAFEADFQKLSPGGAISYVEVPNMQNNIPAVLSLMHFIYENIMYAELNTKSDYCCACGYDGEIQIVEDSYGKLQWRCPNCGNENQDQLSVARRTCGYIGTQFWNQGRTQEIKDRVLHL

SEQ ID NO: 604 - protein, 977 aa, unidentified
  REGION 1..977: note = Description of Unknown:uncultivated organism sequence
  REGION 1..977: note = Category: MG55 effectors
  REGION 1..977: note = Description: MG55-179 effector
MSLRIGIDIGSTTVKVVVLDEQNKLLFRSYERHYSKTRERACETLRSISDMLAGRQVKMVITGSAGLGVANASGIDFVQEVYATAAAVNTYIPGTDAVIELGGEDAKIIFFGGALEERMNGSCAGGTGAFIDQMATLMNVSVNELDALSLKHEKIYPIASRCGVFAKSDIQPILNQGGRKEDVAASIFQAVVDQTVAGLTQGRELKGKIVFLGGPLHFLMGLRERFVETLKLDEEHAIFPEDGDCFAAMGAALCSSDYDTILFEDALKKLEESVDTTTLVDTMPPLFQDVAEYGAFCARHNAKRPPQVDIKTYEGPAWLGIDAGSTTTKLALITEDGGLLYTYYHSNLGNPVAIVLEQLREIYAQCGDRIEIRGVAVTGYGEDLIKNAFSCDLGLVETMAHYKAAAHFEPDVDFIIDIGGQDMKCFKIRNGAVDSIMLNEACSSGCGSFIETFAKALGYTIADFAKLGLFAQKPVNLGSRCTVFMNSSVKQAQKDGASVEEISAGLSISIVKNAIYKVIRAASADDLGKHIVVQGGTFLNDAVLRAFEQELGRDVTRPTISGIMGAFGAALAARDLHLEKSSLLSAQALEKFTHTAKPATCGLCTNHCALTVNTFDGGRRFVSGNRCSRPLGEEPTHLPDLMRYKYAKLRALQGKGQGDGSRGRIGIPFGLNMYENLPFWFELFTRLNFEVVLSPESSRKLYVKGQRTIPSDTVCYPAKLLHGHMEALVEQGVDAIFYPCMPYNFNEGVSDNNYNCPVVAYYPELLAANVPELKKTRYLYPYFGLHRPKDFEKHAAKWFEEEFNVPKKETVAAARAAYGAYDAYKEDLRATAQQYIAQARAEGRPILVVAGRPYHMDPEINHGINDLITNYGFILITEDAVAYLEDRAPRHVLNQWTYHARMYNAARYVCTQPDMELIQLVSFGCGIDAITGDEMRSILEEGGKLYTQLKIDDISNLGAVKIRIRSLMAAIEARKAN

SEQ ID NO: 605 - protein, 1008 aa, unidentified
  REGION 1..1008: note = Description of Unknown:uncultivated organism sequence
  REGION 1..1008: note = Category: MG55 effectors
  REGION 1..1008: note = Description: MG55-180 effector
MHNEIILFAPQNNIAAGCGRRARALNTAGTMAKLMGIDVGSTTVKVTVVDGGEVLYKSYERHYAQVRETVLSELEKIKEQFGGDFCASITGSAGLGLSQRSGINFVQEVQAAFVAIRNFYPDADAAVELGGEDAKIIFITGGTEQRMNGSCAGGTGAFIDQMATLLNISVQEMDELALKAEKIYPIASRCGVFAKSDIQPLINQGAKKEDISASIFQAVVDQTVSGLAQGRRIKGKVLFLGGPLYFLKGLRRAFVRTLKLSEENAVFPENAPCFMSIGAALHSAGVKPMPIDDIISAIEHAEGTDEVVTGEPLFKDRDEYAAFVKRHRATDLTFADIATYEGDAYLGIDSGSTTTKLILITPDCRIIYSHYQSNNGQPVDIIVEKLKEIYKLAGGRIHIRGSAVTGYGEDLIKAAIKADFGIVETVAHFKAALHFNPNVDFIIDIGGQDIKCFKIKNRAIDSIMLNEACSSGCGSFIQTFARAMGMEIDKFSQLGLFAPHPVELGSRCTVFMNSAVKQAQKEGSSVEDISAGLSISIVKNAIYKVIRAASADELGDNIVVQGGTFLNDAVLRAFERETGKNVIRPGIAGLMGAFGAALYAKEMSTGESTTMGGEELKNFSYKSASTVCRGCTSKCNVNIVTFADGSRYISGNKCERGAGRKPASADLDIYSYKQERLPQVITGANAGKVRVGLPLQLGMYEQLPIWAGFFESLGFEVVLSDKSSRELYFLGQHTVASDTACYPAKLIHGHIESLLDKGVDFIFMPCESYNLDEHDSVNHYNCPIVAYYPELLKANNERLNDDNFIMPYIDLNERENAVKRLCAALKKYNIKKKVAAAALKEGFARFDKYHADVRAKGAEIIKKAREQGKQIIILAGRPYHVDNEINHGINKLLTSLNLAVLSEDAVFDEADLVKVNVLNQWTYHARLYRAAEYACRHSDVNLVQLVSFGCGLDAITTDEVRSIMEKNGRLYTQIKIDEINNLGVVKIRLRSMLAAIEESKKNKPQSAN

SEQ ID NO: 606 - protein, 739 aa, unidentified
  REGION 1..739: note = Description of Unknown:uncultivated organism sequence
  REGION 1..739: note = Category: MG55 effectors
  REGION 1..739: note = Description: MG55-181 effector
MNIIKRDGSVVEYDADKIRTAIGKANAEVHKNEKASKEEIEEIIKYIQELNKKRMLVEDIQDIIEEKLMAYNHYQLAKAYITYRYTRSLVRQANTTDQSIKELIDGTSEYWNTENSNKNARVVTTQRDYLAGITSTDISRRFLIPKDVIEAHDEGLIHFHDMDYFAQNALHNCDLIDLEDMLQNGTCINGVMIEKPHRFITAMTIATQIITAVNSSQYGGVTITLTHLAPFVRDSYLRYVKKYEDRGFSKEDVEKYAKEDLQKEVVDGVQTFQYQINSMTTTNGQAPFLSVCMYLGETEEYKPELAMIIEEVLKQRTEGMKNEKGIYVTPAFPKLLYVLEEDNAKEGSKYFYLTKLAAKCTAKRLVPDYISEKKMKEYKIDSNGNGQCFPCMGCRSFLTPYVDPKTKKPKYYGRFNQGVVTINLPDVALSSGKDEEKFWKILDERLELCHKGLQTRYERLSHATSDVAPILWQNGALARLPKGASIKPLLHGGYSTISLGYAGLYECVKYMTGDSHTDEGKGEEFGLKVMKYLNDKCNQWKEAEDIDYSVYGTPLESTTYKFSKCLQKRFGKIEGITDRGYITNSYHVPVFEKIDAFKKLSIESKFQRLSPGGAISYIETPNLQNNLDAVMQVIQYIYDNIVYAELNTKSDYCQKCGFDGEILLDENLEWYCPNCGNKDHNTLNVARRTCGYIGTNFWNKGRTQEIKERVLHLENTDDENDKTKITKEEKKVRIANQQQ

SEQ ID NO: 607 - protein, 341 aa, unidentified
  REGION 1..341: note = Description of Unknown:uncultivated organism sequence
  REGION 1..341: note = Category: MG55 effectors
  REGION 1..341: note = Description: MG55-182 effector
MAATMKDIARRTGLGLATISSYFNGGNVREKNRIKIEEAIQELHYEVNEVARGLKTNATKTIGVVIPELNNTFCAEIITGMEDVLRSHGYATIVCDCRTDKRLERDAVEFLSRKRVDGIISMPVDAEGNHLKKFQKTGKPIVLIDRRIRELSCDSVLVDNEKAAEDAMRVFFQAGHRKIGIIGGPEEISTAQERLQGYRNAYEKENIPVRESLIYHGDYTIQGGVQGIEKLVADNPDMTAVFVTNYEMTMGAVIGMNELGLKIPEKLSMIGFDNLQFARACNPKLTIVAQPTQGIAGEVAGIMLKRLEGAASEETEPITEKLGAEIIMGKSVRVLDEKENL

SEQ ID NO: 608 - protein, 990 aa, unidentified
  REGION 1..990: note = Description of Unknown:uncultivated organism sequence
  REGION 1..990: note = Category: MG55 effectors
  REGION 1..990: note = Description: MG55-183 effector
MNVNVGIDIGSTTVKIVVVRDGEIIHKHYERHFSKVREKAVELVQNAREAIGPDATIRCAITGSAGLGVAKAADIDFVQEVFATRKAVGVHVPQADVVIELGGEDAKIVFLSGQLEERMNGSCAGGTGAFIDQMAVLLDVTPGELDELAQHAEQIYTIASRCGVFAKSDIQPLLNDGARKEDVAASIFQAVVNQTVAGLAQGREIKGDVLFLGGPLFFFKGLQKRFQETLKLDDMHAHFPALAPYAIAAGAAEYAKDTQKTYSVDSLLDALEHAAGAPVVANYLPPLFESEQQYEEFKRRHGVHDVMTQNVTMYEGDAYLGIDCGSTTTKLVLIGEDHQILFHHYQSNKGNPADVIREQLTKLYELCGDRVHIVSSAVTGYGEALIQHAFGVDFGLVETVAHFRAARHFCPDVDFIIDIGGQDIKCFKIRNKCIDNISLNEACSSGCGSFIETFARSMGYSIEEFCKLGLFAKHPIDLGSRCTVFMNSSVKQAQKDGAGIDAISAGLSVSVVKNALYKVIRAHSPDDLGQHIVVQGGTFLNDAILRSFEQEIGRDVTRPAIAGLMGAYGAALHAKDNRPAQTSLVGMDVLASFRHTVKSARCGLCENHCSLTINDFGGGRRFISGNRCERPLGGTKKADLPNLYQWKLEKLRSYGESSGKPMPNGRIGLPFGLNYYELLPFWTTFLRSLGFETVLSDVSTRDIYMQGQHSIPSDTVCYPAKLMHGHIENLLEKGVDAIFYPCMTYNLDEGRATNCYNCPVVAYYPELLHANVAALADFDFMMPYFELTDHKRFIQQAAKYFCGKYPQIKKKQVAAAAEAAFQELDNYYAEIRLEGQKAIAYADTHGLDIAVIAGRPYHVDPEINHGIDQLIASFGLVIVSEDAVWQLAEEPKVHVLNQWTYHSRMYGAAKYVTRKENAQLIQLVSFGCGIDAITTDEVRAICENGGKIYTQLKIDEISNLGAAKIRIRSMLAAVEEGRKLAEQQSNQHVG

SEQ ID NO: 609 - protein, 730 aa, unidentified
  REGION 1..730: note = Description of Unknown:uncultivated organism sequence
  REGION 1..730: note = Category: MG55 effectors
  REGION 1..730: note = Description: MG55-184 effector
MQVVKRDGRIVDFDKQKILAAIEKANAEVKPRERANKENIKEIVEYITGLDKKRILVEDIQDIIEEKLMEYGKYFLAKKYITYRYTRELVRKANTTDQSIKELIDGESEYWNNENSNKNARVVTTQRDYLAGITSTDITRRFLLPKDVVEAHDEGIIHFHDADYFAQNALTNCELINLDDMLQNGTIMNGVMIEKPHRFLTAMTIATQIILAVTSSTYGGATVSLTHLAPFVKSSYDRYYKKYQDRGLSEKQCKEYAEQDTKKEVSDGVQTFNYQVNSMTNTNGQAPFLSVCMYLGETKEYKKELAMIIEEFLKQRIEGFKNEKGVYITPAFPKLLYVLEEDNIVEGRPYYYLTELAAKCTAKRMVPDYISEKKMLELKIDKNGNGNCYPCMGCRSFLTPYVDEKTNKPKYYGRFNQGVVTINLVDVALSSEKDMDKFWKIFDERLELCHKALQVRHERLSKVTSDVAPILWQNGALARLKKGESIHSLLHGGYSTISLGYAGLYECVKYMTDHSHTDNGEGKDFGVQVMQKLNDKCKEWKAVEDIDYSVYGTPIESTTYKFSKCLKKRFGVIEGITDRDYITNSYHIPVFEEIDAFSKLSIESQFQQLSPGGAISYVETPNLQNNIEAVLQIIRFIYDNIMYAELNTKSDYCQECGFDGEILIDDNLEWYCPNCGNRNHDTLNVARRTCGYIGSQFWNKGRTQEIKERVLHIDNKDAEMPKREKTKAAV

SEQ ID NO: 610 - protein, 736 aa, unidentified
  REGION 1..736: note = Description of Unknown:uncultivated organism sequence
  REGION 1..736: note = Category: MG55 effectors
  REGION 1..736: note = Description: MG55-185 effector
MEVRTKVIKRNGSEVEFHIDKIVNAISKANHEVDEIHQMNSHQIAAIADNIAKEVSTAPHAVNVEDIQDMVETGIMEMRCYEVAQKYVRYRYKREISRKSNTTDDGILSLIDQANEEVKQENSNKNPVINSTQRDYMAGEVSKDLTKRVLLPEDIVRAHEEGIIHFHDSDYFAQREHNCDLINLEDMLQNGTVISETMIEAPHSFFTACNVTTQIVAQVASNQYGGQSFTLSHLAPFVDVSRQKIREQVIEERKECGESVDDEIVAKLVETRLDREIQNGIQTIQYQLITLMTCNGQAPFVTMFMYLDEVPEGQTRNDLAKIIREVLKQRIKGVKNEKGVWITPAFPKIIYVLDEDNVTPDSPFYDLTVLAAECTAKRMVPDYISAKIMKRDKGDVYPCMGCRSFLTPDDGTCNKENIANVGGYVAGKHKYYGRFNQGVVTINLVDVACSSDGNMERFWEILEERLELCHRALRCRHERLMGTSSDVAPILWQYGALARLKKGEPIDKLLFGNYSTISLGYAGLYEMTMRMLGVSHTDPNGEEFALKVMQKLNDKCAEWRAAENISYSLYGTPMESTTYKFAKCLQKRFGIIPNVTDHNYITNSYHINVREKIDAFSKLKFESKFQKLSPGGAISYVEVPNMQQNIPAVISVMKFIYDNIMYAELNTKSDYCEVCGYDGEIKIVEEESGKLVWECPKCGNRDQDKMSVARRTCGYIGTQFWNQGRTQEIRDRVLHL

SEQ ID NO: 611 - protein, 983 aa, unidentified
  REGION 1..983: note = Description of Unknown:uncultivated organism sequence
  REGION 1..983: note = Category: MG55 effectors
  REGION 1..983: note = Description: MG55-186 effector
MALRIGIDIGSTTVKVVVLDAQNKLLFRSYERHYSKTRERTCETLRGLRGLLGGQQVQLLITGSAGLGVAKAAGLDFVQEVYATAAAVREFIPGTDAVIELGGEDAKIIFFGNTLEERMNGSCAGGTGAFIDQMATLLNVSVDELDELSLRHEKIYPIASRCGVFAKSDIQPILNQGGRKEDVAASIFQAVVDQTVAGLTQGRELKGTIVFLGGPLHFLAGLRQRFVETLHLDQDHAIFPEDGDCFAAIGAALCTEDSQPRPFEELLDLLEHAATVSTPVDTMDPLFTSQADYEAFSARHQAMAVPTVDLATYTGPAYLGIDAGSTTTKMVLIDPDCNLLYSFYHSNQGNPVSIVLPQLREIYAQCGDRVTIQGAAVTGYGEDLIKNAFSCDLGLVETVAHLNAARHFTPDVDFIIDIGGQDMKCFKIRNGAVDSILLNEACSSGCGSFIETFAKALGYTIADFSKMGLFARHPVNLGSRCTVFMNSSVKQAQKDGASVEDISAGLSISVVKNAIYKVIRAASADDLGQHIVVQGGTFLNDAVLRSFELEIGREVTRPTISGMMGAYGAALAAKDAGLTQSTLLSAEALASFTHEARPATCKLCTNHCSLTINRFDGGRKFISGNRCSRPLGQEKVDIPDLLKFKYQYLRSLQGKGEGDGSRGKIGIPFGLNMYENLPFWFTLFTTLNFEVVLSPESTRSLYLKGQQTIPSDTVCYPAKLLHGHIMALLEEGVDTIFYPCMSYNFDEHLSDNHYNCPVVAYYPDLLGVNIPALEDIKYLHPNLGLHRPKDFEKKGAQLLETEFGIPKRASVKAIRKAYAAYEDFRRLVQKKGEEYISFARETGRKILVVAGRPYHMDPEINHGINDLITSFGFVLITEDAVFQHMDKQPRRVLNQWTYHARMYNAARYVCTQPDMAFIQLVSFGCGVDAITTDELRSILEEAGELYTQLKIDDISNLGAVKIRIRSLMAALDARDAQNQKGGQ

SEQ ID NO: 612 - protein, 730 aa, unidentified
  REGION 1..730: note = Description of Unknown:uncultivated organism sequence
  REGION 1..730: note = Category: MG55 effectors
  REGION 1..730: note = Description: MG55-187 effector
MQVVKRDGRIVDFDKQKILAAIEKANAEVKPRERANKENIKEIVEYITGLDKKRILVEDIQDIIEEKLMEYGKYFLAKKYITYRYTRELVRKANTTDQSIKELIDGESEYWNNENSNKNARVVTTQRDYLAGITSTDITRRFLLPKDVVEAHDEGIIHFHDADYFAQNALTNCELINLDDMLQNGTIMNGVMIEKPHRFLTAMTIATQIILAVTSSTYGGATVSLTHLAPFVKSSYDRYYKKYQDRGLSEKQCKEYAEQDTKKEVSDGVQTFNYQVNSMTNTNGQAPFLSVCMYLGETKEYKKELAMIIEEFLKQRMEGFKNEKGVYITPAFPKLLYVLEEDNIVEGRPYYYLTELAAKCTAKRMVPDYISEKKMLELKIDKNGNGNCYPCMGCRSFLTPYVDEKTNKPKYYGRFNQGVVTINLVDVALSSEKDMDKFWKIFDERLELCHKALQVRHERLSKVTSDVAPILWQNGALARLKKGESIHSLLHGGYSTISLGYAGLYECVKYMTDHSHTDNGEGKDFGVQVMQKLNDKCKEWKAVEDIDYSVYGTPIESTTYKFSKCLKKRFGVIEGITDRDYITNSYHIPVFEEIDAFSKLSIESQFQQLSPGGAISYVETPNLQNNIEAVLQIIRFIYDNIMYAELNTKSDYCQECGFDGEILIDDNLEWYCPNCGNRNHDTLNVARRTCGYIGSQFWNKGRTQEIKERVLHIDNKDAEMPKREKTKAAV

SEQ ID NO: 613 - protein, 1438 aa, unidentified
  REGION 1..1438: note = Description of Unknown:uncultivated organism sequence
  REGION 1..1438: note = Category: MG55 effectors
  REGION 1..1438: note = Description: MG55-188 effector
MNKILHVGLDVGSTTVKIIVMDDSQNLIYENYQRHFSDTKNTVCQVLSDFANKYPDYVYTIALTGSGAMSAAKFLDLPFIQEVVACKRAVEKYIPQTDVVIELGGEDAKIIYFGKSIEQRMNGTCAGGTGAFIDQMASLLNTDAAGLNELAKNYKMIYPIASRCGVFAKTDVQPLINEGANKEDIAASIFQAVVNQTISGLACGRPIRGNIAFLGGPLNYLSELRNRFIETLNLDDNSAIIPQDAHLLVAKGAALDSVNNSAISNEKLKAKIEVLKASHDTTSTPLAPLFVTNAEYEAFKERHDKDTVPKKDLKTYKGDCFIGIDAGSTTTKLVVTDCDDNLLYSLYQSNEGNPLKSVINMLKELYKIIPQTATIRYSGVTGYGEQLIQSALNVDLNEIETIAHYTAAKRFMPNVTSIVDIGGQDMKYIKIKNGTINNIMLNEACSSGCGSFIETFAKSLNISINDFVESALDSRSPVDLGSRCTVFMNSKIKQAQKEGATVGDISAGLSYSVIKNAIQKVMKVRDISTLGDHIVVQGGTFYNNAVLRAFELIVGKDVVRPDIAGLMGAYGVAILARKQYEANLDMEYISKLSTLDEIENLQIETSHVRCGGCENHCLLTINKFNNGQKHISGNRCEKGAGITSKSKDLPNIYKYKNERLFSYKPLSEKSAIRGTIGIPRVLNMYEDYPFWFTFLTNLGFRVIISEKSTRKTYEKGMESMPSESVCYPAKLAHGHIMSLINQGIKTIFYPCIPYSRKEYKQADNHYNCPIVISYSEVLKNNVEELKNVKFLNPFLPFEPKKLAEAILSLPEFDEYHFTKKELIKAAQEAEKEYQNFKTDIRNKGQEALNYMKENNIRGIVLAGRPYHVDPEINHGIDTLITSLGLCVLSEDSISNQVTLDKKLRVVNQWVYHSRLYAAADFVGHHANLELVQLNSFGCGVDAVTTDQVEEILSSYDKMYTLIKIDEVNNLGAVRIRIRSLLASMNKRIEKNSNNSDSLGNYELQRKIFTKEMRNDYTILIPQMAPIHFELLESAVQACGYNVHLLRECTPHTVEVGLKYVNNDACYPSILTTGQMIEALESGKYDLNKTALIMSQTGGGCRATNYIGFIRKALKDAGYSDIPVISFNVVGMEKMPGFKLSPKMAEGLLKSVVYGDLLQKMLTKNRAYEKNKGVTQKKYEYWLEKCKKLVSKSSLKEFNHSIYDMVNDFEKIELDTTVEKPKVGIVGEVLIKYHPFGNNFVADKLEQEGAEVILPDFMGFIKFIATHKITFNQLIKTDSGKAKIFKFAIKLIDLLEKNEINALKNSKKGYLLPCNIFELEENVKDILSIGNQTGEGWFLTAEMVEYMQHDIPNIVCVQPFACLPNHVVGKGVIKTIRDKYPEANIAAIDYDPGASEANQTNRIKLLMAVAKDNLKIKNSKNKLLLKENNKINSKNKIYQ

SEQ ID NO: 614 - protein, 726 aa, unidentified
  REGION 1..726: note = Description of Unknown:uncultivated organism sequence
  REGION 1..726: note = Category: MG55 effectors
  REGION 1..726: note = Description: MG55-189 effector
MKIIKRSGSEVTFDISKIMDAVSKANMEVVHSERLSEEQIETISNNVESICKEMNRSLSVEEIQDLVENQIMNFRAFSVARKYITYRYKRALVRKSNSTDKQILSLLECNNEEVKQENSNKNPTVNSVQRDYMAGEVSKDITKRFLLPPDIVDAHEQGLIHFHDADYFAQHMHNCCLVNLEDMLQNGTVISETMIEKPHSFSTACNIATQAIAQIASSQYGGQSISLAHLAPFVQVSREKFIGQVRDEFEKTGIDASEEKIREVAELRVKDEIKRGVQMIQYQVITLMTTNGQAPFVTVFMYLDEVPEGQTRDDLALVTEEVLRQRMQGVKNEQGVYITPAFPKLIYVLEEDNIHEDSKYWYLTEIAAQCTAKRMVPDYISEKKMKELKVDANGNGQCFPCMGCRSFLTPYIDPETGKPKYYGRFNQGVVTLNLVDVACSSGKDMDKFWSILNERLDLCKRALMCRHYRLKGTPSDVAPILWQNGALARLKKGETIDKLLYGGYSTISLGYAGLCECTYYMKGVTHTNPEGTEFALKVMQYLNDTCKRWAAETNIDFSLYGTPLESTTYKFSKCLQKRFGKIAGVTDKNYITNSYHVHVTEQINAFEKLKFESQFQKLSPGGAISYVEVPDMQNNIPAVLKVMQYIYDNIMYAELNTKSDYCQECGYTGQIQIITDDDGKLIWECPNCGNRNQDKMNVARRTCGYIGTQFWNQGRTQEIKERVLHL

SEQ ID NO: 615 - protein, 708 aa, unidentified
  REGION 1..708: note = Description of Unknown:uncultivated organism sequence
  REGION 1..708: note = Category: MG55 effectors
  REGION 1..708: note = Description: MG55-190 effector
MKVIKRDGSTADFDSSKIIVAIQKANQVVEPEDRIDQERIEAIAHYVESKNRMRLLVEDIQDMVEHQLMDEGKFNLAKSYIIYRYTRALVRKANTTDESILSLIRNSNKDVMEENSNKNAVMASTQRDLIAGEVSKDLTRRLILPEKISKAHDEGAIHFHDADYFVQPIFNCCLINVGDMLDNGTVMNGKLIESPKSFQVACTVMTQIIASVASSQYGGQSVDIRHLGKYLRRSYEKFKLTIKAEVGDSVADEVVERLTKRRLQDELRSGVQTIQYQINTLMTTNGQSPFVTIFLNLQADDEYLEENAMIVEEILRQRLEGIKNDKGVFVTPAFPKLVYVLDEHNCLKGGKYDYITKLAVKCSAKRLYPDYISAKKMRENYEGNVFAPMGCRSFLAAWKDDEGNYKFEGRFNQGVVSLNLPQVAILAHGDEEKFWPLLDERLQLCYEALMCRHNSLKGIRSDVSPVHWQYGAIARLEKGEVIDKYLEKGYSTISLGYIGLYEMTKLMKDVSHTTPEGEEFALRVMKYLRAACDKWKKETGLGFALYGTPAESLCYRFARIDKERFGTIVDVTDKGYYTNSYHVDVREDIDAFSKFNFESQFQRISSGGAISYVEIPNMRHNLEAMEDVVRFIYDNIQYAEFNTKSDYCHVCGFDGEIIINDDLEWECPNCGNKNQTLMNVTRRTCGYLGENFWNVGKTKEIKSRVLHL

SEQ ID NO: 616 - protein, 754 aa, unidentified
  REGION 1..754: note = Description of Unknown:uncultivated organism sequence
  REGION 1..754: note = Category: MG55 effectors
  REGION 1..754: note = Description: MG55-191 effector
MKVIKRDGTIVDYDREKIRVAIQKANNEVSKKYRATDEEINEIIAYIEELKKSRILVEDIQDIIEEKLMSLDKYQLAKEYITYRYTRALVRKANTTDQSIKELIEGESEYWNNENSNKNAKVVTTQRDYLAGITSTDITRRFLLPEDVVKAHDEGIIHFHDADYFAQNALHNCDLINLEDMLQNGTNINGVMIEKPHKFLTAMTIATQIITAVTSSQYGGATVTMTHLAPFVRDSYNIYLKKYRDRKLPEDQVVKFAKEDLAKEISDGVQTFQYQINSMTTTNGQSPFLSVCLYLGETDEYKEELAMIIEEVLKQRILGMKNEKGVYITPAFPKLLYVLEEDNIHEDSKYWYLTKLAAKCTAKRMVPDYISEKKMLELKIDKNGNGNCYPCMGCRSFLTPYVDPKTNKPKYYGRFNQGVVTINLVDVALSSGGDFKKFWKIYDERLELCHKALQIRHERLAKATSDVAPILWQYGALARLKKGESIHQLLHGGYSTISLGYAGLYECVKYMTGHSHTDNGKGKDFGLEVMKKLNDKCKEWKAAEDIDYSVYGTPIESTTYKFAKCLQKRFGKIKGITDKNYITNSYHVPVFEEIDAFSKLKLESQFQQLSPGGAISYVETPNLQENLEVVLQLIKFIYDNIMYAELNTKSDYCQKCGYDGEILIDDNLEWYCPNCGNRDHSTLNVARRTCGYIGSNFWNKGRTQEIKERVLHIDNKDDVDDDCDCDDCKHQHEEENKEENVENKVQKNELVLTR

SEQ ID NO: 617 - protein, 978 aa, unidentified
  REGION 1..978: note = Description of Unknown:uncultivated organism sequence
  REGION 1..978: note = Category: MG55 effectors
  REGION 1..978: note = Description: MG55-192 effector
MAKFMGIDVGSTTVKVCVLSESLEILYTSYERHFARVKECVLGQLSVVKEKFGGDFRVCITGSAGLGLAERSGIPFVQEVQAAFTAIRQYYPDADAAVELGGEDAKIIFITGGTEQRMNGSCAGGTGAFIDQMATLLDISVSEMDALSLRAERVYPIASRCGVFAKSDIQPLLNQGARREDIAASIFQAVVDQTVAGLAQGRRIKGKVLFLGGPLYFLQGLRRAFRQTLGLDEEHAVFPENAPSFMAIGAALYAAGTDAMPLAEIVRRIRDARGSDDIVTGEPLFTDRAEYDAFVARHKAHDLAFEDIRTYRGDAYLGIDSGSTTTKLVLITPDCKLLYQHYQSNNGQPLDIVVERLREIYALSEGRVRIAGAATTGYGEDLIKAAIRADFGIVETVAHFKAALHFDPKVDFIIDIGGQDIKCFKIKNGAIDNIMLNEACSSGCGSFIQTFARAMGMEIDEFSKLGLFAKHPVELGSRCTVFMNSSVKQAQKEGAGIEDISAGLSASIVKNAIYKVIRAKTPDELGSNILVQGGTFLNDAVLRCFELETGKQVVRPGIAGLMGAFGAALYAKENVRGESTVLDAQALRTFAYTTRSHVCKGCTSHCNVNVIGFSDGRKFISGNKCEKGAGLKPHSDELDIYHYKYERLLQCAEGARGTRGKVGLPVVLGFYEQLPLWAGFFEACGFEVLFSERSSRSLYFRGQHTVASDTVCYPAKLAHGHIESLLDAGADFIFYPCESYNLDEHDSTNHYNCPVVAYYPELLKANNERLTQDNFIMPYLDLNDERTTVRALHRALKKFGLTPRLIRKGLAEGFRRLALFHADVERKGEEIAAAARAERRPIVVLAGRPYHVDPEINHGIGKLLTSLGVAVLSEDAVFRKGRQVLVNVLNQWTYHARLYRAAEYVAENEDMELVQLVSFGCGIDAITTDEVRALLESRGKLYTQIKIDEINNLGVVKIRLRSMIAAVEEQKRRNHEDR

SEQ ID NO: 618 - protein, 723 aa, unidentified
  REGION 1..723: note = Description of Unknown:uncultivated organism sequence
  REGION 1..723: note = Category: MG55 effectors
  REGION 1..723: note = Description: MG55-193 effector
MKIIKRSGQEVKFDINKIVEAIKKANLDANEKNQLSEEVIFKCAKNVEKECKNKGRILTVEEVQDLVEDQLMSVDAFDVARKYITYRYRRALARKANTTDQQILTLLECNNQNVKEENSNKNPTVNSVQRDYMAGEVSKDITKRILLPKDIVDAHEQGIIHFHDADYFAQHMHNCDLVNLEDMLQNGTVISGTLIEKPKSFSTACNIATQIIAQVASNQYGGQSISITHLAPFVEISRQKITKDVKEELKDLDISEEKIQEIIHKRLLDEIKKGVQTIQYQIVTLLTTNGQAPFVTIFMYLNEARSEQEKKDIALITEEILKQRYQGVKNEKGVWITPAFPKLIYCLEDDNVEPGSPYYYLTELAAKCTAKRMVPDYISEKIMLQLKVDSKGQGHCYTCMGCRSFLTPYINDKGEPQYYGRFNQGVVTINLVDVALSSNKDVKQFWKIFDERLDLCYRALMERHKRLLGTKSDVAPILWQYGALARLNKGETIDKLLFNGYSTISLGYAGLYECVYYMTGKSHTDPEATPFALEIMQHMNDACKKWKEKEHIDFSLYGTPLESTTYKFAKCLQKRFGIIKGVTDKNYITNSYHIVVSEHIDAFSKLAFESQFQKLSPGGAISYVEVPNMENNIPAVMNVIKFIYDHIMYAELNTKSDYCQCCGYTGEIQIKEDEDGKLFWECPQCGNRDQNKMNVARRTCGYIGSQFWNQGRTQEIRDRVLHL

SEQ ID NO: 619 - protein, 720 aa, unidentified
  REGION 1..720: note = Description of Unknown:uncultivated organism sequence
  REGION 1..720: note = Category: MG55 effectors
  REGION 1..720: note = Description: MG55-194 effector
MKIIKRSGAEAVFDISKIIIAINKANHEVVEAERLTADQIKEIAQYIEDSCKDANHALNVEDIQDLVEDQLMDKRAFSVARKYITYRYKRALVRKSNSTDEQILSLIECNNEEVKQENSNKDSTVNSVQRDYMAGEVSKDITRRFLLPEDIVEAHEQGIIHFHDADYFAQHMHNCDLVNLEDMLQNGTVISGTRIDKPHSFSTACNIATQIIAQVASSQYGGQSISLAHLVPFVQISREKIHAELVQTLKESDVELSEEKINSIVERRLHAEIERGVQVIQYQVVTLMTTNGQSPFVTVFMYLNEAKNEQEKKDLAMIIEEVLDQRYQGVKNEDGVWITPAFPKLIYVLEEDNIHEDSEYYYLTKKAAKCTAKRMVPDYISEKKMKELKDGNCYTCMGCRSFLTVYHDEDGKPKFYGRFNQGVVTLNLVDLACSSGGDFEKFWKLFDERLDLCYRALMARHNRLKGTPSDVAPILWQYGALARLKKGETIDKLLYGGYSTISLGYAGLCECTRYMTGKPHTDPAATPFALKVMQRLNDACKEWKEKENIDFSVYGTPLESTTYKFAKCLQKRFGVIPGVTDKNYITNSYHVHVTENIDAFTKLKFESQFQALSPGGAISYVEVPNMQDNLEAVLSVMKFIYENIMYAELNTKSDYCQVCGYDGEIQIVKDDDGKLVWECPHCHNRDQDKMNVARRTCGYIGSQFWNQGRTQEIKERVLHL

SEQ ID NO: 620 - protein, 720 aa, unidentified
  REGION 1..720: note = Description of Unknown:uncultivated organism sequence
  REGION 1..720: note = Category: MG55 effectors
  REGION 1..720: note = Description: MG55-195 effector
MKIIKRSGAEAVFDISKIIIAINKANHEVVEAERLTADQIKAIAQYIEDSCKDANHALNVEDIQDLVEDQLMDKRAFSVARKYITYRYKRALVRKSNSTDEQILSLIECNNEEVKQENSNKDSTVNSVQRDYMAGEVSKDITRRFLLPEDIVEAHEQGIIHFHDADYFAQHMHNCDLVNLEDMLQNGTVISGTRIDKPHSFSTACNIATQIIAQVASSQYGGQRISLAHLVPFVQISREKIHAELVQTLKESDVELSEEKINSIVERRLHAEIERGVQVIQYQVVTLMTTNGQSPFVTVFMYLNEAKNEQEKKDLAMIIEEVLDQRYQGVKNEDGVWITPAFPKLIYVLEEDNIHEDSEYYYLTKKAAKCTAKRMVPDYISEKKMKELKDGNCYTCMGCRSFLTVYHDEDGKPKFYGRFNQGVVTLNLVDLACSSGGDFEKFWKLFDERLDLCYRALMARHNRLKGTPSDVAPILWQYGALARLKKGETIDKLLYGGYSTISLGYAGLCECTRYMTGKPHTDPAATPFALKVMQRLNDACKEWKEKENIDFSVYGTPLESTTYKFAKCLQKRFGVIPGVTDKNYITNSYHVHVTENIDAFTKLKFESQFQALSPGGAISYVEVPNMQDNLDAVLSVMKFIYENIMYAELNTKSDYCQVCGYDGEIQIVKDDDGKLVWECPHCHNRDQDKMNVARRTCGYIGSQFWNQGRTQEIKERVLHL

SEQ ID NO: 621 - protein, 720 aa, unidentified
  REGION 1..720: note = Description of Unknown:uncultivated organism sequence
  REGION 1..720: note = Category: MG55 effectors
  REGION 1..720: note = Description: MG55-196 effector
MKIIKRSGAEAVFDISKIIIAINKANHEVVEAERLTADQIKAIAQYIEDSCKDANHALNVEDIQDLVEDQLMDKRAFSVARKYITYRYKRALVRKSNSTDEQILSLIECNNEEVKQENSNKDSTVNSVQRDYMAGEVSKDITRRFLLPEDIVEAHEQGIIHFHDADYFAQHMHNCDLVNLEDMLQNGTVISGTRIEKPHSFSTACNIATQIIAQVASSQYGGQSISLAHLVPFVQISREKIHAELVQTLKESDVELSEEKINSIVERRLHAEIERGVQVIQYQVVTLMTTNGQSPFVTVFMYLNEAKNEQEKKDLAMIIEEVLDQRYQGVKNEDGVWITPAFPKLIYVLEEDNIHEDSEYYYLTKKAAKCTAKRMVPDYISEKKMKELKDGNCYTCMGCRSFLTVYHDEDGKPKFYGRFNQGVVTLNLVDLACSSGGDFEKFWKLFDERLDLCYRALMARHNRLKGTPSDVAPILWQYGALARLKKGETIDKLLYGGYSTISLGYAGLCECTRYMTGKPHTDPAATPFALKVMQRLNDACKEWKEKENIDFSVYGTPLESTTYKFAKCLQKRFGVIPGVTDKNYITNSYHVHVTENIDAFTKLKFESQFQALSPGGAISYVEVPNMQDNLDAVLSVMKFIYENIMYAELNTKSDYCQVCGYDGEIQIVKDDDGKLVWECPHCHNRDQDKMNVARRTCGYIGSQFWNQGRTQEIKERVLHL

SEQ ID NO: 622 - protein, 720 aa, unidentified
  REGION 1..720: note = Description of Unknown:uncultivated organism sequence
  REGION 1..720: note = Category: MG55 effectors
  REGION 1..720: note = Description: MG55-197 effector
MKIIKRSGAEAVFDISKIIIAINKANHEVVEAERLTADQIKAIAQYIEDSCKDANHALNVEDIQDLVEEQLMDKRAFSVARKYITYRYKRALVRKSNSTDEQILSLIECNNEEVKQENSNKDSTVNSVQRDYMAGEVSKDITRRFLLPEDIVEAHEQGIIHFHDADYFAQHMHNCDLVNLEDMLQNGTVISGTRIDKPHSFSTACNIATQIIAQVASSQYGGQSISLAHLVPFVQISREKIHAELVQTLKESDVELSEEKINSIVERRLHAEIERGVQVIQYQVVTLMTTNGQSPFVTVFMYLNEAKNEQEKKDLAMIIEEVLDQRYQGVKNEDGVWITPAFPKLIYVLEEDNIHEDSEYYYLTKKAAKCTAKRMVPDYISEKKMKELKDGNCYTCMGCRSFLTVYHDEDGKPKFYGRFNQGVVTLNLVDLACSSGGDFEKFWKLFDERLDLCYRALMARHNRLKGTPSDVAPILWQYGALARLKKGETIDKLLYGGYSTISLGYAGLCECTRYMTGKPHTDPAATPFALKVMQRLNDACKEWKEKENIDFSVYGTPLESTTYKFAKCLQKRFGVIPGVTDKNYITNSYHVHVTENIDAFTKLKFESQFQALSPGGAISYVEVPNMQDNLDAVLSVMKFIYENIMYAELNTKSDYCQVCGYDGEIQIVKDDDGKLVWECPHCHNRDQDKMNVARRTCGYIGSQFWNQGRTQEIKERVLHL

SEQ ID NO: 623 - protein, 610 aa, unidentified
  REGION 1..610: note = Description of Unknown:uncultivated organism sequence
  REGION 1..610: note = Category: MG55 effectors
  REGION 1..610: note = Description: MG55-198 effector
MEENSNKNATIASTQRDLIAGEVSKDFAKRDLLPKKIVEAHENAVLHFHDMDYFLQPIFNCCLLNISDMLDNGTVINGKMIESPKSFQVACTVMTQIIAAVASGEYGGQSVKISHLAKYLANDYKKSLKKVREADGTLTAEQVEKIAKAETQEHLKSGIQTIQYQINTLMTTNGQTPFVTLFLQLDESLGYMDEQAAVIEEILKQRIVGMKNEAGVYVTPPFPKLIYVLDECNCLKGGKYDWLTKLAVKCSAKRMYPDYISAKKMRENYEGEVFSCMGCRSFLSPWKDENGNYKWEGRFNQGVVSLNLPQIGILSQSENGPDMYKFWQLMEERTSLCFEALMCRHKALLGTKSDISPIHWQYGGIARLKKGEVIDPLLKDGYSTISLGYIGLYEVTKLMTGKSHTTKEGEEFALKVMRYLKNKCNMWKDMTGIGFGLYGTPAESLCYRFARIDKEKFGEIKDITDKGYYTNSYHVDVREKINAFDKLSFESQFQQISSGGAISYIEIPNMENNLEVLEKVVKFIYENIQYAEFNTKSDYCMNCGFDGEIILNDENEWECPQCGNKDHSKMSVTRRTCGYLGSQFWNKGKTLEIKQRVVHFDIPVVENGGN

SEQ ID NO: 624 - protein, 1005 aa, unidentified
  REGION 1..1005: note = Description of Unknown:uncultivated organism sequence
  REGION 1..1005: note = Category: MG55 effectors
  REGION 1..1005: note = Description: MG55-199 effector
MSEIKLQQKAAYTLGIDVGSTTVKTVILDADHHVLHSTYQRHFSKVKEAVSEQLQAIIKEHPATLFSVHMTGSAGLGLATAAKIPFVQEVHAAFLAVKERYPKADAVIELGGEDAKIIFLTGGVEQRMNGSCAGGTGAFIDQMATLLDVTVDELDQMALQADRTYPIAARCGVFAKSDIQPLLNQGAKRENVAASIYQAVVDQTVSGLAQGRKIQGHVLFLGGPLSFLQGLRNAFMQTLHLDAEHAIFPVDGRTFVAYGCALAAENSADKPVTGEALLKQIESAETNHTVIADKPLFGYQEEYDRFRERHAQNDVVHGDLHTYQGNAYLGVDAGSTTTKVALIGEDNSLLYSFYETNKGQPLECVKRALETLYQKKNPNLKICGSAVTGYGEEMLKAGLGIDFGIVETVAHFRAAEFFCPDVDFIIDIGGQDIKCFQIKNGAIDSIMLNEACSSGCGSFIQAFANALGYDVAEFAKLGLFAERPVDLGSRCTVFMNSSVKQAQKDGATVADISAGLSGSIVKNAIYKVIRAKSPEDLGKHIVVQGGTFLNDAVLRCFEREMGRDVIRPAISGLMGAFGAAIYAKEHTSGSSTLLSLMDLHTLTYRTQNTTCNGCTAHCNLQILRFSNGKRFIAGNRCERGAGVSKKDQIPNLVDWKYETLRSLTDRQPEQPKATVGLPMALHYYDQLPLWYTFFTDLGFAVKLSEESTRKTYYKGQSTIPSDTVCYPAKLAHGHIESLLEQNVDFIFYPCMTYNLDEGDSDNHYNCPVVAYYPELLLANNEKLNEQNFLHPFLDLNRRKHLITVLYACLSDYATKKEIAAALEHGFAALEQYRNQIAQTAQEIVRQARAAGKTILVLAGRPYHIDPEINHGIHKLISSLGMAVITEDSIAGLAHTPELQALNQWTYHSRMYRAAQYVTTQPDFQLVQLVSFGCGIDAITTDEVRRILEQSGKLYTQLKIDEISNLGAAKIRLRSLKAAIGADVPPKPAAAPSETAPKNEKEPVSV

SEQ ID NO: 625 - protein, 709 aa, unidentified
  REGION 1..709: note = Description of Unknown:uncultivated organism sequence
  REGION 1..709: note = Category: MG55 effectors
  REGION 1..709: note = Description: MG55-200 effector
MIKVQKRDGRIVNYDREKIVRAIQKANAEVDAAERAGEALIDGILDDVEKECEDVVHVESIQDMIESRLVKQNKYTLSKKYMIYRYQRALLRKANTTDESILKLIRNENKELAEENSNKNTILASTQRDYIAGEVSRDLTKRMLLPERISMAHEQGAIHFHDADYFVQPIFNCCLINIADMLDNGTVMNEKMIESPKSFQVACTVMTQIIAAVASNQYGGQSVDMRHLGKYLRKSSNKFHRQIREEFGDSLDNEAVEKMARIRLRDELKSGVQTIQYQINTLMTTNGQAPFVTLFLRLDDEDEYIDENALIVEEILRQRLEGIKNEAGVYVTPAFPKLIYVLDENNCLKGGKYDYITKLAVRCSSKRMYPDYISAKKMKENYEGNVFSCMGCRSFLSPWKDENGEYKFEGRFNQGVVSLNLPQIGILAKGDEEVFWKLLDERLAICFEALMCRHKALEGTLSDVSPIHWQYGAIARLPKGAKIDPLLHDGYSTISLGYIGIYEMTKLMKGVSHTDPAGEEFALRVMNRMKEAVECWKEETGLGFGLYGTPAESLCYRFARIDRERFGLIENVTDKGYYTNSYHVDVREKIDAFSKFTFESQFQKISSGGAISYVEVPNMAKNLEAMEEVVKFIYDNIQYAEFNTKSDYCQECGFDGEIIINEDMEWECPQCHNKNKDKMNVTRRTCGYLGENFWNAGKTKEIKSRVLHL

SEQ ID NO: 626 - protein, 972 aa, unidentified
  REGION 1..972: note = Description of Unknown:uncultivated organism sequence
  REGION 1..972: note = Category: MG55 effectors
  REGION 1..972: note = Description: MG55-201 effector
MQIGLDIGSTTIKIAVLDDAGQLQFSKYERHYSQIAEKMQQLLAELHVRMPLLKTARLAISGSAGIGIAESCGLQFAQEVFAEKICTERLNPGTEAVIELGGEDAKLLFLGRHFDARMNDSCAGGTGAFIDQMASLLDVATEDMNALAQQSSTRYTIASRCGVFAKSDIQPLLNQGAAKADLAASIFDAVASQAVTGLAKGRPITGKVLYLGGPLTFMSELRHSFDKILQIEGSCPENSLYYVAMGAAFCAENKVDLTELPAKLAAVGAQRDFDHLEPLFAGQAEYDEFMERHSKERIESGDISAADAAYIGIDAGSTTIKIAVISPSGQLLDSFYQSNKGNPVIAIKEYLQNFYIKYPHCRILGSAVTGYGEDLIRNGFSVDYGIVETMAHFIAAKTLQPDVDFILDIGGQDIKCLKIHNGCIDNIFLNEACSSGCGSFLQTFAEILGYSAEEFARIGLFADKPVNLGSRCTVFMNSSVKQAQKDGATVANISAGLSLSIVKNALYKVIRPGSKESIGKHIVVQGGTFLNDCVLRAFEKEMGLKVVRPNIAGLMGAYGAAIYARSRHQETGHVSTLADAAALKDFFHEVKAVTCGLCSNHCHLTVNTFASGKRFISGNRCERPVTHCAPDDTFNLYRQKLQLLEGLKGVPGKRGRIGLPMGLNMYELLPFWHAFFTRLGFEVITSPIYDKTIYQKGQNTIPSDTVCYPAKLMHGHIKWLLEHGINTIFYPCMTYNVDENSAENCYNCPVVAYYPEVLHANMHDLDNATYIFDYLGLGHKKVLLKKLQQICKEHFPDIGSSELKAALQEAYAAYNKFEAQVKELGQTIINTARSQHKPIVVLAGRPYHIDPKVNHSIDRLITTMGAALVSEDAVSSHISMQELNDDLQVLNQWTYHSRLYAAAKYVSRSSDMYMVHLVSFGCGCDAITADECRRILEEHGQIYTQIKIDDIDNLGAAKIRLRSLFAAAGLES

SEQ ID NO: 627 - protein, 988 aa, unidentified
  REGION 1..988: note = Description of Unknown:uncultivated organism sequence
  REGION 1..988: note = Category: MG55 effectors
  REGION 1..988: note = Description: MG55-202 effector
MSLRIGIDIGSTTVKVVVLDEQNKLLFRSYERHYSKTRERACETLRSISDMLAGRQVKMVITGSAGLGVANASGIDFVQEVYATAAAVNTYIPGTDAVIELGGEDAKIIFFGGALEERMNGSCAGGTGAFIDQMATLMNVSVDELDALSLKHEKIYPIASRCGVFAKSDIQPILNQGGRKEDVAASIFQAVVDQTVAGLTQGRELKGKIVFLGGPLHFLMGLRERFVETLKLDEEHAIFPEDGDCFAAMGAALCSSDYDTILFEDALKKLEESVDTTTLVDTMPPLFQDVAEYGAFCARHNAKRPPEVDIKTYEGPAWLGIDAGSTTTKLALITGDGGLLYTYYHSNLGNPVAIVLEQLREIYAQCGDRIEIRGVAVTGYGEDLIKNAFSCDLGLVETMAHYKAAAHFEPDVDFIIDIGGQDMKCFKIRNGAVDSIMLNEACSSGCGSFIETFAKALGYTIADFAKLGLFAQKPVNLGSRCTVFMNSSVKQAQKDGASVEEISAGLSISIVKNAIYKVIRAASADDLGKHIVVQGGTFHNDAVLRAFEQELGRNVTRPTIAGIMGAFGAALAARDLRLNASGLLSEAALQSFTHSAKPVTCGLCTNHCALTVNQFDGGRKFISGNRCSRPLGKEKVELPDLMNYKYKKLRAMEGKGEGTGVRGRMGIPFGLNMYENLPFWFTFFTKLNFEVVLSPESSRKLYIKGQHTIPSDTVCYPAKLLHGHVEALVEEGVDAIWYPCMSYNNDEGIGDNHFNCPVVAYYPELLAANVPALKQTKFLNPYVGLWRHKDFTKRIAKMMEEEFSIPKKESVAAAKAAYAAYDDYVHDVRATGKKYIEYARAMNMPILVVCGRPYHIDPEINHGINDLITSFGFVLITEDALSYLEGYAPRKVLNQWTFQSRMYNAARYVCTQPDMQVVQLVSFGCGTDAITTDELRSILEEGGKLYTQLKIDDISNLGAVRIRIRSLIAAIDARKQQRPQNGQSAANA

SEQ ID NO: 628 - protein, 733 aa, unidentified
  REGION 1..733: note = Description of Unknown:uncultivated organism sequence
  REGION 1..733: note = Category: MG55 effectors
  REGION 1..733: note = Description: MG55-203 effector
MKIIKRNGQEADFDLDRIVKAVTAANNEVPEYQRMTEMEILCVADNSKRQIDEFHYAVSVEEIQDIVERQIMKFAPVVAQTYIRYRHKRELARQANTTDAAILSLLDYENEEVKQENSNKNPVVASVQRDYMAGEVSKDLSRRVILPKDVVEAHDKGIIHFHDMDYFSQHIFNCCLINLEDMLQNGTVISGVQIDKPKSFQTACTVATQIISTVASNQYGGQSVSLSHLAPFVEVSRQKWQERVRETLDGVAPEAMINELAENLLYKECEAGMQTIQYQVITLMTTNGQAPFITVEMYLGEVKDPQTKKDLAMLIEIMLKQRILGVKNEKGIYITPAFPKIVYVLEEDNASEGSPYWYLTELAAKCTAKRMVPDYVSEKIMLQYKVDQNGEGHCYPPMGCRSFLTPYVDKDGKPKYFGRFNQGVVTINLPDVALSSGGDMEKFWNIFEERLELCHRALQARHERLKGTLSDVSPIHWQHGAIARIEKGKPIDEFLYGGYSTISLGYAGLFECVKYMTGESHTSEAGKPFALEVMQKLNDKCAEWKAAENIAYSVYGTPLESTTYKFAKALQRRFGIIKDVTDHNYITNSYHVNVREEIDAFSKLSFESEFQRLSPGGAISYIEVPDMQDNIPAVLDIIKFIYDNIMYAELNTKSDYCQECGWDGQIEIVSDESGKLIWKCPNCGNTDQSKMNVARRTCGYIGTQFWNQGRTQEIKDRVVHVGVQDYYAGEENG

SEQ ID NO: 629 - protein, 720 aa, unidentified
  REGION 1..720: note = Description of Unknown:uncultivated organism sequence
  REGION 1..720: note = Category: MG55 effectors
  REGION 1..720: note = Description: MG55-204 effector
MKIIKRSGAEAVFDISKIIIAINKANHEVVEAERLTADQIKEIAQYIEDSCKDANHALNVEDIQDLVEDQLMDKRAFSVARKYITYRYKRALVRKSNSTDEQILSLIECNNEEVKQENSNKDSTVNSVQRDYMAGEVSKDITRRFLLPEDIVEAHEQGIIHFHDADYFAQHMHNCDLVNLEDMLQNGTVISGTRIDKPHSFSTACNIATQIIAQVASSQYGGQSISLAHLVPFVQISREKIHAELVQTLKESDVELSEEKINNIVERRLHAEIERGVQVIQYQVVTLMTTNGQSPFVTVFMYLNEAKNEQEKKDLAMIIEEVLDQRYQGVKNEDGVWITPAFPKLIYVLEEDNIHEDSEYYYLTKKAAKCTAKRMVPDYISEKKMKELKDGNCYTCMGCRSFLTVYHDEDGKPKFYGRFNQGVVTLNLVDLACSSGGDFEKFWKLFDERLDLCYRALMARHNRLKGTPSDVAPILWQYGALARLKKGETIDKLLYGGYSTISLGYAGLCECTRYMTGKPHTDPAATPFALKVMQRLNDACKEWKEKENIDFSVYGTPLESTTYKFAKCLQKRFGVIPGVTDKNYITNSYHVHVTENIDAFTKLKFESQFQALSPGGAISYVEVPNMQDNLDAVLSVMKFIYENIMYAELNTKSDYCQVCGYDGEIQIVKDDDGKLVWECPHCHNRDQDKMNVARRTCGYIGSQFWNQGRTQEIKERVLHL

SEQ ID NO: 630 - protein, 979 aa, unidentified
  REGION 1..979: note = Description of Unknown:uncultivated organism sequence
  REGION 1..979: note = Category: MG55 effectors
  REGION 1..979: note = Description: MG55-205 effector
MQIGLDIGSTTIKIAVMDDAGNLLFHKYERHYSQIAEKILALHKELMTKFPTLHSARLAISGSGGIGIADSCGLQFIQEVFAEKICAEKLNPGTDAVIELGGEDAKILFLGRHFDARMNDSCAGGTGAFIDQMASLLNVETPQMNELAQQAQNTYTIASRCGVFAKSDIQPLLNQGAEKSDLAASIFHAVASQAITGLAKGRHISGNVLYLGGPLTFMSCLRDAFDSVLNIKGVCPENSLLYVAMGAAFCAEHEVDLTTLPEKLQAAAAQHSFEHLPPLFKNEGEYTVFKKRHSKESVAIGTPAEASEAFIGIDSGSTTIKIAVMSPDGKLLDSFYQSNKGNPVVAVRNYLTDFYTKYPHCRLLAGAVTGYGEELIRHGFGVDYGIVETMAHFYAAQYLEPEVDFILDIGGQDMKCLKIHNGAIDNIFLNEACSSGCGSFLQTFAEILGYTAEQFAQIGLKADMPVDLGSRCTVFMNSSVKQAQKDGASVANISAGLSISIVKNALYKVIRPASKEAIGKHIVVQGGTFLNDCVLRAFEQEMDLNVIRPNIAGLMGAYGAALYAQRRYKDAPHQTTLLNLQQLGEFVHTVKGMTCGLCNNHCHLTVNTFAGGKRFISGNRCERPITHMAPKDELNLYRQKLQLLKELPVNETPKRGIMGIPMGLNMYELLPFWNALLSSLGFKVVHSPIEDKTIYRLGQGTIPSDTVCYPAKLMHGHIKWLLQQGITNIFYPCMTYNIDEQGTENCYNCPVVAYYPEVLHANIRDLNKPEIHFFYDYLGLLHKKKLVKKLQEMFSKAYPDITKDEIRKAVDAAFNAFYDYEAQVKAKGQQIINKAREEHKPIVVLAGRPYHIDPKVNHSIDRLITNMGAALVSEDAVSSHIKTKELNRDLQVLNQWTYHGRLYAAAEYVAQNPDMHLIQLVSFGCGCDAITADECRRLLEERGRIYTQIKIDDIDNLGAAKIRIRSLFSAAQLFDIDNN

SEQ ID NO: 631 - protein, 708 aa, unidentified
  REGION 1..708: note = Description of Unknown:uncultivated organism sequence
  REGION 1..708: note = Category: MG55 effectors
  REGION 1..708: note = Description: MG55-206 effector
MKVIKRDGSTADFDSSKIIVAIQKANQVVEPEDRIDQERIEAIAHYVESKNRMRLLVEDIQDMVEHQLMDEGKFNLAKSYIIYRYTRALVRKANTTDESILSLIRNSNKDVMEENSNKNAVMASTQRDLIAGEVSKDLTRRLILPEKISKAHDEGAIHFHDADYFVQPIFNCCLINVGDMLDNGTVMNGKLIESPKSFQVACTVMTQIIASVASSQYGGQSVDIRHLGKYLRRSYEKFKLTIKAEVGDSVADEVVERLTKRRLQDELRSGVQTIQYQINTLMTTNGQSPFVTIFLNLQADDEYLEENAMIVEEILRQRLEGIKNDKGVFVTPAFPKLVYVLDEHNCLKGGKYDYITKLAVKCSAKRLYPDYISAKKMRENYEGNVFAPMGCRSFLAAWKDDEGNYKFEGRFNQGVVSLNLPQVAILAHGDEEKFWPLLDERLQLCYEALVCRHNSLKGIRSDVSPVHWQYGAIARLEKGEVIDKYLEKGYSTISLGYIGLYEMTKLMKDVSHTTPEGEEFALRVMKYLRAACDKWKKETGLGFALYGTPAESLCYRFARIDKERFGTIADVTDKGYYTNSYHVDVREDIDAFSKFNFESQFQRISSGGAISYVEIPNMRHNLEAMEDVVRFIYDNIQYAEFNTKSDYCHVCGFDGEIIINDDLEWECPNCGNKNQTLMNVTRRTCGYLGENFWNVGKTKEIKSRVLHL

SEQ ID NO: 632 - protein, 723 aa, unidentified
  REGION 1..723: note = Description of Unknown:uncultivated organism sequence
  REGION 1..723: note = Category: MG55 effectors
  REGION 1..723: note = Description: MG55-207 effector
MKVIKRDKKEVEFDSTKIEAAIKKARNACTSSNLSDENIADIADYITYKCKKLDHSVSVEDIQDMVEDQLMAHGEFALAKEYVKYRYNRQLVRKSNTTDEKILSLIELQNEEVKQENSNKNPTINSTQRDYMAGEVSRDLTNRILLPKDIVEAHEKGIIHFHDSDYFAQHMHNCDLVNLEDMLQNGTVISGTLIEKPHSFHTACNVATQIVAQVASAQYGGQSISLAHLAPFVDISRKKIYNKFRKNFEELGINVTEDKLSELVEKEVKEEINRGVQTIQYQVVTLMTTNGQTPFVTVFMYLGEAKNEREKADLALIIEEVLRQRIQGVKNEKGAWITPAFPKLIYVLEEQNITEDAPYFYLTELAAKCTAKRMVPDYISEKIMLELKKDKNGEGHCYTCMGCRSFLTPYLDKNGKPKYYGRFNQGVVTINLVDVACSSHKDINKFWEIFDERLELCHRALMCRHKRLKGTPSDVAPILWQHGALARLKKGETIDKLLYGGYSTISLGYAGLCECTRYMTGKSHTDPSATPFALEVMKHMNDACAKWKEEENIDFSLYGTPLESTTYKFAKCLQKRFGIIKGVTDKAYITNSYHVHVTEEIDAFTKLAFESQFQKLSPGGAISYVEVPNMQNNIPAVIQVIQFIYDNIMYAELNTKCDYCQKCGYDGEIKVVKKGGKYIWQCPNCGNTDQRFMNVVRRTCGYLGSNYWSHGRTEEIAERKLHL

SEQ ID NO: 633 - protein, 720 aa, unidentified
  REGION 1..720: note = Description of Unknown:uncultivated organism sequence
  REGION 1..720: note = Category: MG55 effectors
  REGION 1..720: note = Description: MG55-208 effector
MKIIKRSGAEAVFDISKIIIAINKANHEVVEAERLTADQIKEIAQYIEDSCKDANHALNVEDIQDLVEDQLMDKRAFSVARKYITYRYKRALVRKSNSTDEQILSLIECNNEEVKQENSNKDSTVNSVQRDYMAGEVSKDITRRFLLPEDIVEAHEQGIIHFHDADYFAQHMHNCDLVNLEDMLQNGTVISGTRIDKPHSFSTACNIATQIIAQVASSQYGGQSISLAHLVPFVQISREKIHAELLQTLKESGVELSEEKINSIVERRLHAEIERGVQVIQYQVVTLMTTNGQSPFVTVFMYLNEAKNEQEKKDLAMIIEEVLDQRYQGVKNEDGVWITPAFPKLIYVLEEDNIHEDSEYYYLTKKAAKCTAKRMVPDYISEKKMKELKDGNCYTCMGCRSFLTVYHDEDGKPKFYGRFNQGVVTLNLVDLACSSGGDFEKFWKLFDERLDLCYRALMARHNRLKGTPSDVAPILWQYGALARLKKGETIDKLLYGGYSTISLGYAGLCECTRYMTGKPHTDPAATPFALKVMQRLNDACKEWKEKENIDFSVYGTPLESTTYKFAKCLQKRFGVIPGVTDKNYITNSYHVHVTENIDAFTKLKFESQFQALSPGGAISYVEVPNMQDNLDAVLSVMKFIYENIMYAELNTKSDYCQVCGYDGEIQIVKDDDGKLVWECPHCHNRDQDKMNVARRTCGYIGSQFWNQGRTQEIKERVLHL

SEQ ID NO: 634 - protein, 720 aa, unidentified
  REGION 1..720: note = Description of Unknown:uncultivated organism sequence
  REGION 1..720: note = Category: MG55 effectors
  REGION 1..720: note = Description: MG55-209 effector
MKIIKRSGAEAVFDISKIIIAINKANHEVVEAERLTADQIKEIAQYIEDSCKDANHALNVEDIQDLVEDQLMDKRAFSVARKYITYRYKRALVRKSNSTDEQILSLIECNNEEVKQENSNKDSTVNSVQRDYMAGEVSKDITRRFLLPEDIVEAHEQGIIHFHDADYFAQHMHNCDLVNLEDMLQNGTVISGTRIDKPHSFSTACNIATQIIAQVASSQYGGQSISLAHLVPFVQISREKIHAELLQTLKESGVELSEEKINSIVERRLHAEIERGVQVIQYQVVTLMTTNGQSPFVTVFMYLNEAKNEQEKKDLAMIIEEVLDQRYQGVKNEDGVWITPAFPKLIYVLEEDNIHEDSEYYYLTKKAAKCTAKRMVPDYISEKKMKELKDGNCYTCMGCRSFLTVYHDEDGKPKFYGRFNQGVVTLNLVDLACSSGGDFEKFWKLFDERLNLCYRALMARHNRLKGTPSDVAPILWQYGALARLKKGETIDKLLYGGYSTISLGYAGLCECTRYMTGKPHTDPAATPFALKVMQRLNDACKEWKEKENIDFSVYGTPLESTTYKFAKCLQKRFGVIPGVTDKNYITNSYHVHVTENIDAFTKLKFESQFQALSPGGAISYVEVPNMQDNLDAVLSVMKFIYENIMYAELNTKSDYCQVCGYDGEIQIVKDDDGKLVWECPHCHNRDQDKMNVARRTCGYIGSQFWNQGRTQEIKERVLHL

SEQ ID NO: 635 - protein, 735 aa, unidentified
  REGION 1..735: note = Description of Unknown:uncultivated organism sequence
  REGION 1..735: note = Category: MG55 effectors
  REGION 1..735: note = Description: MG55-210 effector
MGDKMDKELLIMTNVIKRNGKEVKFDIYKIIHAMEKANKEVAPVYQMNEYQIQAAAETVAKKIQASSHAVNVEDIQDMVETAIMEMRAYEVAQKYVRYRYKREMARKANSTDEDILALIDQANEELKQENSNKNPVINSTQRDYMAGEVSKDLTKRLLLPEDIVKAHEEGVIHFHDSDYYAQKEHNCDLINLEDMLQNGTVISETMIEKPHSFFTACNVTTQIVAQVASNQYGGQSFTLSHLAPFVDISRQKIREAVIGERKETGESMDEDIIAKIVNRRLKEEIKSGIQTIQYQLITLMTCNGQAPFVTMFMYLDEVPEGKTREDLALIIEEVLRQRMQGVKNEKGVWITPAFPKLIYVLDEDNITEDAPYYHLTKLAAQCTAKRMVPDYISAKIMREYKGGDVYPCMGCRSFLTEDKEGLGENGAHKYYGRFNQGVVTINLVDVACSSQGNMDSFWQILEERLELCHKALRLRHERLLGTVSDVAPILWQHGALARLKKGEKIDKLLYNNYSTISLGYAGLYEMCVRMLGKSHTTEEGREFSLKVMEKLNDSCKKWREAENISYSVYGTPMESTTYKFAKALKKRFGTIPGVTDKNYITNSYHVHVSEKIDAFSKLAFEADFQKLSPGGAISYVEVPNMQNNIPAVLSLMHFIYENIMYAELNTKSDYCCACGYDGEIQIIEDQYGKLQWRCPNCGNENQEQLSVARRTCGYIGTQFWNQGRTQEIKDRVLHL

SEQ ID NO: 636 - protein, 982 aa, unidentified
  REGION 1..982: note = Description of Unknown:uncultivated organism sequence
  REGION 1..982: note = Category: MG55 effectors
  REGION 1..982: note = Description: MG55-211 effector
MSLRIGIDIGSTTVKVVVLDEQNKLLFRSYERHYSKTRERACETLRSISDMLAGRQVKMVITGSAGLGVANASGIDFVQEVYATAAAVNTYIPGTDAVIELGGEDAKIIFFGGALEERMNGSCAGGTGAFIDQMATLMNVSVDELDALSLKHEKIYPIASRCGVFAKSDIQPILNQGGRKEDVAASIFQAVVDQTVAGLTQGRELKGKIVFLGGPLHFLMGLRERFVETLKLDEEHAIFPEDGDCFAAMGAALCSSDYDTILFEDALKKLEESVDTTTLVDTMPPLFQDVAEYGAFCARHNAKRPPEVDIKTYEGPAWLGIDAGSTTTKLALITGDGGLLYTYYHSNLGNPVAIVLEQLREIYAQCGDRIEIRGVAVTGYGEDLIKNAFSCDLGLVETMAHYKAAAHFEPDVDFIIDIGGQDMKCFKIRNGAVDSIMLNEACSSGCGSFIETFAKALGYEIADFAKMGLFAQHPVNLGSRCTVFMNSSVKQAQKDGASVEDISAGLSISIVKNAVYKVIRAANADDLGQHIVVQGGTFLNDAVLRAFEQELGRNVTRPTIAGIMGAFGAALAAKDLGLEKSSILGPEALERFTHSAKPVTCNLCTNHCSLTVNQFDGGRRFISGNRCSRPLGKEKVTQPDLMTYKYKKLRAMQGKGEGTGVRGRIGIPFGLNMYENLPFWFTFFTKLNFEVVLSPESSRKLYLKGQHTIPSDTVCYPAKLLHGHVEALVEEGVDAIWYPCMSYNNDEGIGDNHFNCPVVAYYPELLAANVPALKETRFLDPYVGLWRHKDFEKRIAKLMEEEFSIPQRETRAAAQAAYAAYEAYVHDLRQTGQEYIAYAREHGLNIAVVCGRPYHIDPEINHGINDLITSFGFVLITEDALSYLEGYAPRKVLNQWTFQSRMYNAARYVCTQPDMQVIQLVSFGCGTDAITTDEMRSILEEGGKLYTQLKIDDINNLGAVKIRIRSLMAAMDARKHQAAPAR

SEQ ID NO: 637 - protein, 979 aa, unidentified
  REGION 1..979: note = Description of Unknown:uncultivated organism sequence
  REGION 1..979: note = Category: MG55 effectors
  REGION 1..979: note = Description: MG55-212 effector
MQIGLDIGSTTIKIAVMDDAGNLLFHKYERHYSQIAEKILALHKELMTKFPTLHSARLAISGSGGIGIADSCGLQFVQEVFAEKICAEKLNPGTDAVIELGGEDAKILFLGRHFDARMNDSCAGGTGAFIDQMASLLNVETPQMNELAQQAQNTYTIASRCGVFAKSDIQPLLNQGAEKSDLAASIFHAVASQAITGLAKGRPISGNVLYLGGPLTFMSCLRDAFDSVLNIKGVCPENSLLYVAMGAAFCAEHEVDLTTLPEKLQAAAAQHSFEHLPPLFKNEGEYTVFKKRHSKESVAIGTPAEASEAFIGIDSGSTTIKIAVMSPDAKLLDSFYQSNKGNPVVAVRNYLTDFYTKYPNCHLLAGAVTGYGEDLIRHGFGVDYGIVETMAHFYAAQYLEPEVDFILDIGGQDMKCLKIHNGAIDNIFLNEACSSGCGSFLQTFAEILGYTAEQFAQIGLKADMPVDLGSRCTVFMNSSVKQAQKDGASVANISAGLSISIVKNALYKVIRPASKEAIGKHIVVQGGTFLNDCVLRAFEQEMDLNVIRPNIAGLMGAYGAALYAQRRYKDAPHQTTLLNLQQLGEFVHTVKGMTCGLCNNHCHLTVNTFAGGKRFISGNRCERPITHMAPKDELNLYRQKLQLLKELPVNETPKRGIMGIPMGLNMYELLPFWNALLSSLGFKVVHSPIEDKNIYRLGQGTIPSDTVCYPAKLMHGHIKWLLQQGITNIFYPCMTYNIDEQGTENCYNCPVVAYYPEVLHANIRDLNKPEIHFFYDYLGLLHKKKLVKKLQEMFAKVYPDITKEEIRKAVDAAFTAFYDYEAQVKAKGQEIISKAREEHKPIVVLAGRPYHIDPKVNHSIDRLITNMGAALVSEDAVSSHIKTKELNRDLQVLNQWTYHGRLYAAAEYVAQNPDMHLIQLVSFGCGCDAITADECRRLLEERGRIYTQIKIDDIDNLGAAKIRIRSLFSAVQLFDIDNN

SEQ ID NO: 638 - protein, 979 aa, unidentified
  REGION 1..979: note = Description of Unknown:uncultivated organism sequence
  REGION 1..979: note = Category: MG55 effectors
  REGION 1..979: note = Description: MG55-213 effector
MQIGLDIGSTTIKIAVMDDAGNLLFHKYERHYSQIAEKILALHKELMTKFPTLHSARLAISGSGGIGVADSCGLQFVQEVFAEKICAEKLNPGTDAVIELGGEDAKILFLGRHFDARMNDSCAGGTGAFIDQMASLLNVETPQMNELAQQAKNTYTIASRCGVFAKSDIQPLLNQGAEKSDLAASIFHAVASQAITGLAKGRPISGNVLYLGGPLTFMSCLCDAFDSVLNIKGVCPENSLLYVAMGAAFCAEHEVDLTTLPEKLQTAAAQHSFEHLPPLFKNEGEYTVFKKRHSKESVAIGTPEEASEAFIGIDSGSTTIKIAVMSPDGKLLDSFYQSNKGNPVVAVRNYLTDFYTKYPHCHLLAGAVTGYGEELIRHGFCVDYGIVETMAHFYAAQYLEPEVDFILDIGGQDMKCLKIHNGAIDNIFLNEACSSGCGSFLQTFAEILGYTAEQFAHIGLKADMPVDLGSRCTVFMNSSVKQAQKDGASVANISAGLSISIVKNALYKVIRPASKEAIGKHIVVQGGTFLNDCVLRAFEQEMDLNVIRPNIAGLMGAYGAALYAQRRYKDAPHQTTLLNLQQLGEFVHTVKGMTCGLCNNHCHLTVNTFAGGKRFISGNRCERPITHMAPKDELNLYRQKLQLLKELPVNETPKRGIMGIPMGLNMYELLPFWNALLSSLGFKVVHSPIEDKTIYRLGQGTIPSDTVCYPAKLMHGHIKWLLQQGITNIFYPCMTYNIDEQGTENCYNCPVVAYYPEVLHANIRDLNKPEIHFFYDYLGLLHKKKLVKKLQEMFSKAYPNITKDEIRKAVDAAFNAFYDYEAQVKAKGQQIISKAREEHKPIVVLAGRPYHIDPKVNHSIDRLITNMGAALVSEDAVSSHIKTKELNRDLQVLNQWTYHGRLYAAAEYVAQNPDMHLIQLVSFGCGCDAITADECRRLLEERGRIYTQIKIDDIDNLGAAKIRIRSLFSAAQLFDIDNN

SEQ ID NO: 639 - protein, 724 aa, unidentified
  REGION 1..724: note = Description of Unknown:uncultivated organism sequence
  REGION 1..724: note = Category: MG55 effectors
  REGION 1..724: note = Description: MG55-214 effector
MKIIKRNGAEVGFDITKIIIAITKANESVEEVDRMTPVQIQRIAESVDLQCQKMNRAPTVEEIQDMVEHYIMAHGAFEVAKHYITYRYTRSLVRKSNTTDDKILSLIECNNEEAKQENSNKNPVVNSTQRDYMAGEVSRDITNRILLPKDIVEAHNEGIIHFHDTDYYAQHMHNCDLVNLEDMLQNGTVITGTLIEKPHSFATACNIATQIVAQVASNQYGGQSISLTHLAPFVQISREKIRASVRDEFDAVGVAVTEDKINSIAEKRLREEIRRGVQTIQYQVVTLLTTNGQAPFVTVFMYLGEAKNQQEKDDLALIIEETLLQRYQGVKNEKGVWVTPAFPKLIYVLEEDNIREGSKYWELTKLAAKCTAKRMVPDYISEKKMLELKVDKNGNGHCYPCMGCRSFLTPYVDEDGNPKYYGRFNQGVVTVNLPDIALSSGGNIEKFWRIFDERMELCHRALLCRHERLKGTLSDAAPILWQYGACARLKKGEPIDKLLYGGYSTISLGYAGLYECVKYMTGKSHTDPSATPFALEIMHKLNAACKTWKAQHNIDFSLYGTPLESTTYKFAKCLQKRFGVIEGITDKGYITNSYHVHVTEPIDAFKKLEFEAQFQHLSPGGAISYVEVPDMQNNLDAVLEVMKFIYDHIIYAELNTKSDYCQVCGWDGEIEVVEEDGKLIWKCPQCGNTDQDKMNVARRTCGYIGTQFWNQGRTQEIKDRVLHL

SEQ ID NO: 640 - protein, 720 aa, unidentified
  REGION 1..720: note = Description of Unknown:uncultivated organism sequence
  REGION 1..720: note = Category: MG55 effectors
  REGION 1..720: note = Description: MG55-215 effector
MKIIKRSGAEAVFDISKIIIAINKANHEVVEAERLTADQIKAIAQYIEDSCKDANHALNVEDIQDLVEDQLMDKRAFSVARKYITYRYKRALVRKSNSTDEQILSLIECNNEEVKQENSNKDSTVNSVQRDYMAGEVSKDITRRFLLPEDIVEAHEQGIIHFHDADYFAQHMHNCDLVNLEDMLQNGTVISGTRIDKPHSFSTACNIATQIIAQVASSQYGGQSISLAHLAPFVQISREKIHAELVQTLKESDVELSEEKINSIVERRLHAEIERGVQVIQYQVVTLMTTNGQSPFVTVFMYLNEAKNEQEKKDLAMIIEEVLDQRYQGVKNEDGVWITPAFPKLIYVLEEDNIHEDSEYYYLTKKAAKCTAKRMVPDYISEKKMKELKDGNCYTCMGCRSFLTVYHDEDGKPKFYGRFNQGVVTLNLVDLACSSGGDFEKFWKLFDERLDLCYRALMARHNRLKGTPSDVAPILWQYGALARLKKGETIDKLLYGGYSTISLGYAGLCECTRYMTGKPHTDPAATPFALKVMQRLNDACKEWKEKENIDFSVYGTPLESTTYKFAKCLQKRFGVIPGVTDKNYITNSYHVHVTENIDAFTKLKFESQFQALSPGGAISYVEVPNMQDNLDAVLSVMKFIYENIMYAELNTKSDYCQVCGYDGEIQIVKDDDGKLVWECPHCHNRDQDKMNVARRTCGYIGSQFWNQGRTQEIKERVLHL

SEQ ID NO: 641 - protein, 720 aa, unidentified
  REGION 1..720: note = Description of Unknown:uncultivated organism sequence
  REGION 1..720: note = Category: MG55 effectors
  REGION 1..720: note = Description: MG55-216 effector
MKIIKRSGAEAVFDISKIIIAINKANHEVVEAERLTADQIKEIAQYIEDSCKDANHALNVEDIQDLVEDQLMDKRAFSVARKYITYRYKRALVRKSNSTDEQILSLIECNNEEVKQENSNKDSTVNSVQRDYMAGEVSKDITRRFLLPEDIVAAHEQGIIHFHDADYFAQHMHNCDLVNLEDMLQNGTVISGTRIDKPHSFSTACNIATQIIAQVASSQYGGQSISLAHLVPFVQISREKIHAELVQTLKESDVELSEEKINSIVERRLHAEIERGVQVIQYQVVTLMTTNGQSPFVTVFMYLNEAKNEQEKKDLAMIIEEVLDQRYQGVKNEDGVWITPAFPKLIYVLEEDNIHEDSEYYYLTKKAAKCTAKRMVPDYISEKKMKELKDGNCYTCMGCRSFLTVYHDEDGKPKFYGRFNQGVVTLNLVDLACSSGGDFEKFWKLFDERLDLCYRALMARHNRLKGTPSDVAPILWQYGALARLKKGETIDRLLYGGYSTISLGYAGLCECTRYMTGKPHTDPAATPFALKVMQRLNDACKEWKEKENIDFSVYGTPLESTTYKFAKCLQKRFGVIPGVTDKNYITNSYHVHVTENIDAFTKLKFESQFQALSPGGAISYVEVPNMQDNLDAVLSVMKFIYENIMYAELNTKSDYCQVCGYDGEIQIVKDDDGKLVWECPHCHNRDQDKMNVARRTCGYIGSQFWNQGRTQEIKERVLHL

SEQ ID NO: 642 - protein, 341 aa, unidentified
  REGION 1..341: note = Description of Unknown:uncultivated organism sequence
  REGION 1..341: note = Category: MG55 effectors
  REGION 1..341: note = Description: MG55-217 effector
MAATMKDIARRTGLGLATISSYFNGGNVREKNRIKIEEAIQELHYEVNEVARGLKTNATKTIGVVIPELNNTFCAEIITGMEDVLRSHGYATIVCDCRTDKRLEREAVEFLSRKRVDGIISMPVDAEGNHLKKFQKTGKPIVLIDRRIRELSCDSVLVDNEKAAEDAMRVFFQAGHRKIGIIGGPEEISTAQERLQGYRNAYEKENIPVRESLIYHGDYTIQGGVQGIEKLVADNPDMTAVFVTNYEMTMGAVIGMNELGLKIPEQLSMIGFDNLQFARACNPKLTIVAQPTQGIAGEVAGIMLKRLEGAASEETEPITEKLGAEIIMGKSVRVLDEKEKL

SEQ ID NO: 643 - protein, 1005 aa, unidentified
  REGION 1..1005: note = Description of Unknown:uncultivated organism sequence
  REGION 1..1005: note = Category: MG55 effectors
  REGION 1..1005: note = Description: MG55-218 effector
MSEIKLQQKAAYTLGIDVGSTTVKTVILDADHHVLHSTYQRHFSKVKEAVSEQLQAIIKEHPATLFSVHMTGSAGLGLATAAKIPFVQEVHAAFLAVKERYPKADAVIELGGEDAKIIFLTGGVEQRMNGSCAGGTGAFIDQMATLLDVTVDELDQMALQADRTYPIAARCGVFAKSDIQPLLNQGAKRENVAASIYQAVVDQTVSGLAQGRKIQGYVLFLGGPLSFLQGLRNAFMQTLHLDAEHAIFPVDGRTFVAYGCALAAENSADKPVTGEALLKQIESAETNHTVIADKPLFGYQEEYDRFRERHAQNDVVHGDLHTYQGNAYLGVDAGSTTTKVALIGEDNSLLYSFYETNKGQPLECVKRALETLYQKKNPNLKICGSAVTGYGEEMLKAGLGIDFGIVETVAHFRAAEFFCPDVDFIIDIGGQDIKCFQIKNGAIDSIMLNEACSSGCGSFIQAFANALGYDVAEFAKLGLFAERPVDLGSRCTVFMNSSVKQAQKDGATVADISAGLSGSIVKNAIYKVIRAKSPEDLGKHIVVQGGTFLNDAVLRCFEREMGRDVIRPAISGLMGAFGAAIYAKEHTSGSSTLLSLMDLHTLTYRTQNTTCNGCTAHCNLQILRFSNGKRFIAGNRCERGAGVSKKDQIPNLVDWKYETLRSLTDRQPEQPKATVGLPMALHYYDQLPLWYTFFTDLGFAVKLSEESTRKTYYKGQSTIPSDTVCYPAKLAHGHIESLLEQNVDFIFYPCMTYNLDEGDSDNHYNCPVVAYYPELLLANNEKLNEQNFLHPFLDLNRRKHLITVLYACLSDYATKKEIAAALEHGFAALEQYHNQIAQTAQEIVRQARAAGKTILVLAGRPYHIDPEINHGIHKLISSLGMAVITEDSIAGLAHTPELQALNQWTYHSRMYRAAQYVTTQPDFQLVQLVSFGCGIDAITTDEVRRILEQGGKLYTQLKIDEISNLGAAKIRLRSLKAAIGADVPPKPAAAPSEVAPKNEKEPVSV

SEQ ID NO: 644 - protein, 990 aa, unidentified
  REGION 1..990: note = Description of Unknown:uncultivated organism sequence
  REGION 1..990: note = Category: MG55 effectors
  REGION 1..990: note = Description: MG55-219 effector
MNVNVGIDIGSTTVKIVVVRDGEIIHKHYERHFSKVREKAVELVQNAREVIGPDATIRCAITGSAGLGVAKAADIDFVQEVFATRKAVGVHVPQADVVIELGGEDAKIVFLSGQLEERMNGSCAGGTGAFIDQMAVLLDVTPGELDELAQHAEQIYTIASRCGVFAKSDIQPLLNDGARKEDVAASIFQAVVNQTVAGLAQGREIKGDVLFLGGPLFFFKGLQKRFQETLKLDDMHAHFPALAPYAIAAGAAEYAKDTQKTYSVDSLLDALEHAAGAPVVANYLPPLFENEQQYEEFKHRHGVHDVMTQNVTMYEGDAYLGIDCGSTTTKLVLIGEDHQILFHHYQSNKGNPADVIREQLTKLYELCGDRVHIVSSAVTGYGEALIQHAFGVDFGLVETVAHFRAARHFCPDVDFIIDIGGQDIKCFKIRNKCIDNISLNEACSSGCGSFIETFARSMGYSIEEFCKLGLFAKHPIDLGSRCTVFMNSSVKQAQKDGAGIDAISAGLSVSVVKNALYKVIRAHSPDDLGQHIVVQGGTFLNDAILRSFEQEIGRDVTRPAIAGLMGAYGAALHAKDNRPAQTSLVGMDVLASFRHTVKSARCGLCENHCSLTINDFGGGRRFISGNRCERPLGGTKKADLPNLYQWKLEKLRSYGESSGKPMPNGRIGLPFGLNYYELLPFWTTFLRSLGFETVLSDVSTRDIYMQGQHSIPSDTVCYPAKLMHGHIENLLEKGVDAIFYPCMTYNLDEGRATNCYNCPVVAYYPELLHANVAALADFDFMMPYFELTDHKRFIQQAAKYFCGKYPQIKKKQVAAAAEAAFQELDNYYAEIRLEGQKAIAYADTHGLDIAVIAGRPYHVDPEINHGIDQLIASFGLVIVSEDAVWQLAEEPKVHVLNQWTYHSRMYGAAKYVTRKENAQLIQLVSFGCGIDAITTDEVRAICENGGKIYTQLKIDEISNLGAAKIRIRSMLAAVEEGRKLAEQQSNQHVG

SEQ ID NO: 645 - protein, 708 aa, unidentified
  REGION 1..708: note = Description of Unknown:uncultivated organism sequence
  REGION 1..708: note = Category: MG55 effectors
  REGION 1..708: note = Description: MG55-220 effector
MKVIKRDGRVVDYDRSKILLAIQKANDEVEIKEKITEQKIEKIVASIEHLKKDTMHVEEIQDFIEQKLMADGKFTLAKTYIIYRYTRELVRKANTTDESIMSLIKNSNKDVMEENSNKNAVIASTQRDLIAGEVSKDLTRRLLLPEKISKAHDEGVLHFHDADYFLQSIFNCCLINIKDMLDNGTVMNGKLIESPKSFQVACTVMTQIISAVASSQYGGQSVDIRHLGKYLRYSYKKYQERYQERFKGKLSDEVIEQIVQERLQDELKSGVQTIQYQINTLMTTNGQSPFVTLFLNLDKDDEYIEENAMIIEEVLRQRLQGIKNEKGVYVTPAFPKLIYVLDEHNCFKGGKYDYITKLAVQCSAKRLYPDYISAKKMRENYEGNVFSCMGCRSFLTPWKDENGNYKFEGRFNQGVVSLNLPQIGIIAQGDEEVFWPLLDERLALCYEALMCRHRALEGTLSDVSPIHWQYGAIARLNKGETIDKLLHGGYSTISLGYIGLYEVTKLMKGVSHTEAGGSEFAFKLMNRLREACDTWKRDTGIGFGLYGTPAESLCYRFARIDKERFGEIADVTDKGYYTNSYHVDVREHIDAFNKFTFESQFQVISSGGAISYIEIPNMRHNMEALEEIVKFIYENIQYAEFNTKSDYCHECSFDGEIIINENLEWECPNCGNKDHSKMNVTRRTCGYLGENFWNVGKTKEINSRVLHV

SEQ ID NO: 646 - protein, 727 aa, unidentified
  REGION 1..727: note = Description of Unknown:uncultivated organism sequence
  REGION 1..727: note = Category: MG55 effectors
  REGION 1..727: note = Description: MG55-221 effector
MKVIKRDGHMVDYCPEKIEQAIMKANNEVEEEDQASSTQIKNIIKYIEKLGKKRILVEDIQDIIEMKLMSQGKYELAKHYITYRYTRELVRRSNTTDQSIKELIDGESEYWNTENSNKNAKVVTTQRDYLAGITSTDITRRFLLPEDIVEAHDAGIIHFHDADYFAQNALHNCDLVNLEDMLQNGTSINGVMIEKPHRFLTAMTIATQIITAVSSSQYGGVTITLTHLAPFVRESYNRYLDKYKKRKLSKEQCEKFAMEDTKKEIVDGVQTFQYQVNSMTTTNGQAPFLSVCMYLGETTEYKEELSWIIEEFLKQRILGMKNEQGVYITPAFPKLLYVLEEDNINKNGKYYYLTKLAAECTAKRMVPDYISEKIMKELKIDKNGNGNCYPCMGCRSFLTPYVDENGKPKYYGRFNQGVVTINLVDAALSSDKDMDTFWQIFEERLELCHKALQIRHKRLSKATSDVAPILWQHGALARLKKGESIHELLHNGYSTISLGYAGLYECVKYMTGHSHTDNGKGKEFALEVMEKMNAKCKEWKEVENIDYSVYGTPIESTTYKFAKCLKDRFGVVKGITDRDYITNSYHVPVFEEIDAFTKLKLESEFQKLSPGGAISYIETPNLSNNLDAVLEVITFIYNNIMYAELNTKSDYCQECGYTGEILIDDNMEWYCPNCGNRDHNKLNVARRTCGYIGTNFWNKGRTQEIKERVLHIDNKEEKDTKKDKEEK

SEQ ID NO: 647 - protein, 730 aa, unidentified
  REGION 1..730: note = Description of Unknown:uncultivated organism sequence
  REGION 1..730: note = Category: MG55 effectors
  REGION 1..730: note = Description: MG55-222 effector
MKIIKRSGSEDIFDISKIEAAIRKANDSVIDYEKLGDDKIQAILSNVEKACENMKRSPSVEEIQDMVENQIMSQKAFNVARNYITYRYKRELVRKSNSTDEQILSLLECNNEEVKQENSNKNPTVNSVQRDYMAGEVSKDITRRFLLPPEIVEAHEKGIIHFHDADYFAQHMHNCCLVNLEDMLQNGTVISETMIDTPKSFSTACNIATQAIAQIASSQYGGQSISLSHLAPFVQVSREKFRKQVRKELETAGIEATEEKVNQMAEMRVKEEINRGVQMIQYQVITLMTTNGQAPFITVFMYLDEVPEGQLRDDLAAVIEEMLHQRILGVKNEQGVYITPAFPKLIYVLEEDNIREGSKYWYLTRLAAECTAKRMVPDYISEKMMKKLKDGDCYTCMGCRSFLTVDRTTGNLAHAKNYKEGKHKYYGRFNQGVVTLNLVDAACSSGGDEKKFWEIMDERLEMCYQALMIRHNRLKGTPSDVAPILWQNGALARLKKGETIDELLYHGYSTISLGYAGLCECTRYMKGVSHTEPEGTEFALAVMRRLNDACAKWKKETDIDFSLYGTPLESTTYKFAKCLQKRFGIIPGVTDKNYITNSYHVHVTEQINAFDKLKFESQFQELSPGGAISYVEVPNMQNNLEAVLSVMQYIYENIMYAELNTKSDYCMECGYAGEIKIVTDRDGKLVWECPNCGNRDQNKMSVARRTCGYIGTQFWNQGRTQEIKERVLHL

SEQ ID NO: 648 - protein, 712 aa, unidentified
  REGION 1..712: note = Description of Unknown:uncultivated organism sequence
  REGION 1..712: note = Category: MG55 effectors
  REGION 1..712: note = Description: MG55-223 effector
MEDNFDIKKIEAAIRKANESVIDYEKLTEEKIQEILANVEKACENMKRSPSVEEIQDMVENQIMNQRAFNVARNYITYRYKRALVRKSNSTDEQILSLLECNNEEVKQENSNKNPTVNSVQRDYMAGEVSKDITRRFLLDGDIVEAHEQGIIHFHDADYFAQHMHNCCLVNLEDMLQNGTVISETMIDRPKSFSTACNIATQAIAQIASSQYGGQSISLSHLAPFVDVSRQKFRKTVREELTATGIEPTEEMVNKIAEMRVKEEINRGVQMIQYQVITLMTTNGQAPFVTVFMYLDEVPEGQLRDDLAAVIEEVLHQRIQGVKNEKGVFITPAFPKLIYVLEEDNIREGSRYWYLTRLAAECTAKRMVPDYISEKIMKKLKQGNCYTCMGCRSFLTVYKDENDKFKFYGRFNQGVVTLNLVDVACSSGRDMNKFWELMDERLELCHRALMARHERLKGTPSDVAPILWQNGALARLKKGETIDKLLYGGYSTISLGYAGLCECTRYMKGVSHTDPDGTPFALEVMRHLNDACAKWKAEHNIDFSLYGTPLESTTYKFAKCLQKRFGIIPGVTDKNYITNSYHVHVTEEMSAFDKLKFESQFQELSPGGAISYVEVPNMQNNLDAVLSVMQYIYDNIMYAELNTKSDYCQECGYSGEIKIVNDKDGKLVWECPNCGNRDQNKMSVARRTCGYIGTQFWNQGRTQEIKERVLHL

SEQ ID NO: 649 - protein, 735 aa, unidentified
  REGION 1..735: note = Description of Unknown:uncultivated organism sequence
  REGION 1..735: note = Category: MG55 effectors
  REGION 1..735: note = Description: MG55-224 effector
MGVKMDKELLIMTNVIKRNGKEVKFDIYKIIHAMEKANKEVAPVYQMNEYQIQAAAETVAKKIQASSHAVNVEDIQDMVETAIMEMRAYEVAQKYVRYRYKREMARKANSTDEDILALIDQANEELKQENSNKNPVINSTQRDYMAGEVSKDLTRRLLLPEDIVKAHEEGVIHFHDSDYYAQKEHNCDLINLEDMLQNGTVISETMIEKPHSFFTACNVTTQIVAQVASNQYGGQSFTLSHLAPFVDISRQKIREAVIGERKETGESMDEDIIAKIVNRRLKEEIKSGIQTIQYQLITLMTCNGQAPFVTMFMYLDEVPEGKTREDLALIIEEVLHQRMQGVKNEKGVWITPAFPKLIYVLDEDNISEDAPYYHLTKLAAQCTAKRMVPDYISAKIMREYKGGDVYPCMGCRSFLTEDKEGLGENGAHKYYGRFNQGVVTINLVDVACSSEGNMDSFWEILEERLELCHKALRLRHERLLGTVSDVAPILWQHGALARLKKGEKIDKLLYNNYSTISLGYAGLYEMCVRMLGKSHTTEEGRAFSLKVMEKLNDSCKKWREEEKISYSVYGTPMESTTYKFAKALKKRFGTIPGVTDKNYITNSYHVHVSEKIDAFSKLAFEADFQKLSPGGAISYVEVPNMQNNIPAVLSLMHFIYENIMYAELNTKSDYCCACGYDGEIQIVEDSYGKLQWRCPNCGNENQDQLSVARRTCGYIGTQFWNQGRTQEIKDRVLHL

SEQ ID NO: 650 - protein, 708 aa, unidentified
  REGION 1..708: note = Description of Unknown:uncultivated organism sequence
  REGION 1..708: note = Category: MG55 effectors
  REGION 1..708: note = Description: MG55-225 effector
MRVIKRDGRTVEYDRNKILIAIRKANAEVDTFERVNDDMIDGIVAGIENMKRDTMQVEDIQDIIEQKLMAAGKFDLAKKYIIYRYTRELVRKANTTDDSIMSLLQNSNKDVMEENSNKNAYVASTQRDLIAGEGSKDLTKRILLPEKITKAHEDGVLHFHDMDYFIQPIFNCCLINIGDMLDNGTVMNGKLIESPKSFQVACTVMTQIISAVASSQYGGQSVDTRHLGKYLRKSADKYRKHYTERYAGKIAPDVIEEFVKERVNDELRSGVQTIQYQINTLMTTNGQSPFVTLFLNLDPKDEYIKENAMIIEEILRQRLEGIKNEKGVYVTPAFPKLIYVLDEHNALKGGEYDYITKLAVRCSAKRMYPDYISAKKMRENYEGNVFSCMGCRSFLTPWKDENGNYKFEGRFNQGVVSLNLPQIGILAKGDMEYFWQLLEERLSLCFEALMCRHRALEGVTSDVSPIHWQYGAIARLQKGEKIDKLLHGGYSTISLGYIGLYEVTKLMTGESQTTEKGSQFAKALMNRLRRATDTWKEETGIHFGLYGTPAESLCYRFAEIDKKRFGEIEDVTDKGYYTNSYHVDVREKIDAFSKFEFEAQFQVISSGGAISYVEVPNMQNNLPALEEVVKYIYEHIQYAEFNTKSDYCHVCGYDGEIIINDNLEWECPNCGNKDHDKMNVTRRTCGYLGENFWNVGKTKEINARVLHL

SEQ ID NO: 651 - protein, 708 aa, unidentified
  REGION 1..708: note = Description of Unknown:uncultivated organism sequence
  REGION 1..708: note = Category: MG55 effectors
  REGION 1..708: note = Description: MG55-226 effector
MKVIKRDGSTADFDSSKIIVAIQKANQVVEPEDRIDQERIEAIAHYVESKNRMRLLVEDIQDMVEHQLMDEGKFNLAKSYIIYRYTRALVRKANTTDESILSLIRNSNKDVMEENSNKNAVMASTQRDLIAGEVSKDLTRRLILPEKISKAHDEGAIHFHDADYFVQPIFNCCLINVGDMLDNGTVMNGKLIESPKSFQVACTVMTQIIASVASSQYGGQSVDIRHLGKYLRRSYEKFKLTIKAEVGDSVADEVVERLTKRRLQDELRSGVQTIQYQINTLMTTNGQSPFVTIFLNLQADDEYLEENAMIVEEILRQRLEGIKNDKGVFVTPAFPKLVYVLDEHNCLKGGKYDYITKLAVKCSAKRLYPDYISAKKMRENYEGNVFAPMGCRSFLAAWKDDEGNYKFEGRFNQGVVSLNLPQVAILAHGDEEKFWPLLDERLQLCYEALMCRHNSLKGIRSDVSPVHWQYGAIARLEKGEVIDKYLEKGYSTISLGYIGLYEMTKLMKDVSHTTPEGEEFALRVMKYLRAACDKWKKETGLGFALYGTPEISLCYRFARIDKERFGTIADVTDKGYYTNSYHVDVREDIDAFSKFNFESQFQRISSGGAISYVEIPNMRHNLEAMEDVVRFIYDNIQYAEFNTKSDYCHVCGFDGEIIINDDLEWECPNCGNKNQTLMNVTRRTCGYLGENFWNVGKTKEIKSRVLHL

SEQ ID NO: 652 - protein, 1441 aa, unidentified
  REGION 1..1441: note = Description of Unknown:uncultivated organism sequence
  REGION 1..1441: note = Category: MG55 effectors
  REGION 1..1441: note = Description: MG55-227 effector
MDEILHVGLDVGSTTVKIIVMNSNKETIYSNYERHFSDTKNTICNTLEKLAEKYPNNKFTLALTGSGAMSAAKFLGVDFIQEVVSCKRAVEKYIPKTDVVIELGGEDAKIIYFDESIEQRMNGTCAGGTGAFLDQMASLLHTDTQGLNTLAKNYNTIYPIASRCGVFAKTDIQPLLNEGAAKEDIAASIFQAVVNQTISGLACGRPIKGNVAFLGGPLNYLSELRQRFIKTLNLKPEEIIIPEEAHLIVAKGAALDSINSNIITIEELKEKINNLKNSHDNTSKPLDPLFNSKEELEEFKLRHSKAKINKKDLKDFEENCYIGIDAGSTTTKLVLIDDNNNLLYSLYGSNEGNPLKSVMNMLKELYSILPEKAIIRYSGVTGYGENLIQTALNVDLNEIETIAHYTAAKEFEPDVTSIVDIGGQDMKYIKIKDDTIDNIMLNEACSSGCGSFIETFAKSLNITISDFVKEALESKTPVDLGSRCTVFMNSKIKQAQKEGYSVGDISAGLSYSVIKNAIQKVMKVRDVETLGNHIVVQGGTFYNDAVLRAFELIVGKNVIRPEIAGLMGAYGVALLAKEQFESNLNMEYTSTIANLKDIENLDIKTSHIRCKGCENHCLLTINTFSNGQRHISGNRCEKGAGITNKKQDLPNLVKYKYERLFNYTPLEEKDAPRGTIGIPRVLNMYEDYPFWFTFFTNLGFRVILSDKSTRETYEKGMESMPSESVCYPAKLSHGHIINLIEKGITTIFYPCIPYSRKEFEKANNQYNCPIVISYSEVLKNNVEELKTNNIKFLNPFLPFDTKNLVKRILELDEFKEYNFNKKELLNAAKLAEEEYQNFKKEILEKGNETVKYIEENNLRGIVLAGRPYHLDPEINHGIDTLITSLGLCVLTEDFVARNEKLENPLRVVNQWVYHSRLYAAADFVGKHDHLELIQLNSFGCGVDAVTTDQVEEILKSYDKMYTLIKIDEVNNLGAVRIRIRSLLASMNKRIKEKQENKELGNYSPLRPIFTKEMKKDYTILIPQMAPIHFELLESAVRASGYNAVLLRECTQKTVETGLKYVNNDACYPSILTTGQFIEALQSGKYDLDKTAIIMSQTGGGCRATNYIGFIRKALKDAGFEKVPIISFNVVGMEKMPGFKLTLPLLERLLKMVIYGDLLQKMLTKNRAYEINKGETEKLFNEWLEKCKKLVAKSTNKQFKQSIYNIVNDFEKIELDTSIEKPKVGVVGEVLIKYHPFGNNYVANVLEKEGAEVILPDFMGFVKFMATHKITFNTLLKTTPTIAKISKAAIKLIDILEKDVKIALANSKKGYMQPCDIFHLEEQVKDVLSIGNQTGEGWFLTAEMIEYMENEIPNIVCVQPFACLPNHVVGKGVIKTIRNKYPEANISPIDYDPGASEANQTNRIKLLMTVAKDNLKNNKIKKEKLNSKENKAIDHDIKIYKK

SEQ ID NO: 653 - protein, 1416 aa, unidentified
  REGION 1..1416: note = Description of Unknown:uncultivated organism sequence
  REGION 1..1416: note = Category: MG55 effectors
  REGION 1..1416: note = Description: MG55-228 effector
MKLDFNTLGIDIGSTTVKIAILNKDGEIIFSDYQRHYANIQETLAKIIDEAYEEFGDIPVSPMITGSGGLTLSKHMEIPFVQEVVAVATSLKDYAPRTDVAIELGGEDAKIIYFTGGIDQRMNGICAGGTGSFIDQMATLLKTDAAGLNEYAKNYKAIYPIAARCGVFAKTDIQPLINEGATKEDLSASIFQAVVNQTISGLACGKPIKGNVAFLGGPLHFLTELKQAFIRTLGLEGDAIIAPEHSHLFAASGAAMNAHADVQSSLGELKEKLSHKIELEFEVTRMEPLFASEKEYEDFTERHNKHNVRKGDFASYKGDLFLGIDAGSTTTKVAVIGDDGSLLYSFYSSNNGSPLKTALKAMKDIYSKMPEGARIVRSCSTGYGEALLKSALLLDEGEVETVAHYTAAAFFDPNVDCILDIGGQDMKCIKIKNNSVDKVQLNEACSSGCGSFIETFAKSLNYEVADFAKIALFAENPIDLGSRCTVFMNSKVKQAQKEGASVADISAGLAYSVIKNALLKVIKLTDPKDLGKQVVVQGGTFYNDAVLRSFERISGCEAIRPDIAGIMGAFGAALIAKDRYTGQKSTMLSFKEINELRFKTSMTRCQGCINHCLLTVNEFTGDRKFISGNRCEKGLGLEKNKEQIPNLFEYKNERVFRHYKPLKKADAPRGVVGIPRVLNMYENYPFWFTFFTKLGYSVKLSPVSSRKIYELGIESIPSESECYPAKLAHGHVTWLIRQGLEYIFYPCIPYERVEVPDAGNHYNCPIVTSYGENIKNNIEELRDDKIKYQNPFISLESEEILTKRLVDFFRKENGIPAAEIKAAAHEGWLEMQAVREDMTKKGKEVLQYLKETGRHGIVLAGRPYHSDPEINHGIPDLITSYGVAVLTEDSISELSEVDRPTIVMDQWMYHSRLYKAASFVAKNDNLDLIQLNSFGCGLDAVTTDQVNDILTKQNKIYTVLKIDEVNNLGAARIRIRSLLAAVKDRERKKIEAKRVDTAHHRVIFTEQMRKDYTILVPDMSPIHFEILESALASCGYKVEVLKADSKCIDYGLKYVNNDACYPSLIVVGQFMQTLLSGKYDLHKVALIITQTGGGCRATNYIGFIRRALEKAGMGYIPVISMSAGIEKNPGLKVNLEMANKALQALIYGDVFMRVLYKTRPYEKVKGSANALHEKWKKIAIESVKKANKKQFKKNIQNIVKEFDELELVDIKKPKVGIVGEILVKFMPLANNFIVELLEEEGAEAVCPDLIDFFMYSLYNANFKAEYLGKKKSSAKINNFLIWFIERYRKCANDALAASKRFHPTVPIQKLAEYASPIVSCGNQTGEGWFLTGEMIELIKSGVPNIVCTQPFGCLPNHVVGKGVIKELRHQYPDSNIVAVDYDPGASEVNQLNRIKLMLSTAGKNLIAESKDNEEPA

SEQ ID NO: 654 - protein, 337 aa, unidentified
  REGION 1..337: note = Description of Unknown:uncultivated organism sequence
  REGION 1..337: note = Category: MG55 effectors
  REGION 1..337: note = Description: MG55-229 effector
MAATMKDIARRTGLGLATISSYFNGGNVREKNRIKIEEAIEELHYEVNEVARGLKTNATKTIGVVIPELNNIFCAEIITGMEDILRSHGYATIVCDCRTDKKLEREAVEFLIRRRVDGIINMPVDETGAHLKRFQKTGRPIVLIDRRIQGIPCDSVLVDNQKAAEEAVELFIEKGHRNIGIIGGPEGIFTAEERLTGYCTALEKAGISIKNSLVYRGDYTIKGGVRGLEELVRNNPDMTAVFVTNYEMTMGAMIGVNELGIQVPGQLSMIGFDNLPFARACRPKLTIVSQPTDGIAREVARIMLERLEKREAGSEEPFMEKLQTEIMEGKSVCVLSR

SEQ ID NO: 655 - protein, 971 aa, unidentified
  REGION 1..971: note = Description of Unknown:uncultivated organism sequence
  REGION 1..971: note = Category: MG55 effectors
  REGION 1..971: note = Description: MG55-230 effector
MTNYKIGIDVGSTTVKCVLISEDKKILYSEYKRHFSRVKEAVLEQLERMFENFEGNFKVAITGSAGLGLSSAADLLFVQEVYSASLAIKDMYPDADCAVELGGEDAKILFLTGGIEQRMNGTCAGGTGAFIDQMATLLKVSGDNLDGLALKAEKKYPIASRCGVFAKSDIQPLLNQGASLSDVAASIFQAVVDQTVAGLAQGRKIQGKVLFLGGPLHFYKALGKAFKDTLKLSDENAIFPEYATCFMAFGAALYADGNPEYFTKEEILRRIRDSKPNSSIVAFKPLFENEEEYKEFKERHSKMSVAKANINTYEGNAYLGIDAGSTTTKIVLLSEDKKILYSHYTENSGRPLDVVCTKLKEIYSIIGDRIKIKSSAVTGYGEELLRAGLKIDFGIVETVAHFNAAIYFNPDVDFIIDIGGQDIKCFKIKNKAIDNIMLNEACSSGCGSFIQTFANALGYSVEDFAKLGLFAKNPVELGSRCTVFMNSAVKQAQKDGATVEDISAGISSSVVKNAIYKVIRAKSAKELGQNVVVQGGTFLNDAVLRSFERELGINVIRPTIAGLMGAYGAALYAIRKSKDKSTIISKEELNNFSYTSKSVNCQRCTAHCLLDIINFSDGRKLISGNRCERGLGKKDSEILPDIYKFKYSYITEGIVNTNEKPLATVGLPLCLNFYEQMPFWNTVFNELGFRTVISDQSSRETFIRGQHTIPSDTVCYPAKLVHGHIFNLLDKNVDFIFYPCQSYNIDEGDSDNHYNCPVVAYYPELLKANMDVLTKDNFICPHMDLNNPANVADVVYHSLKKYNLKKSKVVKAIHNGYEAMKKYQDAIREEGARLVEIARERNLPIIVLAGRPYHIDPEINHGVQKLIATLGAVSISEDAVSYLAKPPKLGILNQWTYHSRLYRAAQYVTTQKDMHLVQLVSFGCGIDAITTDETRSIIENGGKIYTQLKIDEISNLGAIKIRLRSLLAAIE

SEQ ID NO: 656 - protein, 735 aa, unidentified
  REGION 1..735: note = Description of Unknown:uncultivated organism sequence
  REGION 1..735: note = Category: MG55 effectors
  REGION 1..735: note = Description: MG55-231 effector
MGDNMDKELLIMTNVIKRNGKEVKFDIYKIIHAMEKANKEVAPVYQMNEYQIQAAAETVAKKIQASSHAVNVEDIQDMVETAIMEMRAYEVAQKYVRYRYKREMARKANSTDEDILALIDQANEELKQENSNKNPVINSTQRDYMAGEVSKDLTKRLLLPEDIVKAHEEGVIHFHDSDYYAQKEHNCDLINLEDMLQNGTVISETMIEKPHSFFTACNVTTQIVAQVASNQYGGQSFTLSHLAPFVDISRQKIREAVIAERKETGESMDEDIIAKIVNRRLKEEIKSGIQTIQYQLITLMTCNGQAPFVTMFMYLDEVPEGKTREDLALIIEEVLHQRMQGVKNEKGVWITPAFPKLIYVLDEDNITEDAPYYHLTKLAAQCTAKRMVPDYISAKIMREYKGGDVYPCMGCRSFLTEDKEGLGENGAHKYYGRFNQGVVTINLVDVACSSQGNMDAFWQILEERLELCHKALRLRHERLLGTVSDVAPILWQHGALARLKKGEKIDKLLYNNYSTISLGYAGLYEMCVRMLGKSHTTEEGREFSLKVMEKLNDSCKKWREAENISYSVYGTPMESTTYKFAKALKKRFGTIPGVTDKNYITNSYHVHVSEKIDAFSKLAFEADFQKLSPGGAISYVEVPNMQNNIPAVLSLMHFIYENIMYAELNTKSDYCCACGYDGEIQIVEDSYGKLQWRCPNCGNENQEQLSVARRTCGYIGTQFWNQGRTQEIKDRVLHL

SEQ ID NO: 657 - protein, 1439 aa, unidentified
  REGION 1..1439: note = Description of Unknown:uncultivated organism sequence
  REGION 1..1439: note = Category: MG55 effectors
  REGION 1..1439: note = Description: MG55-232 effector
MIKTLHVGLDVGSTTVKIIVMDENLNTIYTDYKRHFSDTKNTICNVLENLIIMYPDTEFTIALTGSGAISAAKFLDLPFIQEVVSCKRAVEKYIPETDVVIELGGEDAKIIYFDKFIEQRMNGTCAGGTGAFIDQMASLLNTDPTGLNELAKSHKLIYPIASRCGVFAKTDIQPLLNEGAAKEDIAASIFQAVVNQTISGLACGRPIRGNVAFLGGPLNYLSELRNRFIETLNLKDNEIIVPNEAHLLVAKGAALDSLNSHTITIEKLKSKIEVLKSSHDDTSNPLNPLFSIDAEYDEFKKRHEKDKVKRADFKTFKGNCFLGIDAGSTTTKLVVISEDGTLLYSLYGSNEGNPLQSVINMLKKLYAEKPSEAIIRFSGVTGYGEKLIQTALNVDLNEIETIAHYTAAKEFMPNVTSIVDIGGQDMKYIKMKNGAIDNIMLNEACSSGCGSFIETFAKSLGLSIQDFVQSALEARRPVDLGSRCTVFMNSKIKQAQKEGYSVGDISAGLSYSVIKNAIQKVMKVRDVKKLGAHIVVQGGTFYNDAVLRAFELIVGRNVVRPDIAGLMGAYGVALLAKEQYENNLDMDYVSSISNINELDKLEINITHIRCQGCENHCLLTINKFSNGTKYISGNRCEKGAGIVDKTLDRPNLIKYKFERTFNYTPLEEKNAPRGTIGIPRVLNMYEDYPFWFTFLTNLGFRVILSEKSNRKTYEKGMESMPSESVCFPAKLSHGHIIGLINSGIKTIFYPCIPYSRKEYQKADNHYNCPIVISYSEVLKNNVEELKDKNIKFLNPFLPFEPDKLAEIIMNLPEFKEYNFTKKELLSAAKKAETEYQNYKSDIHNKGQETLKFMEENNLKGIVLAGRPYHVDPEVNHGIDTLITSLGLCVLTEDSISNLTEAKRPLRVVDQWVFHARLYAAADFVGKHDNLELVQLNSFGCGVDAVTTDQVEEILTSYEKMYTLIKIDEINNLGAIRIRIRSLLASMNKRIKDNNSSMCNGNYEVNKKIFTKEMRKDYTILMPQMAPIHFEFLESAMKNSGYKMELLRDCTQHTVETGLKYVNNDACYPSILVTGQMIEALESGKYDLNKTALIMSQTGGGCRATNYIGFIRKALKDAGFENVPVISFNVVGMEKMPGFKLTIPLIERLIKSCIYADLLQKMLTKNRAYEINKGKTKELFDYWMEKCKKLVNKSSIKEFKQSIFDIVSDFEKIEIDTSVIKPKVGIVGEVLIKYHPFGNNFVADKLEQEGAEVILPDFMGFIKFIATHKITFNKLIKTDAIKAKLFKTAIKLIDLLEKPVISALNNSKKGYLLPCNIWDLEEKVNDILSIGNQTGEGWFLTAEMIEYIEHDIPNIVCVQPFACLPNHVVGKGVIKTIRSKFPEANIAPIDYDPGASEANQTNRIKLMMTVAKDNLKNKNNINKAIKKENYIIDEKNKISN

SEQ ID NO: 658 - protein, 722 aa, unidentified
  REGION 1..722: note = Description of Unknown:uncultivated organism sequence
  REGION 1..722: note = Category: MG55 effectors
  REGION 1..722: note = Description: MG55-233 effector
MKIIKRNGAEVKFDVSKILNAIRKANREVSEDNRLTEEQIATIAKKVTELAGDLNRAVGVEEIQDFVENQIMDQKAYAVARKYITYRYSRALVRRANTTDERILTLIECNNEEVKQENSNKNPTVNSVQRDYMAGEVSRDLTRRLLLPREIVEAHDAGLIHFHDADYYAQHMHNCDLVNLEDMLQNGTVISGTFIEKPHSFSTACNIATQIIAQVASNQYGGQSISLTHLAPFVDVSRQKIRAEVREELADVGVMEDTVNRIAEKRLRAEIKKGIQTIQYQVVTLLTTNGQAPFVTVFMYLGEARNERERADLAMIIEETLNQRIEGVKNESGVWVTPAFPKLIYVLEEDNVREGSRYWYLTELAAKCTAKRMVPDYISEKKMLEFKVDKNGEGHCYTCMGCRSFLTPYVDETGKPKYYGRFNQGVVTINLPDVALSSGGDMEKFWQIFDERLELCHRALMERHNRLKGTLSDAAPILWQYGALARLKKGETIDKLLYGGYSTISLGYAGLYECVKYMTGKTHTDPSAKPFALSVMQHMNDKCKEWKKMHNIDFSLYGTPLESTTYKFAKALQKRFGIIEGVTDKNYITNSYHVHVTEHIDAFTKLKFESEFQQLSPGGAISYVEVPNMQDNIPAVLSVMQYIYENIMYAELNTKSDYCQVCGYDGEIQIVEDGGKLYWECPHCHNRDQSKMNVARRTCGYIGTQYWNQGRTQEIKDRVLHL

SEQ ID NO: 659 - protein, 1284 aa, unidentified
  REGION 1..1284: note = Description of Unknown:uncultivated organism sequence
  REGION 1..1284: note = Category: MG55 effectors
  REGION 1..1284: note = Description: MG55-234 effector
MKLDFNTLGIDIGSTTVKIAILNKDGEIIFSDYQRHYANIQETLAKIIDEAYEEFGDIPVSPMITGSGGLTLSKHMEIPFVQEVVAVATSLKDYAPRTDVAIELGGEDAKIIYFTGGIDQRMNGICAGGTGSFIDQMATLLKTDAAGLNEYAKNYKAIYPIAARCGVFAKTDIQPLINEGATKEDLSASIFQAVVNQTISGLACGKPIKGNVAFLGGPLHFLTELKQAFIRTLGLEGDAIIAPEHSHLFAASGAAMNAHADVQSSLGELKEKLSHKIELEFEVTRMEPLFASEKEYEDFTERHNKHNVRKGDFASYKGDLFLGIDAGSTTTKVAVIGDDGSLLYSFYSSNNGSPLKTALKAMKDIYSKMPEGARIVRSCSTGYGEALLKSALLLDEGEVETVAHYTAAAFFDPNVDCILDIGGQDMKCIKIKNNSVDKVQLNEACSSGCGSFIETFAKSLNYEVADFAKIALFAENPIDLGSRCTVFMNSKVKQAQKEGASVADISAGLAYSVIKNALLKVIKLTDPKDLGKQVVVQGGTFYNDAVLRSFERISGCEAIRPDIAGIMGAFGAALIAKDRYTGQKSTMLSFKEINELRFKTSMTRCQGCINHCLLTVNEFTGDRKFISGNRCEKGLGLEKNKEQIPNLFEYKNERVFRHYKPLKKADAPRGVVGIPRVLNMYENYPFWFTFFTKLGYSVKLSPVSSRKIYELGIESIPSESECYPAKLAHGHVTWLIRQGLEYIFYPCIPYERVEVPDAGNHYNCPIVTSYGENIKNNIEELRDDKIKYQNPFISLESEEILTKRLVDFFRKENGIPAAEIKAAAHEGWLEMQAVREDMTKKGKEVLQYLKETGRHGIVLAGRPYHSDPEINHGIPDLITSYGVAVLTEDSISELSEVDRPTIVMDQWMYHSRLYKAASFVAKNDNLDLIQLNSFGCGLDAVTTDQVNDILTKQNKIYTVLKIDEVNNLGAARIRIRSLLAAVKDRERKKIEAKRVDTAHHRVIFTEQMRKDYTILVPDMSPIHFEILESALASCGYNVEVLKADSKCIDYGLKYVNNDACYPSLIVVGQFMQALLSGKYDLHKVALIITQTGGGCRATNYIGFIRRALEKAGMGYIPVISMSAGIEKNPGLKVNLEMANKALQALIYGDVFMRVLYKTRPYEKVKGSANALHEKWKKIAIESVKKANKKQFKKNIQNIVKEFDELELVDIKKPKVGIVGEILVKFMPLANNFIVELLEEEGAEAVCPDLIDFFMYSLYNANFKAEYLGKKKSSAKINNFLIWFI

SEQ ID NO: 660 - protein, 978 aa, unidentified
  REGION 1..978: note = Description of Unknown:uncultivated organism sequence
  REGION 1..978: note = Category: MG55 effectors
  REGION 1..978: note = Description: MG55-235 effector
MSRSVGVDIGSTTAKVVVMENDQVLFRRYERHYSQVRQKTLEIIRQAEKEIGSEPFTIAISGSAGLGVAKAADIPFVQEGFATSELVRKKIPDADAVIELGGEDAKILFFDKSGTFEERMNGSCAGGTGAFIDQMATLLAVTPEELDRLSADHKFIYTIASRCGVFAKTDIQPLLNQGASKSDIAASIFQAVVDQTITGLAQGRKIQGKVLFLGGPLHFFTGLQERFVETLKLSEENAVFPEYGLYAVGMGAAIYAEEEGKTFTYDELVEKLENAKDEAVTTLRLQPLFRDEAEYEAFKARHAKATIETVPIENYTGKAFLGIDCGSTTTKLCLIDDNYNILYSYYDSNKGNPVKIVREQLLHILDLCGDRIQICGSAVTGYGEDLIKNAFNIDMGLVETMAHLRAASHFNPNVDFVLDIGGQDIKCFKIRNGVIDNIVLNEACSSGCGSFIETFAKSMGYDAASFAKEGLFAQHPVDLGSRCTVFMNSSVKQAQKEGATLQDISAGLSMSVTKNAIYKVIRAVSKEDLGTNIVVQGGTFLNDAILRSFELEIERDVIRPSISGLMGAYGAALYARELRLETSAMMNKEQLEQFQHTSKTISCGICNNHCNLTVNTFDGKRKFISGNRCEKPLGVKANKELPNMFQYKMEKIRALKGVDGGMGKIGIPMGLNMYENIAFWYAFLTRLGFEVVLSDPSTRALYRKGQDTIPSDTVCYPAKLMHGHIKNLIEKGCTRIFYPCLPYNFDEKVGDNHYNCPVVAYYPELLEANMDDLKTVKFYNGYFGIHRPKDFDKKAYEYFKDEFNFPHKLVKQAAKEAYAVYNSWMEDIRNEGARAIHYAREHGCKIIVLAGRPYHIDPEINHGLDKMLSSFNLVIVTEDSVAHLGHAGKVHVLNQWTYHSRLYNAAKYVTTQLDMELIQIVSFGCGIDAITTDEVRSILENGDKLYTQLKIDEINNLSAIRIRIRSLLAAIKAKEAQK

SEQ ID NO: 661 - protein, 731 aa, unidentified
  REGION 1..731: note = Description of Unknown:uncultivated organism sequence
  REGION 1..731: note = Category: MG55 effectors
  REGION 1..731: note = Description: MG55-236 effector
MKVVKRDGHIVDFDRSKIVTAIRKANAEVDPEEKISDDKIETIVHGIETKKRKRILVEDIQDIIEQDLMEDGKYVLAKTYIIYRYTRELVRKANTTDDSILSLIKNRNKDVMEENSNKNATVASTQRDLIAGEVSKDLTRRVLLPEKISKAHDEGVLHFHDADYFLQPIFNCCLINIKDMLENGTVMNGKLIESPKSFQVACTVMTQIIASVASSQYGGQSVDLIHLGKYLRKSYEKYKERFTKDFGDKVDADTLEAMIQERLNDELRSGVQTIQYQINTLMTTNGQSPFVTLFLHLDPEDEYVEENARIIIEILRQRYEGIKNEAGVYVTPAFPKLIYVLDEFNCLKGGKYDYITEMAVKCSAKRMYPDYISAKKMRENYEGNVFSPMGCRSFLAPWKDENGQYKFEGRFNQGVVSLNLPQIGIIARGDEELFWKILDERLELCYEALMCRHNALMGVTSDVSPIHWQYGAIARLGKGERIDKYLLNGYSSISLGYIGLYEVTKLMKGVSHTTPEGQEFALRIMHKLRNACDTWKKETGLGFALYGTPAESLCYRFARIDKERFGTIPDITDKGYYTNSYHVDVREDIDAFEKFTFESQFQSISSGGAISYVEIPNMANNLEALTELVKFLYDNIQYAEFNTKSDYCHVCGFDGEIKVNENNEWECPVCHNKDHSKMNVTRRTCGYLGENFWNVGKTKEIKSRVLHVGTPDYIAETVTASASKIFPEKKF

SEQ ID NO: 662 - protein, 708 aa, unidentified
  REGION 1..708: note = Description of Unknown:uncultivated organism sequence
  REGION 1..708: note = Category: MG55 effectors
  REGION 1..708: note = Description: MG55-237 effector
MKVIKRDGHTVTYDRSKIITAIKKANAEVEPCEKVTDEKIEEIVQGIESKNRPRMLVEDIQDIIEQKLMADGKFVLAKTYIIYRYTRELVRKANTTDDSILSLIKNRNKDVMEENSNKNATVASTQRDLIAGEVSKDLTRRVLLPEKISKAHDEGVLHFHDADYFLQPIFNCCLINIGDMLDNGTVMNGKLIESPKSFQVACTVMTQIISSVASSQYGGQSVDIRHLGKYLRKSYNKYKNKLVEEFGDKIDDAILEQMAQDRLQDELRSGVQTIQYQINTLMTTNGQSPFVTLFLNLDPNDEYIEENAIIVEEILRQRLEGIKNEKGVYVTPAFPKLIYVLDEHNCLKGGKYDYITKLAVKCSAKRLYPDYISAKKMRENYEGNVFSCMGCRSFLSPWKDENGNYKWEGRFNQGVVSLNLPQIGILAKGNEEKFWSMLDERLDLCYEALMCRHNALLGVTSDVSPVHWQYGAIARLKKGEKIDPLLKDGYSTISLGYIGLYEVTKLMTGKSHTEPEGEEFALRVMNRLRKACDTWKEETGLGFGLYGTPAESLCYRFARIDQERFGTIEDVTDKGYYTNSYHVDVREKIDAFSKFRFESQFQTISSGGAISYVEIPNMRHNLEALEEIVRFIYDNIQYAEFNTKSDYCHVCDYDGEIMINDDNEWECPQCGNKDHSKMNVTRRTCGYLGENFWNVGKTKEIKARVLHL

SEQ ID NO: 663 - protein, 1439 aa, unidentified
  REGION 1..1439: note = Description of Unknown:uncultivated organism sequence
  REGION 1..1439: note = Category: MG55 effectors
  REGION 1..1439: note = Description: MG55-238 effector
MIKTLHVGLDVGSTTVKIIVMDENLNTIYTDYKRHFSDTKNTICNVLENLIIMYPNTEFTIALTGSGAISAAKFLDLPFIQEVVSCKRAVEKYIPETDVVIELGGEDAKIIYFDKFIEQRMNGTCAGGTGAFIDQMASLLNTDPTGLNELAKSHKLIYPIASRCGVFAKTDIQPLLNEGAAKEDIAASIFQAVVNQTISGLACGRPIRGNVAFLGGPLNYLSELRNRFIETLNLKDNEIIVPNEAHLLVAKGAALDSLNSHTITIEKLKSKIEVLKSSHDDTSNPLNPLFSIDAEYDEFKKRHEKDKVKRADFKTFKGNCFLGIDAGSTTTKLVVISEDGTLLYSLYGSNEGNPLQSVINMLKKLYAEKPSEAVIRFSGVTGYGEKLIQTALNVDLNEIETIAHYTAAKEFMPNVTSIVDIGGQDMKYIKMKNGAIDNIMLNEACSSGCGSFIETFAKSLGLSIQDFVQSALEARRPVDLGSRCTVFMNSKIKQAQKEGYSVGDISAGLSYSVIKNAIQKVMKVRDVKKLGAHIVVQGGTFYNDAVLRAFELIVGRNVVRPDIAGLMGAYGVALLAKEQYENNLDMDYVSSISNINELDKLEINITHIRCQGCENHCLLTINKFSNGTKYISGNRCEKGAGIVDKTLDRPNLIKYKFERTFNYTPLEEKNAPRGTIGIPRVLNMYEDYPFWFTFLTNLGFRVILSEKSNRKTYEKGMESMPSESVCFPAKLSHGHIIGLINSGIKTIFYPCIPYSRKEYQKADNHYNCPIVISYSEVLKNNVEELKDKNIKFLNPFLPFEPDKLAEIIMNLPEFKEYNFTKKELLSAAKKAETEYQNYKSDIHNKGQETLKFMEENNLKGIVLAGRPYHVDPEVNHGIDTLITSLGLCVLTEDSISNLTEAKRPLRVVDQWVFHARLYAAADFVGKHDNLELVQLNSFGCGVDAVTTDQVEEILTSYEKMYTLIKIDEINNLGAIRIRIRSLLASMNKRIKDNNSSMCNGNYEVNKKIFTKEMRKDYTILMPQMAPIHFEFLESAMKNSGYKMELLRDCTQHTVETGLKYVNNDACYPSILVTGQMIEALESGKYDLNKTALIMSQTGGGCRATNYIGFIRKALKDAGFENVPVISFNVVGMEKMPGFKLTIPLIERLIKSCIYADLLQKMLTKNRAYEINKGKTKELFDYWMEKCKKLVNKSSIKEFKQSIFDIVSDFEKIEIDTSVIKPKVGIVGEVLIKYHPFGNNFVADKLEQEGAEVILPDFMGFIKFIATHKITFNKLIKTDAIKAKLFKTAIKLIDLLEKPVISALNNSKKGYLLPCNIWDLEEKVNDILSIGNQTGEGWFLTAEMIEYIEHDIPNIVCVQPFACLPNHVVGKGVIKTIRSKFPEANIAPIDYDPGASEANQTNRIKLMMTVAKDNLKNKNNINKAIKKENYIIDEKNKISN

SEQ ID NO: 664 - protein, 1439 aa, unidentified
  REGION 1..1439: note = Description of Unknown:uncultivated organism sequence
  REGION 1..1439: note = Category: MG55 effectors
  REGION 1..1439: note = Description: MG55-239 effector
MIKTLHVGLDVGSTTVKIIVMDENLNTIYTDYKRHFSDTKNTICNVLENLIIMYPNTEFTIALTGSGAISAAKFLDLPFIQEVVSCKRAVEKYIPETDVVIELGGEDAKIIYFDKFIEQRMNGTCAGGTGAFIDQMASLLNTDPTGLNELAKSHKLIYPIASRCGVFAKTDIQPLLNEGAAKEDIAASIFQAVVNQTISGLACGRPIRGNVAFLGGPLNYLSELRNRFIETLNLKDNEIIVPNEAHLLVAKGAALDSLNSHTITIEKLKSKIEVLKSSHDDTSNPLNPLFSIDAEYDEFKKRHEKDKVKRADFKTFKGNCFLGIDAGSTTTKLVVISEDGTLLYSLYGSNEGNPLQSVINMLKKLYAEKPSEAVIRFSGVTGYGEKLIQTALNVDLNEIETIAHYTAAKEFMPNVTSIVDIGGQDMKYIKMKNGAIDNIMLNEACSSGCGSFIETFAKSLGLSIQDFVQSALEARRPVDLGSRCTVFMNSKIKQAQKEGYSVGDISAGLSYSVIKNAIQKVMKVRDVKKLGAHIVVQGGTFYNDAVLRAFELIVGRNVVRPDIAGLMGAYGVALLAKEQYENNLDMDYVSSISNINELDKLEINITHIRCQGCENHCLLTINKFSNGAKYISGNRCEKGAGIVDKTLDRPNLIKYKFERTFNYTPLEEKNAPRGTIGIPRVLNMYEDYPFWFTFLTNLGFRVILSEKSNRKTYEKGMESMPSESVCFPAKLSHGHIIGLINSGIKTIFYPCIPYSRKEYQKADNHYNCPIVISYSEVLKNNVEELKDKNIKFLNPFLPFEPDKLAEIIMNLPEFKEYNFTKKELLSAAKKAETEYQNYKSDIHNKGQETLKFMEENNLKGIVLAGRPYHVDPEVNHGIDTLITSLGLCVLTEDSISNLTEAKRPLRVVDQWVFHARLYAAADFVGKHDNLELVQLNSFGCGVDAVTTDQVEEILTSYEKMYTLIKIDEINNLGAIRIRIRSLLASMNKRIKDNNSSMCNGNYEVNKKIFTKEMRKDYTILMPQMAPIHFEFLESAMKNSGYKMELLKDCTQHTVETGLKYVNNDACYPSILVTGQMIEALESGKYDLNKTALIMSQTGGGCRATNYIGFIRKALKDAGFENVPVISFNVVGMEKMPGFKLTIPLIERLIKSCIYADLLQKMLTKNRAYEINKGKTKELFDYWMEKCKKLVNKSSIKEFKQSIFDIVSDFEKIEIDTSVIKPKVGIVGEVLIKYHPFGNNFVADKLEQEGAEVILPDFMGFIKFIATHKITFNKLIKTDAIKAKLFKTAIKLIDLLEKPVISALNNSKKGYLLPCNIWDLEGKVNDILSIGNQTGEGWFLTAEMIEYIEHDIPNIVCVQPFACLPNHVVGKGVIKTIRSKFPEANIAPIDYDPGASEANQTNRIKLMMTVAKDNLKNKNNINKAIKKENYIIDEKNKISN

SEQ ID NO: 665 - protein, 1439 aa, unidentified
  REGION 1..1439: note = Description of Unknown:uncultivated organism sequence
  REGION 1..1439: note = Category: MG55 effectors
  REGION 1..1439: note = Description: MG55-240 effector
MIKTLHVGLDVGSTTVKIIVMDENLNTIYTDYKRHFSDTKNTICNVLENLIIMYPDTEFTIALTGSGAISAAKFLDLPFIQEVVSCKRAVEKYIPETDVVIELGGEDAKIIYFDKFIEQRMNGTCAGGTGAFIDQMASLLNTDPTGLNELAKSHKLIYPIASRCGVFAKTDIQPLLNEGAAKEDIAASIFQAVVNQTISGLACGRPIRGNVAFLGGPLNYLSELRNRFIETLNLKDNEIIVPNEAHLLVAKGAALDSLNSHTITIEKLKSKIEVLKSSHDDTSNPLNPLFSIDAEYDEFKKRHEKDKVKRADFKTFKGNCFLGIDAGSTTTKLVVISEDGTLLYSLYGSNEGNPLQSVINMLKKLYAEKPSEAIIRFSGVTGYGEKLIQTALNVDLNEIETIAHYTAAKEFMPNVTSIVDIGGQDMKYIKMKNGAIDNIMLNEACSSGCGSFIETFAKSLGLSIQDFVQSALEARRPVDLGSRCTVFMNSKIKQAQKEGYSVGDISAGLSYSVIKNAIQKVMKVRDVKKLGAHIVVQGGTFYNDAVLRAFELIVGRNVVRPDIAGLMGAYGVALLAKEQYENNLDMDYVSSISNINELDKLEINITHIRCQGCENHCLLTINKFSNGTKYISGNRCEKGAGIVDKTLDRPNLIKYKFERTFNYTPLEEKNAPRGTIGIPRVLNMYEDYPFWFTFLTNLGFRVILSEKSNRKTYEKGMESMPSESVCFPAKLSHGHIIGLINSGIKTIFYPCIPYSRKEYQKADNHYNCPIVISYSEVLKNNVEELKDKNIKFLNPFLPFEPDKLAEIIMNLPEFKEYNFTKKELLSAAKKAETEYQNYKSDIHNKGQETLKFMEENNLKGIVLAGRPYHVDPEVNHGIDTLITSLGLCVLTEDSISNLTEAKRPLRVVDQWVFHARLYAAADFVGKHDNLELVQLNSFGCGVDAVTTDQVEEILTSYEKMYTLIKIDEINNLGAIRIRIRSLLASMNKRIKDNNSSMCNGNYEVNKKIFTKEMRKDYTILMPQMAPIHFEFLESAMKNSGYKMELLKDCTQHTVETGLKYVNNDACYPSILVTGQMIEALESGKYDLNKTALIMSQTGGGCRATNYIGFIRKALKDAGFENVPVISFNVVGMEKMPGFKLTIPLIERLIKSCIYADLLQKMLTKNRAYEINKGKTKELFNYWMEKCKKLVNKSSIKEFKQSIFDIVSDFEKIEIDTSVIKPKVGIVGEVLIKYHPFGNNFVADKLEQEGAEVILPDFMGFIKFIATHKITFNKLIKTDAIKAKLFKTAIKLIDLLEKPVISALNNSKKGYLLPCNIWDLEEKVNDILSIGNQTGEGWFLTAEMIEYIEHDIPNIVCVQPFACLPNHVVGKGVIKTIRSKFPEANIAPIDYDPGASEANQTNRIKLMMTVAKDNLKNKNNINKAIKKENYIIDEKNKISN

SEQ ID NO: 666 - protein, 354 aa, unidentified
  REGION 1..354: note = Description of Unknown:uncultivated organism sequence
  REGION 1..354: note = Category: MG55 effectors
  REGION 1..354: note = Description: MG55-241 effector
MRSKVEKLREEKGRLDQLEQRDWLTGQYNRVATERLVNRLIEERGCGVMLVLDVDHLRKINGRHGHIVGDHVLRAVAGVLDSMVFRHDVVGRIDGDMFVVFMPVDQEERFLQERCRQIRERLKEIRLPGDLSLSVSLNAGGAVWRSGDDYNSMFERAKEQLSSEKPIGPARERSAGSGARKGNFMVDLRQVRGELAEQTMIPGAYCQDYETFKNIYRFVERRLRRAKISSYILLLTLTDGNGDFPPLEKRERQMATLRELIQNSLRSGDVFTQYSSCQYLVMVADASAENVEMIASRIREAFYRIIDNGTGQVLLHHCYPMWPAGRPARDPGAGRDEDGVDPGNALGNVSGEFK

SEQ ID NO: 667 - protein, 967 aa, unidentified
  REGION 1..967: note = Description of Unknown:uncultivated organism sequence
  REGION 1..967: note = Category: MG55 effectors
  REGION 1..967: note = Description: MG55-242 effector
MRLGLDIGSTTIKCVVLDDNDKLLYSTYERHYSQITTKIGEILTRVRKEIDGVENALVAMSGSAGMGVADQCDITFVQEVYATRVATNTFIPGTDVVIELGGEDAKILFLSGGMEVRMNGTCAGGTGAFIDQMATLLNVPLEEMNDLAKGYEKTYTIASRCGVFAKTDIQPLLNQGARKADIAQSIFHAVVNQTVAGLAQGREIEGNVVYLGGPLTFMEELRKAFDEELGTKGTCPENSLYYVACGAALCAESTINFDEIIEKVSHYTGSGNFAFNPPLFKNEEEYEQFKARHAKATVKEVPLEDYDGDCYIGMDAGSTTVKAVVMGKNGELLYSKYLSNSGNPVPIIKDFLNELYDKKPNIKIKSSAVTGYGEDIIKNAFCVDYGIVETVAHFTAAKSFMPDVEFVIDIGGQDIKCFKVHNGAIDNIFLNEACSSGCGSFLQTFANALGYSIQDFAQLGIFGKHPVDLGSRCTVFMNSSVKQAQKDGATIEDISSGLSLSVVKNALYKVIRASGPDELGKKIVVQGGTFLNDAVLRAFEQEMGVNVVRPTISGLMGAYGAAMYAQSKSEGSAEGSTLLKKPDLENFVHEIKVVNCGMCNNNCRLTVNTFADGRKFIAGNRCERPITKKSPDESLNMYEYKLKVLREYKPVKGSRGKIGIPMGLNMFELLPFWHRFFTELGFEVIRSPFSTRKLYQKGQQTIPSDTVCFPAKLMHGHVKALIDMGVDTIFYPCMSYNIDEHLGDNHYNCPVVAYYPEVIYNNMKEVHNVTFIKDYFGIHRPKDFYKKAYEDLSKYFPDLTQKEVKNAAKCAYEEYDNYFAKIRQHGNEIIEKAEKEGKDIIVLSGRPYHIDPEINHGISKMIASFGVAIVSEDCVSDRVEKFKVGVLNQWTYHSRLYAAAKYVSTRKDMNLVQLVSFGCGVDAITTDEVRDILEKNGKIYTQIKIDEITNLGAVKIRIRSLLAAIGK

SEQ ID NO: 668 - protein, 983 aa, unidentified
  REGION 1..983: note = Description of Unknown:uncultivated organism sequence
  REGION 1..983: note = Category: MG55 effectors
  REGION 1..983: note = Description: MG55-243 effector
MLAMNESQEKYTLGIDVGSTTVKAVLLNSKGEVLYVSYKRHFSKVRETSESEVKKIREKFGNLEVKFAFTGSAGLGLSERSHLPFVQEVQSSYVAIKRLYPMTDSAIELGGEDAKIIFITGGLEERMNGQCAGGTGAFIDQMATLLNVTVPGLEELATQSKKTYPIASRCGVFAKSDIQALLNQGASKEDVAMSIFYAVADQTIAGLAQGRRIQGHVLFLGGPLHFLNSLGKAFKDRLKLTDEEAIFPEDSDTFVAKGAAIYAEGFKETISLDEIADHLEQANMKGTITTGKPLFNNQEEYDSFVASHQDFDIKRADLRTYEGKAYLGIDAGSTTTKIVLLSENNEILYDHYESNLGLPIDRIVEQLKTIYSLANPKLDIVGSAVTGYGEDLIRAALHVDYGMVETVAHFKAARFYEPDVNFVIDIGGQDIKCFNVKNGAIDSIMLNEACSSGCGSFLQTFAQSLGYGVEEFAQTAYFAKNPVLLGSRCTVFMNSSVKQAQREGAPVDDIAAGLCRSVVKNALYKVIRVRDAKELGEKIVCQGGTFLNNAVLRSFEQEIGHQVIRPSIAGLMGAFGAALTAKEKGGERGLISPKDLDNFGYTSTHSTCHMCGARCPLTLLKFPNGQIFLSGNKCDKPEGRRRSSDALDLYVYKRNRIKELLPSPASPKGVVGLPMSLVMWEQLPFWDAFFKHLGFDTLVSPFSTRKMYREGQKTIPSDTACYPAKLMHGHVDYLLQQNPTFIFYPSESYNVNEKRGDNHFNCPVVAYYGELIKKNDERFPTATFLDPFVDLSAPKKAIATLTDCLSSYGVKKKEVKNAFEFAYQAELKYRADLKQKAKQIIAEAREKKMITVVLAGRPYHVDPEVSHGIERLLDSLGVAVVSEDALDYSEQPQSKVHVLNQWTFHARLYDAANYVAKHEDMELVQLISFGCGVDAVTSDEVRRILESQHKLYTGIKIDEINNLGAVRIRLRSLLAAVEEKKHV

SEQ ID NO: 669 - protein, 720 aa, unidentified
  REGION 1..720: note = Description of Unknown:uncultivated organism sequence
  REGION 1..720: note = Category: MG55 effectors
  REGION 1..720: note = Description: MG55-244 effector
MKIIKRSGSEDTFDARKITAAVTKANYEVPTKERLSKEQIKSITADVENICLDMNRALSVEEIQDLVEEQIMDRRAFAVARKYITYRYNRALLRKANSTDKQILSLLECNNEMVKQENSNKNPTVNSVQRDYMAGEVSKDITKRFLLPSEIVRAHEQGIIHFHDSDYFAQHMHNCCLVNLEDMLQNGTVISETMIEKPKSFSTACNIATQSIAQIASSQYGGQSISLTHLAPFVDISRQKYKKQVENELKEAGLSYNSKQVDEIAEIRVRDEIKRGVQMIQYQVITLMTTNGQAPFVSVFMYLDEAPEGRLREDLALIMEEILRQRMQGVKNEKGVYITPAFPKLLYVLEEDNVREGSKYWYLTQLAAKCTAKRMVPDYISEKIMKKMKDGNCYPCMGCRSFLTVYHDEKDRPKFYGRFNQGVVTINLVDVACSSDGDEETFWKILDKRLELCKKALMYRHNRLKGTPSDVAPILWQYGALARLKKGEVIDKLLYNGYSTISLGYAGLCECTRYMTGKSHTDPSATPFALKVMEKLNDACSRWREEENIDFSLYGTPLESTTYKFAKCLQKRFGIIKGVTDKNYITNSYHVHVTEEINAFDKLKFEAQFQNLSPGGAVSYVEVPNMENNIDAVLQVMQFIYDNIMYAELNTKSDYCQVCDYSGQIEIVNDEHGKLIWKCPNCGNTDQDKMNVARRTCGYIGTQFWNQGRTQEIKERVLHL

SEQ ID NO: 670 - protein, 1439 aa, unidentified
  REGION 1..1439: note = Description of Unknown:uncultivated organism sequence
  REGION 1..1439: note = Category: MG55 effectors
  REGION 1..1439: note = Description: MG55-245 effector
MIKTLHVGLDVGSTTVKIIVMDENLNTIYTDYKRHFSDTQNTICNVLENLIIMYPDTEFTIALTGSGAISAAKFLDLPFIQEVVSCKRAVEKYIPETDVVIELGGEDAKIIYFDKFIEQRMNGTCAGGTGAFIDQMASLLNTDPTGLNELAKSHKLIYPIASRCGVFAKTDIQPLLNEGAAKEDIAASIFQAVVNQTISGLACGRPIRGNVAFLGGPLNYLSELRNRFIETLNLKDNEIIVPNEAHLLVAKGAALDSLNSHTITIEKLKSKIEVLKSSHDDTSNPLNPLFSIDAEYDEFKKRHEKDKVKRADFKTFKGNCFLGIDAGSTTTKLVVISEDGTLLYSLYGSNEGNPLQSVINMLKKLYAEKPSEAVIRFSGVTGYGEKLIQTALNVDLNEIETIAHYTAAKEFMPNVTSIVDIGGQDMKYIKMKNGAIDNIMLNEACSSGCGSFIETFAKSLGLSIQDFVQSALEARRPVDLGSRCTVFMNSKIKQAQKEGYSVGDISAGLSYSVIKNAIQKVMKVRDVKKLGAHIVVQGGTFYNDAVLRAFELIVGRNVVRPDIAGLMGAYGVALLAKEQYKNNLDMDYVSSISNINELDKLEINITHIRCQGCENHCLLTINKFSNGAKYISGNRCEKGAGIVDKTLDRPNLIKYKFERTFNYTPLEEKNAPRGTIGIPRVLNMYEDYPFWFTFLTNLGFRVILSEKSNRKTYEKGMESMPSESVCFPAKLSHGHIIGLINSGIKTIFYPCIPYSRKEYQKADNHYNCPIVISYSEVLKNNVEELKDKNIKFLNPFLPFEPDKLAEIIMNLPEFKEYNFTKKELLSAAKKAETEYQNYKSDIHNKGQETLKFMEENNLKGIVLAGRPYHVDPEVNHGIDTLITSLGLCVLTEDSISNLTEAKRPLRVVDQWVFHARLYAAADFVGKHDNLELVQLNSFGCGVDAVTTDQVEEILTSYEKMYTLIKIDEINNLGAIRIRIRSLLASMNKRIKDNNSSMCNGNYEVNKKIFTKEMRKDYTILMPQMAPIHFEFLESAMKNSGYKMELLKDCTQHTVETGLKYVNNDACYPSILVTGQMIEALESGKYDLNKTALIMSQTGGGCRATNYIGFIRKALKDAGFENVPVISFNVVGMEKMPGFKLTIPLIERLIKSCIYADLLQKMLTKNRAYEINKGKTKELFDYWMEKCKKLVNKSSIKEFKQSIFDIVSDFEKIEIDTSVIKPKVGIVGEVLIKYHPFGNNFVADKLEQEGAEVILPDFMGFIKFIATHKITFNKLIKTDAIKAKLFKTAIKLIDLLEKPVISALNNSKKGYLLPCNIWDLEGKVNDILSIGNQTGEGWFLTAEMIEYIEHDIPNIVCVQPFACLPNHVVGKGVIKTIRSKFPEANIAPIDYDPGASEANQTNRIKLMMTVAKDNLKNKNNINKAIKKENYIIDEKNKISN

SEQ ID NO: 671 - protein, 1439 aa, unidentified
  REGION 1..1439: note = Description of Unknown:uncultivated organism sequence
  REGION 1..1439: note = Category: MG55 effectors
  REGION 1..1439: note = Description: MG55-246 effector
MIKTLHVGLDVGSTTVKIIVMDENLNTIYTDYKRHFSDTKNTICNVLENLIIMYPNTEFTIALTGSGAISAAKFLDLPFIQEVVSCKRAVEKYIPETDVVIELGGEDAKIIYFDKFIEQRMNGTCAGGTGAFIDQMASLLNTDPTGLNELAKSHKLIYPIASRCGVFAKTDIQPLLNEGAAKEDIAASIFQAVVNQTISGLACGRPIRGNVAFLGGPLNYLSELRNRFIETLNLKDNEIIVPNEAHLLVAKGAALDSLNSHTITIEKLKSKIEVLKSSHDDTSNPLNPLFSIDAEYDEFKKRHEKDKVKRADFKTFKGNCFLGIDAGSTTTKLVVISEDGTLLYSLYGSNEGNPLQSVINMLKKLYAEKPSEAVIRFSGVTGYGEKLIQTALNVDLNEIETIAHYTAAKEFMPNVTSIVDIGGQDMKYIKMKNGAIDNIMLNEACSSGCGSFIETFAKSLGLSIQDFVQSALEARRPVDLGSRCTVFMNSKIKQAQKEGYSVGDISAGLSYSVIKNAIQKVMKVRDVKKLGAHIVVQGGTFYNDAVLRAFELIVGRNVVRPDIAGLMGAYGVALLAKEQYENNLDMDYVSSISNINELDKLEINITHIRCQGCENHCLLTINKFSNGTKYISGNRCEKGAGIVDKTLDRPNLIKYKFERTFNYTPLEEKNAPRGTIGIPRVLNMYEDYPFWFTFLTNLGFRVILSEKSNRKTYEKGMESMPSESVCFPAKLSHGHIIGLINSGIKTIFYPCIPYSRKEYQKADNHYNCPIVISYSEVLKNNVEELKDKNIKFLNPFLPFEPDKLAEIIMNLPEFKEYNFTKKELLSAAKKAETEYQNYKSDIHNKGQETLKFMEENNLKGIVLAGRPYHVDPEVNHGIDTLITSLGLCVLTEDSISNLTEAKRPLRVVDQWVFHARLYAAADFVGKHDNLELVQLNSFGCGVDAVTTDQVEEILTSYEKMYTLIKIDEINNLGAIRIRIRSLLASMNKRIKDNNSSMCNGNYEVNKKIFTKEMRKDYTILMPQMAPIHFEFLESAMKNSGYKMELLRDCTQHTVETGLKYVNNDACYPSILVTGQMIEALESGKYDLNKTALIMSQTGGGCRATNYIGFIRKALKDAGFENVPVISFNVVGMEKMPGFKLTIPLIERLIKSCIYADLLQKMLTKNRAYEINKGKTKELFDYWMEKCKKLVNKSSIKEFKQSIFDIVSDFEKIEIDTSVIKPKVGIVGEVLIKYHPFGNNFVADKLEQEGAEVILPDFMGFIKFIATHKITFNKLIKTDAIKAKLFKTAIKLIDLLEKPVISALNNSKKGYLLPCNIWNLEEKVNDILSIGNQTGEGWFLTAEMIEYIEHDIPNIVCVQPFACLPNHVVGKGVIKTIRSKFPEANIAPIDYDPGASEANQTNRIKLMMTVAKDNLKNKNNINKAIKKENYIIDEKNKISN

SEQ ID NO: 672 - protein, 1416 aa, unidentified
  REGION 1..1416: note = Description of Unknown:uncultivated organism sequence
  REGION 1..1416: note = Category: MG55 effectors
  REGION 1..1416: note = Description: MG55-247 effector
MKLDFNTLGIDIGSTTVKIAILNKDGEIIFSDYQRHYANIQETLAKIIDEAYEEFGDIPVSPMITGSGGLTLSKHMEIPFVQEVVAVATSLKDYAPRTDVAIELGGEDAKIIYFTGGIDQRMNGICAGGTGSFIDQMATLLKTDAAGLNEYAKNYKAIYPIAARCGVFAKTDIQPLINEGATKEDLSASIFQAVVNQTISGLACGKPIKGNVAFLGGPLHFLTELKQAFIRTLGLEGDAIIAPEHSHLFAASGAAMNAHADVQSSLGELKEKLSHKIELEFEVTRMEPLFASEKEYEDFTERHNKHNVRKGDFASYKGDLFLGIDAGSTTTKVAVIGDDGSLLYSFYSSNNGSPLKTALKAMKDIYSKMPEGARIVRSCSTGYGEALLKSALLLDEGEVETVAHYTAAAFFDPNVDCILDIGGQDMKCIKIKNNSVDKVQLNEACSSGCGSFIETFAKSLNYEVADFAKIALFAENPIDLGSRCTVFMNSKVKQAQKEGASVADISAGLAYSVIKNALLKVIKLTDPKDLGKQVVVQGGTFYNDAVLRSFERISGCEAIRPDIAGIMGAFGAALIAKDRYTGQKSTMLSFKEINELRFKTSMTRCQGCINHCLLTVNEFTGNRKFISGNRCEKGLGLEKNKEQIPNLFEYKNERVFRHYKPLKKADATRGVVGIPRVLNMYENYPFWFTFFTKLGYSVKLSPVSSRKIYELGIESIPSESECYPAKLAHGHVTWLIRQGLEYIFYPCIPYERVEVPDAGNHYNCPIVTSYGENIKNNIEELRDDKIKYQNPFISLESEEILTKRLVDFFRKENGIPAAEIKAAAHEGWLEMQAVREDMNKKGKEVLQYLKETGRHGIVLAGRPYHSDPEINHGIPDLITSYGVAVLTEDSISELSEVDRPTIVMDQWMYHSRLYKAASFVAKNDNLDLIQLNSFGCGLDAVTTDQVSDILTKQNKIYTVLKIDEVNNLGAARIRIRSLLAAVKDRERKKIEAKRVDTAHHRVIFTEQMRKDYTILVPDMSPIHFEILESALASCGYNVEVLKADSKCIDYGLKYVNNDACYPSLIVVGQFMQALLSGKYDLHKVALIITQTGGGCRATNYIGFIRRALEKAGMGYIPVISMSAGIEKNPGLKVNLEMANKALQALIYGDVFMRVLYKTRPYEKVKGSANALHEKWKKIAIESVKKANKKQFKKNIQNIVKEFDELELVDIKKPKVGIVGEILVKFMPLANNFIVELLEEEGAEAVCPDLIDFFMYSLYNANFKAEYLGKKKSSAKINNFLIWFIERYRKCANDALAASKRFHPTVPIQKLAEYASPIVSCGNQTGEGWFLTGEMIELIKSGVPNIVCTQPFGCLPNHVVGKGVIKELRHQYPDSNIVAVDYDPGASEVNQLNRIKLMLSTAGKNLIAESKDNEETA

SEQ ID NO: 673 - protein, 1439 aa, unidentified
  REGION 1..1439: note = Description of Unknown:uncultivated organism sequence
  REGION 1..1439: note = Category: MG55 effectors
  REGION 1..1439: note = Description: MG55-248 effector
MIKTLHVGLDVGSTTVKIIVMDENLNTIYTDYKRHFSDTKNTICNVLENLIIMYPNTEFTIALTGSGAISAAKFLDLPFIQEVVSCKRAVEKYIPETDVVIELGGEDAKIIYFDKFIEQRMNGTCAGGTGAFIDQMASLLNTDPTGLNELAKSHKLIYPIASRCGVFAKTDIQPLLNEGAAKEDIAASIFQAVVNQTISGLACGRPIRGNVAFLGGPLNYLSELRNRFIETLNLKDNEIIVPNEAHLLVAKGAALDSLNSHTITIEKLKSKIEVLKSSHDDTSNPLNPLFSIDAEYDEFKKRHEKDKVKRADFKTFKGNCFLGIDAGSTTTKLVVISEDGTLLYSLYGSNEGNPLQSVINMLKKLYAEKPSEAVIRFSGVTGYGEKLIQTALNVDLNEIETIAHYTAAKEFMPNVTSIVDIGGQDMKYIKMKNGAIDNIMLNEACSSGCGSFIETFAKSLGLSIQDFVQSALEARRPVDLGSRCTVFMNSKIKQAQKEGYSVGDISAGLSYSVIKNAIQKVMKVRDVKKLGAHIVVQGGTFYNDAVLRAFELIVGRNVVRPDIAGLMGAYGVALLAKEQYENNLDMDYVSSISNINELDKLEINITHIRCQGCENHCLLTINKFSNGAKYISGNRCEKGAGIVDKTLDRPNLIKYKFERTFNYTPLEEKNAPRGTIGIPRVLNMYEDYPFWFTFLTNLGFRVILSEKSNRKTYEKGMESMPSESVCFPAKLSHGHIIGLINSGIKTIFYPCIPYSRKEYQKADNHYNCPIVISYSEVLKNNVEELKDKNIKFLNPFLPFEPDKLAEIIMNLPEFKEYNFTKKELLSAAKKAETEYQNYKSDIHNKGQETLKFMEENNLKGIVLAGRPYHVDPEVNHGIDTLITSLGLCVLTEDSISNLTEAKRPLRVVDQWVFHARLYAAADFVGKHDNLELVQLNSFGCGVDAVTTDQVEEILTSYEKMYTLIKIDEINNLGAIRIRIRSLLASMNKRIKDNNSSMCNGNYEVNKKIFTKEMRKDYTILMPQMAPIHFEFLESAMKNSGYKMELLRDCTQHTVETGLKYVNNDACYPSILVTGQMIEALESGKYDLNKTALIMSQTGGGCRATNYIGFIRKALKDAGFENVPVISFNVVGMEKMPGFKLTIPLIERLIKSCIYADLLQKMLTKNRAYEINKGKTKELFDYWMEKCKKLVNKSSIKEFKQSIFDIVSDFEKIEIDTSVIKPKVGIVGEVLIKYHPFGNNFVADKLEQEGAEVILPDFMGFIKFIATHKITFNKLIKTDAIKAKLFKTAIKLIDLLEKPVISALNNSKKGYLLPCNIWNLEEKVNDILSIGNQTGEGWFLTAEMIEYIEHDIPNIVCVQPFACLPNHVVGKGVIKTIRSKFPEANIAPIDYDPGASEANQTNRIKLMMTVAKDNLKNKNNINKAIKKENYIIDEKNKISN

SEQ ID NO: 674 - protein, 1439 aa, unidentified
  REGION 1..1439: note = Description of Unknown:uncultivated organism sequence
  REGION 1..1439: note = Category: MG55 effectors
  REGION 1..1439: note = Description: MG55-249 effector
MIKTLHVGLDVGSTTVKIIVMDENLNTIYTDYKRHFSDTKNTICNVLENLIIMYPDTEFTIALTGSGAISAAKFLDLPFIQEVVSCKRAVEKYIPETDVVIELGGEDAKIIYFDKFIEQRMNGTCAGGTGAFIDQMASLLNTDPTGLNELAKSHKLIYPIASRCGVFAKTDIQPLLNEGAAKEDIAASIFQAVVNQTISGLACGRPIRGNVAFLGGPLNYLSELRNRFIETLNLKDNEIIVPNEAHLLVAKGAALDSLNSHTITIEKLKSKIEVLKSSHDDTSNPLNPLFSIDAEYDEFKKRHEKDKVKRADFKTFKGNCFLGIDAGSTTTKLVVISEDGTLLYSLYGSNEGNPLQSVINMLKKLYAEKPSEAVIRFSGVTGYGEKLIQTALNVDLNEIETIAHYTAAKEFMPNVTSIVDIGGQDMKYIKMKNGAIDNIMLNEACSSGCGSFIETFAKSLGLSIQDFVQSALEARRPVDLGSRCTVFMNSKIKQAQKEGYSVGDISAGLSYSVIKNAIQKVMKVRDVKKLGAHIVVQGGTFYNDAVLRAFELIVGRNVVRPDIAGLMGAYGVALLAKEQYENNLDMDYVSSISNINELDKLEINITHIRCQGCENHCLLTINKFSNGTKYISGNRCEKGAGIVDKTLDRPNLIKYKFERTFNYTPLEEKNAPRGTIGIPRVLNMYEDYPFWFTFLTNLGFRVILSEKSNRKTYEKGMESMPSESVCFPAKLSHGHIIGLINSGIKTIFYPCIPYSRKEYQKADNHYNCPIVISYSEVLKNNVEELKDKNIKFLNPFLPFEPDKLAEIIMNLPEFKEYNFTKKELLSAAKKAETEYQNYKSDIHNKGQETLKFMEENNLKGIVLAGRPYHVDPEVNHGIDTLITSLGLCVLTEDSISNLTEAKRPLRVVDQWVFHARLYAAADFVGKHDNLELVQLNSFGCGVDAVTTDQVEEILTSYEKMYTLIKIDEINNLGAIRIRIRSLLASMNKRIKDNDSSMCNGNYEVNKKIFTKEMRKDYTILMPQMAPIHFEFLESAMKNSGYKMELLKDCTQHTVETGLKYVNNDACYPSILVTGQMIEALESGKYDLNKTALIMSQTGGGCRATNYIGFIRKALKDAGFENVPVISFNVVGMEKMPGFKLTIPLIERLIKSCIYADLLQKMLTKNRAYEINKGKTKELFDYWMEKCKKLVNKSSIKEFKQSIFDIVSDFEKIEIDTSVIKPKVGIVGEVLIKYHPFGNNFVADKLEQEGAEVILPDFMGFIKFIATHKITFNKLIKTDAIKAKLFKTAIKLIDLLEKPVIFALNNSKKGYLLPCNIWNLEEKVNDILSIGNQTGEGWFLTAEMIEYIEHDIPNIICVQPFACLPNHVVGKGVIKTIRSKFPEANIAPIDYDPGASEANQTNRIKLMMTVAKDNLKNKNNINKAIKKENYIIDEKNKISN

SEQ ID NO: 675 - protein, 1439 aa, unidentified
  REGION 1..1439: note = Description of Unknown:uncultivated organism sequence
  REGION 1..1439: note = Category: MG55 effectors
  REGION 1..1439: note = Description: MG55-250 effector
MIKTLHVGLDVGSTTVKIIVMDENLNTIYTDYKRHFSDTKNTICNVLENLIIMYPNTEFTIALTGSGAISAAKFLDLPFIQEVVSCKRAVEKYIPETDVVIELGGEDAKIIYFDKFIEQRMNGTCAGGTGAFIDQMASLLNTDPTGLNELAKSHKLIYPIASRCGVFAKTDIQPLLNEGAAKEDIAASIFQAVVNQTISGLACGRPIRGNVAFLGGPLNYLSELRNRFIETLNLKDNEIIVPNEAHLLVAKGAALDSLNSHTITIEKLKSKIEVLKSSHDDTSNPLNPLFSIDAEYDEFKKRHEKDKVKRADFKTFKGNCFLGIDAGSTTTKLVVISEDGTLLYSLYGSNEGNPLQSVINMLKKLYAEKPSEAVIRFSGVTGYGEKLIQTALNVDLNEIETIAHYTAAKEFMPNVTSIVDIGGQDMKYIKMKNGAIDNIMLNEACSSGCGSFIETFAKSLGLSIQDFVQSALEARRPVDLGSRCTVFMNSKIKQAQKEGYSVGDISAGLSYSVIKNAIQKVMKVRDVKKLGAHIVVQGGTFYNDAVLRAFELIVGRNVVRPDIAGLMGAYGVALLAKEQYENNLDMDYVSSISNINELDKLEINITHIRCQGCENHCLLTINKFSNGAKYISGNRCEKGAGIVDKTLDRPNLIKYKFERTFNYTPLEEKNAPRGTIGIPRVLNMYEDYPFWFTFLTNLGFRVILSEKSNRKTYEKGMESMPSESVCFPAKLSHGHIIGLINSGIKTIFYPCIPYSRKEYQKADNHYNCPIVISYSEVLKNNVEELKDKNIKFLNPFLPFEPDKLAEIIMNLPEFKEYNFTKKELLSAAKKAETEYQNYKSDIHNKGQETLKFMEENNLKGIVLAGRPYHVDPEVNHGIDTLITSLGLCVLTEDSISNLTEAKRPLRVVDQWVFHARLYAAADFVGKHDNLELVQLNSFGCGVDAVTTDQVEEILTSYEKMYTLIKIDEINNLGAIRIRIRSLLASMNKRIKDNNSSICNGNYEVNKKIFTKEMRKDYTILMPQMAPIHFEFLESAMKNSGYKMELLRDCTQHTVETGLKYVNNDACYPSILVTGQMIEALESGKYDLNKTALIMSQTGGGCRATNYIGFIRKALKDAGFENVPVISFNVVGMEKMPGFKLTIPLIERLIKSCIYADLLQKMLTKNRAYEINKGKTKELFDYWMEKCKKLVNKSSIKEFKQSIFDIVSDFEKIEIDTSVIKPKVGIVGEVLIKYHPFGNNFVADKLEQEGAEVILPDFMGFIKFIATHKITFNKLIKTDAIKAKLFKTAIKLIDLLEKPVISALNNSKKGYLLPCNIWNLEEKVNDILSIGNQTGEGWFLTAEMIEYIEHDIPNIVCVQPFACLPNHVVGKGVIKTIRSKFPEANIAPIDYDPGASEANQTNRIKLMMTVAKDNLKNKNNINKAIKKENYIIDEKNKISN

SEQ ID NO: 676 - protein, 1439 aa, unidentified
  REGION 1..1439: note = Description of Unknown:uncultivated organism sequence
  REGION 1..1439: note = Category: MG55 effectors
  REGION 1..1439: note = Description: MG55-251 effector
MIKTLHVGLDVGSTTVKIIVMDENLNTIYTDYKRHFSDTKNTICNVLENLIIMYPDTEFTIALTGSGAISAAKFLDLPFIQEVVSCKRAVEKYIPETDVVIELGGEDAKIIYFDKFIEQRMNGTCAGGTGAFIDQMASLLNTDPTGLNELAKSHKLIYPIASRCGVFAKTDIQPLLNEGAAKEDIAASIFQAVVNQTISGLACGRPIRGNVAFLGGPLNYLSELRNRFIETLNLKDNEIIVPNEAHLLVAKGAALDSLNSHTITIEKLKSKIEVLKSSHDDTSNPLNPLFSIDAEYDEFKKRHEKDKVKRADFKTFKGNCFLGIDAGSTTTKLVVISEDGTLLYSLYGSNEGNPLQSVINMLKKLYAEKPSEAVIRFSGVTGYGEKLIQTALNVDLNEIETIAHYTAAKEFMPNVTSIVDIGGQDMKYIKMKNGAIDNIMLNEACSSGCGSFIETFAKSLGLSIQDFVQSALEARRPVDLGSRCTVFMNSKIKQAQKEGYSVGDISAGLSYSVIKNAIQKVMKVRDVKKLGAHIVVQGGTFYNDAVLRAFELIVGRNVVRPDIAGLMGAYGVALLAKEQYKNNLDMDYVSSISNINELDKLEINITHIRCQGCENHCLLTINKFSNGAKYISGNRCEKGAGIVDKTLDRPNLIKYKFERTFNYTPLEEKNAPRGTIGIPRVLNMYEDYPFWFTFLTNLGFRVILSEKSNRKTYEKGMESMPSESVCFPAKLSHGHIIGLINSGIKTIFYPCIPYSRKEYQKADNHYNCPIVISYSEVLKNNVEELKDKNIKFLNPFLPFEPDKLAEIIMNLPEFKEYNFTKKELLSAAKKAETEYQNYKSDIHNKGQETLKFMEENNLKGIVLAGRPYHVDPEVNHGIDTLITSLGLCVLTEDSISNLTEAKRPLRVVDQWVFHARLYAAADFVGKHDNLELVQLNSFGCGVDAVTTDQVEEILTSYEKMYTLIKIDEINNLGAIRIRIRSLLASMNKRIKDNNSSMCNGNYEVNKKIFTKEMRKDYTILMPQMAPIHFEFLESAMKNSGYKMELLKDCTQHTVETGLKYVNNDACYPSILVTGQMIEALESGKYDLNKTALIMSQTGGGCRATNYIGFIRKALKDAGFENVPVISFNVVGMEKMPGFKLTIPLIERLIKSCIYADLLQKMLTKNRAYEINKGKTKELFDYWMEKCKKLVNKSSIKEFKQSIFDIVSDFEKIEIDTSVIKPKVGIVGEVLIKYHPFGNNFVADKLEQEGAEVILPDFMGFIKFIATHKITFNKLIKTDAIKAKLFKTAIKLIDLLEKPVISALNNSKKGYLLPCNIWDLEGKVNDILSIGNQTGEGWFLTAEMIEYIEHDIPNIVCVQPFACLPNHVVGKGVIKTIRSKFPEANIAPIDYDPGASEANQTNRIKLMMTVAKDNLKNKNNINKAIKKENYIIDEKNKISN

SEQ ID NO: 677 - protein, 1439 aa, unidentified
  REGION 1..1439: note = Description of Unknown:uncultivated organism sequence
  REGION 1..1439: note = Category: MG55 effectors
  REGION 1..1439: note = Description: MG55-252 effector
MIKTLHVGLDVGSTTVKIIVMDENLNTIYTDYKRHFSDTKNTICNVLENLIIMYPDTEFTIALTGSGAISAAKFLDLPFIQEVVSCKRAVEKYIPETDVVIELGGEDAKIIYFDKFIEQRMNGTCAGGTGAFIDQMASLLNTDPTGLNELAKSHKLIYPIASRCGVFAKTDIQPLLNEGAAKEDIAASIFQAVVNQTISGLACGRPIRGNVAFLGGPLNYLSELRNRFIETLNLKDNEIIVPNEAHLLVAKGAALDSLNSHTITIEKLKSKIEVLKSSHDDTSNPLNPLFSIDAEYDEFKKRHEKDKVKRADFKTFKGNCFLGIDAGSTTTKLVVISEDGTLLYSLYGSNEGNPLQSVINMLKKLYAEKPSEAIIRFSGVTGYGEKLIQTALNVDLNEIETIAHYTAAKEFMPNVTSIVDIGGQDMKYIKMKNGAIDNIMLNEACSSGCGSFIETFAKSLGLSIQDFVQSALEARRPVDLGSRCTVFMNSKIKQAQKEGYSVGDISAGLSYSVIKNAIQKVMKVRDVKKLGAHIVVQGGTFYNDAVLRAFELIVGRNVVRPDIAGLMGAYGVALLAKEQYENNLDMDYVSSISNINELDKLEINITHIRCQGCENHCLLTINKFSNGTKYISGNRCEKGAGIVDKTLDRPNLIKYKFERTFNYTPLEEKNAPRGTIGIPRVLNMYEDYPFWFTFLTNLGFRVILSEKSNRKTYEKGMESMPSESVCFPAKLSHGHIIGLINSGIKTIFYPCIPYSRKEYQKADNHYNCPIVISYSEVLKNNVEELKDKNIKFLNPFLPFEPDKLAEIIMNLPEFKEYNFTKKELLSAAKKAETEYQNYKSDIHNKGQETLKFMEENNLKGIVLAGRPYHVDPEVNHGIDTLITSLGLCVLTEDSISNLTEAKRPLRVVDQWVFHARLYAAADFVGKHDNLELVQLNSFGCGVDAVTTDQVEEILTSYEKMYTLIKIDEINNLGAIRIRIRSLLASMNKRIKDNNSSMCNGNYEVNKKIFTKEMRKDYTILMPQMAPIHFEFLESAMKNSGYKMELLRDCTQHTVETGLKYVNNDACYPSILVTGQMIEALESGKYDLNKTALIMSQTGGGCRATNYIGFIRKALKDAGFENVPVISFNVVGMEKMSGFKLTIPLIERLIKSCIYADLLQKMLTKNRAYEINKGKTKELFDYWMEKCKKLVNKSSIKEFKQSIFDIVSDFEKIEIDTSVIKPKVGIVGEVLIKYHPFGNNFVADKLEQEGAEVILPDFMGFIKFIATHKITFNKLIKTDAIKAKLFKTAIKLIDLLEKPVISALNNSKKGYLLPCNIWDLEGKVNDILSIGNQTGEGWFLTAEMIEYIEHDIPNIVCVQPFACLPNHVVGKGVIKTIRSKFPEANIAPIDYDPGASEANQTNRIKLMMTVAKDNLKNKNNINKAIKKENYIIDEKNKISN

SEQ ID NO: 678 - protein, 1439 aa, unidentified
  REGION 1..1439: note = Description of Unknown:uncultivated organism sequence
  REGION 1..1439: note = Category: MG55 effectors
  REGION 1..1439: note = Description: MG55-253 effector
MIKTLHVGLDVGSTTVKIIVMDENLNTIYTDYKRHFSDTQNTICNVLENLIIMYPDTEFTIALTGSGAISAAKFLDLPFIQEVVSCKRAVEKYIPETDVVIELGGEDAKIIYFDKFIEQRMNGTCAGGTGAFIDQMASLLNTDPTGLNELAKSHKLIYPIASRCGVFAKTDIQPLLNEGAAKEDIAASIFQAVVNQTISGLACGRPIRGNVAFLGGPLNYLSELRNRFIETLNLKDNEIIVPNEAHLLVAKGAALDSLNSHTITIEKLKSKIEVLKSSHDDTSNPLNPLFSIDAEYDEFKKRHEKDKVKRADFKTFKGNCFLGIDAGSTTTKLVVISEDGTLLYSLYGSNEGNPLQSVINMLKKLYAEKPSEAVIRFSGVTGYGEKLIQTALNVDLNEIETIAHYTAAKEFMPNVTSIVDIGGQDMKYIKMKNGAIDNIMLNEACSSGCGSFIETFAKSLGLSIQDFVQSALEARRPVDLGSRCTVFMNSKIKQAQKEGYSVGDISAGLSYSVIKNAIQKVMKVRDVKKLGAHIVVQGGTFYNDAVLRAFELIVGRNVVRPDIAGLMGAYGVALLAKEQYENNLDMDYVSAISNINELDKLEINITHIRCQGCENHCLLTINKFSNGAKYISGNRCEKGAGIVDKTLDRPNLIKYKFERTFNYTPLEEKNAPRGTIGIPRVLNMYEDYPFWFTFLTNLGFRVILSEKSNRKTYEKGMESMPSESVCFPAKLSHGHIIGLINSGIKTIFYPCIPYSRKEYQKADNHYNCPIVISYSEVLKNNVEELKDKNIKFLNPFLPFEPDKLAEIIMNLPEFKEYNFTKKELLSAAKKAETEYQNYKSDIHNKGQETLKFMEENNLKGIVLAGRPYHVDPEVNHGIDTLITSLGLCVLTEDSISNLTEAKRPLRVVDQWVFHARLYAAADFVGKHDNLELVQLNSFGCGVDAVTTDQVEEILTSYEKMYTLIKIDEINNLGAIRIRIRSLLASMNKRIKDNNSSMCNGNYEVNKKIFTKEMRKDYTILMPQMAPIHFEFLESAMKNSGYKMELLRDCTQHTVETGLKYVNNDACYPSILVTGQMIEALESGKYDLNKTALIMSQTGGGCRATNYIGFIRKALKDAGFENVPVISFNVVGMEKMPGFKLTIPLIERLIKSCIYADLLQKMLTKNRAYEINKGKTKELFDYWMEKCKKLVNKSSIKEFKQSIFDIVSDFEKIEIDTSVIKPKVGIVGEVLIKYHPFGNNFVADKLEQEGAEVILPDFMGFIKFIATHKITFNKLIKTDAIKAKLFKTAIKLIDLLEKPVISALNNSKKGYLLPCNIWDLEEKVNDILSIGNQTGEGWFLTAEMIEYIEHDIPNIVCVQPFACLPNHVVGKGVIKTIRSKFPEANIAPIDYDPGASEANQTNRIKLMMTVAKDNLKNKNNINKAIKKENYIIDEKNKISN

SEQ ID NO: 679 - protein, 1439 aa, unidentified
  REGION 1..1439: note = Description of Unknown:uncultivated organism sequence
  REGION 1..1439: note = Category: MG55 effectors
  REGION 1..1439: note = Description: MG55-254 effector
MIKTLHVGLDVGSTTVKIIVMDENLNTIYTDYKRHFSDTKNTICNVLENLIIMYPDTEFTIALTGSGAISAAKFLDLPFIQEVVSCKRAVEKYIPETDVVIELGGEDAKIIYFDKFIEQRMNGTCAGGTGAFIDQMASLLNTDPTGLNELAKSHKLIYPIASRCGVFAKTDIQPLLNEGAAKEDIAASIFQAVVNQTISGLACGRPIRGNVAFLGGPLNYLSELRNRFIETLNLKDNEIIVPNEAHLLVAKGAALDSLNSHTITIEKLKSKIEVLKSSHDDTSNPLNPLFSIDAEYDEFKKRHEKDKVKRADFKTFRGNCFLGIDAGSTTTKLVVISEDGTLLYSLYGSNEGNPLQSVINMLKKLYAEKPSEAVIRFSGVTGYGEKLIQTALNVDLNEIETIAHYTAAKEFMPNVTSIVDIGGQDMKYIKMKNGAIDNIMLNEACSSGCGSFIETFAKSLGLSIQDFVQSALEARRPVDLGSRCTVFMNSKIKQAQKEGYSVGDISAGLSYSVIKNAIQKVMKVRDVKKLGAHIVVQGGTFYNDAVLRAFELIVGRNVVRPDIAGLMGAYGVALLAKEQYENNLDMDYVSSISNINELDKLEINITHIRCQGCENHCLLTINKFSNGTKYISGNRCEKGAGIVDKTLDRPNLIKYKFERTFNYTPLEEKNAPRGTIGIPRVLNMYEDYPFWFTFLTNLGFRVILSEKSNRKTYEKGMESMPSESVCFPAKLSHGHIIGLINSGIKTIFYPCIPYSRKEYQKADNHYNCPIVISYSEVLKNNVEELKDKNIKFLNPFLPFEPDKLAEIIMNLPEFKEYNFTKKELLSAAKKAETEYQNYKSDIHNKGQETLKFMEENNLKGIVLAGRPYHVDPEVNHGIDTLITSLGLCVLTEDSISNLTEAKRPLRVVDQWVFHARLYAAADFVGKHDNLELVQLNSFGCGVDAVTTDQVEEILTSYEKMYTLIKIDEINNLGAIRIRIRSLLASMNKRIKDNNSSMCNGNYEVNKKIFTKEMRKDYTILMPQMAPIHFEFLESAMKNSGYKMELLRDCTQHTVETGLKYVNNDACYPSILVTGQMIEALESGKYDLNKTALIMSQTGGGCRATNYIGFIRKALKDAGFENVPVISFNVVGMEKMPGFKLTIPLIERLIKSCIYADLLQKMLTKNRAYEINKGKTKELFDYWMEKCKKLVNKSSIKEFKQSIFDIVSDFEKIEIDTSVIKPKVGIVGEVLIKYHPFGNNFVADKLEQEGAEVILPDFMGFIKFIATHKITFNKLIKTDAIKAKLFKTAIKLIDLLEKPVISALNNSKKGYLLPCNIWNLEEKVNDILSIGNQTGEGWFLTAEMIEYIEHDIPNIVCVQPFACLPNHVVGKGVIKTIRSKFPEANIAPIDYDPGASEANQTNRIKLMMTVAKDNLKNKNNINKAIKKENYIIDEKNKISN

SEQ ID NO: 680 - protein, 723 aa, unidentified
  REGION 1..723: note = Description of Unknown:uncultivated organism sequence
  REGION 1..723: note = Category: MG55 effectors
  REGION 1..723: note = Description: MG55-255 effector
MRIIKRNGSEEDFNIEKIINAVKKANGSGEHKFLTDEQIEDVADYVEYKCNKIRRAVSVEEIQDMVEDQLMAKGAFELARRYVRYRYNRSLVRKANTTDNRILSLIECNNEEVKQENSNKNPTVNSVQRDYMAGEVSRDLTRRMLLPADIVEADKEGIIHFHDSDYFAQHMHNCDLVNLEDMLQNGTVISDTLIERPHSFSTACNIATQIIAQVASNQYGGQSISLAHLAPFVQVSREKIRRETLAEIEELGVHPTEEKINDIVEQRLRKEVNRGVQTIQYQVVTLLTTNGQAPFVTVFMYLNEAKNEQEKHDLAMIIEETLKQRHKGVKNEKGVWITPAFPKLIYVLEEDNITEDSKYWYLTELAAKCTAKRMVPDYISEKVMLQSKIDKNGEGHCFTCMGCRSFLTPYVDENGKPKYYGRFNQGVVTVNLIDIGLSAGKDLDKFWKIFDERMELCHRALQCRHERLTGTLSDAAPILWQYGALARLKKGEKIDKLLHGGYSTLSLGYAGLWECVYSLIGKKLTEKEGKELGLEIMQKLNDYCAKWKKEENIDYSIYGTPLESTTYKFAKCLQKRFGIIKGVTDKNYITNSYHVHVTENIDAFSKLKLESEFQALSPGGAISYVEVPNMQDNIPAVLQVIKFIYDNIMYAELNTKSDYCQVCGYDGEIKIVHDDGKLVWECPNCGNRDQDKMNVARRTCGYIGTQFWNQGRTQEIEERVLHL

SEQ ID NO: 681 - protein, 723 aa, unidentified
  REGION 1..723: note = Description of Unknown:uncultivated organism sequence
  REGION 1..723: note = Category: MG55 effectors
  REGION 1..723: note = Description: MG55-256 effector
MKIIKRNGSEVPFDITKIITAVTKASDSVSGKSRLTREQITQIAAEVTDQCQSLNRAVSVEEIQDMVENKLMDMKAHDIARHYITYRYVQSLKRQTNTTDERILSLIECQNEEVKQENANKNPTVNSVQRDYMAGEISKDLTARLLLDPEIVKAHQEGLIHFHDSDYFAQHMHNCDLVNLEDMLQNGTVISGTYIEKPHSFSTACNIATQIIAQVASNQYGGQSISLTHLAPFVDVSRKKIAAEVEAEMEGLNVSAERKKAIVERRLRNEINRGVQTIQYQVVTLMTTNGQAPFITVFMYLGEARNAQEKADLAIIIEETIRQRYQGVKNEAGVWITPAFPKLIYVLEEDNIRPGTPYYYLTELAAKCTAKRMVPDYISEKKMLEMKIDKNGEGHCYTCMGCRSFLTPYVDPETGKPKYYGRFNQGVVTINLVDVALSSGGNFEKFWKIFDERLALCHRALQARHKRLLGTPSDAAPILWQYGALARLKKGEKIDKLLFGGYSTISLGYAGLYECVKYMTGRSHTDAGAKPFALSVMQHMNDKCNEWKKAENIDYSLYGTPLESTTYKFAKCLQKRFGIVPGITDKNYITNSYHVHVSEPIDAFTKLKFESEFQRLSPGGAISYVEVPNMQDNLEAVISVLQFIYDNIMYAELNTKSDYCQCCGYDGEIKIVEDDGKLVWECPKCGNRDQNKLNVARRTCGYIGTQFWNQGRTQEIKDRVLHL

SEQ ID NO: 682 - protein, 723 aa, unidentified
  REGION 1..723: note = Description of Unknown:uncultivated organism sequence
  REGION 1..723: note = Category: MG55 effectors
  REGION 1..723: note = Description: MG55-257 effector
MKIIKRNGSEVPFDITKIITAVTKASDSVSGKSRLTREQITQIAAEVTDQCQSLNRAVSVEEIQDMVENKLMDMKAHDIARHYITYRYVQSLKRQTNTTDERILSLIECQNEEVKQENANKNPTVNSVQRDYMAGEISKDLTARLLLDPEIVKAHQEGLIHFHDSDYFAQHMHNCDLVNLEDMLQNGTVISGTYIEKPHSFSTACNIATQIIAQVASNQYGGQSISLTHLAPFVDVSRKKIAAEVETEMEGLNVSAERKKAIVERRLRNEINRGVQTIQYQVVTLMTTNGQAPFITVFMYLGEARNAQEKADLAIIIEETIRQRYQGVKNEAGVWITPAFPKLIYVLEEDNIRPGTPYYYLTELAAKCTAKRMVPDYISEKKMLEMKIDKNGEGHCYTCMGCRSFLTPYVDPETGKPKYYGRFNQGVVTINLVDVALSSGGNFEKFWKIFDERLALCHRALQARHKRLLGTPSDAAPILWQYGALARLKKGEKIDKLLFGGYSTISLGYAGLYECVKYMTGRSHTDAGAKPFALSVMQHMNDKCNEWKKAENIDYSLYGTPLESTTYKFAKCLQKRFGIVPGITDKNYITNSYHVHVSEPIDAFTKLKFESEFQRLSPGGAISYVEVPNMQDNLEAVISVLQFIYDNIMYAELNTKSDYCQCCGYDGEIKIVEDDGKLVWECPKCGNRDQNKLNVARRTCGYIGTQFWNQGRTQEIKDRVLHL

SEQ ID NO: 683 - protein, 703 aa, unidentified
  REGION 1..703: note = Description of Unknown:uncultivated organism sequence
  REGION 1..703: note = Category: MG55 effectors
  REGION 1..703: note = Description: MG55-258 effector
MKVIKRDGSTADFDSSKIIVAIQKANQVVEPEDRIDQERIEAIAHYVESKNRMRLLVEDIQDMVEHQLMDEGKFNLAKSYIIYRYTRALVRKANTTDESILSLIRNSNKDVMEENSNKNAVMASTQRDLIAGEVSKDLTRRLILPEKISKAHDEGAIHFHDADYFVQPIFNCCLINVGDMLDNGTVMNGKLIESPKSFQVACTVMTQIIASVASSQYGGQSVDIRHLGKYLRRSYEKFKLTIKAEVGDSVADEVVERLTKRRLQDELRSGVQTIQYQINTLMTTNGQSPFVTIFLNLQADDEYLEENAMIVEEILRQRLEGIKNDKGVFVTPAFPKLVYVLDEHNCLKGGKYDYITKLAVKCSAKRLYPDYISAKKMRENYEGNVFAPMGCRSFLAAWKDDEGNYKFEGRFNQGVVSLNLPQVAILAHGDEEKFWPLLDERLQLCYEALMCRHNSLKGIRSDVSPVHWQYGAIARLEKGEVIDKYLEKGYSTIGLYEMTKLMKDVSHTTPEGEEFALRVMKYLRAACDKWKKETGLGFALYGTPAESLCYRFARIDKERFGTIADVTDKGYYTNSYHVDVREDIDAFSKFNFESQFQRISSGGAISYVEIPNMRHNLEAMEDVVRFIYDNIQYAEFNTKSDYCHVCGFDGEIIINDDLEWECPNCGNKNQTLMNVTRRTCGYLGENFWNVGKTKEIKSRVLHL

SEQ ID NO: 684 - protein, 972 aa, unidentified
  REGION 1..972: note = Description of Unknown:uncultivated organism sequence
  REGION 1..972: note = Category: MG55 effectors
  REGION 1..972: note = Description: MG55-259 effector
MQIGLDIGSTTIKIAVLDDAGQLQFSKYERHYSQIAEKMQQLLAELHIKMPLLKTARLAISGSAGIGIADSCSLQFVQEVFAEKVCTERLNPGTEAVIELGGEDAKLLFLGRHFDARMNDSCAGGTGAFIDQMASLLSVPTEAMNELAQQASTRYTIASRCGVFAKSDIQPLLNQGAAKADLAASIFDAVASQAVTGLAKGRPITGKVLYLGGPLTFMSELRHSFDKILKIEGYCPENSLYYVAMGAAFCAENKVDLTELPAKLAAVGAQRDFDHLEPLFASTAEYDEFMERHSKERIEPGDISAATEAYIGMDAGSTTIKIAVISPSGQLLDSSYQSNKGNPVIAIKEYLQNFYIKYPHCRILGSAVTGYGEDLIRNGFSVDYGIVETMAHFIAAKTLQPDVDFILDIGGQDIKCLKIHNGCIDNIFLNEACSSGCGSFLQTFAEILGYSAEEFARIGLFADKPVDLGSRCTVFMNSSVKQAQKDGATVANISAGLSLSIVKNALYKVIRPGSKESIGKHIVVQGGTFLNDCVLRAFEKEMGLKVVRPNIAGLMGAYGAAIYSRSRHQETGHVSTLADAAALENFVHEVKAVTCGLCSNHCHLTVNTFASGKRFISGNRCERPVTHCAPDDTFNLYRQKLQLLESLKGVPGKRGKIGLPMGLNMYELLPFWHAFFTRLGFEVITSPIYDKTIFQKGQNTIPSDTVCYPAKLMHGHIKWLLENGINTIFYPCMTYNVDENSAENCYNCPVVAYYPEVLHANMHDLDNATYIFDYLGLGHKKVLLKKLQQICKEHFPDIGSSELKAALQEAYAAYNKFEAQVKELGQTIINTARSQHKPIVVLAGRPYHIDPKVNHSIDRLITTMGAALVSEDAVSSHISMQELNDDLQVLNQWTYHSRLYAAAKYVSRSSDMYMVHLVSFGCGCDAITADECRRILEEHGQIYTQIKIDDIDNLGAAKIRLRSLFAAAGLES

SEQ ID NO: 685 - protein, 724 aa, unidentified
  REGION 1..724: note = Description of Unknown:uncultivated organism sequence
  REGION 1..724: note = Category: MG55 effectors
  REGION 1..724: note = Description: MG55-260 effector
MKIIKRNGAEENFDISKIIMAVTKANAAVEECDRMTPRQIQRIAESVELACQELGRSAAVEEIQDMVEKQIMAHGAFEVAKAYITYRYTRSLVRRANTTDDRILSLIECNNEEAKQENSNKNPIVNSTQRDYMAGEVSRDITSRLLLPKDIVEAHEEGIIHFHDADYYAQHMHNCDLVNLEDMLENGTVITGTLIERPHSFSTACNIATQIIAQVASNQYGGQSISLTHLAPFVQVSRERIRREVEAEMQAIDAHPGEEKLAELVENRVREEIRRGVQTIQYQVVTLLTTNGQAPFVTVFMYLGEAKNEQERHDLAMIIEETLRQRYQGVKNEKGVWVTPAFPKLIYVLEEDNIHEDSPYWYLTELAARCTAKRMVPDYISEKKMLELKVDKNGEGHCYTCMGCRSFLTPYVDENGKPKYYGRFNQGVVTINLPDVALSSGGNMEKFWKIFDERLELCHRALMCRHERLKGTLSDAAPILWQYGALARLKKGEPIDKLLYGGYSTISLGYAGLYECVKYMTGKSHTDPSATPFALEIMQHMNDACAKWKQMHNIDFSLYGTPLESTTYKFAKCLQKRFGIIPGVTDKGYITNSYHIHVTEHIDAFSKLAFESKFQALSPGGAISYVEVPNMQNNIPAVLEVMKFIYDNIMYAELNTKSDYCQKCGFDGEIEILEQDGKLVWTCPQCGNQDQDTMNVARRTCGYIGTQFWNQGRTQEIKERVLHL

SEQ ID NO: 686 - protein, 728 aa, unidentified
  REGION 1..728: note = Description of Unknown:uncultivated organism sequence
  REGION 1..728: note = Category: MG55 effectors
  REGION 1..728: note = Description: MG55-261 effector
MYIIKRSGAEELFDHTKIETAIAKANETVEAVERATKAERELVARRVEECAETCGHALNIEEIQDLVVTNIMDLKLYRLAQNYAVYRYKRELVRKSNTTDEQILSLIECNNEEVKQENSNKNPTVNSVQRDYMAGEVSKDLTRRFLLPPDIVQAHEEGLIHFHDADYFAQHMHNCCLVNLEDMLQNGTVISETQIDPPKSFSTACNVATQAIAQVASSQYGGQTISLSHLAPFVQVSREKFRKQAIAEYDANGIDYTDEQVERAVAMRVKEEIKKGVQTIQYQVITLMTTNGQAPFITVFMYLDEVPEGQTRDDLAAIIEEMLHQRIIGVKNEKGVYVTPAFPKLIYVLEEDNIHEESKYFYLTSLAAQCTAKRMVPDYISEKKMKEIKIDANGDSYCYPSMGCRSFLTPYIDPETNKPKYYGRFNQGVVTLNLVDVACSSDGDMDKFWKILDERLQLCYRALMCRHKRLLGTPSDVAPILWQNGALARLKKGEPIDKLLFNGYSTISLGYAGLYETCMRMLGVSHTEKEKGMPFAKAVMQHLNDACKEWKEKENIDFSVYGTPLESTTYKFAKCLQKRFGKIKDVTDHNYITNSYHVCVREEINAFDKLKFESEFQPLSPGGAISYVEVPNMQNNIEAVLSVMKYIYDNIMYAELNTKSDYCMECGYDGEIKIVKEEGSGKLVWECPCCGNRDQNKMSVARRTCGYIGTQFWNQGRTAEIADRRLHL

SEQ ID NO: 687 - protein, 984 aa, unidentified
  REGION 1..984: note = Description of Unknown:uncultivated organism sequence
  REGION 1..984: note = Category: MG55 effectors
  REGION 1..984: note = Description: MG55-262 effector
MARRIKNVASNNYTLGIDIGSTTAKLALMCDGKIVYSKYQRHRSRIIGTTLDMLREMKEIHPVDKVRVTISGSAGMGMAEKAGIDFIQEVYATGEVVYKLAPDTGVVIELGGEDAKVIFFKGGVDERMNGSCAGGTGAFIDQMAVLLNMSVDDMDKASLEAKRIYPIASRCGVFAKTDIQPLLNQGASKADIAASIFQAVVNQTITGLIQGRKIEGKVMFLGGPLYYCEGLKKRFYETLSLTKETAVFPEYALYAVAMGASMYAQNSEEISFEELEKRIENSAKCESRGLDTLPPLFASKEEYDYFVQRHNKATVPQKDINTYIGNAWLGIDCGSTTTKLVLISDDRSILYSFYSSNKGNPVKLVKEQLEIIYFLCQNRIKICGSSVTGYGEELIRHAFRTDEGVVETIAHYTAAKYFRPDVDFILDIGGQDIKCFKIRNGAIDSIMLNEACSSGCGSFVETFAKAMGYNVSDFAKLGIFAKSPVNLGSRCTVFMNSSVKQSQKDGASVEDISAGLSASVVKNAIYKVIRANSPKELGNCIVVQGGTFYNDAVLRAFEKEIKNNVIRPSIAGLMGAYGAALHIMKSKESTLLSQKELETFTHTSNSSICRGCSNNCHLTINRFSDGETFVSGNQCQKALGLKNTEELPNLYAWKRNFFENLKPVRGTRGKIGIPMALSMYELAPLWNAFFTYLGFEVHFSALSNRKTYEKGQFTIPSDTACYPAKIMHGHMVELMEKGFENIFYPSITYNINEHAGDNHFNCPIVAYYAELLNGNMEELKNINFLYPYVSIDSPSELSKTIYDTILKLDPKVSKSEVLKAAKSGFAAYKEYKNKVKNEGAKAIAYARENGKRIMILAGRPYHIDPEIGHGIDKLATSLGFVVVSEDSVCELAPVQYVKVLDQWTFHSRLYRAARYATEHSDTELVQLVSFGCGVDAITTDEVRSILEEKHKHYTQIKIDEITNLGAVKIRLRSLIGALEEGEAK

SEQ ID NO: 688 - protein, 1416 aa, unidentified
  REGION 1..1416: note = Description of Unknown:uncultivated organism sequence
  REGION 1..1416: note = Category: MG55 effectors
  REGION 1..1416: note = Description: MG55-263 effector
MKLDFNTLGIDIGSTTVKIAILNKDGEIIFSDYQRHYANIQETLAKIIDEAYEEFGDIPVSPMITGSGGLTLSKHMEIPFVQEVVAVATSLKDYAPRTDVAIELGGEDAKIIYFTGGIDQRMNGICAGGTGSFIDQMATLLKTDAAGLNEYAKNYKAIYPIAARCGVFAKTDIQPLINEGATKEDLSASIFQAVVNQTISGLACGKPIKGNVAFLGGPLHFLTELKQAFIRTLGLEGDAIIAPEHSHLFAASGAAMNAHADVQSSLGELKEKLSHKIELEFEVTRMEPLFASEKEYEDFTERHNKHNVKKGDFASYKGDLFLGIDAGSTTTKVAVIGDDGSLLYSFYSSNNGSPLKTALKAMKDIYSKMPEGARIVRSCSTGYGEALLKSALLLDEGEVETVAHYTAAAFFDPNVDCILDIGGQDMKCIKIKNNSVDKVQLNEACSSGCGSFIETFAKSLNYEVADFAKIALFAENPIDLGSRCTVFMNSKVKQAQKEGASVADISAGLAYSVIKNALLKVIKLTDPKDLGKQVVVQGGTFYNDAVLRSFERISGCEAIRPDIAGIMGAFGAALIAKDRYTGQKSTMLSFKEINELRFKTSMTRCQGCINHCLLTVNEFTGDRKFISGNRCEKGLGLEKNKEHIPNLFEYKNERVFKHYKPLKKADAPRGVVGIPRVLNMYENYPFWFTFFTKLGYSVKLSPVSSRKIYELGIESIPSESECYPAKLAHGHVTWLIRQGLEYIFYPCIPYERVEVPDAGNHYNCPIVTSYGENIKNNIEELRDDKIKYQNPFISLESEEILTKRLVDFFRKENGIPAAEIKAAAHEGWLEMQAVREDMNKKGKEVLQYLKETGRHGIVLAGRPYHSDPEINHGIPDLITSYGVAVLTEDSISELSEVDRPTIVMDQWMYHSRLYKAASFVAKNDNLDLIQLNSFGCGLDAVTTDQVNDILTKQNKIYTVLKIDEVNNLGAARIRIRSLLAAVKDRERKKIEAKRVDTAHHRVIFTEQMRKDYTILVPDMSPIHFEILESALASCGYNVEVLKADSKCIDYGLKYVNNDACYPSLIVVGQFMQALLSGKYDLHKVALIITQTGGGCRATNYIGFIRRALEKAGMGYIPVISMSAGIEKNPGLKVNLEMANKALQALIYGDVFMRVLYKTRPYEKVKGSANALHEKWKKIAIESVKKANKKQFKKNIQNIVKEFDELELVDIKKPKVGIVGEILVKFMPLANNFIVELLEEEGAEAVCPDLIDFFMYSLYNANFKAEYLGKKKSSAKINNFLIWFIERYRKCANDALAASKRFHPTVPIQKLAEYASPIVSCGNQTGEGWFLTGEMIELIKSGVPNIVCTQPFGCLPNHVVGKGVIKELRHQYPDSNIVAVDYDPGASEVNQLNRIKLMLSTAGKNLIAESKDNEETA

SEQ ID NO: 689 - protein, 1415 aa, unidentified
  REGION 1..1415: note = Description of Unknown:uncultivated organism sequence
  REGION 1..1415: note = Category: MG56 effectors
  REGION 1..1415: note = Description: MG56-1 effector
MDKITREDKAKYFINKNKTGVHLLERDKKRARVFSLFKKLVTALHAEYIDRVLSENDNTESLSDDFASLINKLVDYKNKKSRESDDLSDIEKNVNKLKKELASSINKVLKNKNNAIEIAIGERNITIDFNALTGAGDPGADKLVEAFREIPIEDLKKAEIFKHYIDEQDWDLEDISWGKEADALNPFSFFHKWKTYLRKFYQIRAKIYDTDGYDSDTENSGIVKGLAHQITTRILDDNAELFVQNYQKYLSQIAEKDYKAKLDEQLSKELSVNSDIFKPENFANVLSQSQIDIYNKAVGIANRFLNEKLQGSGKKPDFFKKLYKQILGKENKDENSDSKDEFLEFDTIDELQKFLLVANDYDGKPFLQYAVDLLDKDIFTGLLDKENKKLNFPETELGEFRLNTNQLSFISNFAFGNWEVFRDAVKRVKEELKNKKDDELTGEEKQVIDSVNKFLDENEIALSELVQIFRFKVEDPDSSEKTKINLTGKDLYKLVKEESAWNLPKEELQKFSQEDTGDAALYNLLLVFELYFNSLRNGRAWHTAVEEKEMEESCDKKTCPEHKSLRELFEDLKSYVSAHGEQIKESKNKRNDYMEKLSILFYRLNDMNKFLYLFELADDESLYTNKALQEIVKINPRKNKINEAFNATRNYATKAIVVEDKIKLTFERQKLADGWSLKKTENRWGNQYEAFILKKNDKYHLGINAKLPFRIENNFNLDGFEIMEYKLLKNKTLFGSSWRGYFNESSPNYTLERLRKENPDTAVKKINKMLAEFLNEKFVKTNYFSAITDKFKEIVALLESGKVDFELSYEKLSSLYAKKFSTEYKDDDSDKSTKLDRMEELSKYLVDEQILNTIPLHCIVNKIKSILDKKEGVLSGNEVAMCYIATLEKYMYEIEFINVNKKNPPTNLVLFEIYNKDFSDKKEADSTKNIHTLYFLELFSAENKKNSQFKLSGQAEVFFRDALPESEREKVSKAELKKPKTDKIPYRKKRFASPKILFHVPIEINRLAGKGGVADEIKEYIKNNKDEISVIGVDRGEKHLAYYCLLDKDGNIKEIDSLNEIEGIKFQEKLTAREEQRMKNRKLWKTIEQIKDLKKGYISFVIRKLAEMIVDNNTILTMEELNRGFKRGRMKIEKNIYQQLENALLHKLEYFVKEKTSGGIRNAYQLVPPVGPQYKWGSQQGVVFYVDAKFTSKTCPKCGYRRRGVNFGSSKDIRKMMDKKDLQLFYDKENDRFIVKYKWEYKYKNPSGNEIPFRSDYLLTDSNGFETIYSNIDRSVWRKKQHNVERINVTKILKEALLDVDLDDLAINKNIFEIPDIEVSFSKLKMALKYWTNLRFEDNWSDIEDDKRDVLQCPSCHFDTRKANHLINGDAVGAYNIARKGILAKQNLAEKNKAKVILKEWDEYTHQQRSEQRDL

SEQ ID NO: 690 - protein, 1189 aa, unidentified
  REGION 1..1189: note = Description of Unknown:uncultivated organism sequence
  REGION 1..1189: note = Category: MG56 effectors
  REGION 1..1189: note = Description: MG56-2 effector
MNKYQKTSAIRLALKVNENFESNLKNAIETYKKNTADPEELCSRLIEILKKVIELFDKEEVKKDEYKSLLYKLKLSPHIIGSEFGLFISGSGRADSLRLNSRKLKGFFSTLFKKTNESLISLEKQLTEKNTPNFSPKNTRKILDEIFKSSLDIEHELLKRKAPTLKEAIDLIQKQNYHSDDLVPQEFAELQKTLAKLSKILDKLKESLSIFHEVITASLNEHTLTRQTTLEEREKKIKEEEDKLTQKVWAGDLKDNLNYISRFVAGHKNAFKATMNYLGKSINDNFITVEEAGKWTKKFYKIIAEGYKTEIKGLKKEVDELAKQIIGSDLEEFVKSNKDKIRVNKIKIDQNIKNSAINIFKKYLPDLPSNIKDDFLIKFLRNRILKVLIDNLIGKENKKYQIKPERKNAANELAKIINNKSEDNLEESQIIEILLNKKQKAAHTAGTNYTHIINKSNFIQNKNKVAKYIGNIKAKIATYKKDKKNLSHLALLVLDKKDENFDLLLVPKKFKKEFLYTLERLNEPVGDKKIYKIESLTLRSAKTLISANLGELIPFFKAGKWHTIFAFKAFLIKYLLDAGSINSTKAAALKCKVVEEFKKLIEYASLGGQEQKEADKFIGVVDKLICNSKNRFSHIELSHSFAEKSISIVEKDYSDVADFKKDFTELYNFVLVANVNSGKLIKLIQEAQKKFNNPNNLQFSNLFLLTSSGVKGNYRQNRRYLKEEKELLQSIKKQDFESIRLNPEIKIFLELGLDTQSSEELKELASKTRRGKDRLSIVFTITKNAKEEEDFLPAFAQDEDLETRIFELNKVVNENLKNAVRIGLDRGESELVSAVFGKIEEGRVKFQKIQVYYIDYKKIFDENQEGAVKIFLNPSLLFDENKPYTKYTKHLIEKEISQENLSYAKVIKDKVIMNADISSVVNQLMYITFADLNIEQVENLIVAEPGFVDKTKTIQLKFNGINSKKFGINASYLYLNGNITEDVKENFISAFLIKVLEHKLKIFNERVLPLIKIGQISIDTLPKNTKEALASNIAGVIAYLIEKEFNNQAIIHLEDLSAQFKDDHSKNGRAISREFEWALYRRLGKIENDFDLVPPKLGQTIYFAEIKKLKQAGIIKYLPTGKSSSFCPECLQFNFTNKDGIKKYIKITQKCQFCDFEIGNNELGIDSPDTLAAYNLIYPEFERRAINNN

SEQ ID NO: 691 - protein, 1403 aa, unidentified
  REGION 1..1403: note = Description of Unknown:uncultivated organism sequence
  REGION 1..1403: note = Category: MG57 effectors
  REGION 1..1403: note = Description: MG57-1 effector
MEKFTNLYQLSKTLRFKLEPIGNTAETFKQWLNDMNSTNESDNLFAKDKNIYDAYLVIKSIMDKLHEQFIEKSLLSDEAKQIDFSEYYEVFKDSTKEISTDLEKRLRREIGNTYNVGGSFFLNEIATATKKLEEEKNKVRKSGKKSKGEKTDNKKKKKPYEYLTDAKILNYLSANVKTLAIQNDIEEQELDKHIKQFKGFWGYLGGYNQNRENYYEVEKEASTAVATRIVHENLPTFCSNALRFEKHKDEYLGIHQYLKDNNLITKIKNSSGEENEAETMTDTIFLIGHFNECLAQTQIEEYNRIIGNYNYLINLYNQARCDEKGFNKIDEFEKLKKQIGCGKKKHMFASLIKDKQSELTETEKKNEIEDGAILSVETLLKRAKEAGDVMFNNGNDEVEIKTIPDFIQFLKECDNWDGIYMSKTAINKISNLYFANWHSIVDTFIEIYNGKDKELKEKVNTSVTYDKKREDPLKLRDAIELSGLFAVLDTVPTEHFFKESLFKEDDTNEYRGLLDKTLPPSKNLIKLLCFDIEHNTKAFLNKSRDVIKLEKYKEENIQADEEDQKIKLIKDWFDAATDVMRIVRYFAVRKGKMKGNLPNVTMEQALSNLLYRDDAQWFKWYDLIRNYLTKKPQDDVKENKLKLNFGNSSLLGGWSDGQEKTKAATLLRCENDLYLCILKKRDVFDTSKDNPIYSSPSNASRLIIRNLKFQTLAGKGFLSEYGISYGEMSKDDPKKAIQCLQEIIKERYVKKYPLLEKFVTIKYADKSEFDAEINETLKECYVCEFVPINWNLIVEKQNNDELFLFKILCKDYKPNSIGKRDLQTIYWEDVLSDASNHQLCAGAEIFMRKPIANESPLTHRIGSKLVNKRDKDGNTIPDKFYREIYLYANGKTKVISKEAKKYIDEEKATIKDVNHEIIKDKRFYGDSQEPQYMFHCPIKLNYKTKGYKEPQYAFPEVNAKINGALQQSENMQFVGIDRGEKHLVYSCTIDKDGKIVKDTNNEWKCQHHDNINGTDYVKKLEAIAGERIIAKKNWQAQNRIKDLKCGYISHVVHRLVEEVIKDDNNRISPHAYIVLEDLNTEMKRGRQKIEKQVYQNLEVALAKKLNFVVDKEAKQGELGSVSKALQLTPPISNYQDIEGKKQFGVMLYTRANYTSITDPATGWRKTIYIRNGKEEDIKKQVLEKFSDFGFDGKDYFFEYTEANAGHTWRMYSGKNGEPLLRFQNKKQMQKDKNVWVPEPINVVEILDNLFADFDKAKSFKEQINGGVKLKKIDGRNETAWQSLRYALDIIQQIRNSGIKETDDNFLYSPVRSANGEHFDTHFPEKNGELSAIRDADANGAYNIARKGLIMDAHYRYWIEQGKPEIKKGETALSLYVSDIEWDMWLLDKEMWKRHLGEFALKKK

SEQ ID NO: 692 - protein, 1372 aa, unidentified
  REGION 1..1372: note = Description of Unknown:uncultivated organism sequence
  REGION 1..1372: note = Category: MG57 effectors
  REGION 1..1372: note = Description: MG57-2 effector
MKTKTITIMKEKEQYSDFTNLYQLSKTLRFELKPVGKTAETFKQWLSEMNNSDKEENLFAKDKKIKNAYMVIKPIIDKLHERFIEKSLTSKEAKEIDFSPYFEAYKQKNVLDTFEEGLRKKIGETYTVAGGFQYLTDKRILNYLSANVEELAKQNGIDEKTLANHIEQFKGFGGYLSGYNQNRMNYYTTKEEQSTAVATRIVHENLPTFCDNILRFEKSREGYLSICQYLKDNNREIKIKNAQGEETEAETITEAIFQIKHFNSCLAQSQIEEYNRIIGNYNFLINLYNQARREEKEFKKLDEFESLYKQIGCGEKKSLFESLHDDSDLKALLQKIKEAGDTFFKECCDETEISTVSAFIKFLKECDNWEGIYMSSAAVNKISNLYFTNWHSIKDKLKESNANACITYDKDREEPVKLRDAVELSELFAVLNKESLEHLFKESLFKDNKLDTELTPSHNLINLLCSDVKQNIDYFWEHSEGITDLINDKNQSNEETQKIKQIKEWLDAAMNAMRIVRYFAVRKSKMKGNMPNVTIEQALSNLLYNDDAQWFKWYDLVRNYLTKKPQDDVKENKLKLNFGNSTLMNGWDMNKERDNTAVIIRRNNLYYLGIMDKNYNKILDADKIKSDDKSSYYEKMDYKQIALPTGVGGFVRKCFDTAQQYGWSCPKDCLNEDEKIIIKDDEARKNLTKIIDCYKDFFDKYEKDGFKYRNFNFRFLKSTEYEKLSDFFKDVERQRYMIKFRNISADYIDDLVNEGKLYLFQIYNKDFSTGRNERNGSKGKPNMHTLYWKTLFDETNLNDVVYKLNGQAEIFMREPIAENSPVKHGVGSKLVNKRDKDGNTIPEQIYKEIYLFANNKVKKENLSAEAKNYIESEKVKIKEAKYEIVKDNRFYGETKYMFHCPITINFKAGSSSGVNEKITDALQQSDNLQFIGIDRGEKHLVYSCTIDKYGKIIKCNHHDNINGTDYVQKLEAVANERLIAKKNWQQQNRIKDLKSGYISHVVHRLVEETIKDDKTIAPHAYIVLEDLNSEMKRGRQKIEKQVYQNLELALAKKFNFVVDKTAKQGELGSVSMALQLTPPVTNYKDIEGKKRFGIMLYTRANYTSITDPATGWRKTIYIKNGKDEEIKAQIIDKFSNFGFDEKDYYFEYTEENAGHTWRMYSGKDGKPLPRFQNKKQMLQDKNIWVPEQINVKEILDKLFANFDKGRSFKEQVNEEVKLEKIEGRSETAWQSLRYALNMIQQIRNSGVEKTDDNFLYSPVRNENGEHFDTRNHENNGDLSPIVDADANGAFNIARKGLIMDAHIKKWIKEGKPTTKEGDSKTPDLDLFISDREWDLWLLDREEWKKYLPVFASKSKKDADKTTSTKSPKRKKK

SEQ ID NO: 693 - protein, 1353 aa, unidentified
  REGION 1..1353: note = Description of Unknown:uncultivated organism sequence
  REGION 1..1353: note = Category: MG57 effectors
  REGION 1..1353: note = Description: MG57-3 effector
MKKKLDDFTNLYSLSKTLRFELKPEAETNKRFDDWIKELEANNETTVENLIAKDYKIFNAYKALKPILDSIHEEYITIALQSDTAKNIDFLTFYEAYSDKSKDTKNIESDLRNEIEKSFEVAEEDFFDAIKSVEPKVKKSTKASVLTDKYILSYIEKNMKNFVSNTLSEEELEKHLNAFKGFFTYFSGYNINRANYYDCKEEKNTAVATRIVNENLPIFCNNKIRFEKYRQQYSIIYSELKNLGVETKIVDNNGKLQESEPISDSVFDIKYFNYCLSQVEIEKYNQIIGNANFLINLFNQQKSKEQKFAKLPLFEKLRKQIGCGTRKNLFFALKKDKEPELTEKERNSEEILSVEKLLKITAEAGERIFNGHNNTEYSVKKLIDFLQTQTNWDGFYWSDASVSYISNKFFANWHDLLDKLKDNKACASFVKKRDEQVKLNEAVELSGLFQVLDKEANEQAFKKSVLDNYRCIINLKESVSSNLINIICSDLQNFLNEFNKNKTAILTLEKYKKKNAYNTEYDSNIRLIKEWYDSIKGILRIVGLFHAKKTKMKGCLANPEIENFVESILNPENVSWNKWYDGIRNYLTKKPQDDVKENMLKLNFGSSSLLGGWSDGQEKVKISTILKHENQVYLCILKNKQFFDTSKDNNPVYKGDGGFRLILRNLKFQTLAGKGFIGAFGQGYSEMGKETPKKAMDCLKSFIKDNYIGKYPILQSVIINEYKNKKDFDLAIQEKLKECYECKFIPIDWNKIIEAEKNGDLFIFQISSKDSKENSRGRKDLQTLYWESVLSENSPHQLCAGAEIFMRKPVDKKSPVIHKKGSILINKRFSDETTIPDELYKKLMAFVASIKQPFENEQAVKDLLFKSELSKIYAKEYLDKVKLRIAEYDIEKDKRFYGETKYFFHCPIKLNYNLKTYGKPEYAFTEINQKVNDVFTSLESPYFIGLDRGEKHLVYLCEIDNSCNIIDCRSLNNINGTNYMLKLEEKAGSRQKSRQEWQRIDNISNLKDGYVSHVVHAITEKVVNEPSYIVLEDLSRKMMQGRQKIEKSLYQKFEVALAKKLNFVVEKEIPNGEPGSVSSALQLTPPLNNYKDIENKRQFGIMLYTRANYTSVTDPVTGWRKTIYLKKGSAESIRQQIIDTFSEIGFDGKDYYFEYIELNAHKTWRMYSGKDGVSLPRFINEKKLQEDKNLWIPVEVDIVEILNQLFHCFDKNKSLLEQIKDGKELNKLCNRNETAWESLIFAINMIQQIRNNGCTEQDENFLYSPVRNENGVHFDTRKQDNTKYPADADANGAYNIARKGIIMHEHILQWRKEGSKKGDVDLFVSDEEWDLWLLDRKRWQEKLPYFASKSAKK

SEQ ID NO: 694 - protein, 1357 aa, unidentified
  REGION 1..1357: note = Description of Unknown:uncultivated organism sequence
  REGION 1..1357: note = Category: MG57 effectors
  REGION 1..1357: note = Description: MG57-4 effector
MKKKLDDFTNLYSLSKTLRFELKPEAETNKRFDDWIKELEANNETTAENLIAKDYKIFNAYKALKPILDSIHEEYITIALQSDTAKNIDFSTFYEAYSDKSKDTKNIESDLRNEIEKSFEVAEEDFFDAIKSVEPKVKKSTKASVLTDKYILSYIEKNMKNFVSNTLSEEELEKHLKAFKGFFTYFSGYNINRANYYDCKEEKNTAVATRIVNENLPIFCNNKIRFEKYRQQYSIIYSELKTLGVETKIVDNNGKLQESEPISDSVFDIKYFNYCLSQVEIEKYNQIIGNANFLINLFNQQKSKEQGFVKLPLFEKLRKQIGCGTRKNLFFALKKDKESELTEKERNSEEILSVEKLLKTTAESGERIFNGHNNTEYSVKKLIDFLQTQTNWDGFYWSDASVSYISNRFFANWHDLLDKLKDNRACASFDKKREEQVKLNEAVELSGLFKVLDKETNEQAFKESVFDNYKNIIDVKESVSSNLINIICSDLQNFLNEFNKNKTSILTLEKYKEKNAYNTEDDSNIRLIKEWYDSIKGILRIVGLFHAKKTKMKGSLANPEIESFVESILNPENVFWNKWYDGIRNYLTKKPQDDVKENMLKLNFGSSSLLGGWSDGQEKVKISTILKHENQVYLCILKNKQFFDTSKDNNPVYKGDGGFRLILRNLKFQTLAGKGFIGAFGQGYSEMGKETPKKAIDCLKSFIKDNYIGKYPILQSVIINEYKNKKDFDLAIQEKLKECYECKFILIDWNKIMEAEKNGDLFIFQISSKDFKENSRGRKDLQTLYWESVLSENSSHQLCAGAEIFMRKPVAEKSPVIHTKGSILINKRFSDGTTIPDELYKKLMAFVASIKQPFENEQAVKDLLFNSELSRIYAKEYLDKIKFRIAEYDIEKDKRFYGKTKYFFHCPIKLNYNLKTYGKPEYAFTEINQKVNDVFTSLESPYFIGLDRGEKHLVYLCEIDNSCNIIDCRSLNNINGTNYMLKLEEKAGSRQKSRQEWQRIDNISNLKDGYVSHVVHAITEKVVNEPSYIVLEDLSRKMMQGRQKIEKSLYQKFEVALAKKLNFVVEKEIPNGEPGSVSSALQLTPPLNNYKDIENKRQFGIMLYTRANYTSVTDPVTGWRKTIYLKKGSAESIRQQIIDTFSEIGFDGKDYYFEYIELNAHKTWRMYSGKDGVSLPRFINEKKLQEDKNLWIPVEVDIVEILNQLFHCFDKNESLLEQIKDGKELNKLCNRNETAWESLIFAINMIQQIRNNGCTEQDENFLYSPVRNENGVHFDTRKQDNTKYPADADANGAYNIARKGIIMHEHIVQWKKDGSKKGDVDLFVSEEEWDLWLLDKNKWQEKLPYFASKSAKKKNEY

SEQ ID NO: 695 - protein, 1410 aa, unidentified
  REGION 1..1410: note = Description of Unknown:uncultivated organism sequence
  REGION 1..1410: note = Category: MG57 effectors
  REGION 1..1410: note = Description: MG57-5 effector
MEEFTNLYQLSKTLRFELKPVGKTAETFKQWLEELKNDELVVDNDGNLFAKDKSIKDAYLAIKPIMDRLHEQFIEMSLLSEEAKQIDFSDYFEKYQKNNVPEKLEGGLREIIGNTYKVAGNYLSEEISIVLGKEFKTKKDRPYECLTDAKMYNYLSAHVKDLAEQNGIDEEDLKKHIEQFKGFWGYLDGYNQNRENYYKVDKEASTAVATRIVHENLPTFCSNAIRFEKRKEEYLCIYRYLHDNSRETKIKNAKGEEIDVEAISDVIFQINHFNECLAQSQIEEYNRIIGNYNMLINLYNQLRCGEKDFKKVDEFEKLRKQIGCGKNKSMFETLQDDCDVKNLLRKASKAGKMMFGVASDNIEIKTVPDFIKFLRECDNWDGIYMSKTAIDKISSLYFANWHSIKDKLKESKADACITYEKKREEPIKLRDAVELSGLFAVLDSEQSEHFFKDSLFKDDDTNNYRGILNIDLKPSSNLINLLCFDIEQNIKAFLDESDNIVALEKYKDENNQAGEEDQTIKKLKEWFDAATSAMRIVRYFAVRKSKMKGNNIPNATMEQALSNLLYSDDVQWFKWYDLIRNYLTKKPQDDVKENMLKLNFGNETLMDGWDMNKEHDNSTVILRKNGKNGWYYLGIMDTKHKDVLDKEKVRTTGECYEKMDYKQIALHSGVGGFVRKCFGTAQNFGWRCPNNCLNEEGKIIIKDDEAQANLKEIIDCHKDFFDKYEKDGFKYKDFNFDFRESNKYGKLSEFYRDVEQQGYKITFRNVSVDYINDLVSEGKLYLFKINNKDFSPGKNGGKGSIGKPNLHTMYWRMLFDENNLKDVVFTLNGKSEIFMRKPVAKESPTKHSIGSKLVNKQYKDGDTKKTIPEKIYREIYSYANGETKDISAEAKKYIDEKKAIIKDVKHEIIKDNRFYGDDIEGTKYMFHCPITINFKANKYKDPKYAYPEVNKKITDSLQQSDNLQFIGIDRGEKHLVYSCTIDKNGRIIKDKCHHHDNINGTDYVQKLEAVADDRTIAKENWQAQRKIKDLRDGYISHVVHQLVEEAIKDDGKIAPHAYIVLEDLNTEMKRGRQKFEKQVYQNLETALAKKLNFVVDKDAKQGELGSESNALQLTPPINNYQDIEGKKQFGVMLYTRSNYTSVTDPATGWRKTIYIKNGKEEDIKKQILEKFSDFGFDGKDYYFEYTESNAGHLWRMYSGNNGEPLPRFLYKKQILKDKNNWVPERIDVVKILDKLFANFDKAKSFKSQIENGVELQKDEERNETAWQSLRFALDLIQQIRNSGEKDSEDDNFLFSPVRNDKGEHFDTHNYKNNAELSEIKDADANGAYNIARKGLIMDAHIKYWIEKGRPKISAKKDEKTSDLDLFISDREWDLWLLDKKLWKKELPTFASKSAKYDSDTPQTAKKRKKR

SEQ ID NO: 696 - protein, 1358 aa, unidentified
  REGION 1..1358: note = Description of Unknown:uncultivated organism sequence
  REGION 1..1358: note = Category: MG57 effectors
  REGION 1..1358: note = Description: MG57-6 effector
MEEKEKVQYSDFTNLYQLSKTLRFELKPIGKTKETFEGWLKENNSFNNEDNLFAQDKKIKDAYVVIKSIMDKLHEQFIEKSLTSEEAKNIDFSDFLDIYKYRGNDFPKDFEKKLREQIGNTYKVAGAYFSKEISEALNKEFKTKKPFECLTDAKMLNYLSANVKEIAEQNNIDQETLANHIEQFKGFWGYLSNYNKNRENYYTTDKEQSTAVATRIVHENLPTFCDNILRFEKSREGYLSICQYLKDNNREIKIKNAQGEETEAETITEAIFQIKHFNSCLAQSQIEEYNRIIGNYNFLINLYNQARREEKEFKKLDEFESLYKQIGCGEKKSLFESLHDDSDLKALLQKIKEAGDTFFKECCDETEISTVSAFIKFLKECDNWEGIYMSSAAVNKISNLYFTNWHSIKDKLKDNKACVTYDKNREEPIQLRDAVELSDLFKVLDDKEQSEHFFKESLSNDINEKECPSKNLINLLCFDIEQNISKFLANSENIINLLNGNKDNQASEEDKIKQIKEWLDAAIDTMRIVRYFAVRKSKMKGNLPNTTMEKALNNLLYNDDAQWFKWYDLVRNYLTKKPQDDAKENKLKLNFGNPSLLGGWSDGQEQTKAATLLKYNNELYLCILKIRNIFDTSKADNPIYTKAPFCACRLILRNLKFQTLAGKGFKSKYGIKYSEMGNEDQSQAIKCLKEIIRERYAKKYPPLEQIINQEYSDKKSFDNEVKEALKECYVCEFVPINWDVVSKKQNSTDLFLFKIHCKDYLPKATGKKDLQTMYWEDVLSDSSNHQLCGGAEIFMREPVPKESPVKHGVGSKLVNKRDKDGNTIPEQIYKEIYLFANDKVKKENLSAEAKNYIESEKVKIKEAKYEIVKDNRFYGETKYMFHCPITINFKAGSSSGVNEKITDALQQSDNLQFIGIDRGEKHLVYSCTIDKYGKIIKCNHHDNINGTDYVQKLEAVANERLIAKKNWQQQNRIKDLKSGYISHVVHRLVEETIKDDKTIAPHAYIVLEDLNSEMKRGRQKIEKQVYQNLELALAKKFNFVVDKTAKQGELGSVSMALQLTPPVTNYKDIEGKKRFGIMLYTRANYTSITDPATGWRKTIYIKNGKDEEIKAQIIDKFSNFGFYGKDYYFEYTEENAGHTWRMYSGKDGKPLPRFQNKKQMLQDKNIWVPEQINVKEILDKLFANFDKGRSFKEQVNEEVKLEKIEGRSETAWQSFRYVLNMIQQIRNSGIEKKDDNFLYSPVRNENGEHFDTRNPQNNGGLELIVDADANGAFNIARKGLIMDAHIKHWINSGRPKIKKDGKETSDLDLFISDREWDLWLLDREEWKKYLPVFASKSKKDAEKLPLQSPQKERRNNKY

SEQ ID NO: 697 - protein, 1353 aa, unidentified
  REGION 1..1353: note = Description of Unknown:uncultivated organism sequence
  REGION 1..1353: note = Category: MG57 effectors
  REGION 1..1353: note = Description: MG57-7 effector
MEEKEKVQYSDFTNLYQLSKTLRFELKPIGKTKETFEGWLKENNSFNNEDNLFAQDKKIKDAYVVIKSIMDKLHEQFIEKSLTSEEAKNIDFSDFLDIYKYRGNDFPKDFEKKLREQIGNTYKVAGAYFSKEISEALNKEFKTKKPFECLTDAKMLNYLSANVKEIAEQNNIDQETLANHIEQFKGFWGYLSNYNKNRENYYTTDKEQSTAVATRIVHENLPTFCDNILRFEKSREGYLSICQYLKDNNREIKIKNAQGEETEAETITEAIFQIKHFNSCLAQSQIEEYNRIIGNYNFLINLYNQARREEKEFKKLDEFESLYKQIGCGEKKSLFESLHDDSDLKALLQKIKEAGDTFFKECCDETEISTVSAFIKFLKECDNWEGIYMSSAAVNKISNLYFTNWHSIKDKLKDNKACVTYDKNREEPIQLRDAVELSDLFKVLDDKEQSEHFFKESLSNDINEKECPSKNLINLLCFDIEQNISKFLANSENIINLLNGNKDNQASEEDKIKQIKEWLDAAIDTMRIVRYFAVRKSKMKGNLPNTTMEKALNNLLYNDDAQWFKWYDLVRNYLTKKPQDDAKENKLKLNFGNPSLLGGWSDGQEQTKAATLLKYNNELYLCILKIRNIFDTSKADNPIYTKAPFCACRLILRNLKFQTLAGKGFKSKYGIKYSEMGNEDQSQAIKCLKEIIRERYAKKYPPLEQIINQEYSDKKSFDNEVKEALKECYVCEFVPINWDVVSKKQNSTDLFLFKIHCKDYLPKATGKKDLQTMYWEDVLSDSSNHQLCGGAEIFMREPVPKESPVKHAKGSKLVNKRDKDGNTIPEQIYREIYLYANDKKQDISTEAKKYITDKKVIIKDVKHEIIKDRRFYGETKYMFHCPITINFKAGSSSGVNEKITDALQQSDNLQFIGIDRGEKHLVYSCTIDKEGKIVKCNHHDNINGTDYVQKLEAVANERLIAKKNWQQQNRIKDLKSGYISHVVHRLVEETIKDDKTIAPHAYIVLEDLNSEMKRGRQKIEKQVYQNLELALAKKFNFVVDKTAKQGELGSVSMALQLTPPVTNYKDIEGKKRFGIMLYTRANYTSITDPTTGWRKTIYIKNGKDEEIRKQILEKFTDFGFAGKDYYFEYIEANAGHSWRMYSGKDGKPLPRFQNKKQLQNDKNIWVPEPVNVVEILNNIFEDFDKRSSFKDQVKNNVELKKVEGRNETAWQSLRYALNMIQQIRNSGVEKTDDNFLYSPVRNENGEHFDTRNPQNNGGLELIVDADANGAFNIARKGLIMDAHIKHWINSGRPKIKKDGKETPDLDLFISDREWDLWLLDREEWKKYLPVFASKSKKDADKTTSTKSPKRKKK

SEQ ID NO: 698 - protein, 1450 aa, unidentified
  REGION 1..1450: note = Description of Unknown:uncultivated organism sequence
  REGION 1..1450: note = Category: MG57 effectors
  REGION 1..1450: note = Description: MG57-8 effector
MEQFTNLYQLSKTLKFKLEPEGNTKTTFEKWVNEMNSTSEDSNLFAKDEKIRDAYLVIKPIMDKLHEQFIEKSLTSDEAKHIDFSEFLAEFRDKKKRRSKKIQKIEERLRKDIGATYNVGGRFFSAEIEKAVEKLKEEKNNGEESEKKSKDEETDNKRKKTPYDCLTEKKIFSYLCANAKTLAKENGITERILNKHLEQFKKFWGYLDGYNQNRENYYEVKEEAATAVATRIVHENLPTFCSNALRFEKHREEYLGIYQFLKDNNCEAKIKNSQGKEVEAEAITETCFLIGHFNNCLAQSQIEEYNRIIGNYNYLINLYNQAPHDEKDFKKIDEFEKLKKQIGCGKKKTMFAALIKDKQNELTDEQKKKENKEGDILTVETLLNRAKDAGDVMFVKDDNKDNDKAEIITIPDFIQFLEGCDNWDGIYMSKAAINKISNRYFANWHSIVDLFIEIYNGKDKELKEKINACITYDKKREEPLKLRDAVELSGFFAVLDKVKSEHFFKEWLFKEDNTNEYCGDKALSPSKNLIKLLCHDMKYYTEEVFLKKSSEIVALKKYKDEKTQAGKEDENIKKIKEWFDAAADAMSIVRFFAVRRSKMKGSLPNVTMEQALSNLLYSEDIQWFKWRDLIRNYLTKKPQDDVKENKLKLNFGNPTLMKGWDLNKEPDNTTVILRKNDWYYLGIMNKEYNHILDNVKTSSNGECYEKMDYKQISLSSGVGGFVRKCFSSAQEYGWHCPDNCLNEDGKIIIKDDEAQPHLKAIIDCYKDFFDKYKKDGFEYKDYNFNFLESNEYEKLSDFFRDVEQQGYKISFRKVSVNYIDNLVKEGKLYLFKIYSKDFSTGKDGGNGSTGNENLHTKYWKRLFDENNLKDVVYKLNGKSEIFMRKPIAKEARIKHKKGSKLVNKRDINGEIIPEHIYKEIYSYVNNNTKISKEAKIYIDEKKAIIKDAKHEIVKDNRFYGETNSYFFHCPITINFKAKKYKEPQYAYPEVNAKITDALQQSDNLQFIGIDRGEKHLVYSCTIDKNGKIVKDKNNEWKCHHHDIITVIRKDKDGKIVEHKTNYVQKLEAVAGERIIAKKNWQAQRKIKDLRNGYISHVVHRLVEEVIKEDNKRIAPHAYIVLEDLSTEMKRGRQKFEKQVYQNLEVALAKKLNFVVDKEAEQGELGSVSKALQLTPPISNYQDIEGKKQFGIMLYTRANYTSITDPATGWRKTIYIRNGKEEDIKKQILDKFNDFGLEGKDYFFEYREANAGRIWRMYSGKNGEPLTRFRNKREKLTDKNVWVTEPINVVEILDKLFADFDKTKSFKKQIEDDGIELKKIEGRSETAWQSLRYVLDMIQQIRNSGIEKKDDNFLHSPVRGENGEHFDTRNHENNGELSAIKDADANGAYNIARKGLIMNAHYRYWVNQGRPEIKKGKTALSLYVSDAEWDMWLLDKEKWHEHLCEFALRTK

SEQ ID NO: 699 - protein, 1435 aa, unidentified
  REGION 1..1435: note = Description of Unknown:uncultivated organism sequence
  REGION 1..1435: note = Category: MG57 effectors
  REGION 1..1435: note = Description: MG57-9 effector
MKEFTNLYQLSKTLRFELKPIGKTTKTFQRWLEEMNKAELVGDNDGNLFLKDKKIKNAYLAIKPIMDKLHEQLIEMSLLSEEAKQIDFSVYFEAYKNKAVKVEMENGFRKAFAKPFQYAGQCFIEKISKAQKNGKEIKTKKDKQYECLTDAKMYNYLSAHIKDLAEQNGIDEQELKKHLEQFKGFWGYLDGYNQNRENYYEVDKEASTAVATRIVHENLPTFCSNALRFEDRREEYLGIYQYLKDNNHETKIKDSKGAEIEAEAISEEIFQINYFNECLAQSQIDEYNRIIGNYNYLINLYKQARRSEKDFKKIDEFEKLKKQIGCGKKKLMFAALIKDKQSELTEDQKKMENDGGAILTVKTLLQKAKSAGDTMFNKGEDTEEIKTVPEFIQFLQGCDDWNGIYMSKSAIRKISNMYFANWHNIEDIFIDWYNGTDKEKKEMAKACITYDKNRENPLKLRDAVELSGLFAVMDKDEQSEHFFKDSLFDNEDTNDYRGVLDKELTPSKNLINLLCFDIEQNIKVFLNNSGKIVALEKYKDENNQEGEEDQTINDIKDWFDAATDAMRIVRYFAVRKSKMKGNIPNATMEQALSNLLYGEEEQWFNWYDQIRNYLTKKPQDDVKENMLKLNFGNETLMDGWDMNKEHDNSTVILRKDGFYYLGIMDTTHKDVLDKEKVRTTGECYEKMDYKQIALHSGVGGFVRKCFGTAQNFGWRCPNNCLNEEGKIIIKDDEAQANLKEIIDCHKDFFDKYEKDGFKYKDFNFDFRESNKYEKLSEFYRDVEQQSYKITFRNVSVDYINNLVSEGQLYLFKIYNKDFSTGKNGGNGSTGKPNLHTIYWRMLFDKNNLKDVVFTLNGKSEIFMRKPVAKESPTKHSIGSKLVNKRYKDGDTKKTIPEKIYREIYSYANGETKDISAEAQKYIDEKKAIIKDVKHEIIKDNRFYGDDIEGTKYMFHCPITINFKANKYKEPKYAYPEVNKKITDSLQQSANLQFIGIDRGEKHLVYSCIVDKDCKILKCGHHDVINGTDYVQKLEAVADERIIAKKNWQSQSRIKDLRDGYISHVVHSLVKETIKDDGKIAPHAYIVLEDLSTEMKRGRQKFEKQVYQNLETALAKKLNFVVDKEAKQGELGSVTKALQLTPPINNYQDIEGKKQFGVMLYTRANYTSVTDPATGWRKTIYIKDGKEEEIKKQFFEKFSKFGFDGKDYYFEYTEANAGHTWRMFSGKDGKPLPRFRNKKQKLEDKNIWVPEQINVVEILNKLFTKFDKTKSFKTQIENGVELQKVEGRSETAWQSLRYALDLIQQIRNSGEKNSRDDNFLYSPVRNDNGEHFDTRNYKNNGELSEIRDADANGAYNIARKGLIMDKHIKYWINNGRPKTKVDGNEVSDLDLFISDREWDLWLLDREQWMKELSTFASKIAKYDSDAPQTAKRRKKR

SEQ ID NO: 700 - protein, 1364 aa, unidentified
  REGION 1..1364: note = Description of Unknown:uncultivated organism sequence
  REGION 1..1364: note = Category: MG57 effectors
  REGION 1..1364: note = Description: MG57-10 effector
MKQFTDLYQVSKTLRFELQPIGKTAETFKQWLEDLKSTEAVVDNNNLFAKDQGIKDAYSIIKPIMDKLHEQFIEMSLLSEVAKEIDFSQYFEAYQERNVSERLEAELREQIGKTYIVAGHFFTKEISDAIGKDFKIKKDKPYECLTDAKMTYYLSAKSQELAKQNDIDEKKLAMHIEQFKGFWGYLTGFNQNRENYYEVKKETSTAVATRIVHENLPTFCDNILRFEKRKEEYLNIFQFLKDNERETKIKNAQGEEVEIEPIAETFFQIEYFNKCLSQSQIEEYNRIICNFNYLVNLYNQARRGEDGFKKIDEFETLYKQIGCGKKKTYFETLQDISELKNLLQKARIAGDSMFNKESSKTEINTVPEFIKFLQECDNWQGIYMSSAAINKISNLYFANWHSIKDKLKEAKANACITYDKKREEPIKLRDAVELSELFDVLNTEQSEHFFKDSLFKNDETNEYRGVLDKALKPSQNLIKLLCHDIKRNIEAFLEDSDKIVALEKFKDESNPSGEEDKAIKRIKDWLDAAIGAMRIVRYFAVRKSKMKGSIPNVTMEQALGNLLYCEEAPWFKWYDLVRNYLTKKPQDDAKENKMKLNFGTSSLLGGWSDGQEMNKAATLLKYEDEMYLCILKTKNVFDTSKKDNPIYNVASSNASRLILRNLKFQTLAGKGFLGEYKVSYGEMGQSDPVKAIQCLQKIIEDRYVKKYPLLEKFVVNRYDDKSQFDKEIKEALNECYVCEFVPIDWNLVTEKQNNTELFLFKIHSKDYKSNATGKRDLQTMYWEDVLSDGSKHQLCAGAEIFMRKPVAKESPVRHRVGSKIVNKRDKDGNTIPEQIYREIYAYANGKTKDISTEAQKYINEKRAIIKDVKHDIDKDKRFYGETKFMFHCPIKLHFEAKDPKYAFAEVNAKITESLHQSNNLNYIGIDRGEKHLVYSCTIDQDGKILKCNHHDNINGTDYVQKLEAVADERIIAKKNWQAQNRIKDLKNGYISHVVHRLVEETIKDGGIISPHAYIVLEDLNTEMKRGRQKIEKQVYQNLELALAKKFNFVVDKNAEPGGLGSVSQALQLTPPVSNYQDIEGKKQFGVMLYTRANYTSITDPATGWRKTIYIKNGKEEDIRNEILDKFRDFGFDGKDYFFEYVEVHAGHTWRMYSGKDGKPLPRFQNNKQMIDDKNVWVPEQINVVDILDLLFAKFDKSKSFKKQIDQGVELTKIDGRSETAWQSLRYALNMIQQIRNSGLKNEDDNFLFSPVRNNKGEHFDTRNHQNNGELSLIVDADANGAFNIARKGLIMDAHIKHWIEIGRPMKSARRDERTSDLDLFISDKEWDLWLLNREAWEKELPLFSSRAAKEDFSKPKTGKSRKKK

SEQ ID NO: 701 - protein, 1414 aa, unidentified
  REGION 1..1414: note = Description of Unknown:uncultivated organism sequence
  REGION 1..1414: note = Category: MG57 effectors
  REGION 1..1414: note = Description: MG57-11 effector
MKTFNDLTGLYSLSKTLRFELKPVGKTEETFKQWLEEMPNDKIVVDNDGNLFQKDKKIKDAYLAIKPIMDRLHEQFIEMSLLSEKAKQIDFSEYFVRFIDKDISSDLEKKLRREIGGTYQVAGECISKEITNACVKESKNKKVKDFKTKKGKEYQCLTDAKILDYLSANARILAEQNGIDEKTLEKHINQLKGFWGYLTGYNQNRENYYEVEKEASTAVATRIVHENLPTFCSNISRFEKRKDEYVGIYQYLADNNRERKIKNSKGEEVDAEAISENVFQIGYFNECLAQSQIEEYNRIIGNYNMLINLYNQARRSEKDFKKIEEFEKLYKQIGCGVKKTMFETLQNESDVKSLLEKASEAGNAMFKTCSNSLEIKTVPDFISFLKECDNWDGIYMSKTAISKISNLYFANWHSIKDKLKEAKADACITYDKNREEPIKLRDAVELSGLFAVMDSERPEYTFKESLFKNDKTNDYRGVLDKELSSSQNLIRLLCSDIERNINDFLKDSNSIVALETYKNINSQADEENQTIKQIKDWFDAATDAMRIVRYFAVRKSKMKGKNLPNVTMEQALSNLLYSDEAQWFKWYDLIRNYLTKKPQDDAKENKLKLNFDSSSFLKESGWDNDYLKHGAFIVIKGNDYYLVVVNDKLEEDDINQLKTSSNNTAKRLVYKQQKMDFKNFPRWFIFSKGDNLAPAVEKYKLPIETILTDYKKYRELSQKGKESFIEEHPKFRSNLIAYFKKCALVHESLMPFKDMLEMVWRKTDEYKTLSDFYNDTINACYEITFEDIDFDKLRSMDKFYIFQIYNKDFSTGQNGGNGTTGKPNMHTIYWKMLFDEINLKNVVFKLDGQGAELFKRKPIGKESLVKHGLGFKLVNKRDKEGNTIPEQIYREIYMYVNDKKEVISVEAQKYIDEQKVIIKDVKHEIIKDKRFFGETKYLFHCPITINFKAKSANEPEVNSKILNVLHQLDNLHFIGIDRGEKHLVYSCTIDKDGKIIKCNHHDNINGTDYVQKLEAVADERIIAKKNWQEQNKIKDLKSGYISHVVHRLVEETIKDDGKIAPHAYIVLEDLNTEMKRGRQKIEKQVYQNLETALAKKLNFVVDKNAKQGELGSVSKALQLTPPISNYQDIENKKQFGVMLYTRANYTSVTDPATGWRKTIYVKNGKEEDIKNQILEKFDDFGFDGKDYYFEYTEAHVGRTWRLYSGKNGEALPRFQNRKQLLQDKNIWVPESINVVEILDKLFVDFDKSKSFKLQIKKGVELKKIEGKSETAWQSLRYALDLIQQIRNSGEKNSIDDNFLYSPVRNINGEHFDTRNHEGNGDLSKIVDADANGAYNIARKGLIMDAHIKHWIESGSPAKKGEKSPDLDLFISDKEWDMWLLNRDLWKKELPIFASRNAKEDAVKSNIGIRRAKKK

SEQ ID NO: 702 - protein, 1365 aa, unidentified
  REGION 1..1365: note = Description of Unknown:uncultivated organism sequence
  REGION 1..1365: note = Category: MG57 effectors
  REGION 1..1365: note = Description: MG57-12 effector
MKTLNDFTGLYSLSKTLRFELKPVGKTEETFKQWLEEMQSKEIVVDNDGNLFLKDKKIKDAYLAIKPIMDKLHEQFIEMSLLSEKANQIDFSEYFIKFRDKNVSSDLEKNLRSKIGDTYQVAGECISEEITNACKKEFKTKKGKEYQCLTDAKMLDYLSANVKDLAEQNGIDKQTLDNHIKQFKGFWGYLDGYNQNRENYYVVDKEASTAVATRIVHENLPTFCSNILRFEKREDEYVGIYQYLKGINRERKIKNSKGEEVDVEAISENVFQIEHFNECLAQSQIEEYNRIIGNYNMLINLYKQARRGEKDFKKIEEFEKLYKQIGCGEKETMFETLQNESDVKNLLEKASEAGKEMFKTCSKSLEIKTVPDFITFLKECDNWDGIYMSKTAISKISNLYFANWHSIKDKLKEAKKDACITYDKNREEPIKLRDAVELSGLFDVLDSERPEYTFKESLFKDDETNEYRDVLDKDRSSSQNLIRLLCFDIERNIRSFLNASDSIVALKKYKNINSQADEESQTIKQIKEWFDAATDAMRIVRYFAVRKSKMKGNMPNVTMEQALNNLLYSDEARWFKWYDLIRNYLTKKPQDDAKENKLKLNFGTSSLLGGWSDGQEKTKAATLLKFENELYLCILKTKNIFDTSKNNNPIYTTQSNASRLILRNLKFQTLAGKGFLGENGISYGDMGNDNPVKAIQCLQKIIKERYVKKYPLLEKFVVNKYTDKSKFDAEINETLKECYVCEFMPIDWSLVIEKQNNAELFLFKIHCKDYLSNAIGKKDLQTMYWEDVLSDGSKHQLCAGAEIFMRKPVAKESPIKHSVGSKLVNKRDKDGNTIPEQIYKEIYLYANGKTKDISAEAQRYIFEQKAVIKDVKHEIIKDKRFYGEAKYMFHCPIKLQFEAKDPKYVLPEVNRIITDALQQSNNLNFIGIDRGEKHLVYSCTIDKDGKIKECNHHDNINGTDYVQKLEAVADARVIAKKNWQEQNKIKDLKSGYISHVVHRLVEETIKDNDKIAPHAYIVLEDLNTEMKRGRQKIEKQVYQNLETALAKKLNFVVDKNAKQGELGSVSKALQLTPPINNYQDIENKKQFGVMLYTRANYTSVTDPATGWRKTIYIKNGKEEDIKSQILDKFDDFGFDGKDYYFEYTESNTGHTWRMYSGKNGKSLPRFQNRKQMMQDKNIWVSESIDVVEILNQLFSDFDKGKSFKEQIGQGVDLKKIEGRSEPAWQSLRYALDLIQQIRNSGLEKKDDNFLFSPVRNETGEHFDTRKHANNGGLSKIEDADANGAYNIARKGLIMDAHIKHWIERGRPTMKGEKTPDLDLFISDKEWDLWLLDREQWEKELHIFASRSEKEGEDNSLVAKKRKKKI

SEQ ID NO: 703 - protein, 1365 aa, unidentified
  REGION 1..1365: note = Description of Unknown:uncultivated organism sequence
  REGION 1..1365: note = Category: MG57 effectors
  REGION 1..1365: note = Description: MG57-13 effector
MKTLNEFTGLYSLSKTLRFELKPVGKTEETFKQWLEEMQSNEIVVDNDGNLFLKDKKIKDAYLAIKPIMDKLHEQFIEMSLLSEKAKHIDFSEYFTKFRDKNVSSDLEKNLRSKIGDTYQVAGECISEEITNVCEKEFKTKKGKEYQCLTDAKMLDYLSTNVKDLAEQNGIDEQTLANHIKQFKGFWGYLDGYNQNRENYYVVDKEASTAVATRIVHENLPTFCSNILRFEKREDEYVGIYQYLKGINRERKIKNSKGEEVDVEAISENVFQIEHFNECLAQSQIEEYNRIIGNYNMLINLYNQARRDEKDFKKIEEFEKLYKQIGCGEKETMFETLQNESDVKNLLEKASKAGEAMFRTSNNSLEIKTMPDFITFLKKCDDWDGIYMSKTAISKISNLYFANWHSIKDKLKEAKKDACITYDKNREEPIKLRDAVELSGLFDVLDSERPEYTFKESLFKDDETNEYRDVLDKDRSSSQNLIRLLCFDIERNIRSFLNASDSIVALEKYKDENNQIGEENQTIKQIKDWFDAAIDAMRIVRYFAVRKSKMKGNMPNVTMEQALNNLLYSDEARWFKWYDLIRNYLTKKPQDDAKENKLKLNFGTSSLLGGWSDGQEKTKAATLLKFENELYLCILKTKNIFDTSKNNNPIYTTQSNASRLILRNLKFQTLAGKGFLGENGISYGDMGNDNPVKAIQCLQKIIKERYVKKYPLLEKFVVNKYTDKSKFDAEINETLKECYVCEFMPIDWSLVIEKQNNAELFLFKIHCKDYLSNAIGKKDLQTMYWEDVLSDGSKHQLCAGAEIFMRKPVAKESPIKHSVGSKLVNKRDKDGNTIPEQIYKEIYLYANGKTKDISAEAQRYIFEQKAVIKDVKHEIIKDKRFYGEAKYMFHCPIKLQFEAKDPKYVLPEVNRIITDALQHSNNLHFIGIDRGEKHLVYSCTIDKDGKIIKCNHHDNINGTDYVQKLEAVADARVIAKKNWQEQNKIKDLKSGYISHVVHRLVEETIKDNDKIAPHAYIVLEDLNTEMKRGRQKIEKQVYQNLETALAKKLNFVVDKNAKQGELGSVSKALQLTPPINNYQDIENKKQFGVMLYTRANYTSVTDPATGWRKTIYIKNGKEEDIKSQILDKFDDFGFDGKDYYFEYTESNTGHTWRMYSGKNGKSLPRFQNRKQMMQDKNIWVPESIDVVEILNQLFSDFDKGKSFKEQIGQGVDLKKIEGRSEPAWQSLRYALDLIQQIRNSGLEKKDDNFLFSPVRNETGEHFDTRKHANNGGLSKIEDADANGAYNIARKGLIMDAHIKHWIERGRPTMKGEKTPDLDLFISDKEWDLWLLDREQWEKELHIFASRSAKEGEDNSLVAKKRKKKI

SEQ ID NO: 704 - protein, 1401 aa, unidentified
  REGION 1..1401: note = Description of Unknown:uncultivated organism sequence
  REGION 1..1401: note = Category: MG57 effectors
  REGION 1..1401: note = Description: MG57-14 effector
MKTLTNLYQVSKTLRFELQPIGKTSETFKQWLEDMNMNELVVDNDGNLFAKDKNIKEAYLAIKPIMDRLHEQLIEMSLLSEEAKQIDFSDYFEAYKNKAVKAEMEKGLRKAFAKPFQFAGQCFIDMISNDPKVGIEIKTKKDKQYECLTDAKMYNYLLANVKDLAEQNGIAEQKLAKHIEQFKGFWGYLDGYNQNRENYYEVDKETSTAVATRIVHENLPTFCSNILRFEKRLEEYLSIYQYLKDNNRETKIKDSKGEEIDVEAISDDIFQIKHFNECLAQSQIEEYNRIVGNYNMLINIYNQLRRSEKDFKKVDEFETLYKQIGCGKKKSMFETLQGDSDVKELLRKASEAGKQMFKDATDTIEIKTLPDFIKFLKECDNWDGIYMSKTAIDKISSLYFANWHSIKDKLKEAKADACITYDKKREDPIKLRDAVELSGLFAVLDTEQSEHFFKDSLFKDDESNDYRGVLDKALMPSKNLINLLCFDIEQNTKAFLNESNNIVALEKYKDENNQARVEDKTIKQIKDWFDAATDAMRIVRYFAVRKSKMKGNIPNTTMEQALSNLLYCDEARWFKWYDLIRNYLTKKPQDDAKENMLKLNFDNSTLMEGWDINKEHDNTTVILRKKGLYYLGIINKKYNNILDKDNAISDGECYEKMDYKQIALPMGVGAFVRKCFGTAQNFGWCCPQNCLNEEGKIIIKDDEAQPNLKAIVDCYKDFFDKYEKDGFKYKDFNFRFLESDKYKKLSEFFREVEPQGYKIAFRNVSVDYIEDLVENGKLYLFNIYNKDFEDKATGTPNLHTIYWKMLFDENNLKDVVYKLNGKAEVFMRNPVAKESPIKHSIGSKLVNKRDKDGNSIPEQIYREIYLYANGKTKAISVEAKKYIDEQKVVIKDVKHEIIKDKRFYGETKYMFHCPITINFKAKSSSGSEVNAKITDALQQSKNLNFIGIDRGEKHLVYSCTIDNDGKIIKGKCHDHDIISVIIKDKDGKDITHKTNYVQKLEAVADERIIAKKNWQAQNKIKDLKNGYISHVVHHLVEETIKVDGNISPHAYIVLEDLNTEMKRGRQKIEKQVYQNLELALAKKLNFVVDKNAKQGELGSVFQALQLTPPINNYQDIEGKKQFGVMLYTRANYTSVTDPATGWRKTIYIKNGKEEDIRKEILSKFDDFGFDGQDYFFEYTEANAGHIWRLYSGKNGKALPRFQNKKQMLQDKNVWVPEIINVVEILDNLFADFDKAKSFKKQIENGVELRKIEGRNETAWQSLRFALDIIQQIRNSGEKNSKDDNFLYSPVRKNGEHFDTRNYEYNGELSEIRDADANGAYNIARKGLIMDAHIKYWIDKGRPMMSSKKDKKTSDLDLFISDKEWDLWLLDKNQWRKELPTFASRSAKEGNTESKTGKRKKK

SEQ ID NO: 705 - protein, 1407 aa, unidentified
  REGION 1..1407: note = Description of Unknown:uncultivated organism sequence
  REGION 1..1407: note = Category: MG57 effectors
  REGION 1..1407: note = Description: MG57-15 effector
MNDLKQFTGLYSLSKTLRFELKPVGKTKETFKRWLDELKNTELVVDDGGNLFLKDKQIKDAYLAIKPIMDKLHDQFIEMSLLSKEARNIDFSDYYTAFKDRSKGLNDIEKKLRENIGATYNVAGNYFSAEISKALGKEFKIKKDKSYECLTDAKMYYYLSANIKDLAEQNNIEEQALAQYIEKFKGFWGYLDGYNQNRENYYEFGNEASTAVATRIVHENLPTFCSNVFRFEKRKEEYLDIYQYLKDNNRETRIKDSQGKEVEVEAISEIVFQIKHFNECLAQSQIEEYNRIIGNYNMLINIYNQLRSSDKDFKRIDEFETLYKQIGCGERKAMFETLQDDSDVKNLLKRASDAGSEMFNTYSDSSEIKTVLDFIKFLRGCDNWDGIYMSKTAISKISNLYFANWHSIKDKLKEAKASACITYEKNLEDPIKLRDAVELSGLFAVFDTEQSEHFFKESLFKDDETNEYRGVLDKALTPSKNLIRLLCFDIERNIKFFLQKSVEIVALEKYKDENNYAGDEDQTIRIIKDWLDAATDAMRIVRYFAVRKNKMKGNLPNTTMEQALGNLLYNDDAQWFKWYDLIRNYLTKKPQDDVKENKLKLNFDSSSFLKESGWDNDYSKSGAFIVIHDNAYYLVVLNNKLEEREINKLKTLSNNSAQRIVYKQQKMDFKNFPRLFIFSKGDNLAPAVNKYNLPIATIIDDYKKYRNLNGKDKDAFIEEHPKFRYNLIEYFKKCAPLHESLSPFKDQFEKVWRKTEDYNTLSEFYKDTANACYEISFENIDFQQLCSMDKCWLFQIYNKDFSIGKDGCNGSTGKPNLHTIYWKMLFDETNLKNVIFKLDGQGAEIFMREPVPKESPTKHPVGSKIVNKRDNDGNTIPEHIFREIYLYANGKTKDISNVARKYIGEGKAVIKDVKHEIIKDKRFYGEPKYIFHCPITINFKSKSANESEINSKITNALQQSDNLQFIGIDRGEKHLVYSCTIDKNCKIIKCDHHDNINGTNYVQKLEGVADDRIIAKKNWQAQSKIKDLRDGYISHVVHRLVDETIKDGDSIAPHAYIVLEDLNTEMKRGRQKFEKQVYQNLETALAKKLNFVVDKNAKQGELGSVSKALQLTPPINNYQDIEGRKQFGVMLYTRANYTSVTDPATGWRKTIYIKNGKEEDIKEQILDKFSDFGFDGKDYYFEYTESNVGHTWRLYSGNNGEPLPRFQNKKQMQQDKNVWVPEKNNVVEILDKLFVNFDKSKSFKAQIENGVELQKAEGRSETSWQSLRYALDLIQQIRNSGEKNSKDDNFLYSPVRDDKGEHFDSRHPERNGELSEIKDADANGAYNIARKGLIMDAHIKYWIEKGRPTMKKDGKEISDLDLFISDKEWDLWLLDRDQWKNTLPTFALRNAKEGDAKPPKRKGGKKK

SEQ ID NO: 706 - protein, 1391 aa, unidentified
  REGION 1..1391: note = Description of Unknown:uncultivated organism sequence
  REGION 1..1391: note = Category: MG57 effectors
  REGION 1..1391: note = Description: MG57-16 effector
MNNTDALTNLYSLSKTLRFELQPIGKTKETFDDWLKEMNGDNPVVDNDSNLFVKDQGIKDAYMAIKPIMDKLHERFIEKSLTSEESKRIDFSEYFARFKDKSKDITNELEKGLRERIGETYIVAGNYFSEEIDKATKKLQEEQPKGKSRKQKENGTKPQKAKKKKPFECLTDAQMLNYLYANVAELAKENNIDEKVLANHIKKFQGFWGYLSGYNTNRENYYTTDTEQSTAVATRIVNDNLPTFCTNVLRFEKCRDEYLGMYQYLKDHNRETKIKKPQGELVEAETIKETFFQIEHFNECLSQQQIEEYNRVIGNCNLLINLYNQSSRDEKDFKKVDEFETLYKQIGCGKKKSMFAALIKDKQSELSEEQKKEENEENAIYSVETLLRKAQKAGDKMFGNGKNESSINTLPAFIHFLKDCDNWNGIYMSSTAVNKISNRYFANWHSIEDKLKEAKADACITYNKNREEQIRLRDAVELSGLFAVLDTEQSEHLFKQSLFKEEATNDYRGVLDTTLTPSKNLINLLCFDMERNMKAFLEISDSINALKKYKDDNTSSGEENQAIKLIKEWFDAATHAMRIVRFFAVRKSKMKGNLPNVTMEQALSNLLYSDDAQWFMWYDLVRNYLTKKPQDDVKENKLKLNFDNPILLGGWSDGQEKVKSATLLKYMNEMYLCILKTRNIFDTSKENPIYIEHSDASRLILRNLKFQTLAGKGFKGENGITYGEMGKSDPQKAIQCLQKIIAERYVSKYPLLEEYVSNAYTDKSKFDAAITETLKQCYVCEFEPIDWNLVVEKQNNGELFLFKIHCKDYMPKVSGKKDLQTLYWEDVLSEGSKHQLCAGAEIFMRKPVAKAPRKKHSVGSKLVNKKDSDGNTIPERIYSEIYLYVNSKTESISAEAQRYIDEQKAVIKDVKHEIIKDKRFYGETKFMFHCPVKLNYESKGYKGPNYAYPEVNTAIRESLQQSDNLQFIGIDRGEKHLVYSCTLDKDCNIIACHDHDNINGTDYVQKLEDVANERIIAKKNWQAEDKIKDLKSGYISHVVHRLVEEVIKDGNTIEPHAYIVLEDLNTEMKRGRQKIEKQVYQNLETALAKKLNFVVDKDAQPNELGSVGKALQLTPPISNYQDIEGKKQFGVMLYTRANYTSVTDPATGWRKTIYLKNGKEEEIKKQVLEKFSDLGFDGRDYFFEYTEAHAGHTWRLYSGKDGQPLPRFQNKKQLQQDKNIWVPEQVNVVEILDNLFAHFDKTKSFKQQIEQGVELVKIERRKEIAWQSLRYALDLIQQIRNTGTEQKDDNFLYSPVRNSKGEHFDTRNHANNGKLSAIKDADANGAYNIARKGLIMDAHIKYWMACGQPSRKNTLDLFVSDKEWDLWLLDRKGWEQELPAFALRNANESKD

SEQ ID NO: 707 - protein, 1406 aa, unidentified
  REGION 1..1406: note = Description of Unknown:uncultivated organism sequence
  REGION 1..1406: note = Category: MG57 effectors
  REGION 1..1406: note = Description: MG57-17 effector
MTQFTNLYQISKTLRFELKPVGKTKETFKQWFEELKNAELIVDNDGNLFLKDKNIKEAYLTIKPIMDRLHEQFIEMSLLSEEAKQIDFSEYFEKYQAKSVSEKLEKGLREKIGNTYIVAGKYLSNEIGIVLDKELNTKKGKPYDCLTDAKMYNYLSANVKVLAEQNGIDEQVLDKHIKQFKGFWGYLTGYNHNRKNYYEVDKEATTAIATRIVHENLPIFCCNIMRFVKRREEYISIYQYLKEHNRETKIKDSKGNDMDVEAISEEVFQINHFNECLAQSQIEEYNRIISNYNMLINLYNQLRRSEKDFKKIDELETLYKQIGCGKKRTMFETLQDDSDVKRLLQKVSKAGDEMFRVRSNSLEIKTVPDFITFLKDCDNWDGIYMSKAAISKISNIYFANWHSIKDKLKRAKANSCITYDKNREEQIKLRDAVELSELFAVVDTEQTEHFFKESLFKDSDTNEYRGVIDKKITPSKNLIKLLCYDIERNKKVFLEKTDEIVTLKKYKEENNQTSEEDQTIKTIKDWFDAVTDAMRIVRYFSVRKSKMKGNLPNATMEQALSNLLYSDNAQWFKWYDLIRNYLTKKPQDDAKENKLKLNFDSSSFLRESGWDNDYSKNGAFIVIKDNDYYLVVIKEKLEEEDINKLKNLSDNSAKRVVYKQQKMDFKNFPRLFVFSKGDNLAPAVSKYNLPIDTIFDDYRKYRNLKGKEKDVFIEEHPKFRYNLIEYFKKCAPLHESLSSFKDKFEEVWKRTEDYNSLSEFYKDTANACYELSFEHINFEELCSSDKCHLFQIYNKDFSIGENGGNGSIGKPNLHTIYWNMLFDETNLKDVIFKLDGQGAEIFMREPVAKESPTKHPIGSKLVNKRDKDGNTIPAQLYREIYLYVNGKAKIISKEAQEYLDNEKVVIKEVKHEIIKDNRFYGDSAKYMFHCPITINFKAQPGNESEVNSIITNALQQSDNLNIIGIDRGEKHLVYSCTIDRNGKIIKGKCHHYDNINGTNYVQKLEAVADERIIAKKNWQAQDKIKDLKNGYISHVVHRLVKEAIKDGDIIDPHAYIVLEDLNAEMKRGRQKIEKQVYQNLETALAKKLNFVVDKNVTQCELGSARKALQLTPPISNYQDIEGKKQFGIMLYTRANYTSVTDPATGWRKTIYIKNGRDEEIKKQILDRFIDFGFDGKDYYFKYTEDNVGHTWQMYSGKNGEPLSRFQNRKQILKDKNIWVPEQVNVIKILDKLFAEFDKSESFKAQINNGSELQKDDERNETAWQSLRYALDMIQQIRNSGEKNSENDNFLCSPVRNNNGEHFDTRRHEKNGELSEIIDADANGAFNIARKGLIMDAHIKYWIGNGRPTTKRDGKVISDLDLFISDKEWDMWLLDRAQWVKQLPSFASRNVKDSNENPPTAKRGKKS

SEQ ID NO: 708 - protein, 1406 aa, unidentified
  REGION 1..1406: note = Description of Unknown:uncultivated organism sequence
  REGION 1..1406: note = Category: MG57 effectors
  REGION 1..1406: note = Description: MG57-18 effector
MTQFTNLYQISKTLRFELKPVGKTKETFKQWFEELKNAELIVDNDGNLFLKDKNIKEAYLTIKPIMDRLHEQFIEMSLLSEEAKQIDFSEYFEKYQAKSVSEKLEKGLREKIGNTYIVAGKYLSNEIGIVLDKELNTKKGKPYDCLTDAKMYNYLSANVKVLAEQNGIDEQVLDKHIKQFKGFWGYLTGYNHNRKNYYEVDKEATTAIATRIVHENLPIFCCNIMRFVKRREEYISIYQYLKEHNRETKIKDSKGNDMDVEAISEEVFQINHFNECLAQSQIEEYNRIISNYNMLINLYNQLRRSEKDFKKIDELETLYKQIGCGKKRTMFETLQDDSDVKRLLQKVSKAGDEMFRVRSNSLEIKTVPDFITFLKDCDNWDGIYMSKAAISKISNIYFANWHSIKDKLKRAKANSCITYDKNREEQIKLRDAVELSELFAVVDTEQTEHFFKESLFKDSDTNEYRGVIDKKITPSKNLIKLLCYDIERNKKVFLEKTDEIVTLKKYKEENNQTSEEDQTIKTIKDWFDAVTDAMRIVRYFSVRKSKMKGNLPNATMEQALSNLLYSDNAQWFKWYDLIRNYLTKKPQDDAKENKLKLNFDSSSFLRESGWDNDYSKNGAFIVIKDNDYYLVVIKEKLEEEDINKLKNLSDNSAKRVVYKQQKMNFKNFPRLFVFSKGDNLAPAVSKYNLPIDTIIDDYRKYRNLKGKEKDVFIEEHPKFRYNLIEYFKKCAPLHESLSSFKDKFEEVWKRTEDYNSLSEFYKDTANACYELSFEHINFEELCSSDKCHLFQIYNKDFSIGENGGNGSIGKPNLHTIYWNMLFDETNLKDVIFKLDGQGAEIFMREPVAKESPTQHPIGSKLVNKRDKDGNTIPAQLYREIYLYVNGKTKIISKEAQEYLDNEKVVIKEVKHEIIKDNRFYGDSAKYMFHCPITINFKAQPGNESEVNSIITNALQQSDNLKFIGIDRGEKHLVYSCTIDRNGKIIKGKCHHYDNINGTNYVQKLEAVADERIIAKKNWQAQDKIKDLKNGYISHVVHRLVKEAIKDGDIIDPHAYIVLEDLNAEMKRGRQKIEKQVYQNLETALAKKLNFVVDKNVTQCELGSVRKALQLTPPISNYQDIEGKKQFGIMLYTRANYTSVTDPATGWRKTIYIKNGRDEEIKKQILDRFIDFGFDGKDYYFKYTEDNVGHTWQMYSGKNGEPLSRFQNRKQILKDKNIWVPEQVNVIKILDKLFAEFDKSESFKAQINNGSELQKDDERNETAWQSLRYALDMIQQIRNSGEKNSENDNFLCSPVRNNNGEHFDTRRHEKNGELSEIIDADANGAFNIARKGLIMDAHIKYWIGNGRPTTKRDGKVISDLDLFISDKEWDMWLLDRAQWVKQLPSFASKNVKDGNENPPTAKRGKKS

SEQ ID NO: 709 - protein, 1401 aa, unidentified; identical to SEQ ID NO: 704
  REGION 1..1401: note = Description of Unknown:uncultivated organism sequence
  REGION 1..1401: note = Category: MG57 effectors
  REGION 1..1401: note = Description: MG57-19 effector

SEQ ID NO: 710 - protein, 431 aa, unidentified
  REGION 1..431: note = Description of Unknown:uncultivated organism sequence
  REGION 1..431: note = Category: MG57 effectors
  REGION 1..431: note = Description: MG57-20 effector
MKTKTITIMKEKEQYSDFTNLYQLSKTLRFELKPVGKTAETFKQWLSEMNNSDKEENLFAKDKKIKNAYMVIKPIIDKLHERFIEKSLTSKEAKEIDFSPYFEAYKQKNVLDTFEEGLRKKIGETYTVAGGFQYLTDKRILNYLSDNVQELAKQNGIDEKTLANHIEQFKGFGGYLSGYNQNRMNYYTTKEEQSTAVATRIVHENLPTFCDNILRFEKSREGYLSICQYLKDNNREIKIKNAQGEETEAETITEAIFQIKHFNSCLAQSQIEEYNRIIGNYNFLINLYNQARREEKEFKKLDEFESLYKQIGCGEKKSLFESLHDDSDLKALLQKIKEAGDTFFKECCDETEISTVSAFIKFLKECDNWEGIYMSSAAVNKISNLYFTNWHSIKDKLKESNANACITYDKDREEPVKLRDAMGGKTKSKIM

SEQ ID NO: 711 - protein, 1406 aa, unidentified
  REGION 1..1406: note = Description of Unknown:uncultivated organism sequence
  REGION 1..1406: note = Category: MG57 effectors
  REGION 1..1406: note = Description: MG57-21 effector
MKTFNDLTGLYSLSKTLRFELKPVGKTEETFKRWLEEMQNNEKVIDNDSNLFLKDKNIKDAYLAIKPIMDRLHEQFIEMSLLSEKAKQIDFSEYFIKFKDKNISSDLEKKLRREIGDTYQVAGECISEEITNACGKEFKIKKGKEYQCLTDAKILDYLSANVKNLAKFNCIDEKTLDKHINQLKGFWGYLTGYNQNRENYYEVEKEASTAVATRIVHENLPTFCSNILRLEKRKDEYVGIYQYLADNNREIKIKNSKGEEVDAEAISENVFQIGYFNECLAQSQIEEYNRIIGNYNMLINLYNQARRSEKNFKKIEEFEKLYKQIGCGVKKTMFETLQNESDVKSLLEKASEAGNAMFKTCSNSLEIKTVPDFVSFLKECDNWDGIYMSKTAISKISNLYFANWHSIKDKLKETKAEACITYDKNREEPIKLRDAVELSGLFAVMDLERPEYTFKESLFKNDETNDYRGVLDKELSSSQNLIRLLCSDIERNINDFLKDSDSIVALETYKNINSQADEENQTIKQIKDWFDAATDAMRIVRYFAVRKSKMKGKNLPNVTMEQALSNLLYSDEAQWFKWYDLIRNYLTKKPQDDAKENKLKLNFDSSSFFKESGWDNDYLKHGAFIVIKGNDYYLVVVNDKLEEDDINQLKTSSNNTAKRLVYKQQKMDFKNFPRWFIFSKGDNLAPAVEKYKLPIETILKDYQKYRELSQKGKESFIEEHPKFRSNLIAYFKKCALVHESLMPFKDMLEMVWRKTDEYKTLSDFYNDTINACYEITFEDIDFDKLRSMDKFYIFQIYNKDFSTGQNGGNGTTGKPNMHTIYWKMLFDEINLKNVVFKLDGQGAEIFMRKPIGKESLVKHGLGFKLVNKRDKEGNTIPEQIYREIYMYVNDKKEVISVEAQKYIDEQKVIIKDVKHEIIKDKRFFGETKYLFHCPITINFKAKSANEPEVNSKILNVLHQLDNLHFIGIDRGEKHLVYSCTIDKDGKIIKCNHHDNINGTDYVQKLEAVADERIIAKKNWQEQNKIKDLKSGYISHVVHRLVEETIKDDGKIAPHAYIVLEDLNTEMKRGRQKIEKQVYQNLETALAKKLNFVVDKNAQQGELGSVSKALQLTPPISNYQDIENKKQFGVMLYTRANYTSVTDPATGWRKTIYVKNGKEEDVKNQILEKFDDFGFDGKDYYFEYTEAHVGRTWRLYSGKNGEPLPRFQNRKQLLQDKNIWVPESINVVEILDKLFVDFDKSKSFKLQIKQGVELKKIEGKSETAWQSLRYALDLIQQIRNSGEKKSIDDNFLYSPVRNINGEHFDTRNHEGNGDLSKIVDADANGAYNIARKGLIMDAHIRHWIESGRPAKKGEKSPDLDLFISDKEWDLWLLNRDQWKKELPIFASRNAKEDAVKSNTGIRRAKKK

SEQ ID NO: 712 - protein, 1372 aa, unidentified
  REGION 1..1372: note = Description of Unknown:uncultivated organism sequence
  REGION 1..1372: note = Category: MG57 effectors
  REGION 1..1372: note = Description: MG57-22 effector
MKTKTITIMKEKEQYSDFTNLYQLSKTLRFELKPVGKTAETFKQWLSEMNNSDKEENLFAKDKKIKNAYMVIKPIIDKLHERFIEKSLTSKEAKEIDFSPYFEAYKQKNVLDTFEEGLRKKIGETYTVAGGFQYLTDKRILNYLSANVEELAKQNGIDEKTLANHIEQFKGFGGYLSGYNQNRMNYYTTKEEQSTSVATRIVHENLPIFCDNILRFEKSREGYLSICQYLKGNNREIKIKNAQGEETEAETITEAIFQIKHFNSCLAQSQIEEYNRIIGNYNFLINLYNQARREEKEFKKLDEFESLYKQIGCGEKKSLFESLHDDSDLKALLQKIKEAGDTFFKECCDETEISTVSAFIKFLKECDNWEGIYMSSAAVNKISNLYFTNWHSIKDKLKESNANACITYDKDREEPVKLRDAVELSELFAVLNKESLEHLFKESLFKDNKLDTELTPSHNLINLLCSDVKQNIDYFWEHSEGITDLINDKNQSNEETQKIKQIKEWLDAAMNAMRIVRYFAVRKSKMKGNMPNVTIEQALSNLLYNDDAQWFKWYDLVRNYLTKKPQDDVKENKLKLNFGNSTLMNGWDMNKERDNTAVIIRRNNLYYLGIMDKNYNKILDADKIKSDDKSSYYEKMDYKQIALPTGVGGFVRKCFDTAQQYGWSCPKDCLNEDEKIIIKDDEARKNLTKIIDCYKDFFDKYEKDGFKYRNFNFRFLKSTEYEKLSDFFKDVERQRYMIKFRNISADYIDDLVNEGKLYLFQIYNKDFSTGRNERNGSKGKPNMHTIYWKTLFDETNLNDVVYKLNGQAEIFMREPVAKESPVKHGVGSKLVNKRDKDGNTIPEQIYKEIYLFANNKVKKENLSAEAKNYIESEKVKIKEAKYEIVKDNRFYGETKYMFHCPITINFKAGSSSGVNEKITDALQQSDNLQFIGIDRGEKHLVYSCTIDKEGKIVKCNHHDNINGTDYVQKLEAVANERLIAKKNWQQQNRIKDLKSGYISHVVHRLVEETIKDDKTIAPHAYIVLEDLNSEMKRGRQKIEKQVYQNLELALAKKFNFVVDKTAKQGELGSVSMALQLTPPVTNYKDIEGKKRFGIMLYTRANYTSITDPATGWRKTIYIKNGKDEEIKAQIIDKFSNFGFYGKDYYFEYTEENAGHTWRMYSGKDGKPLPRFQNKKQMLQDKNIWVPEQINVKEILDKLFANFDKGRSFKEQVNEEVKLEKIEGRSETAWQSFRYVLNMIQQIRNSGIEKKDDNFLYSPVRNENGEHFDTRNPQNNGGLELIVDADANGAFNIARKGLIMDAHIKHWINSGRPKIKKDGKETSDLDLFISDREWDLWLLDREEWKKYLPVFASKSKKDADKTTSTKSPKRKKK

SEQ ID NO: 713 - protein, 765 aa, unidentified
  REGION 1..765: note = Description of Unknown:uncultivated organism sequence
  REGION 1..765: note = Category: MG57 effectors
  REGION 1..765: note = Description: MG57-23 effector
MKRFTNLYQLSKTLKFKLEPMDNTADTFKDWLEEMERDVCTDENLFAKDKNIKKAYMAIKPIMDRLHEQFIEMSLLSEDAKQIDFSEYFEAYRKKPITPAMEKELRKAFAKPFQCAGRCFIEEISKAQKDGKEIKTKKDKQYECLIDAKIYNYLSANVKEIAEQNGIDELTLDRHIKQFKGFWGYLDGYNQNRENYYEVEKEASTAVATRIVHENLPTFCDNAIRFEKRKEDYLCIYQYLKDNSRETKIKNSKGEEIEVETISDEIFHIKHFNECLAQSQIEEYNRIIGNYNYMINLYNQLRRGEKDFKIIDEFEKLYKQIGCGRKKSMFAVLIKDKHNELKEDQKKAEEDGEVILTVQTLLQRAKSAGDMMFKKGKDTAEIKTVPEFIQFLQGCKDWNGIYMSSAAVNKISNLYFANWHSVKDRLKEAKASACITYDKYREEPIKLRDAVELSGLFAVLDEEQSEHLFKESLFKDDDTNEYRGVLNKALTSSQNLINLLCSDIERNIKVFQEKTADILALDKYKDENNQAGEEDENIKLIKEWFDAATDAMRVVRYFAVRKSKMKGNLPNVTIEQALSNLLYNDDVQWFKWYDLVRNYLTKKPQDYAKDNKLKLNFDSSSFLKENGWDNDYSKSGAFIVIKDNNYYLVVVKDKMEEDELIKLKSPSNNAAKRVIYKQQKMDFKNFPRWFIFSKGDNLAPAVEKYNLPIDTILDDYKVYRTLSGSEKDKFIEGHPRFRYNLIEYFKKCATLHESLSPFKDKFETI

SEQ ID NO: 714 - protein, 1372 aa, unidentified
  REGION 1..1372: note = Description of Unknown:uncultivated organism sequence
  REGION 1..1372: note = Category: MG57 effectors
  REGION 1..1372: note = Description: MG57-24 effector
MKTKTITIMKEKEQYSDFTNLYQLSKTLRFELKPVGKTAETFKQWLSEMNNSDKEENLFAKDKKIKNAYMVIKPIIDKLHERFIEKSLTSNKAKKIDFSPYIEAYKQKNVLDTFEEGLRKKIGETYTVAGGFQYLTDKRILNYLSANVEELAKQNGIDEKTLANHIEQFKGFGGYLSGYNQNRMNYYTTKEEQSTAVATRIVHENLPTFCDNILRFEKSREGYLSICQYLKDNNREIKIKNAQGEETEAETITEAIFQIKHFNSCLAQSQIEEYNRIIGNYNFLINLYNQARREEKEFKKLDEFESLYKQIGCGEKKSLFESLHDDSDLKALLQKIKEAGDTFFKECCDETEISTVSAFIKFLKECDNWEGIYMSSAAVNKISNLYFTNWHSIKDKLKESNANACITYDKDREEPVKLRDAVELSELFAVLNKESLEHLFKESLFKDNKLDTELTPSHNLINLLCSDVKQNIDYFWEHSEGITDLINDKNQSNEETQKIKQIKEWLDAAMNAMRIVRYFAVRKSKMKGNMPNVTIEQALSNLLYNDDAQWFKWYDLVRNYLTKKPQDDVKENKLKLNFGNSTLMNGWDMNKERDNTAVIIRRNNLYYLGIMDKNYNKILDADKIKSDDKSSYYEKMDYKQIALPTGVGGFVRKCFDTAQQYGWSCPKDCLNEDEKIIIKDDEARKNLTKIIDCYKDFFDKYEKDGFKYRNFNFRFLKSTEYEKLSDFFKDVERQRYMIKFRNISADYIDDLVNEGKLYLFQIYNKDFSTGRNERNGSKGKPNMHTIYWKTLFDETNLNDVVYKLNGQAEIFMREPIAENSPVKHGVGSKLVNKRDKDGNTIPEQIYKEIYLFANNKVKKENLSAEAKNYIESEKVKIKEAKYEIVKDNRFYGETKYMFHCPITINFKAGSSSGVNEKITDALQQSDNLQFIGIDRGEKHLVYSCTIDKYGKIIKCNHHDNINGTDYVQKLEAVANERLIAKKNWQQQNRIKDLKSGYISHVVHRLVEETIKDDKTIAPHAYIVLEDLNSEMKRGRQKIEKQVYQNLELALAKKFNFVVDKTAKQGELGSVSMALQLTPPVTNYKDIEGKKRFGIMLYTRANYTSITDPATGWRKTIYIKNGKDEEIKVQIIDKFSNFGFDEKDYYFEYTEENAGHTWRMYSGKDGKPLPRFQNKKQMLQDKNIWVPEQINVKEILDKLFANFDKGRSFKEQVNEEVKLEKIEGRSETAWQSLRYALNMIQQIRNSGVEKTDDNFLYSPVRNENGEHFDTRNHENNGDLSPIVDADANGAFNIARKGLIMDAHIKKWIKEGKPTTKEGDSKTPDLDLFISDREWDLWLLDREEWKKYLPVFASKSKKDADKTTSTKSPKRKKK

SEQ ID NO: 715 - protein, 431 aa, unidentified
  REGION 1..431: note = Description of Unknown:uncultivated organism sequence
  REGION 1..431: note = Category: MG57 effectors
  REGION 1..431: note = Description: MG57-25 effector
MKTKTITIMKEKEQYSDFTNLYQLSKTLRFELKPVGKTAETFKQWLSEMNNSDKEENLFAKDKKIKNAYMVIKPIIDKLHERFIEKSLTSKEAKEIDFSPYFEAYKQKNVLDTFEEGLRKKIGETYTVAGGFQYLTDKRILNYLSANVEELAKQNGIDEKTLANHIEQFKGFGGYLSGYNQNRMNYYTTKEEQSTAVATRIVHENLPTFCDNILRFEKSREGYLSICQYLKDNNREIKIKNAQGEETEAETITEAIFQIKHFNSCLAQSQIEEYNRIIGNYNFLINLYNQARREEKEFKKLDEFESLYKQIGCGEKKSLFESLHDDSDLKALLQKIKEAGDTFFKECCDETEISTVSAFIKFLKECDNWEGIYMSSAAVNKISNLYFTNWHSIKDKLKESNANACITYDKDREEPVKLRDAMGGKTKSKIM

SEQ ID NO: 716 - protein, 1366 aa, unidentified
  REGION 1..1366: note = Description of Unknown:uncultivated organism sequence
  REGION 1..1366: note = Category: MG57 effectors
  REGION 1..1366: note = Description: MG57-26 effector
MKQFTNLYQVSKTLRFELQPIGKTKETFKGWLEKIDTAIPDVDDENLFLRDKKIKEAYLAIKPIMDSIHEEFIEKSLSSKEAKNIDFSDYYSLFKEKKVSSEFEKRLRKKISDTYSIAGDYFISEIEKTIANQKRKSNKKAAVAEEEKITKRKSKKPFECLTDVKMLFYLSANVKRLAEQHEIDEETLSRYIQTFKGFWGYLDGYNQNRENYYESEKETSTAVATRIVNENLPTFCNNILRFEKREKEYLNVFQYLKNNNRETKIKNSLGEEEDVVPIRASIFKIEHFNECLTQSQIEEYNRVIGNYNLLINLYNQLRSEETEYREIDEFEKLRKQIGCGKKPTNFDMLHDDSELKELLQKAGEAGEKMFGTENKQAEISTLPQFVKFLKDCNNWEGIYMSKAAINIISSLYFANWHSIEDKLYEAKAKACITYDKNREEPIQLRDAVELSELFAVLDTELTEHIFKDSLFKKDETNEYQNVLDKTLSPSKNLINLLCCDIEQYTKSFLVKTDKILALEKFKNDTHANEENETVKIIREWFVAATNAMRIVRFFAVRKSKMKGKIPNVAMEHALDNLLYCDNVQWFKWYDLVRNYLTKKPQDDVKENKLKLNFGTSSLLDGWSDGQEKTKAATLLKYNNELYLCILKTKNIFDTSKEDNPVYQTNLSVASRLILRNLKFQTLAGKGFLSENDISYSEMGAANPSQAILCLQKIIKERYVSKYPQLEKFVLKSYTDKGKFDAEISDALKDCYVCEYMPIDWNVIIEKQNSEELFLFKICCKDIKPGTYGRKDLQTMYWEDVLSEGSNHQLCAGAEIFMREPISKESPVRHRVGSKLVNKRDQDGNTIPEHIYREIYSYANGRVNVLSAEAKVFAEKSIIKDAKYEIIKDKRFYGDTKFMFHCPIKLFFKAKDPSRVFSEVNTLVNDALQESTNLHFIGIDRGEKHLVYSCAIDKDARIVKCIHHDIINGTDYVQKLEAVADERIIAKKNWQEENKIKDLKKGYISHVVHRLVEETIKDDGMISPHAYIILEDLSTSMKRGRQKIEKQVYQNLEMALAKKLNFVVDKTASQGELGSVSMALQLTPPVNTYQDIEGKKQFGVMLYTRANYTSITDPATGWRKTIYIKDGKEDNIRKDFISKFTDWGFDGLDYYFEYKEENVGHIWRMYSGINGEPLPRFQNRKQIMQDKNIWVSEQVNVVDILDNLFARFDKSKSLKEQLEHGVELQKINGRNETAWQSLRYAINVIQQIRNSGDKKSGNDNFLYSPVRNAKGEHFDTRNHHNNGELSEIKDADANGAFNIARKGLIMDAHIKYWNECGRPMKSDKKDEKTSDLDLFISDREWDMWLLDRSLWEKELPIFASLKAKKKQ

SEQ ID NO: 717 - protein, 1366 aa, unidentified
  REGION 1..1366: note = Description of Unknown:uncultivated organism sequence
  REGION 1..1366: note = Category: MG57 effectors
  REGION 1..1366: note = Description: MG57-27 effector
MKQFTNLYQVSKTLRFELQPIGKTKETFKGWLEKIDTAIPDVDDENLFLRDKKIKEAYLAIKPIMDSIHEEFIEKSLSSKEAKNIDFSDYYSLFKEKKVSSEFEKRLRKKISDTYSIAGDYFISEIEKTIANQKRKSNKKAAVAEEEKITKRKSKKPFECLTDVKMLFYLSANVKRLAEQHEIDEETLSRYIQTFKGFWGYLDGYNQNRENYYESEKETSTAVATRIVNENLPTFCNNILRFEKREKEYLNVFQYLKNNNRETKIKNSLGEEEDVVPIRASIFKIEHFNECLTQSQIEEYNRVIGNYNLLINLYNQLRSEETEYREIDEFEKLRKQIGCGKKPTNFDMLHDDSELKELLQKAGEAGEKMFGTENKQAEISTLPQFVKFLKDCNNWEGIYMSKAAINIISSLYFANWHSIEDKLYEAKAKACITYDKNREEPIQLRDAVELSELFAVLDTELSEHIFKDSLFKKDETNEYQNVLDKTLSPSKNLINLLCCDIEQYTKSFLVKTDKILALEKFKNDTHANEENETVKIIREWFVAATNAMRIVRFFAVRKSKMKGKIPNVAMEHALDNLLYCDNVQWFKWYDLVRNYLTKKPQDDVKENKLKLNFGTSSLLDGWSDGQEKTKAATLLKYNNELYLCILKTKNIFDTSKEDNPVYQTNLSVASRLILRNLKFQTLAGKGFLSENDISYSEMGAANPSQAILCLQKIIKERYVSKYPQLEKFVLKSYTDKGKFDAEISDALKDCYVCEYMPIDWNVIIEKQNSEELFLFKICCKDIKPGTYGRKDLQTMYWEDVLSEGSNHQLCAGAEIFMREPISKESPVRHRVGSKLVNKRDQDGNTIPEHIYREIYSYANGRVNVLSAEAKVFAEKSIIKDAKYEIIKDKRFYGDTKFMFHCPIKLFFKAKDPSRVFSEVNTLVNDVLQESTNLHFIGIDRGEKHLVYSCAIDKDARIVKCIHHDIINGTDYVQKLEAVADERIIAKKNWQEENKIKDLKKGYISHVVHRLVEETIKDDGMISPHAYIILEDLSTSMKRGRQKIEKQVYQNLEMALAKKLNFVVDKTASQGELGSVSMALQLTPPVNTYQDIEGKKQFGVMLYTRANYTSITDPATGWRKTIYIKDGKEDNIRKDFISKFTDWGFDGLDYYFEYKEENVGHIWRMYSGINGEPLPRFQNRKQIMQDKNIWVSEQVNVVDILDNLFARFDKSKSLKEQLEHGVELQKINGRNETAWQSLRYAINVIQQIRNSGDKKSGNDNFLYSPVRNAKGEHFDTRNHHNNGELSEIKDADANGAFNIARKGLIMDAHIKYWNECGRPMKSDKKDEKTSDLDLFISDREWDMWLLDRSLWEKELPIFASLKAKKKQ

SEQ ID NO: 718 - protein, 1366 aa, unidentified
  REGION 1..1366: note = Description of Unknown:uncultivated organism sequence
  REGION 1..1366: note = Category: MG57 effectors
  REGION 1..1366: note = Description: MG57-28 effector
MKQFTNLYQVSKTLRFELQPIGKTKETFKGWLEKIDTAIPDVDDENLFLRDKKIKEAYLAIKPIMDSIHEEFIEKSLSSKEAKNIDFSDYYSLFKEKKVSSEFEKRLRKKISDTYSIAGDYFISEIEKTIANQKRKSNKKAAVAEEEKITKRKSKKPFECLTDVKMLFYLSANVKRLAEQHEIDEETLSRYIQTFKGFWGYLDGYNQNRENYYESEKETSTAVATRIVNENLPTFCNNILRFEKREKEYLNVFQYLKNNNRETKIKNSLGEEEDVVPIRASIFKIEHFNECLTQSQIEEYNRVIGNYNLLINLYNQLRSEETEYREIDEFEKLRKQIGCGKKPTNFDMLHDDSELKELLQKAGEAGEKMFGTENKQAEISTLPQFVKFLKDCNNWEGIYMSKAAINIISSLYFANWHSIEDKLYEAKAKACITYDKNREEPIQLRDAVELSELFAVLDTELTEHIFKDSLFKKDETNEYQNVLDKTLSPSKNLINLLCCDIEQYTKSFLVKTDKILALEKFKNDTHANEENETVKIIREWFVAATNAMRIVRFFAVRKSKMKGKIPNVAMEHALDNLLYCDNVQWFKWYDLVRNYLTKKPQDDVKENKLKLNFGTSSLLDGWSDGQEKTKAATLLKYNNELYLCILKTKNIFDTSKEDNPVYQTNLSVASRLILRNLKFQTLAGKGFLSENDISYSEMGAANPSQAILCLQKIIKERYVSKYPQLEKFVLKSYTDKGKFDAEISDALKDCYVCEYMPIDWNVIIEKQNSEELFLFKICCKDIKPGTYGRKDLQTMYWEDVLSEGSNHQLCAGAEIFMREPISKESPVRHRVGSKLVNKRDQDGNTIPEHIYREIYSYANGRVNVLSAEAKVFAEKSIIKDAKYEIIKDKRFYGDTKFMFHCPIKLFFKAKDPSRVFSEVNTLVNDVLQESTNLHFIGIDRGEKHLVYSCAIDKDARIVKCIHHDIINGTDYVQKLEAVADERIIAKKNWQEENKIKDLKKGYISHVVHRLVEETIKDDGMISPHAYIILEDLSTSMKRGRQKIEKQVYQNLEMALAKKLNFVVDKTASQGELGSVSMALQLTPPVNTYQDIEGKKQFGVMLYTRANYTSITDPATGWRKTIYIKDGKEDNIRKDFISKFTDWGFDGLDYYFEYKEENVGHIWRMYSGINGEPLPRFQNRKQIMQDKNIWVSEQVNVVDILDNLFARFDKSKSLKEQLEHGVELQKINGRNETAWQSLRYAINVIQQIRNSGDKKSGNDNFLYSPVRNAKGEHFDTRNHHNNGELSEIKDADANGAFNIARKGLIMDAHIKYWNECGRPMKSDKKDEKTSDLDLFISDREWDMWLLDRSLWEKELPIFASLKAKKKQ

SEQ ID NO: 719 - protein, 1128 aa, unidentified
  REGION 1..1128: note = Description of Unknown:uncultivated organism sequence
  REGION 1..1128: note = Category: MG57 effectors
  REGION 1..1128: note = Description: MG57-29 effector
MEQFTNLYQLVKTLRFGLEPVGETKVTFEKWIEKLKNSEPVDDEDGNLFVKDERIRDAYLAIKPIMDRLHEKFIEESLTSNEARKIDFSEYFEAFKDEDKDVSAFEKKLRLDIGATYVVGGRYFSSEIEEAIKKPKEKKEKKEETKDEKTNKTKKKQPYECLTDANMLDYLSANVKKLAEQNGIDEQALSKHIEVFKGFWGYMSGYNQNRKNYYEVKKKATTAVATRIVHENLPIFCNNIRRFEKCRDEYIGIYQLLKDNNRETKIKNSHGVEVEAEAISEDMFQIAHFNNCLSQTQIDEYNRVIGDYNYMINLYKQARSDEKNSKKIDEFERLKKQIGCGKKKSMFVALIKDRKSELKDDDKKRENEDGVILTVETLLQRANIAGEAAFNEHDNESEINSIPGFIRFLKGCNNWSGIYMSKNAINKISSLYFANWHSLEEILVEWHKGNDKELKEKVKACITYDEKREEPLKLRDAVELSGLFAALDTALPEHFFKESLFKDDDTNEYRGVLDKTFTPSENLINMLCFDMKRYTEEFLENSKRILVKEKYKDENIKAGEEDQTIKEIKDWFDAATDAMRIVRYFAVRKSKMKGNIPNATMEQALSNLLYSDEAQWFKWYDLIRNYLTKKPQADVKENRLKLNFNNPTLMEGWDLNKESNYATVILRKNGFYYIGIMAKGHNNKFDEGTIDTDGECYEKMIYKQIPMPMGVVGFVRKCAGTAEKYGWHCPNNCLNEEGKIIGKDDEAHTHLKEIIDCYKDFFDKYEKDGYKYRDFNFTFLDSDKYEKLSDFFRDVEWQSYKVTFRNVSVVFINDKVKNGELYLFKLVSKDFSPGKNGGKGTIGTPNLQTLYWKKLFDEDNLKDVIYKLNGESEIFMRKPVAKESPVKHVLGSKLVNKRDKDDKTIPEQIYREIFLYENKKKKNISDDAKKYIDEQKAIVKDVKHEIVKDNRFYGETKYLFHCPITINFKAKKYKEPKDALAKVNEEITNSLQQSVKDLHFIGIDRGEKHLVYSCTIDENGKIIEGKCHDHDNINGTNYVQKLEAIADERTIARKNWQQQSKIKDLKRGYLSHVVHNLVEETIKDGDVIAPHAYIVLEDLSTEMKRGRQKIEKQVYQLLCLQSEIPMSR

SEQ ID NO: 720 - protein, 990 aa, unidentified
  REGION 1..990: note = Description of Unknown:uncultivated organism sequence
  REGION 1..990: note = Category: MG57 effectors
  REGION 1..990: note = Description: MG57-30 effector
MPAFIKFLQECGNWDGIYMSSAAINKISNLYFANWHSLKDKLKDAKANACITYDKKREEQIKLRDAVELSGLFAVLDTEPSEHFFKDSLFKDDDTNEYHNVLDKRLSPSKNLINLLCFDIERNIKAFLKDSDKIVALEKFKGEEETIKQIKDWLDTATDAMRVVRYFAVRKSKMKGSLPNSTMEQALSNLLYNDDAQWFKWYDLVRNYLTKKPQDDAKENKLKLNFGTSSLLGGWSDGQEKNKAATILKCDNDLYLCILKTKNIFDTSKEDNPIYKTNKSKASRLILKNLAFKTLAGKGFKGEYGVSYGDMGKDDPTKAIQCLQKFIKERYVNKYPLLEKFVANKYTDKRIFDAEINETLKECYVCEFVPIDWNIVTEKQNNEELFLFEIHSKDYQQGRKGKKDLQTMYWEDVLSDGSKHQLCAGAEIFMREPVEKESPIKHSVGSKLVNKRDNDGNTIPEQIYREIYLYANGKTKDISKEAQLYIDEQKAIIKEVKHEITKDKRFYGEQKYMFHCPIKLYFEAKDPKYASPEVNSKITKALQQSDNLQFIGIDRGEKHLVYSCSIDMNGKIVKCNHHDNINGTDYVQKLEAVADERIIAKKNWKAQNRIKDLKNGYISHVVHRLVEETIKDGDIIAPHAYIVLEDLNTEMKRGRQKFEKQVYQNLETALAKKLNFVVDKDAKQGELGSVSKALQFTPPISNYQDIEGKKQFGVMLYTRANYTSVTDPATGWRKTIYIKNGKEEDIKNQILEKFSDFGFDGKDYYFEYTEANAGHTWRLYSGKNGEPLPRFQNRKQLQQDKNIWVPEQINVVEILDNLFDNFDKRNSFKSQIGQGVELKKIEGRSETAWQSLRYALDLIQQIRNSGLKKEDDNFLCSPVRDENGKHFDTRNHANNGELSPIVDADANGAYNIARKGLIMDAHIKHWTDSGQPTKKGEKTPDLDLLISDEEWDLWLLDKEQWKKKLPTFASRKAKEDDKKSQTRKKSGMKQ

SEQ ID NO: 721 - protein, 976 aa, unidentified
  REGION 1..976: note = Description of Unknown:uncultivated organism sequence
  REGION 1..976: note = Category: MG57 effectors
  REGION 1..976: note = Description: MG57-31 effector
MLPFKIFFCFSYSKNFAFRIFDYNAVELSELFAVLNKESLEHLFKESLFKDNKLDTELTPSHNLINLLCSDVKQNIDYFWEHSEGITDLINDKNQSNEETQKIKQIKEWLDAAMNAMRIVRYFAVRKSKMKGNMPNVTIEQALSNLLYNDDAQWFKWYDLVRNYLTKKPQDDVKENKLKLNFGNSTLMNGWDMNKERDNTAVIIRRNNLYYLGIMDKNYNKILDADKIKSDDKSSYYEKMDYKQIALPTGVGGFVRKCFDTAQQYGWSCPKDCLNEDEKIIIKDDEARKNLTKIIDCYKDFFDKYEKDGFKYRNFNFRFLKSTEYEKLSDFFKDVERQRYMIKFRNISADYIDDLVNEGKLYLFQIYNKDFSTGRNERNGSKGKPNMHTIYWKTLFDETNLNDVVYKLNGQAEIFMREPIAENSPVKHGVGSKLVNKRDKDGNTIPEQIYKEIYLFANNKVKKENLSAEAKNYIESEKVKIKEAKYEIVKDNRFYGETKYMFHCPITINFKAGSSSGVNEKITDALQQSDNLQFIGIDRGEKHLVYSCTIDKYGKIIKCNHHDNINGTDYVQKLEAVANERLIAKKNWQQQNRIKDLKSGYISHVVHRLVEETIKDDKTIAPHAYIVLEDLNSEMKRGRQKIEKQVYQNLELALAKKFNFVVDKTAKQGELGSVSMALQLTPPVTNYKDIEGKKRFGIMLYTRANYTSITDPATGWRKTIYIKNGKDEEIKVQIIDKFSNFGFDEKDYYFEYTEENAGHTWRMYSGKDGKPLPRFQNKKQMLQDKNIWVPEQINVKEILDKLFANFDKGRSFKEQVNEEVKLEKIEGRSETAWQSLRYALNMIQQIRNSGVEKTDDNFLYSPVRNENGEHFDTRNHENNGDLSPIVDADANGAFNIARKGLIMDAHIKKWIKEGKPTTKEGDSKTPDLDLFISDREWDLWLLDREEWKKYLPVFASKSKKDADKTTSTKSPKRKKK

SEQ ID NO: 722 - protein, 1248 aa, unidentified
  REGION 1..1248: note = Description of Unknown:uncultivated organism sequence
  REGION 1..1248: note = Category: MG58 effectors
  REGION 1..1248: note = Description: MG58-1 effector
MVKEIFYLLFSKKMKSDFFSPFTNLYPIQKTLRRELKPLNENFQHDPALTALRNSEILQRDEQREKDYQAIKPLLDELHNQFITESLQSLEPQDRSDFVDFYQNYQKSKKNKANLSEKELKSLDEEFESRTKALRTAIGTSFSNTAELRKSNPDYVNEKGKPFLDQKSYKILTEAGVLWLLEKKYASDPEKLALIRRFGNFFTYFTGFNQNRENYYATDEKATAVAYRAINENLLTFANNCELFEKLSVLSLSEREKKIFNPDSYSEYLTQSGIDFYNEMFANIRSKANLYTQEHKTKLPQPKLLYKQIWSPRGNTIPFDLINKDEEFQKMLDTMIAETDQRIPEFKKLLEPIFEGKADLSQIFLSKTALNIISNRYFSSWHTLLEKGVELKLFKFKKNDEESFKLPAYLSLAELKELLEAVPFQTAEKSDTTEGNHHQASLLKLQRENLHLERSNSNWELLLKSMKSDFESFWTWEGEFWSYTSAKKALQSLSSLQSTNQEHKNLIKMLLDNTLYAYRMLKWFKVDTSKLGFVPEGEFYPSLDQILQDYPLPKWYDMIRNYLTRKPYSQAKLKLNFDCSTLLNGRDKNKETQNLSVILRKDGKFYLAIMKKDQNKFFEKSALYEGNLGTMEKMDYKLLPWANKMLPKCLMPGSDKKKYGASDQVLELYAKGSFKKSEKSFNLADLHTLIDFYKSALPKYEDWKVFNFQFQATENYQDISQFYREVEQQGYLLNWRKVNEELIKQGIKDWSLFLFQISSKDFEGKSKTPDLQTLYWQQLFEFSTNVKLNGEAEIFFRPWSMKKEKKNLKVDNYDVFKHKRYTEDKILFHVPITLWFGNNEVSPSAPSKFNQKLNQELIIPHFDDLHVIGLDRWEKHLAFYSVVSVKTGKIVKQGTLNLLNGTDYEAKLSQKAENRLHARQNRDTIEKIADLKNGYISQVVNKLVELVLEYNAVIVFEDLNAGFKRGRQKIEQSVYQKLELALAKKLNFIVKKEKAVGEPWSVTSAYQLAPQINTFWDIKWKQRGIMLYTRANYTSVTDPLTGWRKQHYFKKGSSKEMKAQFFKSFKNLTRDTNQEAYIFDDGTWKLYSNVERRRGKRGDHRERTQIKYDPSLELDTLFSKYQIEKSESLFGQLKNRELPQTFWTSFFRILDLIMQIRNTDDESRDIILSPIGNAQERFDSRKRYDQLPRDEKGVVIEESAFEYPTSGDANGAYNIARKGVMMLERIKENPEKPDLLIRDAEWDRKITN

SEQ ID NO: 723 - protein, 1253 aa, unidentified
  REGION 1..1253: note = Description of Unknown:uncultivated organism sequence
  REGION 1..1253: note = Category: MG58 effectors
  REGION 1..1253: note = Description: MG58-2 effector
MYTDYIDKLVGGFMDNAFSKFTNQYSFSKTLRFELVPQGRTADFLNGELESDQDRAESYQLLKPHFDNFHDGFIEQSLKAYSDSENRFEQLGDLLQKQQKFDKNSSNYEKLEKDIIKLQKSIRTNLSRFFTGFAKKLNQDYGLGDKSIISNAGAMVDFAKILWKDQPEKLVLLSKFDKFSGYFTGYCQNRTNYYVGDDKSTAVSNRIVNQNFTKYTQNFIEINKDEFKSFLKWFNQEDRYIYNQSTKQSQLTHINPETFSFAHYTEHLNQSGIETYNFNIGDINYWINQFNQTKPPKKVKKLLNLYKQIGQIPVDKKELFKFYETDEDLATDLLVTIENLPKYTENANTLFRNLADEEFNLEEINISARGTNSLANKYLIGWESVRELVNSNKKHDSSNKLIKLSEKPKSTTLGSLNEIINQFEPNQIFKPKYLNNLSDEPGQPSEILIWLIKESLLNALKESKDLAANLNLNKQSKLLGEKSITENIKTFLDSLLLSSQIMKTFQVDGALGDSDFYNELDQVLNEIDIFSIYNATRNYLTKKPYSQDKILLKFANSSLLDGWDINKESDNTSVILRDSTGYFLAIMKKSSNKFFDKAKNPLLYQVDSGDLEKMDYKLLPGPNKMIPKCIISVFWNKQEKQIVRDKPTTIKLAKSGISPSDEFIYKYNQGLHTKDPETKKIRDKKYLVEYIDYVKDALNKYEGWQGYIFNFKSSDQYQDTSEFYKDISDGGYSLNWSSIDLDVLNKAVDEGEIYLFKLKNKDLARKSKSNGKPNLHTMYWQNLFIDESSFKLNGSAEMFYRPKTIDKKQKVFTGSGIKKSGIFEKNRFTENKYLFHVPITINRKANNVIKFRDKINQAIIDEKITNVIGVDRGEKHLEFYCLLGKDGEIIEQGSLNVINGADYSKILDQKSSDRNEARKNWKTIDQIKDIKNGHTSLAIKQIIDLAVKHNALIVLEDLNTGFMRGRQKIEKSNYQQFELAMAKKLNYLVSKDTPAQQVGGTNKGLQLTPILNNYSDIEKVKQFGIILYTTAGYTSSTDPVTGWRKTVYLKSLNQDSMKNDISKFSQIYWDNKEKCYIFSYDTKNFNSKANSRVWSLYSSVERLRSERNKNGIWEKKQYSPTDVMRKALVNSGINPQSANLKEDILSMANSRSLKDIIFGFNLICQIRNSGTSVRDSDYILSPVKPFFDSRKQLDEQNLNENPNSNQLPTSGDSNGAYNIARKGQIMLSRVKQNPEKPDLFISDSDWDKYLAED

SEQ ID NO: 724 - protein, 1245 aa, unidentified
  REGION 1..1245: note = Description of Unknown:uncultivated organism sequence
  REGION 1..1245: note = Category: MG58 effectors
  REGION 1..1245: note = Description: MG58-3 effector
MFYLLFSKKMKSDFFAPFTNLYPIQKTLRRELKPLNENFQHDPALTALRNSEIPQRDQQREKDYQAIKPLLDELHNQFITESLQSLEPQDRSDFVDFYQNYQKSKKNKANLSEKELKNLDEEFESRTKALRTAIGTSFSNTAELRKSNPDYVNEKGKPFLDQKSYKILTEAGVLWLLEKKYASDPEKLALIRRFGNFFTYFTGFNQNRENYYATDEKSTAVAYRAINENLLTFANNCELFEKLSVLSLSEREKKIFNPDSYSEYLTQSGIDFYNEMLANIRSKANLYTQEHKTKLPQPKLLYKQIWSPRGNTIPFDLINNDEEFKKMLHTMIAETDQRIPEFNKLLESIFEENADLSQIFLSKTALNIISNRYFSSWHTLLEKGVELKLFKFKKNDEESFKLPAYLSLAELKELLEAVPFQTVEKSDTAEGTHHQVSLLKLQRENLHLESSHSNWELLLKSMKSDFESFWTWEGEFWSYTSAKNTLLSLSTLESTNQEHKNLIKMLLDNALYAYRMLKWFKIDTSKLGFVPEGEFYPSLDQLLQDYPLSKWYDMIRNYLTRKPYSEAKLKLNFDCSTLLNGRDKNKESQNLSVILRKDGKFYLAIMKKDQNKFFEKSALYEGNLGTMEKMDYKLLPWANKMLPKCLMPGSNKKKYGASDQVLELYAKGSFKKSEKSFNLPDLHTLIDFYKLALPKYEDWKVFNFQFQATENYQDISQFYREVEQQGYLLKWRKINEELIKQGIKDWSLFLFQMSSKDFEGKSKTPDLQTLYWQQLFESQTNVKLNGEAEIFFRPWSMKKEKKTLKVDNYDVFNHKRYTEDKILFHVPITLWFGNNEVSPSAPSKFNQKLNQELIIPHFDDLHMIGVDRWEKHLAFYSVISVKTGKIVKQGTLNLLNGTDYEAKLSQKAENRLHARQNRDTIEKIADLKNGYISQVVNKLIELVLEYNAVIVFEDLNAGFKRGRQKIEQSVYQKLELALAKKLNFIVKKEKAVGEPWSVTSAYQLAPQINTFWDIKWKQRGIMLYTRANYTSVTDPLTGWRKQHYFKKGSSEEMKAQFFESFKNLSRDAGQKAYIFDDGTWQLYSNVERRRGKRGDHRERTQIKYDPSLELDTLFSKYQIEKSDSLLDQLKNRDLPQTFWTSFFRILDLIMQIRNTDDEGRDIILSPIGNAEERFDSRKRYDQLPRDEKGLVIEESAFEYPTSGDANGAYNIARKGVMMLQRIKENPEKPDLLIRDAEWDKKITRK

SEQ ID NO: 725 - protein, 1287 aa, unidentified
  REGION 1..1287: note = Description of Unknown:uncultivated organism sequence
  REGION 1..1287: note = Category: MG58 effectors
  REGION 1..1287: note = Description: MG58-4 effector
MKSDFFAPFTNLYPIQKTLRRELKPLNENFEHDPSLSSLRNSDIPQRDEQREKDYQAIKPLLDELHNEFITKSLQSLEPQDRSDFILFYQTYQKSKKNKANLSEKELKSLDEEFESRTKALRAAIGTSFSNTAELRKSNPEYTNEKGKPFLTQKSYKILTEAGVLWLLEKKYASDPESLALIRRFGNFFTYFTGFNQNRENYYATDEKATAVAYRAINENLLTFANNCEVFEKLAVLSLSELEKKVFNPDSYSEYLTQSGIDFYNEMLANIRSKANLYTQEHKTKLPQPKLLYKQIWSPRGNTIPFDLITSEAEFQKMLHTMIRETDQRIPEFKKLLAQIFEEKADLSQIFLSKTALNIISNRYFSSWHTLLEKGVELKLFKFKKNDEESFKLPAYLSLAELKELLEAVPFQAAEKADTAEENHHQISLLKLQRENLHWENSHSNWELLLKSMKSDFESFWTWEGEFWSYTLAKEALQSLSTLESSNQEHKNLIKMLLDNALYAYRMLKWFKVDTSKLGFVPEGDFYPSLDQLLQDYPLPKWYDMIRNYLTRKPYSQAKLKLNFDCSTLLNGRDKNKETQNLSVILRKDGKFYLAIMKKDQNKFFEKSALYEGNLGAMEKMDFKFLPEASKMIPKCSTQLNEVRAAFKKGLPSFIINNEKNFRLPLEVSQRVYNLNNEMYRIENPNKSLISYKKMDKNEKKLYIKSFQKDFLRITWKEDVYKKSLLDWINFCKVFLLSFQSTQNFDFSWLKESSLYGSLEEFYADVDRACYFISWRNVNEELIKQGIKDCSLFLFQISSKDFEGKSKTPDLQTLYRNQIFAPQPNVKLNGEAEIFFRPWSMGKEKKTLKVDNYDVFKHKRYTEDKILFHVPITLWFWNNEVSPSAPSKFNQKLNQELIIPHFDDLHVIGVDRWEKHLAFYSVVSVKTGKIVKQGTLNLLNGTDYEAKLSQKAENRLYARQNRDTIEKIADLKNGYISQVVNKLVELALEYNAVIVFEDLNAGFKRGRQKIEQSVYQKLELALAKKLNFIVKKEKAVGKPWSVTSAYQLAPQINTFWDIKWKQRGIMLYTRANYTSVTDPLTGWRKQHYFKKGSSEEMKAQFFKSFKNLTRDAGQEAYIFDDGTWQLYSNVERRRGKRGDHRERTQIKYDPSLELDTLFSKNQIKKTESLFDQLKNRELPQTFWTSFFRIMDLIMQIRNTDDEGRDIILSPIGNAQERFDSRKRYNQLPCDKNGAVLEESAFEYPTSGDANGAYNIARKGVMMLERIKENPEKPNLLIRDAERDSWVK

SEQ ID NO: 726 - protein, 1234 aa, unidentified
  REGION 1..1234: note = Description of Unknown:uncultivated organism sequence
  REGION 1..1234: note = Category: MG58 effectors
  REGION 1..1234: note = Description: MG58-5 effector
MKSDFFAPFTNLYPIQKTLRRELKPLNENFEHDPSLSSLRNSEIPQRDEQREKDYQAIKPLLDELHNQFITESLQSLETQDRSDFVLFYQTYQKKKKNKADFSEKELKSLDEEFESRTKASRTAIGNSYAKLAELRKSNPDYVNEKGKPFLDQKSYKILTEAGVLWLLEKKYASDPEKLALIRRFGNFFTYFTGFNQNRENYYATDEKATAVAYRAINENLLTFANNCELFEKISVLSLSEREKKIFNPDSYSEYLTQSGIDFYNEMLANIRSKANLYTQEHKTKLPQPKLLYKQIWSPRGNTIPFDLINKDEEFQKMLHTMIAETDQRIPEFNKLLESIFEENADLSQIFLSKTSLNIISNRYFSSWHTLLEKGVELKLFKFKKNDEESFKLPAYLSLAELKELLEAVPFQTAEKSDTTEGNHHQASLLKLQRENLHLESSHSNWELLLKSMKSDFESFWTWEGEFWSYTSAKKALQSLSTLESSNQEHKNLIKMLLDNALCAYRILKWFKIDTSKLGFVPEGEFYPSLDQLLQDYPLPKWYDMIRNYLTRKPYSQAKLKLNFDCSTLLNGRDKNKETQNLSVILRKDGKFYLAIMKKDQNKFFEKSALYEGNLGTMEKMDYKLLPWANKMLPKCLMPGSDKKKYRASDQVLELYAKGSFKKSEKSFNLADLHTLIDFYKSALPKYEDWKVFNFQFQATENYQDISQFYREVEQQGYLLNWRKVNEELIKQGIKDWSLFLFQISSKDFEGKSKTPDLQTLYWQQLFKNQTNVKLNGEAEIFFRPWSMKKEKKTLKVDNYDVFKHKRYTEDKILFHVPITLWFGNNEVSPSAPSKFNQKLNQELIIPHFDDLHVIGVDRWEKHLAFYSVVSVKTGKIVKQGTLNLLNGTDYEAKLSQKAENRLHARQNRDTIEKIADLKNGYISQVVNKLVELVLEYNAVIVFEDLNAGFKRGRQKIEQSVYQKLELALAKKLNFIVKKEKAVGESWSVTSAYQLAPQINTFWDIKWKQRGIMLYTRANYTSVTDPLTGWRKQHYFKKGSSEEMKAQFFKSYKNLTRDAGQKAYIFDDGTWLLYSNVERRRGKRGDHRERTQIKYDPSLELDTLFSKYQIEKSHSLFDQLKNREFPQTFWTSFFRILDLIMQIRNTDDKGRDIILSPIGNAQERFDSRKRYDQLPCDEKGLIIEESEFEYPTSGDANGAYNIARKGMMMLERIKENPEKPDLLIRDAEWDSWSK

SEQ ID NO: 727 - protein, 1234 aa, unidentified
  REGION 1..1234: note = Description of Unknown:uncultivated organism sequence
  REGION 1..1234: note = Category: MG58 effectors
  REGION 1..1234: note = Description: MG58-6 effector
MKSDFFSPFTNLYPIQKTLRRELKPLNENFEYDPSLSLLRNSEIPQRDEQREKDYQAIKPLLDELHNQFIAESLQSLETQNRSDFVDFYQTYQKKKKNKVDLSEKELKMLNEEFESRTKALRTAIGNSYAKLAELRKSNPDYVNEKGKPFLTQKSYKILTEAGVLWLLEKKYASDPEKLALIRRFGNFFTYFTGFNQNRENYYATDEKATAVAYRAINENLLTFANNCELFEKLSVLSLSEREKKIFNPDSYSEYLTQSGIDFYNEMLANIRSKANLYTQEYKTKLPQPKLLYKQIWSPRGNTIPFDLINNDEEFKKMLHTMIAETDQRIPEFNKLLESIFEENADLSQIFLSKTSLNIISNRYFSSWHTLLEKGVELKLFKFKKNDEESFKLPAYLSLAELKELLEAVPFQTIEKADTAEGNHHQVSLLKLQRENLHLKNSHSNWELLLKSMKSDFESFWAWDEEFWSYTSAKNVIQSLSSLQSTNQEHKNLIKMLLDNALYAYRMLKWFKIDTSKLGFIPEGEFYPSLDQLLQDYPLPKWYDMIRNYLTRKPYSQAKLKLNFDCSTLLNGRDKNKETQNLSVILRKDGKFYLAIMKKDQNKFFEKSALYEGNLGTMEKMDYKLLPWANKMLPKCLMPGSDKKKYGASDQVLELYAKGSFKKSEKSFNLADLHTLIDFYKSALPKYEDWKVFNFQFQATENYQDISQFYREVEQQGYLLNWRKVNEELIKQGIKDWSLFLFQISSKDFEGKSKTPDLQTLYWQQLFESPTNVKLNGEAEIFFRPWSMKKEKKALKVDNYDVFKHKRYTEDKILFHVPITLWFGNNEVSPSAPSKFNQKLNQELIIPHFDDLHVIGVDRWEKHLAFYSVVSVKTGKIVKQGTLNLLNGTDYEAKLSQKAENRLHARQNRDTIEKIADLKNGYISQVVNKLVELVLEYNAVIVFEDLNAGFKRGRQKIEQSVYQKLELALAKKLNFIVKKEKTVGEPWSVTSAYQLAPQINTFWDIKWKQRGVMLYTRANYTSVTDPLTGWRKQHYFKKGSSEEMKAQFFKSFKNLTRDINQEAYIFDDGTWKLYSNVERRRGKRGDHRERTQIKYDPSLELDTLFFKNQIEKYDSLFDQLKNRELPQTFWTSFFRILDLIMQIRNTDDEGRDIILSPIGNVQERFDSRKRYDQLPRDEKGLIIEESEFEYPTSGDANGAYNIARKGVMMLERIKENPEKPDLLIRDAEWDSWAK

SEQ ID NO: 728 - protein, 1236 aa, unidentified
  REGION 1..1236: note = Description of Unknown:uncultivated organism sequence
  REGION 1..1236: note = Category: MG58 effectors
  REGION 1..1236: note = Description: MG58-7 effector
MKSDFFSPFTNLYPIQKTLRRELKPLNENFQHDPALTALRNSEILQRDEQREKDYQAIKPLLDELHNQFITESLQSLEPQDRSDFVDFYQNYQKSKKNKANLSEKELKSLDEEFESRTKALRTAIGTSFSNTAELRKSNPDYVNEKGKPFLTQKSYKILTEAGVLWLLEKKYASEPENLALIRRFGNFFTYFTGFNQNRENYYATDEKVTAVAYRAINENLLTFANNCELFEKLSVLSLSDLEKKIFNPDSYSEYLTQSGIDFYNEMLANIRSKANLYTQEHKTKLPQPKLLYKQIWSPRGNTIPFDLINKDEEFQKMLDTMIAETDQRIPEFKKLLVQIFEGKADLSQIFLSKTSLNTISNRYFSSWHTLLEKGVELKLFKFKKNDEESFKLPAYLSLAELKELLEAVPFQTAEKSDTAEGTHHQVSLLKLQRENLHLESSHSNWELLLKSMKSDFESFWTWEGEFWSYTSAKNTFLSLSTLESTNQEHKNLIKMLLDNALYAYRMLKWFKVDTSKLGFVPEGEFYPSLDQLLQDYSLPKWYDMIRNYLTRKPYSQAKLKLNFDCSTLLNGRDKNKETQNLSVILRKDGKFYLAIMKKDQNKFFEKSALYEGNLGTMEKMDYKLLPWANKMLPKCLMPGSDKKKYGASDQVLELYAKGSFKKSEKSFNLPDLHTLIDFYKSALPKYEDWKVFNFQFQATENYQDISQFYREVEQQGYLLNWRKVNEELIKQGIKDWSLFLFQISSKDFEGKSKTPDLQTLYWQQLFEFPTNVKLNGEAEIFFRPWSMKKEKKTLKVDNYDVFKHKRYTEDKILFHVPITLWFGNNEVSPSAPSKFNQKLNQELIIPHFDDLHVAWVDRGERNLWYFSIISVKTGKIVKQGTLNLLNGTDYEAKLSQKAENRLHARQNRDTIEKIADLKNGYISQVVNKLIELVLEYNAVIVFEDLNAGFKRGRQKIEQSVYQKLELALAKKLNFIVKKEKAVGEPWSVTSAYQLAPQINTFWDIKWKQRGIMLYTRANYTSVTDPLTGWRKQHYFKKDSSEEMKTQFFKSFKNLTRDAGQEAYILDDGTWKLYSNVERRRGKRGDHRERTQIKYDPSLELDTLFSKYQIEKSDSLLDQLKNRDLPQTFWTSFFRILDLIMQIRNTDDEGRDIILSPIGNAEERFDSRKRYDLLPRDEKGLVIEESAFEYPTSGDANGAYNIARKGVMMLQRIKENPEKPDLLIRDAEWDKKITRK

SEQ ID NO: 729 - protein, 1236 aa, unidentified
  REGION 1..1236: note = Description of Unknown:uncultivated organism sequence
  REGION 1..1236: note = Category: MG58 effectors
  REGION 1..1236: note = Description: MG58-8 effector
MKSDLFSPFTNLYPIQKTLRRELKPLNENFQHDLALSALRNSEIPQRDQQREKDYQAIKPLLDELHNQFITESLQSLEPQHRSDFVLFYQTYQKKKKNKADLPEKELKSLDEEFESRTKALRAAIGTSFSATAELRKSNPDYVNEKGKPFLDQKSYKILTESGVLWLLEKKYTSDPEKLALIRRFGNFFTYFTGFNQNRENYYATDEKSTAVAYRAINENLLTFANNCELFEKLAVLSLSELEKKVFNPDFYSEYLTQSGVDFYNEMLGNIRSKANLYTQEHKTKLPQPKLLYKQIWSPRGNTIPFDLINNDEEFKKMLHMMIAETDQRIPEFNRLLEPIFEGKADLSQVFLSKTSLNIISNRYFSSWHTLLEKGVELKLFKFKKNDEESFKLPAYLSLAELKELLEAVPFQTVEKSDTAEGTHHQVSLLKLQRENLHLESSHSNWELLLKSMKSDFESFWTWEGEFWSYTSAKNTLLSLSTLESTNQEHKNLIKMLLDNVLYAYRMLKWFKIDTSKLGFVPEGEFYLSLDQLLQDYPLPKWYDMIRNYLTRKPYSQAKLKLNFDCSTVLNGRDKNKETQNLSVILRKDGKFYLAIMKKDQNKFFEKSALYEGNLGTMEKMDYKLLPWANKMLPKCLMPGSDKKKYGASDQVLELYAKGSFKKSEKSFNLPDLHTLIDFYKSALPKYEDWKVFNFQFQATENYQDISQFYREVEQQGYLLNWRKVNEELIKQGIKDWTLFLFQISSKDFEGKSKTPDLQTLYWQQLFKNQTNVKLDGEAEIFFRPWSMKKEKKTLKVDNYDVFKHKRYTEDKILFHVPITLWFGNNEVSPSAPSKFNQKLNQELIIPYFDDLHVIGVDRWEKHLAFYSVVSVKTGKIVKQGTLNLLNGTDYEAKLSQKAENRLHARQNRDTIEKIADLKNGYISQVVNKLVELVLEYNAVIVFEDLNAGFKRGRQKIEQSVYQKLELALAKKLNFIVKKEKAVGEPWSVTSAYQLAPQINTFWDIKWKQRGIMLYTRANYTSVTDPLTGRRKHYYFKKGSSEEMKAQFFKSFKNLTRDASQEAYIFDDGTWQLYSNVERRRGKRGDHRERMQIKYDPSLELDTLFSKYQIEKSEALLDQLKNRELPQTFWTSFFRILDLIMQIRNTDDEGRDIILSPIGNAEERFDSRKRYDQLPYDENRVVIEESTFEYPTSGDANGAYNIARKGVMMLERIKENPEKPDLLIRDAEWDSWVWNF

SEQ ID NO: 730 - protein, 1234 aa, unidentified
  REGION 1..1234: note = Description of Unknown:uncultivated organism sequence
  REGION 1..1234: note = Category: MG58 effectors
  REGION 1..1234: note = Description: MG58-9 effector
MKSDLFSPFTNLYPIQKTLRRELKPLNENFQHDPALSALRNSEIPQRDQQREKDYQAIKPLLDELHNQFITESLQSLEPQDRSDFVLFYQTYQKKKKNKADLSEKDLKTLDEEFESRTKALRNAIGASFSVTAELRKSNPDYVNEKGKPFLDQKSYKILTESGVLWLLEKKYASDPEKLALIRRFGNFFTYFTGFNQNRENYYATDEKSTAVAYRAINENLLTFANNCELFEKLSMLSLSELEKKVFNPDSYSEYLAQSGIDFYNEMFANIRSKANLYTQEHKTKLPQPKLLYKQIWSPRGNTIPFDLITSEAEFQEMLHTMIRETDQRLPEFNKLLAQIFEEKADLSQIFLSKTALNIISNRYFSSWHTLLEKGVELKLFKFKKNDEESFKLPAYLSLAELKELLESVPFQTAENADTAQGSHHQVSLLKLQREKLYLENSHSNWELLLKSMKSDFESFWTWEGEFWSYTSAKKALQSLSTLESTNQEHKNLIKMLLDNALYAYRMLKWFRVDTSKLGFVPEGEFYPSLDQLLQDYPLPKWYDMIRNYLTRKPYSQAKLKLNFDCSTLLKGRDKNKETQNLSVILRKDGKFYLAIMKKDQNKFFEKSALYEGNLGTMEKMDYKLLPWANKMLPKCLMPGSDKKKYRASDQVLELYAKGSFKKSEKSFNLADLHTLIDFYKSALPKYEDWKVFNFQFQATENYQDISQFYREVEQQGYLLNWRKVNEKLIKQGIKDWSLFLFQISSKDFEGKSKTPDLQTLYWQQLFEFSTNVKLNGEAEIFFRPWSMKKEKKKLKVDNYDVFKHKRYTEDKILFHVPITLWFGNNEVSPSAPSKFNQKLNQELIIPHFDDLHVIGVDRWEKHLAFYSVVSVKTGKIVKQGTLNLLNGTDYEAKLSQKAENRLHARQNRDTIEKIADLKNGYISQVVNKLVELALEYNAVIVFEDLNAGFKRGRQKIEQSVYQKLELALAKKLNFIVKKEKAVGEPWSVTSAYQLAPQINTFWDIKWKQRGIMLYTRANYTSVTDPLTGWRKQHYFKKGSSEEMKAQFFKSFKNLSRDAGQKAYIFDDGTWQLYSNVERRRGKRGDHRERTQIKYDPSLELDTLFSKYQIEKSESLFDQFKNREFPQTFWTSFFRILDLIMQIRNTDDEGRDIILSPIGNAQERFDSRKRYDQLPRDEKGLVIEESAFEYPTSGDANGAYNIARKGVMMLERIKENPEKPDLLIRDAEWDSWII

SEQ ID NO: 731 - protein, 1234 aa, unidentified
  REGION 1..1234: note = Description of Unknown:uncultivated organism sequence
  REGION 1..1234: note = Category: MG58 effectors
  REGION 1..1234: note = Description: MG58-10 effector
MKSDLFSPFTNLYPIQKTLRRELKPLNENFQHDPALTALRNSEIPQRDEQREKDYQAIKPLLDELHNQFITKSLQSLEPQDRSDFILFYQTYQKKKKNKADLSEKELKSLDEEFKSRTKALRAAIGTSFSNTAELRKSNPDYTNGKGKSKKPKKSYKILTEAGVLWLLEKKYASDPEKLALIRRFGNFFTYFTGFNQNRENYYATDKKATAVAYRAINENLLTFANNRELFEKLAVLSLSELEKKIFNPDSYSEYLTQSGIDFYNEMLANIRSKANLYTQEHKTKLPQPKLLYKQIWSPRGNTIPFDLINNDEEFQEMLHMMITETDQRIPEFNKLLEQIFEEKTDLSQIFLSKTALNIISNRYFSSWHTLLEKGVELKLFKFKKNDEESFKLPAYLSLAELKELLEAVPFQTAEKSDTDEETHHQVSLLKLQRENLHWENSHSNWELLLKSMKSDFESFWTWEGEFWSYTSAKKALQSLLSLESTNQEHKNLIKMLLDNALYAYRMLKWFRVDTSKLGFVPEGEFYPSLDQLLQDYPLPKWYDMIRNYLTRKPYSQAKLKLNFDCSTLLNGRDKNKETQNLSVILRKDGKFYLAIMKKDQNKFFEKSALYKGNLGTMEKMDYKLLPWANKMLPKCLMPGSEKKKYGASDQVLALYAKGSFQKSEKSFNLPDLHTLIDFYKSALQKYEDWKVFNFQFQATENYQDISQFYREVEQQGYLLNWRKVNEELIKQGIKDWSLFLFQISSKDFEGKSKTPDLQTLYWCQLFESQTNVKLNGEAEIFFRPRSMKKEKKKLKVDNYDVFKHKRYTEDKILFHVPITLWFWNNEVSPSAPSKFNQKLNQELIIPHFDDLHVIGVDRWEKHLAFYSVVSVKTGKIVKQGTLNLLNGTNYEEKLSQKAENRLHARQNRDTIEKIADLKNGYISQVVNKLVELVLEYNAVIVFEDLNAGFKRGRQKIEQSVYQKLELALAKKLNFIVKKEKAVGEPWSVTSAYQLAPQINTFWDIKWKQRGIMLYTRANYTSVTDPLTGWRKQHYFKKGSSEEMKAQFFRSFKNLTRDAGQKAYIFDDGTWQLYSNVERRRGKRGDHRKRTQIKYDPSLELDTLFSKCQIEKSDSLFDQLKNRELPQTFWTSFFRILDLIMQIRNTDDEGRDVILSPIGNTQERFDSRQRYDQLPRDENGLVIEESVFEYPTSGDANGAYNIARKGVMMLQRIKENPEKPDLLIRDAEWDSWVW

SEQ ID NO: 732 - protein, 1236 aa, unidentified
  REGION 1..1236: note = Description of Unknown:uncultivated organism sequence
  REGION 1..1236: note = Category: MG58 effectors
  REGION 1..1236: note = Description: MG58-11 effector
MKSDLFSPFTNLYPIQKTLRRELKPLNESFEHDPSLSSLRNSDIPQRDEQREKDYQAIKPLLDELHNQFITESLQSLETQNRSDFVLFYQTYQKKKKNKAELSEKELKSLDEEFESRTKALRAAIGTSFSNTAELRKSNPDYVSEKGKPFLTQKSYKILTEAEVLWLLEKKYASDPEKLALICRFGNFFTYFTGFNQNRENYYATDEKATAVAYRAINENLLTFANNCEVFEKLAVLSLSELEKKVFNPDSYSEYLTQSGIDFYNEMLENIRSKANLYNQEHKTKLPQPKLLYKQIWSPRGNTIPFDLITSEAEFQKMLHMMIAETDQRIPEFKRLLAQIFEQKADLSQIFLSKTALNIISNRYFSSWHTLLEKGVELKLFKFKKNDEESFKLPAYLSLAELKELFEAVPFQTAEKSDTDEETHHQVSLLKLQRENLHWENSHSNWELLLKSMKSDFESFWTWEGEFWSYTLAKKALQSLSTLESTNQEHKNLIKMLLDNALYAYRMLKWFKVDTSKLGFVPEGEFYPSLDQLLQDYPLPKWYDMIRNYLTRKPYSQAKLKLNFDCSTLLNGRDKNKETQNLSVILRKDGKFYLAIMKKDQNKFFEKSVLYEGNLGTMEKMDYKLLPWANKMLPKCLMPGSDKKKYGASDQVLELYAKGSFKKSEKSFNLVDLHTLIDFYKSALPKYEDWKVFNFQFQATENYQDISQFYREVEQQGYLLNWRKVNEELIKQGIKDWSLFLFQISSKDFEGKSKTPDLQTLYWQQLFKNQTNVKLNGEAEIFFRPWSMKKEKKTLTVDNYDVFKHKRYTEDKILFHVPITLWFWNNEVSPSAPSKFNQKLNQELIIPHFDDLHVIGVDRWEKHLAFYSVVSVKTGKIVKQGTLNLLNGTDYEVKLSQKAENRLHARQNRDTIEKIADLKNGYISQVVNKLVELVLEYNAVIVFEDLNAGFKRGRQKIEQSVYQKLELALAKKLNFIVKKEKAVGEPWSVTSAYQLAPQINTFWDIKWKQRGIMLYTRANYTSVTDPLTGWRKQHYFKKGSSEEMKTQFFKNFKNLTRDAGQEAYIFDDGTWKLYSNVERRRGKRGDHRERTQIKYDPSLELDTLFSKYQIENSDSLLDQLKNRDLPQTFWTSFFRILDLIMQIRNTDDEGRDIILSPIGNAQERFDSRKRYNQLPRDEKGLVIEESAFEYPTSGDANGAYNIARKGVMMLQRIKENPEKPDLLIRDAEWDKKITRK

SEQ ID NO: 733 - protein, 1250 aa, unidentified
  REGION 1..1250: note = Description of Unknown:uncultivated organism sequence
  REGION 1..1250: note = Category: MG58 effectors
  REGION 1..1250: note = Description: MG58-12 effector
MLSFNWVLFFFFSKMSRSIFSPFTNLYPIQKTLRRELKPLNENFQHDPALSALRNSEIPQRDEQREKDYQAIKPLLDEFHNQFITESLHSLEPQDRSDFILFYQTYQKKKKNKAEISEKELKSLDEEFESRTKALRNAIGTSFSVTAELRKSNPDYVSEKGKPFLTQKSYKILTEAGVLWLLEKKYTSDPEKLALIRRFGNFFTYFTGFNQNRENYYATDEKSTAVAYRAINENLLTFANNCELFEKLSVLSLSELEKKTFNPDSYSEYLTQSGIVFYNEMLANIRSKANLYTQEHKAKLPQPKLLYKQIWSPRGDTIPFDLIASEAEFQETLHTMIRETDQRIPEFNKLLEQIFEEKVDLSQIFFSKTSLNIISNRYFSSWHTLLEKGVELKLFKFKKNDEESFKLPAYLSLAELKELLESAPFQMAEKADADEEKHHQASLFKLQRENLHLEKSHSNWELLLKSMKSDFESFWTWEGEFWSYTLAKKALQSLSALESTNQEHKNLIKMLLDNALYAYRMLKWFKVDTSKLGFVPEGEFYPSLDQLLQDYPLPKWYDMIRNYLTRKTYSQAKLKLNFDCSTLLNGRDKNKEIQNLSVILRKDGKFYLAIMKKDQNKFFENSALYEGNLGTMEKMDYKLLPWANKMLPKCLMPGSDKKKYGASDQVLELYAKGSFKKSEKSFNLADLHTLIDFYKLALPKYEDWKVFNFQFQATENYQDISQFYREVEQQGYLLNWRKVNEKLIKQGIKDWSLFLFQISSKDFEGKSKTPDLQTLYWQQLFEFSTNVKLNGEAEIFFRPWSMKKEKKKLKVDNYDVFKHKRYTEDKILFHVPITLWFGNNEVSPSAPSKFNQKLNQELIIPHFDDLHVIGVDRWEKHLAFYSVVSVKTGKIVKQGTLNLLNGTDYEAKLSQKAENRLYARQNRDTIEKIADLKNGYISQVVNKLVELVLEYNAVIVFEDLNAGFKRGRQKIEQSVYQKLELALAKKLNFIVKKEKAVGEPWSVTSAYQLAPQINTFWDIKWKQRGIMLYTRANYTSVTDPLTGWRKQYYFKKGSSEEMKAQFFKSFKNLTRDAGQEAYIFDDGTWLLYSNVERRRGKRGDHRERTQIKYDPSLELDTLFSKYQIEKSDSLFDQLKNRELPQTFWTSFFRIIDLIMQIRNTDDEGRDIILSPIGNPQERFDSRKRYNQLPRDEKGGIIEESAFEYPTSWDANGAYNIARKGVMMLERIKENPEKPDLLIRDAEWDKKITRK

SEQ ID NO: 734 - protein, 1236 aa, unidentified
  REGION 1..1236: note = Description of Unknown:uncultivated organism sequence
  REGION 1..1236: note = Category: MG58 effectors
  REGION 1..1236: note = Description: MG58-13 effector
MSRSIFSPFTNLYPIQKTLRRELKPLNENFQHDPALSALRNSEIPQRDEQREKDYQAIKPLLDEFHNQFITESLHSLEPQDRSDFILFYQTYQKKKKNKAEISEKELKSLDEEFESRTKALRNAIGTSFSVTAELRKSNPDYVSEKGKPFLTQKSYKILTEAGVLWLLEKKYTSDPEKLALIRRFGNFFTYFTGFNQNRENYYATDEKSTAVAYRAINENLLTFANNCELFEKLSVLSLSELEKKTFNPDSYSEYLTQSGIVFYNEMLANIRSKANLYTQEHKAKLPQPKLLYKQIWSPRGDTIPFDLIASEAEFQETLHTMIRETDQRIPEFNKLLEQIFEEKVDLSQIFFSKTSLNIISNRYFSSWHTLLEKGVELKLFKFKKNDEESFKLPAYLSLAELKELLESAPFQMAEKADADEEKHHQASLFKLQRENLHLEKSHSNWELLLKSMKSDFESFWTWEGEFWSYTLAKKALQSLSALESTNQEHKNLIKMLLDNALYAYRMLKWFKVDTSKLGFVPEGEFYPSLDQLLQDYPLPKWYDMIRNYLTRKTYSQAKLKLNFDCSTLLNGRDKNKEIQNLSVILRKDGKFYLAIMKKDQNKFFENSALYEGNLGTMEKMDYKLLPWANKMLPKCLMPGSDKKKYGASDQVLELYAKGSFKKSEKSFNLADLHTLIDFYKLALPKYEDWKVFNFQFQATENYQDISQFYREVEQQGYLLNWRKVNEKLIKQGIKDWSLFLFQISSKDFEGKSKTPDLQTLYWQQLFEFSTNVKLNGEAEIFFRPWSMKKEKKKLKVDNYDVFKHKRYTEDKILFHVPITLWFGNNEVSPSAPSKFNQKLNQELIIPHFDDLHVIGVDRWEKHLAFYSVVSVKTGKIVKQGTLNLLNGTDYEAKLSQKAENRLHARQNRDTIEKIADLKNGYISQVVNKLVELVLEYNAVIVFEDLNAGFKRGRQKIEQSVYQKLELALAKKLNFIVKKEKAVGEPWSVTSAYQLAPQINTFWDIKWKQRGIMLYTRANYTSVTDPLTGWRKQYYFKKGSSEEMKAQFFKSFKNLTRDAGQEAYIFDDGTWLLYSNVERRRGKRGDHRERTQIKYDPSLELDTLFSKYQIEKSDSLFDQLKNRELPQTFWTSFFRIIDLIMQIRNTDDEGRDIILSPIGNPQERFDSRKRYNQLPRDEKGGIIEESAFEYPTSWDANGAYNIARKGVMMLERIKENPEKPDLLIRDAEWDKKITRK

SEQ ID NO: 735 - protein, 178 aa, unidentified
  REGION 1..178: note = Description of Unknown:uncultivated organism sequence
  REGION 1..178: note = Category: MG58 effectors
  REGION 1..178: note = Description: MG58-14 effector
MVKEIFYLLFSKKMKSDFFSPFTNLYPIQKTLRRELKPLNENFQHDPALTALRNSEILQRDEQREKDYQAIKPLLDELHNQFITESLQSLEPQDRSDFVDFYQNYQKSKKNKANLSEKELKSLDEEFESRTKALRTAIGTSFSNTAELRKSNPDYVNEKGKPFLDQKSYKILTEAGVL

SEQ ID NO: 736 - protein, 129 aa, unidentified
  REGION 1..129: note = Description of Unknown:uncultivated organism sequence
  REGION 1..129: note = Category: MG58 effectors
  REGION 1..129: note = Description: MG58-15 effector
MEKKYASDPEKLALIHRFGNFFTYFTGFNQNRENYYATDEKVTAVAYRAINENLLTFANNCELFEKLSVLSLSDLEKKIFNPDSYSEYLTQSGIDFYNEMLANIRSKANLYTQEHKTKLPQPKLLYKQI

SEQ ID NO: 737 - protein, 178 aa, unidentified
  REGION 1..178: note = Description of Unknown:uncultivated organism sequence
  REGION 1..178: note = Category: MG58 effectors
  REGION 1..178: note = Description: MG58-16 effector
MVKEIFYLLFSKKMKSDFFAPFTNLYPIQKTLRRELKPLNENFQHDPALTALRNSEIPQRDQQREKDYQAIKPLLDELHNQFITESLQSLETQDRSDFVLFYQTYQKKKKNKADFSEKELKSLDEEFESRTKSLRTAIGNSYAKLAELRKSNPDYVNEKGKPFLDQKSYKILTEAGVL

SEQ ID NO: 738 - protein, 141 aa, unidentified
  REGION 1..141: note = Description of Unknown:uncultivated organism sequence
  REGION 1..141: note = Category: MG58 effectors
  REGION 1..141: note = Description: MG58-17 effector
MIAETDQRIPEFKKLLEPIFEGKADLSQIFLSKTALNIISNRYFSSWHTLLEKGVELKLFKFKKNDEESFKLPAYLSLTELKELLEAVPFQTAEKSGTAEGTHHQVSLLKLQRENLHLERSNSNWELLLKSMKSDFESFWT

SEQ ID NO: 739 - protein, 132 aa, unidentified
  REGION 1..132: note = Description of Unknown:uncultivated organism sequence
  REGION 1..132: note = Category: MG58 effectors
  REGION 1..132: note = Description: MG58-18 effector
MLLDNALYAYRMLKWFKVDTSKLGFVPEGEFYPSLDQLLQGYPLPKWYDMIRNYLTRKPYSQAKLKLNFDCSTLLNGRDKNKETQNLSVILRKDGKFYLAIMKKDQNKFFEKSALYEGNLGTMEKMDYKLLP

SEQ ID NO: 740 - protein, 141 aa, unidentified
  REGION 1..141: note = Description of Unknown:uncultivated organism sequence
  REGION 1..141: note = Category: MG58 effectors
  REGION 1..141: note = Description: MG58-19 effector
MIAETDQRIPEFNKLLESIFEENADLSQIFLSKTSLNIISNRYFSSWNTLLEKGVELKLFKFKKNDEESFKLPTYLSLAELKELLEAVPFQTAEKSDTAEGTHHQVSLLKLQRENLHLESSHSNWELLLKSMKSDFESFWT

SEQ ID NO: 741 - protein, 99 aa, unidentified
  REGION 1..99: note = Description of Unknown:uncultivated organism sequence
  REGION 1..99: note = Category: MG58 effectors
  REGION 1..99: note = Description: MG58-20 effector
MPGSDKKKYGASDQVLELYAKGSFKKSEKSFNLADLHTLIDFYKSALPKYEDWKVFNFQFQATENYQDISQFYREVEQQGYLLNWRKVNEELIKQGIKD

SEQ ID NO: 742 - protein, 132 aa, unidentified
  REGION 1..132: note = Description of Unknown:uncultivated organism sequence
  REGION 1..132: note = Category: MG58 effectors
  REGION 1..132: note = Description: MG58-21 effector
MLLDNTLYAYRMLKWFKVDTSKLGFVPEGEFYPSLDQLLQDYPLPKWYDMIRNYLTRKPYSQAKLKLNFDCSTLLNGRDKNKETQNLSVILRKDGKFYLAIMKKDQNKFFEKSALYEGNLGTMEKMDYKLLP

SEQ ID NO: 743 - protein, 105 aa, unidentified
  REGION 1..105: note = Description of Unknown:uncultivated organism sequence
  REGION 1..105: note = Category: MG58 effectors
  REGION 1..105: note = Description: MG58-22 effector
MLPKCLMPGSDKKKYGASDQVLELYAKGSFKKSEKSFNLADLHTLIDFYKSALPKYEDWKVFNFQFQATENYQDISQFYREVEQQGYLLNRRKVNEELIKQGIKD

SEQ ID NO: 744 - protein, 115 aa, unidentified
  REGION 1..115: note = Description of Unknown:uncultivated organism sequence
  REGION 1..115: note = Category: MG58 effectors
  REGION 1..115: note = Description: MG58-23 effector
MKTGKIVKQGTLNLLNGTDYEAKLSQKAENRLHARQNRDTIEKIADLKNGYISQVVNKLVELVLEYNALIVFEDLNAGFKRGRQKIEQSVYQKLELALAKKLNFIVKKEKAVGEP

SEQ ID NO: 745 - protein, 115 aa, unidentified
  REGION 1..115: note = Description of Unknown:uncultivated organism sequence
  REGION 1..115: note = Category: MG58 effectors
  REGION 1..115: note = Description: MG58-24 effector
MKTGKIVKQGTLNLLNGTDYEAKLSQKAENRLHARQNRDTIEKIADLKNGYISQVVNKLVELVLEYNAVIVFEDLNAGFKRGRQKIEQSVYQKLELALAKKLNFIVKKEKAVVEP

SEQ ID NO: 746 - protein, 867 aa, unidentified
  REGION 1..867: note = Description of Unknown:uncultivated organism sequence
  REGION 1..867: note = Category: MG58 effectors
  REGION 1..867: note = Description: MG58-25 effector
MKSDLFSPFTNLYPIQKTLRRELKPLNENFQHDPALTALRNSEIPQRDEQREKDYQAIKPLLDELHNQFITESLQSLETQDRSDFVLFYQTYQKKKKNKAALSEKDLKTLDEEFESRTKALRNAIGTSFLNTAELRKSNPDYVNEKGKPFLTQKSYKILTEAGVLWLLEKKYASDPENLALIRRFGNFFTYFTGFNQNRENYYATDEKSTAVAYRAINENLLTFANNCELFEKLSVLSLSELEKKTFNPDSYSEYLTQSGIVFYNEMLANIRSKANLYTQEHKAKLPQPKLLYKQIWSPRGDTIPFDLIASEAEFQETLHTMIRETDQRIPEFNKLLEQIFEEKVDLSQIFFSKTSLNIISNRYFSSWHTLLEKGVELKLFKFKKNDEESFKLPAYLSLAELKELLESVPFQMAEKADADEEKHHQASLFKLQRENLHLEKSHSNWELLLKSMKSDFESFWTWEGEFWSYTLAKKALQSLSALESTNQEHKNLIKMLLDNALYAYRMLKWFKIDMSKLGFVPEGEFYPSLDQLLQDYPLPKWYDMIRNYLTRKPYSQAKLKLNFDCSTLLNGRDKNKETQNLSVILRKDGKFYLAIMKKDQNKFFEKSALYEGNLGTMEKMDYKLLPWAHKMLPKCLMPGSDKKKYGASDQVLELYAKGSFKKSEKSFNLADLHTLIDFYKSALQKYEDWKVFNFQFQATENYQDISQFYREVEQQGYLLKWRKVNEELIKQGIKDWSLFLFQISSKDFEGKSKTPDLQTLYWQQLFESPTNVKLNGEAEIFFRPWSMKKEKKTLKVDNYDVFKHKRYTEDKIFFHVPITLWFWNNEVSPSAPSKFNQKLNQELIIPYFDDLHVIGVDRWEKHLETI

SEQ ID NO: 747 - protein, 1294 aa, unidentified
  REGION 1..1294: note = Description of Unknown:uncultivated organism sequence
  REGION 1..1294: note = Category: MG58 effectors
  REGION 1..1294: note = Description: MG58-26 effector
MVERESPKLRVASSILASPELSWKCWIKSVFFLAKTFYLLDFYNKKNMVKEIFYLLFSKKMKSDFFAPFTNLYPIQKTLRRELKPLNENFEHDPSLSSLRNSEIPQRDEQREKDYQAIKPLLDELHNQFITESLQSLETQDRSDFVLFYQTYQKKKKNKADFSEKELKSLDEEFESRTKASRTAIGNSYAKLAELRKSNPDYVNEKGKPFLDQKSYKILTEAGVLWLLEKKYASDPEKLALIRRFGNFFTYFTGFNQNRENYYATDEKATAVAYRAINENLLTFANNCELFEKISVLSLSEREKKIFNPDSYSEYLTQSGIDFYNEMLANIRSKANLYTQEHKTKLPQPKLLYKQIWSPRGNTIPFDLINKDEEFQKMLHTMIAETDQRIPEFNKLLESIFEENADLSQIFLSKTSLNIISNRYFSSWHTLLEKGVELKLFKFKKNDEESFKLPAYLSLAELKELLEAVPFQTAEKSDTTEGNHHQASLLKLQRENLHLESSHSNWELLLKSMKSDFESFWTWEGEFWSYTSAKKALQSLSTLESSNQEHKNLIKMLLDNALCAYRILKWFKIDTSKLGFVPEGEFYPSLDQLLQDYPLPKWYDMIRNYLTRKPYSQAKLKLNFDCSTLLNGRDKNKETQNLSVILRKDGKFYLAIMKKDQNKFFEKSALYEGNLGTMEKMDYKLLPWANKMLPKCLMPGSDKKKYRASDQVLELYAKGSFKKSEKSFNLADLHTLIDFYKSALPKYEDWKVFNFQFQATENYQDISQFYREVEQQGYLLNWRKVNEELIKQGIKDWSLFLFQISSKDFEGKSKTPDLQTLYWQQLFKNQTNVKLNGEAEIFFRPWSMKKEKKTLKVDNYDVFKHKRYTEDKILFHVPITLWFGNNEVSPSAPSKFNQKLNQELIIPHFDDLHVIGVDRWEKHLAFYSVVSVKTGKIVKQGTLNLLNGTDYEAKLSQKAENRLHARQNRDTIEKIADLKNGYISQVVNKLVELVLEYNAVIVFEDLNAGFKRGRQKIEQSVYQKLELALAKKLNFIVKKEKAVGESWSVTSAYQLAPQINTFWDIKWKQRGIMLYTRANYTSVTDPLTGWRKQHYFKKGSSEEMKAQFFKSYKNLTRDAGQKAYIFDDGTWLLYSNVERRRGKRGDHRERTQIKYDPSLELDTLFSKYQIEKSHSLFDQLKNREFPQTFWTSFFRILDLIMQIRNTDDKGRDIILSPIGNAQERFDSRKRYDQLPCDEKGLIIEESEFEYPTSGDANGAYNIARKGMMMLERIKENPEKPDLLIRDAEWDSWSK

SEQ ID NO: 748 - protein, 105 aa, unidentified
  REGION 1..105: note = Description of Unknown:uncultivated organism sequence
  REGION 1..105: note = Category: MG58 effectors
  REGION 1..105: note = Description: MG58-27 effector
MLPKCLMPGSNKKKYGASDQVLELYAKGSFKKSEKSFNLPDLHTLIDFYKLALPKYEDWKVFNFQFQATENYQDISQFYREVEQQGYLLKWRKINEELIKQGIKD

SEQ ID NO: 749 - protein, 132 aa, unidentified
  REGION 1..132: note = Description of Unknown:uncultivated organism sequence
  REGION 1..132: note = Category: MG58 effectors
  REGION 1..132: note = Description: MG58-28 effector
MLLDNALYAYRMLKWFKIDTSKLGFVPEGEFYPSLDQLLQDYPLSKWYDMIRNYLTRKPYSEAKLKLNFDCSTLLNGRDKNKESQNLSVILRKDGKFYLAIMKKDQNKFFEKSALYEGNLGTMEKMDYKLLP

SEQ ID NO: 750 - protein, 141 aa, unidentified
  REGION 1..141: note = Description of Unknown:uncultivated organism sequence
  REGION 1..141: note = Category: MG58 effectors
  REGION 1..141: note = Description: MG58-29 effector
MIAETDQRIPEFNKLLESIFEENADLSQIFLSKTALNIISNRYFSSWHTLLEKGVELKLFKFKKNDEESFKLPAYLSLAELKELLEAVPFQTVEKSDTAEGTHHQVSLLKLQRENLHLESSHSNWELLLKSMKSDFESFWT

SEQ ID NO: 751 - protein, 141 aa, unidentified
  REGION 1..141: note = Description of Unknown:uncultivated organism sequence
  REGION 1..141: note = Category: MG58 effectors
  REGION 1..141: note = Description: MG58-30 effector
MIAETDQRIPEFNKLLESIFEENADLSQISLSKTSLNIISNRYFSSWNTLLEKGVELKLFKFKKNDEESFKLPTYLSLAELKELLEAVPFQTAEKSDTAEGTHHQVSLLKLQRENLHLESSHSNWELLLKSMKSDFESFWT

SEQ ID NO: 752 - protein, 129 aa, unidentified
  REGION 1..129: note = Description of Unknown:uncultivated organism sequence
  REGION 1..129: note = Category: MG58 effectors
  REGION 1..129: note = Description: MG58-31 effector
MEKKYASDPEKLALIRRFGNFFTYFTGFNQNRENYYATDEKSTAVAYRAINENLLTFANNCELFEKLSVLSLSEREKKIFNPDSYSEYLTQSGIDFYNEMLANIRSKANLYTQEHKTKLPQPKLLYKQI

SEQ ID NO: 753 - protein, 165 aa, unidentified
  REGION 1..165: note = Description of Unknown:uncultivated organism sequence
  REGION 1..165: note = Category: MG58 effectors
  REGION 1..165: note = Description: MG58-32 effector
MTKPFFSQFTNLYPIQKTLRRELKPLNKNFEHDPSLSSLRNSEIPQRDEQREKDYQAIKPLLDKLHNQFITEGLQSLEPQDRSDFILFYQTYQKKKKNKANLSEKELKSLDEEFESRTKAFRAAIGTSFSNTAELRKSNPNYVNEKGKPFLTQKSYKILTEAGVL

SEQ ID NO: 754 - protein, 129 aa, unidentified
  REGION 1..129: note = Description of Unknown:uncultivated organism sequence
  REGION 1..129: note = Category: MG58 effectors
  REGION 1..129: note = Description: MG58-33 effector
MEKKYASEPENLALIRRFGNFFTYFTGFNQNRENYYATDEKVTAVAYRAINENLLTFANNCELFEKLSVLSLSDLEKKIFNPDSYSEYLTQSGIDFYNEMLANIRSKANLYTQEHKTKLPQPKLLYKQI

SEQ ID NO: 755 - protein, 165 aa, unidentified
  REGION 1..165: note = Description of Unknown:uncultivated organism sequence
  REGION 1..165: note = Category: MG58 effectors
  REGION 1..165: note = Description: MG58-34 effector
MTKPFFSQFINLYPIQKTLRRELKPLNENFQHDPSLSALRNSEIPQRDEQREKDYQAIKPLLDELHNEFITESLQSLEIQNRSGFVDFYQNYQKSKKNKAELSEKELKSLDEEFESRTKALRNAIGTSFSATAELRKSNPDYVNEKGKPFLTQKSYKILTEAGVL

SEQ ID NO: 756 - protein, 141 aa, unidentified
  REGION 1..141: note = Description of Unknown:uncultivated organism sequence
  REGION 1..141: note = Category: MG58 effectors
  REGION 1..141: note = Description: MG58-35 effector
MIAETDQRIPEFNKLLESIFEENADLSQIFLSKTSLNIISNRYFSSWHTLLEKGVELKLFKFKKNDEESFKLPAYLSLAELKELLEAVPFQTIEKADTAEGNHHQVSLLKLQRENLHLKNSHSNWELLLKSMKSDFESFWA

SEQ ID NO: 757 - protein, 117 aa, unidentified
  REGION 1..117: note = Description of Unknown:uncultivated organism sequence
  REGION 1..117: note = Category: MG58 effectors
  REGION 1..117: note = Description: MG58-36 effector
MIRETDQRIPELKKLLAQIFEEKADLSQIFLSKTALNIISNRYFSSWHTLLEKGVELKLFKFKKNDEESFKLPAYLSLAELKELLEAVPFQTAEKSDTDEETHHQVSLLKLQRENLH

SEQ ID NO: 758 - protein, 1234 aa, unidentified
  REGION 1..1234: note = Description of Unknown:uncultivated organism sequence
  REGION 1..1234: note = Category: MG58 effectors
  REGION 1..1234: note = Description: MG58-37 effector
MKSDFFAPFTNLYPIQKTLRRELKPLNENFEHDPSLSSLRNSEIPQRDEQREKDYQAIKPLLDELHNQFITESLQSLETQGRSDFVLFYQTYQKKKKNKVDLSEKDLKTLDEEFESRTKALRTAIGNSYAKLAELRKSNPDYVNEKGKPFLDQKSYKILTEAGVLWLLEKKYTSDPEKLALIRRFGNFFTYFTGFNQNRENYYATDEKSTAVAYRAINENLLTFANNCELFEKLSVLSLSEREKKIFNPDSYSEYLTQSGIDFYNEMLANIRSKANLYTQEHKTKLPQPKLLYKQIWSPRGNTIPFDLINKDEEFQKMLHTMIAETDQRIPEFNKLLESIFEENADLSQIFLSKTSLNIISNRYFSSWHTLLEKGVELKLFKFKKNDEESFKLPAYLSLAELKELLEAVPFQTAEKSDTTEGNHHQASLLKLQRENLHLESSHSNWELLLKSMKSDFESFWTWEGEFWSYTSAKKALQSLSTLESSNQEHKSLIKMLLDNALCAYRMLKWFKIDTSKLGFVPEGEFYPSLDQLLQDYPLPKWYDMIRNYLTRKPYSQAKLKLNFDCSTLLNGRDKNKETQNLSVILRKDGKFYLAIMKKDQNKFFEKSALYEGNLGTMEKMDYKLLPWANKMLPKCLMPGSDKKKYGASDQVLELYAKGSFKKSEKSFNLADLHTLIDFYKSALQKYEDWKVFNFQFQATENYQDISQFYREVEQQGYLLNWRKVNEELIKQGIKDWTLFLFQISSKDFEGKSKTPDLQTLYWQQLFKNQTNVKLNGEAEIFFRPWSMKKEKKKLKVDNYDVFKHKRYTEDKILFHVPITLWFGNNEVSPSAPSKFNQKLNQELIIPHFDDLHVIGVDRWEKHLAFYSVVSVKTGKIVKQGTLNLLNGTDYEAKLSQKAENRLHARQNRDTIEKIADLKNGYISQVVNKLVELVLEYNAVIVFEDLNAGFKRGRQKIEQSVYQKLELALAKKLNFIVKKEKAVGEPWSVTSAYQLAPQINTFWDIKWKQRGIMLYTRANYTSVTDPLTGWRKQHYFKKGSSEEMKAQFFKSFKNLTRDTNQEAYIFDDGTWKLYSNVERRRGKRGDHRERTQIKYDPSLELDTLFSKYQIEKSESLFGQLKNRELPQTFWTSFFRILDLIMQIRNTDDEGRDIILSPIGNAQERFDSRKRYNQLPRDENGLVLEESAFEYPTSGDANGAYNIARKGVMMLERIKENPEKPDLLIRDAEWDSWVK

SEQ ID NO: 759 - protein, 132 aa, unidentified
  REGION 1..132: note = Description of Unknown:uncultivated organism sequence
  REGION 1..132: note = Category: MG58 effectors
  REGION 1..132: note = Description: MG58-38 effector
MLLDNALYAYRMLKWFKIDTSKLGFIPEGEFYPSLDQLLQDYPLPKWYDMIRNYLTRKPYSQAKLKLNFDCSTLLNGRDKNKETQNLSVILRKDGKFYLAIMKKDQNKFFEKSALYEGNLGTMEKMDYKLLP

SEQ ID NO: 760 - protein, 1253 aa, unidentified
  REGION 1..1253: note = Description of Unknown:uncultivated organism sequence
  REGION 1..1253: note = Category: MG58 effectors
  REGION 1..1253: note = Description: MG58-39 effector
MYTDYIDKLVGGFMDNAFSKFTNQYSFSKTLRFELVPQGRTADFLNGELESDQDRAESYQLLKPHFDNFHDGFIEQSLKAYSDSENRFEQLGDLLQKQQKFDKNSSNYEKLEKDIIKLQKSIRTNLSRFFTGFAKKLNQDYGLGDKSIISNAGAMVDFAKILWKDQPEKLVLLSKFDKFSGYFTGYCQNRTNYYVGDDKSTAVSNRIVNQNFTKYTQNFIEINKDEFKSFLKWFNQEDRYIYNQSTKQGQLTHINPEMFSFAHYTEHLNQSGIETYNFNIGDINYWINQFNQTKPPKKVKKLLNLYKQIGQIPVDKKELFKFYETDEDLATDLLVTIENLPKYTENANTLFRNLADEEFNLEEINISARGTNSLANKYLIGWESVRELVNSNKKHDSSNKLIKLSEKPKSTTLGSLNEIINQFEPNQIFKPKYLNNLSDEPGQPSEILIWLIKESLLNALKESKDLAANLNLNKQSKLLGEKSITENIKTFLDSLLLSSQIMKTFQVDGALGDSDFYNELDQVLNEIDIFSIYNATRNYLTKKPYSQDKILLKFANSSLLDGWDINKESDNTSVILRDSTGYFLAIMKKSSNKFFDKAKNPLLYQVDSGDLEKMDYKLLPGPNKMIPKCIISVFWNKQEKQIVRDKPTTIKLAKSGISPSDEFIYKYNQGLHTKDPETKKIRDKKYLVEYIDYVKDALNKYEGWQGYIFNFKSSDQYQDTSEFYKDISDGGYSLNWSSIDLDVLNKAVDEGEIYLFKLKNKDLARKSKSNGKPNLHTMYWQNLFIDESSFKLNGSAEMFYRPKSIDKKQKVFTGSGIKKSGIFEKNRFTENKYLFHVPITINRKANNVIKFRDKINQAIIDEKITNVIGVDRGEKHLEFYCLLGKDGEIIEQGSLNVINGADYSKILDQKSSDRNEARKNWKTIDQIKDIKNGHTSLAIKQIIDLAVKHNALIVLEDLNTGFMRGRQKIEKSNYQQFELAMAKKLNYLVSKDTPAQQVGGTNKGLQLTPILNNYSDIEKVKQFGIILYTTAGYTSSTDPVTGWRKTVYLKSLNQDSMKNDISKFSQIYWDNKEKCYIFSYDTKNFNSKANSRVWSLYSSVERLRSERNKNGIWEKKQYSPTDVMRKALVNSGINPQSANLKEDILSMANSRSLKDIIFGFNLICQIRNSGTSVRDSDYILSPVKPFFDSRKQLDEQNLNENPNSNQLPTSGDSNGAYNIARKGQIMLSRVKQNPEKPDLFISDSDWDKYLAED

SEQ ID NO: 761 - protein, 132 aa, unidentified
  REGION 1..132: note = Description of Unknown:uncultivated organism sequence
  REGION 1..132: note = Category: MG58 effectors
  REGION 1..132: note = Description: MG58-40 effector
MLLDNALYAYRMLKWFKVDTSKLGFVPEGEFYPSLDLLLQNYPLSKWYDMIRNYLTRKPYSQAKLKLNFDCSTLLNGRDKNKETQNLSVILRKDGKFYLAIMKKDQNKFFEKSALYEGTLGTMEKMDYKLLP

SEQ ID NO: 762 - protein, 141 aa, unidentified
  REGION 1..141: note = Description of Unknown:uncultivated organism sequence
  REGION 1..141: note = Category: MG58 effectors
  REGION 1..141: note = Description: MG58-41 effector
MIRETDQRIPEFNKLLEQIFEEKADLSQIFLLKTALNIVSNRYFSSWHTLLEKGVELKLFKFKKNDEESFKLPAYLSLAELKELLEAVPFQTPEKSDTDEETHHQVSLLKLQRENLHLENSYSNWELLLKSMKSDFESFWT

SEQ ID NO: 763 - protein, 105 aa, unidentified
  REGION 1..105: note = Description of Unknown:uncultivated organism sequence
  REGION 1..105: note = Category: MG58 effectors
  REGION 1..105: note = Description: MG58-42 effector
MLPKCLMPGSDKKKYGASDQVLELYAKGSFKKSEKSFNLADLHTLIDFYKSALPKYEDWKVFNFQFQATENYQDISQFYREVEQQGYLLNWRKVNEELIKQGIKD

SEQ ID NO: 764 - protein, 1240 aa, unidentified
  REGION 1..1240: note = Description of Unknown:uncultivated organism sequence
  REGION 1..1240: note = Category: MG58 effectors
  REGION 1..1240: note = Description: MG58-43 effector
MKSDLFSPFINLYHIQKTLRRELKPLNENFEHDPSLTALRNSEIPQRDEQREKDYQAIKPLLDELHNQFITESLQSLETQNRSDFVDFYQNYQKSKKNKAHLSEKELKSLDEEFESRTKAFRAAIGTSFSNTAELRKSNPDYVNEKGKPLLTQKSYKILTEAGVLWLLEKKYASEPETLALIRRFGNFFTYFTGFNQNRENYYATDEKSTAVAYRAINENLLTFANNCELFEKFSVLSLSDLEKKIFNPDSYSEYLTQEWIDFYNEMLANIRSKANLYTQEHKTKLPQPKLLYKQIWSPRGNTIPFDLINNDKEFQEMLHTMIAETDQRIPEFNKLLEQIFEEKADLSQIFLSKTALNIISNRYFSSWHTLLEKGVELKLFKFKKNDEESFKLPAYLSLAELKELLEAVPFQTVEKSDTAEEKHHQVSLLKLQRENLYLENSHSNWELLLKSMKSDFESFWTWEGEFWSYTSAKNALQSLLSLESTNQEHKNLIKKLLDNALYAYRMLKWFRVDTSKLGFVPEGEFYPSLDQLLQDYPLPKWYDMIRNYLTRKPYSQAKLKLNFDCSTLLNGRDKNKETQNLSVILRKDGKFYLAIMKKDQNKFFEKSALYEGNLGTMEKMDYKLLPWANKMLPKCLMPGSDKKKYGASDQVLELYAKGSFKKSEKSFNLADLHTLIDFYKSALPKYEDWKVFNFQFQATENYQDISQFYREVEQQGYLLNWRKVNEELIKQGIKDWSLFLFQISSKDFEGKSKTPDLQTLYWCQLFESPTNVKLNGEAEIFFRPWSMKKEKKTLKVDNYDVFKHKRYTEDKILFHVPITLWFGNNEVSPSAPSKFNQKLNQELIIPHFDDLHVIGVDRWEKHLAFYSVVSVKTGKIVKQGTLNLLNGTDYEAKLSQKAENRLHARQNRDTIEKIADLKNGYISQVVNKLVELALEYNAVIVFEDLNAGFKRGRQKIEQSVYQKLELALAKKLNFIVKKEKAVGEPWSVTSAYQLAPQINTFWDIKWKQRGIMLYTRANYTSVTDPLTGWRKQHYFKKGSSEEMKAQFFKSFKNLTRDAGQEAYIFDDGTWQLYSNVERRRGKRGDHRERTQIKYDPSLELDTLFSKYQIEKSDSLFDQLKNREFPQTFWTSFFRILDLIMQIRNTDDKGRDIILSPIGNAKERFDSRKQYNQLPRDEKGMIIEESVFEYPTSGDANGAYNIARKGVMMLERIKENPEKPDLLIRDAEWDSWVKLNNIII

SEQ ID NO: 765 - protein, 105 aa, unidentified
  REGION 1..105: note = Description of Unknown:uncultivated organism sequence
  REGION 1..105: note = Category: MG58 effectors
  REGION 1..105: note = Description: MG58-44 effector
MLPKCLMPGSDKKKYGASDQVLELYAKGSFKKSEKSFNLADLHTLIDFYKLALPKYEDWKVFNFQFQATENYQDISQFYREVEQQGYLLNWRKVNEELIKQGIKD

SEQ ID NO: 766 - protein, 132 aa, unidentified
  REGION 1..132: note = Description of Unknown:uncultivated organism sequence
  REGION 1..132: note = Category: MG58 effectors
  REGION 1..132: note = Description: MG58-45 effector
MLLDNALYAYRMLKWFKVDTSKLGFVPEGEFYPSLDRLLQDYPLPKWYDMIRNYLTRKPYSEAKLKLNFDCSTLLNGRDKNKETQNLSVILRKDGKFYLAIMKKDQNKFFEKSALYEGNLRTMEKMDYKLLP

SEQ ID NO: 767 - protein, 115 aa, unidentified
  REGION 1..115: note = Description of Unknown:uncultivated organism sequence
  REGION 1..115: note = Category: MG58 effectors
  REGION 1..115: note = Description: MG58-46 effector
MKTGKIVKQGTLNLLNGTDYEAKLSQKAENRLHARQNRDTIEKIADLKNGYISQVVNKLVELVLEYNAVIVFEDLNAGFKRGRQKIEQSVYQKLELALAKKLNFIVKKEKTVGEP

SEQ ID NO: 768 - protein, 115 aa, unidentified
  REGION 1..115: note = Description of Unknown:uncultivated organism sequence
  REGION 1..115: note = Category: MG58 effectors
  REGION 1..115: note = Description: MG58-47 effector
MKTGKIVKQGTLNLLNGTDYEAKLSQKAENRLHARQNRDTIEKIADLKNGYISQVVNKLVELVLEYNAVIVFEDLNAGFKRGRQKIEQSVYQKLELALAKKLNFIVKKEKAVGEP

SEQ ID NO: 769 - protein, 34 aa, unidentified
  REGION 1..34: note = Description of Unknown:uncultivated organism sequence
  REGION 1..34: note = Category: MG58 effectors
  REGION 1..34: note = Description: MG58-48 effector
MKKEKKTLTVDNYDVFKHKRYTEDKILFHVPITL

SEQ ID NO: 770 - protein, 165 aa, unidentified
  REGION 1..165: note = Description of Unknown:uncultivated organism sequence
  REGION 1..165: note = Category: MG58 effectors
  REGION 1..165: note = Description: MG58-49 effector
MSRSIFSPFTNLYPIQKTLRRELKPLNENFQHDPALSALRNSEIPQRDEQREKDYQAIKPLLDELHNQFITESLQSLETQDRSDFVLFYQTYQKKKKNKAALSEKDLKTLDEEFESRTKALRTAIGNSYAKLAELRKSNPDYVNEKGKPFLNQKSYKILTEAGVL

SEQ ID NO: 771 - protein, 155 aa, unidentified
  REGION 1..155: note = Description of Unknown:uncultivated organism sequence
  REGION 1..155: note = Category: MG58 effectors
  REGION 1..155: note = Description: MG58-50 effector
MITSEAEFKKILHTVIRETDQRIPEVKKLLESIFEEKTDLSQIFLSKTAFNIISNRYFSSWHTLLEKGVELKLFKFKKNDEESFQLPAYLSLAELKELLESVPFETAEKVDAAEGNHHQVSLLKLQRENLHLENSHSNRELLLKSMKSDFESFWT

SEQ ID NO: 772 - protein, 1236 aa, unidentified
  REGION 1..1236: note = Description of Unknown:uncultivated organism sequence
  REGION 1..1236: note = Category: MG58 effectors
  REGION 1..1236: note = Description: MG58-51 effector
MKSDFFAPFTNLYPIQKTLRRELKPLNENFEHDPSLSSLRNSEIPQRDEQREKDYQAIKPLLDELHNQFITESLQSLEPQDRSDFVLFYQTYQKKKKNKAELSEKELKSLDEEFESRTKALRAAIGTSFSNTAELRKSNPDYVSEKGKPFLTQKSYKILTEAGVLWLLEKKYASDHEKIALIRRFGNFFTYFTGFNQNRENYYATDEKSTAVAYRAINENLLTFANNCELFEKLSVLSLSDLEKKIFNPDSYSEYLTQSGIDFYNEMLANIRSKANLYTQEHKVKLPQPKLLYKQIWSPRGNTIPFDLITSEEEFQEMLHAMIRETDQRIPEFNKLLEQIFEQKADLSQIFLSKTALNIISNRYFSSWHTLLEKGVELKLFKFKKNDEESFKLPAYLSLAELKELLEAVPFQTVEKSDTAEGNHHQVSLLKLQRENLHLEKSHSNWELLLKSMKSDFESFWTWEGEFWSYTSAKKALQSLSSLQSTNQEHKNLIKMLLDNTLYAYRMLKWFKVDTSKLGFVPEGEFYPSLDQLLQDYPLPKWYDMIRNYLTRKPYSQAKLKLNFDCSTLLNGRDKNKETQNLSVILRKDGKFYLAIMKKDQNKFFEKSALYEGNLGTMEKMDYKLLPWANKMLPKCLMPGSDKKKYGASDQVLELYAKGSFKKSEKSFNLADLHTLIDFYKSALPKYEDWKVFNFQFQATENYQDISQFYREVEQQGYLLKWRKVNEELIKQGIKDWSLFLFQISSKDFEGKSKTPDLQTLYWQQLFESQTNVKLNGEAEIFLRPWSMKKEKKTLKVDNYDVFKHKRYTEDKILFHVPITLWFGNNEVSPSAPSKFNQKLNQELIIPHFDDLHVIGVDRWEKHLAFYSVVSVKTGKIVKQGTLNLLNGTDYEAKLSQKAENRLHARQNRDTIEKIADLKNGYISQVVNKLVELALEYNAVIVFEDLNAGFKRGRQKIEQSVYQKLELALAKKLNFIVKKEKAVGEPWSVTSAYQLAPQINTFWDIKWKQRGIMLYTRANYTSVTDPLTGWRKQHYFKKGSSEEMKTQFFKNFKNLTRDAGQEAYIFDDGTWKLYSNVERRRGKRGDHRERTQIKYDPSLELDTLFSKYQIEKSDSLLDQLKNRDLPQTFWTSFFRILDSIMQIRNTDDEGRDIILSPIGNAQERFDSRKRYNQLPRDEKGLVIEESAFEYPTSGDANGAYNIARKGVMMLQRIKENPEKPDLLIRDAEWDKKITRK

SEQ ID NO: 773 - protein, 178 aa, unidentified
  REGION 1..178: note = Description of Unknown:uncultivated organism sequence
  REGION 1..178: note = Category: MG58 effectors
  REGION 1..178: note = Description: MG58-52 effector
MVKEIFYLLFSKKMKSDLFSPFTNLYPIQKTLRRELKPINENFEHDPFLTTLRNSKIPQRDKQREKDYQEIKPLLDKLHNQFITESLQSLETQDRSDSVLFYQTYQKKKKNKADLSEKDLKTLDEEFESRTKALRNAIGASFSVTAALRKSNPDYVNEKGKPFLDQKSYKILTEAGVL

SEQ ID NO: 774 - protein, 309 aa, unidentified
  REGION 1..309: note = Description of Unknown:uncultivated organism sequence
  REGION 1..309: note = Category: MG58 effectors
  REGION 1..309: note = Description: MG58-53 effector
MVKEIFYLLFSKKMKSDLFSPFTNLYPIQKTLRRELKPINENFEHDPFLTTLRNSKIPQRDKQREKDYQEIKPLLDKLHNQFITESLQSLETQDRSDFVLFYQTYQKKKKNKAALSEKDLKTLDEEFESRTKALRNAIGTSFLNTAELRKSNPDYVNEKGKPFLTQKSYKILTEAGVLWLLEKKYASDPENLALIRRFGNFFTYFTGFNQNRENYYATDEKSTAVAYRAINENLLTFANNCELFEKLSVLSLSELEKKTFNPDSYSEYLTQSGIVFYNEMLANIRSKANLYTQEHKAKLPQPKLLYKQI

SEQ ID NO: 775 - protein, 658 aa, unidentified
  REGION 1..658: note = Description of Unknown:uncultivated organism sequence
  REGION 1..658: note = Category: MG58 effectors
  REGION 1..658: note = Description: MG58-54 effector
MLDLSLEEKNIFNPDSYSDYLVQEGIQDYNTQIASIKSKINLYSGAHKTKLPQPKLLYKQIWSPRGNTIPFDLITSEAEFQKMLHTMIAETDQRIPEFKKLLAQIFEEKADLSQIFLSKTALNIISNRYFSSWHTLLEKGVELKLFKFKKNDEESFKLPAYLSLAELKELLEAVPFQTPEKSDTDEETHHQVSLLKLQRENLHLENSYSNWELLLKSMKSDFESFWTWEGEFWSYTLAKNALQSLSTLESTNQEHKNLIKMLLDNALYAYRMLKWFKVDTSKLGFVPEGEFYPSLDLIFQDYPLPKWYDMIRNYLTKKPYSQAKLKLNFDCSTLLNGRDKNKETQNLSVILRKDGKFYLAIMKKDQNKFFEKSALYEGNLGTMEKMDYKLLPWANKMLPKCLMPGSDKKKYGAFDQVLELYAKGSFKKSEKSFNLPDLHTLIDFYKSALPKYEDWKVFNFQFQATENYQDISQFYREVEQQGYLLNWRNVNEELIKQGIKDWSLFLFQISSKDFEGKSRTPDLQTLYRNQSFAPQTNVKLNGEAEIFFRPWSMKKEKKKLKVDNYDVFKHKRYTEDKILFHVPITLWFWNNEVSPSAPSKFNQKLNQELIIPHFDDLHVIGVDRWEKHLNLYKISTFVDIVEFSFLRLFRTYIRFLLL

SEQ ID NO: 776 - protein, 130 aa, unidentified
  REGION 1..130: note = Description of Unknown:uncultivated organism sequence
  REGION 1..130: note = Category: MG58 effectors
  REGION 1..130: note = Description: MG58-55 effector
MDNALYAYRMLKWFKVDTSKLGFLPEGEFYPSLDQLLQDYPLPKWYDMIRNYLTRKPYSQAKLKLNFDCSTLLNGRDKNKETQNLSVILRKDGKFYLAIMKKDQNKFFEKSALYEGNLGTMEKMDYKLLP

SEQ ID NO: 777 - protein, 1234 aa, unidentified
  REGION 1..1234: note = Description of Unknown:uncultivated organism sequence
  REGION 1..1234: note = Category: MG58 effectors
  REGION 1..1234: note = Description: MG58-56 effector
MTKPFFSQFINLYPIQKTLRRELKPLNENFQHDPSLSALRNSEIPQRDEQREKDYQAIKPLLDELHNEFITESLQSLEIQNRSGFVDFYQNYQKSKKNKAELSEKELKSLDEEFESRTKALRNAIGTSFSATAELRKSNPDYVNEKGKPFLTQKSYKILTEAGVLWLLEKKYASDPERLALIRRFGNFFTYFTGFNQNRENYYSTEEKSTAVAYRTINENLLTFANNCELFEKLSVPSLSELEKKIFNPDSYSEYLTQEWIDFYNEMLANIRSKANLYTQEHKTKLPQPKLLYKQIWSPRANTIPFDLIASEAEFQEMLHTMIRETDQRIPEFNKLLEQIFEEKADLSQIFLLKTALNIVSNRYFSSWHTLLEKGVELKLFKFKKNDEESFKLPAYLSLAELKELLEAVPFQTPEKSDTDEETHHQVSLLKLQRENLHLENSYSNWELLLKSMKSDFESFWTWEGEFWSYTSAKKALQSLSTLESTNQEHKNLIKMLLDNALYAYRMLKWFKVDTSKLGFVPEGEFYPSLDRLLQDYPLPKWYDMIRNYLTRKPYSEAKLKLNFDCSTLLNGRDKNKETQNLSVILRKDGKFYLAIMKKDQNKFFEKSALYEGNLRTMEKMDYKLLPWANKMLPKCLMPGSDKKKYGASDQVLELYAKGSFKKSEKSFNLADLHTLIDFYKSALPKYEDWKVFNFQFQATENYQDISQFYREVEQQGYLLNWRKVNEELIKQGIKDWSLFLFQISSKDFEGKSKTPDLQTLYWQELFESPTNVKLNGEAEIFFRPWSMKKEKKTLTVDNYDVFKHKRYTEDKILFHVPITLWFGNNEVSPSAPSKFNQKLNQELIIPHFDDLHVAWVDRGERNLWYFSIISVKTGKIVKQGTLNLLNGTDYEAKLSQKAENRLHARQNRDTIEKIADLKNGYISQVVNKLVELVLEYNAVIVFEDLNAGFKRGRQKIEQSVYQKLELALAKKLNFIVKKEKAVGEPWSVTSAYQLAPQINTFWDIKWKQRGIILYTRANYTSVTDPLTGWRKQHYFKKSSSEEMKAQFFKSFKNLTRDAGQEAYIFDDGTWQLYSNVERRRGKRGDHRERTQIKYDPSLELDTLFSKYQIEKSDSLFDQLKNRELPQTFWTSFFRILDLIMQIRNTDDEGRDIILSPIGNPQERFDSRKRYDQLPRDEKGLVIEESEFEYPTSGDANGAYNIARKGVMMLERIKENPEKPDLLVRDAEWDSWVI

SEQ ID NO: 778 - protein, 1237 aa, unidentified
  REGION 1..1237: note = Description of Unknown:uncultivated organism sequence
  REGION 1..1237: note = Category: MG58 effectors
  REGION 1..1237: note = Description: MG58-57 effector
MTKPLFSQFTNLYPIQKTLRRELKPLNENFEHDPALSALRNSEIPQRDEQREKDYQAIKPLLDELHNQFITESLQSLETQNRSGFIDFYQNYQKSKKNKADLSEKELKSIDEEFESRTKALRTAIGNSYAKLAELRKSNPDYVNEKGKPFLDQKSYKILTESGVLWLLEKKYASDPENLALIRRFGNFFTYFTGFNQNRENYYATDEKSTAVAYRAINENLLTFANNCGLFEALQVLDLSLEEKNIFNPDSYSDYLVQEGIQDYNTQIASIKSKINLYSGAHKTKLPQPKLLYKQIWSPRANTIPFDLIASEAEFQEMLHTMIRETDQRIPEFKKLLAQIFEEKADLSQIFLSKTALNIVSNRYFSSWHTLLEKGVELKLFKFKKNDEESFKLPAYLSLAELKELLEAVPFQTPEKSDTDEETHHQVSLLKLQRENLHLENSYSNWELLLKSMKSDFESFWTWEGEFWSYTSAKNALQSLSTLESANQEQKNLIKMLLDNALYAYRMLKWFKVDTSKLGFVPEGEFYPSLDQLLQDYPLPKWYDMIRNYLTRKPYSQAKLKLNFDCSTLLNGRDKNKETQNLSVILRKDGKFYLAIMKKDQNKFFEKSALYEGNLGAMEKMDYKLLPWANKMLPKCLMPGSDKKKYGASDQVLELYTKGSFKKSEKSFNLPDLHTLIDFYKSALPKYEDWKVFNFQFQATENYQDISQFYREVEQQGYLLNWRKVNEELIKQGIKEWSLFLFQISSKDFEGKSKTPDLQTLYWQQLFKNQTNVKLNGEAEIFFRPWSMKKEKKTLTVDNYDVFKHKRYTEDKILFHVPITLWFGNNEVSPSAPSKFNQKLNQELIIPHFDDLHVIGIDRWEKHLAFYSVVSVKTGKIVKQGTLNLLNGTDYEAKLSQKAENRLHARQNRDTIEKIADLKNGYISQVVNKLVELVLEYNAVIVFEDLNAGFKRGRQKIEQSVYQKLELALAKKLNFIVKKEKAVGEPWSVTSAYQLAPQINTFWDIKWKQRGIMLYTRANYTSVTDPLTGWRKQHYFKKGSSEEMKAQFFRSFKNLTRDAGQEAYIFDDGTWKIYSNVERRRGKRGDHRERTQIKYDPSLELDALFSKYQIEKSDSLLDQLKNRELPQTFWTSLFRILDLIMQIRNTDDEGRDIILSPIGNPQERFDSRKRYDQLSRDEKGVVIEESAFEYPTSGDANGAYNIARKGVMMLERIKKNPEKPDLLIRDAEWDKENNKLT

SEQ ID NO: 779 - protein, 1247 aa, unidentified
  REGION 1..1247: note = Description of Unknown:uncultivated organism sequence
  REGION 1..1247: note = Category: MG58 effectors
  REGION 1..1247: note = Description: MG58-59 effector
MVKEIFYLLFSKKMKSDFFSPFTNLYPIQKTLRRELKPLNENFEYDPSLSLLRNSEIPQRDEQREKDYQAIKPLLDELHNQFIAESLQSLETQNRSDFVDFYQTYQKKKKNKVDLSEKELKMLNEEFESRTKALRTAIGNSYAKLAELRKSNPDYVNEKGKPFLTQKSYKILTEAGVLWLLEKKYASDPEKLALIRRFGNFFTYFTGFNQNRENYYATDEKATAVAYRAINENLLTFANNCELFEKLSVLSLSEREKKIFNPDSYSEYLTQSGIDFYNEMLANIRSKANLYTQEYKTKLPQPKLLYKQIWSPRGNTIPFDLINNDEEFKKMLHTMIAETDQRIPEFNKLLESIFEENADLSQIFLSKTSLNIISNRYFSSWHTLLEKGVELKLFKFKKNDEESFKLPAYLSLAELKELLEAVPFQTIEKADTAEGNHHQVSLLKLQRENLHLKNSHSNWELLLKSMKSDFESFWAWDEEFWSYTSAKNVIQSLSSLQSTNQEHKNLIKMLLDNALYAYRMLKWFKIDTSKLGFIPEGEFYPSLDQLLQDYPLPKWYDMIRNYLTRKPYSQAKLKLNFDCSTLLNGRDKNKETQNLSVILRKDGKFYLAIMKKDQNKFFEKSALYEGNLGTMEKMDYKLLPWANKMLPKCLMPGSDKKKYGASDQVLELYAKGSFKKSEKSFNLADLHTLIDFYKSALPKYEDWKVFNFQFQATENYQDISQFYREVEQQGYLLNWRKVNEELIKQGIKDWSLFLFQISSKDFEGKSKTPDLQTLYWQQLFESPTNVKLNGEAEIFFRPWSMKKEKKALKVDNYDVFKHKRYTEDKILFHVPITLWFGNNEVSPSAPSKFNQKLNQELIIPHFDDLHVIGVDRWEKHLAFYSVVSVKTGKIVKQGTLNLLNGTDYEAKLSQKAENRLHARQNRDTIEKIADLKNGYISQVVNKLVELVLEYNAVIVFEDLNAGFKRGRQKIEQSVYQKLELALAKKLNFIVKKEKTVGEPWSVTSAYQLAPQINTFWDIKWKQRGVMLYTRANYTSVTDPLTGWRKQHYFKKGSSEEMKAQFFKSFKNLTRDINQEAYIFDDGTWKLYSNVERRRGKRGDHRERTQIKYDPSLELDTLFFKNQIEKYDSLFDQLKNRELPQTFWTSFFRILDLIMQIRNTDDEGRDIILSPIGNVQERFDSRKRYDQLPRDEKGLIIEESEFEYPTSGDANGAYNIARKGVMMLERIKENPEKPDLLIRDAEWDSWAK

SEQ ID NO: 780 - protein, 1281 aa, unidentified
  REGION 1..1281: note = Description of Unknown:uncultivated organism sequence
  REGION 1..1281: note = Category: MG59 effectors
  REGION 1..1281: note = Description: MG59-1 effector
MNLDSFTRKYKLAKTLRFELRPVGRTLETFKEQFFEGDKRRAEDYPIVKELLDGEHKALLERALSNPPSDLDWTALAQAHEDYRTSDKSKEAKDALAAKQAEFRKKIVALFKKDDAFSNLTAPTPKDIFAAMRQRYEDAGEEVPEALVTFSRFAGFFKGYQENRRNIYSDEAQATSAANRAVNENFPKFLEDVRIFRHIADAYPAILSGAEKELAPLLKGRTLASLFDPAAYGSFLSQSNIDFFNSVLGGFVPEEGEKTRGINEFVNLYRQQHEDARTDRSLSALHSLYKQILSDRETRSLVPRALETDEDVLVSLRAMLEERLLGLATESGRVNVLDDLQALLSKIPAADDIWIDGAEISRVSMNLLGSWNALGSLMESAAEVRFASESTEKKRLSAIDKWMKRSVYALSELADLRQETDTGSVIVDVSKLWKGPAAAQRFDAARAAVAAALPLLSSPIPENGPKLRERKDDVEIIKAALDAVLDVLHFVKPLHAGEGLDRDEAFYSAFDPLYTALDGFVPLYNKVRNYLTKKPGETERIKLMFDNPTLADGWDQNKEKDNTCVLFFRDGLYYLGVMNPEEKTDFSKLSGPKTPGCYRKMVYKLLPGPNKMLPKVFFSKKGLELFHPSANLLERYHAGAYKKGPSFDLAFCRRLIDFYKASIAAHPDWSKFGFRFSPTSSYNGIDEFYREVSEQGYRISFENIPVETVDRLVEEGKLCLFQLWNKDFSRASTGRPNLHTQYWNAVFAPENLQDVVIKLNGEAELFYRPRSIKEHVFRHKVGEKMVNRRGADGSPMPESVHGELFRHFNGSPEPLSDEARAWIESGNLVVKDVTHEIVKDRRYTEDKFSFHVPLTINFKQPDAPARFNEQVRDFLRGNPDVNVIGIDRGERNLIYLTLVDRQGNLLEQRSFNVVSRTRRDGVEMRTDYQSKLAQAEKDRAAARLTWSEIGAIKDLKEGYLSAVVHEIAKMMVERNAIVVLEDLNFGFKRGRFRIERQVYQKFEKALIDKLNYLVFKDRGLAEPGGTLRGYQLTDAFESFERIGKQTGFLFYVPAGYTSKIDPTTGFTNLFNTKRCTNAAGIRDFFAAFDSIRWDAARRAFAFAFDYRNFKTSQESHRTAWTVYSANRRLVFDKDARTEKEIDPTAILLDALKKHGVSVTDGFDLKALLADTEPSKANAGFFRNVFYAFDRTLQMRNSRAGEDYIESPVLNGRGEFFDSRKADATLPKDADANGAYHIALKGVQLLEENIAENRTANGSADLKIEHKDWFRFAQELAARKFK

SEQ ID NO: 781 - protein, 1245 aa, unidentified
  REGION 1..1245: note = Description of Unknown:uncultivated organism sequence
  REGION 1..1245: note = Category: MG59 effectors
  REGION 1..1245: note = Description: MG59-2 effector
MTAMTDFTKLYNLSHTLTFELHPIGKTAEKLQESGLLNQDFKRSQDYAEVKSVLDEIHKKFLQEVLSDCDLSWQELADALKIFRINKDRRALEGIQKKYRKSLADKFSKNKFFKILTEATPSKLFRYLLDQPDMVERKVETFGKFACYFKGYQENRKNIYSAEEQQTAAAYRAVNVNFQKYLRVVELYGDFVKNFPELTEDIKQRTAELTKEDLSQVLQIENYNKFIAQSGIEYLNSLIAQINLSVNWYRQAHNVRLSFAPLLFKQILSDREQAFVVERIEKDDDLYEKLKAFCEQHICSVEIRGETGDLFSRLKGLFATLNDDSDLYVDAASLSGIGNVLTGNWSCFRDAMDAYANETLKSKILREKYCKQPVYSFSEIKSWRIVRTDDDGNTTPVRLTDYWNGKKVQEMFATEKTLRNRVLEMVRVSHDKNFRERNHDVALVKEYLDAVQGILHLLKPLNVGSENGGGFYDALSPIIPLYNQVRNYVTQKPSDIGKIKLMFNNPTLADGWDFNKEKANTSVIFCRNGEYYLGIMNPKSKTDFDKLAVDDPANCYQKMVYKLLPGPNKMLPKVFFADKNIDFFAPSGDLLRRYEAKEHLKGEKFDLAYCHELINFFKESIARHKDWSKFGFKFSETSAYSGIDEFYREVAEQGYKMSFANIPVGTIDKLVEDGNLFLFQIWNKDFSEKSTGIPNKFTLYWKALFDRRNLSDVIFKLNGEAELFLREPAITEPVVHRPGEKLVNKTVVMEVGGDHQAIRNSIPDVVYTEIYKYVNGMEEGPLSSAAKEHLNKFPRLDWEPGMGLEATLKRTVVKDVKFQLVKDRRFAKRFFSFHVPITVNFKSPDPKGVRLNDRVWVFLKDNPDVNIIGIDRGERNLIYVNCIDQKGRILLQKSFNVVGGFDYHQKLDMREKERAQARKSWSEIGSIKELKSGYLSGVIYEIARMMIKYNAIVVMEDLNGGFKRSRTGIEKQVYQKFEKALIDKLNYLVFKNESDWSAPGGLLNGYQLTEHLESFSKLGRQCGWLFYVPAAYTSKIDPSTGFVSLFKLKDYTNSEKRKAFFENFKSIVYQAELDAFVFAFDYKKFKDVQSCWQSSWEVCSAKRRLVYSSRSQQIEEVNPTQLIKRALDKRDVALSDGFDLKHYISTVEAVDENAAFFKALLDAFGMTLQMRNSSKTEDYIESPVLNSKGLFFDSRKADENWPQDADSNGAYHIALKGLLCLKKGKVDLKLKDWFEFVQRRDFMVK

SEQ ID NO: 782 - protein, 1312 aa, unidentified
  REGION 1..1312: note = Description of Unknown:uncultivated organism sequence
  REGION 1..1312: note = Category: MG59 effectors
  REGION 1..1312: note = Description: MG59-3 effector
MKHHHALFAPISDSSGSAEAAPKSIRDFTGLFAVSETLQFELRPLDADFKPKSPELALADMDKYLEKDRERAGQYSNLKLILDEEHKKLIERVFSDVSASIRRLPASASGRKLLNDAGTGICWSKLAEAERQESFEKVQESFRKLIAELLNTDEKKKSLLEATPSKYIKGMLSSPDLSDSDRKTLSAFEKFACYLKGFQENRANLYSDEAKITAISNRIVNQNFPKFLIGCQIMKHIGEQYPEIIQSAERNLASILHGLSLKDVFRPDAFDRCLSQSGIDAYNNLLGGFTADGGAQKIQGINETINLYRQQHPDVVKKDKLFAPLPSLFKQILSERSSISYIPEMFDSDHAVCETIRTFLAEADLAKALQSITDLLSSIAPDDSGVFVTANELNWISNKVFGAWNMIERALDNYAETLKTKKEQEKWLKKKYYSLAELGALDFRAITTEDAAIPAVADFWRGQVFGQTAATLTNAVAEVQSVLNSPAYLPGNRDPLMRENADDVKRIKALFDSLLDLLHFLKPLRVDAPDANQVFYTGFNAVYDRLDTVVPLYNRVRNYLTRKPSEMKKTKLMFDCATLADGWDRNKESSNNAVLLLKDGNYYLAIIQPAKSRTDRKVDFASLESDRQGDCFRKMVYKYLPGPNKMLPKVIFSDRNRDLFAPSAELKRKYDAKMHTKGDNFDLGFCHELIDYFKACIAKHEDWSKFGFKFSDTAKYRGIDEFYNEISAQGYKMSFTPIPASSISDLIRQDKILLFQIYNKDFAPGATGRPNKFTLYWKQLFDEKNLNDVVFKLNGEAELFLRDPSIRKPFRHRKGEKLVNRTQKDGTPIPESVHRELCKLANGQLNESALSPEARSIWLSGQALVKTATHDIVKDRRFTVPKILFHVPITINFKSPDGKYGINQRVNDYLRGNSDVKIIGIDRGERNLIYITLVDQSGRILLQKSFNTIPQKRPDKTIELDYHAKLDLREKERDEARKNWTEINRIKDMKAGYLSQVVHEIARLMVEHNAIVVMEDLNAGFKRGRTAFEKQVYQNFERALITKLNYLVFKDAEESAPGFVRKGLQLANFFDSFEKLGKQSGFLFYVPPSYTSGIDPATGFVSLFQFGKYTNAAARKQFFESFESIRFDAGRNAFTFEFDYSKFPVPKNSEPSKVRRWTVFSVGDRIVHRMKDAQTVKPTAVILGELQKRGIQVTDGFDLLEYIRGTDADSRNASFFNAIFDAFRWTVQLRNSDKENDYILSPVLSPDGTFFDSRKATDGMPKDADANGAYHIAMKGLYLLQNRFPATDSKKIDLFISNRDWLDFMQTRSRAN

SEQ ID NO: 783 - protein, 1317 aa, unidentified
  REGION 1..1317: note = Description of Unknown:uncultivated organism sequence
  REGION 1..1317: note = Category: MG59 effectors
  REGION 1..1317: note = Description: MG59-4 effector
MKHHHALFAPNSDSSGSAEAAPKSIRDFTGLFAVSETLQFELRPLDADFNPKSPELALADMEKYLEKDRERAAQYSNLKSILDEEHKKLIERVFSDVSASIRRLPASAPGRKLLNETGTGILWSKLVEAEGQESFEKVQESFRKLIAELLNTDEKKKSLLEATPSKYIKDMLSSPDLADSDRKTLSAFEKFACYLKGFQENRTNLYSAEAKITAISNRIVNQNFPKFLIGCRIMAHIWKQYPEIIQSAEKNLASILHGRSLHDVFRPDGFDRCLSQSGIDAYNNLLGGFTAEGGAQKIQGINETINLYHQQHPEEVKKDKMFAQLPSLFKQILSERSTISYIPEMFDSDHAVCEAIRTFLAEADLTQTMQTISDLLNSITPADSGIFVAANELNWISSKVFGSWNQIERALDDYAETLKSKKEQEKCLKKKYYSLAELGTLDFRSLTAEDAAVPAVADFWHGQFFNQTADAVTNAVAEVQSVLNSPDYQPGNRDPLMRENADDVKKIKALFDSLLDLLHFLKPLRVDAPDADQVFYTGFNAVYDRLDTVVPLYNRVRNYLTRKPSEMKKTKLMFDCATLADGWDKNKESDNNAVILLKDENFYLAVIQPAQKKVDGKREQKVDFAKLETTDSGACFRKMIYKYLPTPSRMLPKVVFGKSNEALFHPSAELLRKYRADMHKKTSPNFDLGFCHELIDYFKACIAKHEDWSKFGFKFTDTAKYRGIDEFYNEISAQGYKMSFTSIPASSISDLIRQDKILLFQIYNKDFAPGATGRPNKFTLYWKQLFDENNLNDVVFKLNGEAELFLRDPSIRKPFRHRKGEKLVNRTQKDGTPIPEPVHIELCKLANGQLNENTLSPEALSIWQSGQAVVKAATHDIVKDRRFTVPKFLFHVPITINFKSPDGKYGINQRVNDYLRGNPDVKIIGIDRGERNLIYITLVDQSGRILLQKSFNTIPQKRPDKTIELDYHAKLDLREKERDAARKNWTEINRIRDLKAGYLSQVVHEIAKLMVEHNAIVVMEDLNAGFKRGRTAFEKQVYQNFERALITKLNYLVFKDAEESAPGFVRKGLQLANFFDSFEKLGKQSGFLFYVPPSYTSGIDPATGFVSLFQFGKYTNAAARKQFFESFESIRFKAGRSAFAFEFDYSRFPVPKNAEPSKVRRWTVFSVGDRIVHRMKDTQTVRPTCVILGELQKRGVQVTDGFDLLEYIRGTDEDSRNASFFNAVFDAFRWTVQLRNSDKENDYILSPFLSPDGTFFDSRKATDGMPKDADANGAYHIAMKGLYLLQNRFPSTDSKKIDLFISNRDWLDFMQTRSRAN

SEQ ID NO: 784 - protein, 1276 aa, unidentified
  REGION 1..1276: note = Description of Unknown:uncultivated organism sequence
  REGION 1..1276: note = Category: MG59 effectors
  REGION 1..1276: note = Description: MG59-5 effector
MNNSFTHQYSISKTLSFELRPIGRTEETVRSIFLPQDEKRAKDYFEVKELLDAEHKAFLNHALQNVPNLDWEDLENAHEAYRKSEKSAKDKKVLEEVQGKFRKEIARAFKADGERYAEITATTPSRIFARLIEQHENANEKIPDSLLSFVNFGGYFIWFQNNRKNIYSEEAQSTSAANRAINENFPRFLHDVKTFLHLVENYPSIIKDAENELLELLNGETFACLFDVSSYGRFLPQDGIDLFNQILGGYTKNDGTKIRGLNEFVNLYRQQHKEVQNDKGLLPLIPFYKQILSDRTTLSNRIKPFENDSEVIEILKYMLTDGLAFETESGRIKIGDALKKLFACISNSEGIWIDRRQLSNLSKMMFDSWGTIKTIMESEAVKMFSNEKTEKKKQSAIDKWMRRNAYSLHELFGMKIETDNEERFVDVAAFFQSDALMKHLKSIEEAKAKALVALSVENAENIPLREQEETKQKIQSALDSILELFQFIKPLYVDNSMERDESFYSQFDKIYSALDEFVPFFNKIRNYLTKKHDGSEPIRLMFGNPTLAAGWDKNKELDNTCVLFIKDGLYYLGIMNPKAKTDFSKFAVGDSQDCYQKMVYKFLPEPHKMLPKVFFSEKGKSIYNPPPSLIKKYQLGFHRHGETFDLEFCHELIDFFKKSIGAKTEWQTFNFKFSPTESYDGIDKFYNEIKEQGYKISFENIPVKVIDSLVDDGKLCLFKLWHRDFSDKFTGKPDPYTFYWKAAFSPENLRDYIIKLNGNARVFYRPASIKKPFSHKTGENMLNRRGKSGKAIPGEIYGELFRHFNGDKTPLSAEAQHWIDSGELTIKKATYEIVKDRRFTKDQFKLEVPIVINFKQPESPNNFNEKVNQYLRENTDVNIIGLDRGERNLIYLTVVNQNGDILEQRSLNSIGNTNPNGTEILTNYKEKLSDIEKERQQQRKSWQSLSAIADLKSGYISMVVHEIAKLMIKYNAIVVLEDLNVGFKQTRTKVERQVYQNFEIALIKKLNYLCFKDKKALEVGGVLAGLQLANKFETFEKVGKQTGFIFYVPAGYTSKIDPTTGFTNLFNTKKCTNAQATQRFFNSFDSIIWDEKSKSFALAFDYNNFKTGIKSPRSKWVVYSAIRRLVFSKEKKSTVELNPTQIIIDAVKKMGLALTDGFDLKAVLSNLEPSRENAWFFRSVFYAFDKTLHLRNSNEIEDYIESPVLNAAGEHFDSRNAPKSLPQDADANGAYHIALKGIMLINSIRSSEKPNLAIKNEDWFKFAQELAERKIGGIAK

SEQ ID NO: 785 - protein, 1255 aa, unidentified
  REGION 1..1255: note = Description of Unknown:uncultivated organism sequence
  REGION 1..1255: note = Category: MG59 effectors
  REGION 1..1255: note = Description: MG59-6 effector
MTKMTDFTKLYQLSHTLKFELRPIGKTSENLQNSGLLEEDFKRSQDYVEVKLVLDEVHKKFLQDVLSDCDLSWQELADALKIFQVNKDRKVLEDVQKKYRKLLVDRFNKNKFFKTLTEATPSKLFKSLLAEPDMAERKVETFKRFACYFKGYQETRKNIYSAEAQQTAAAYRAVNENFVKYLRVVELYENFRKNFPELAEEIGRRTAELTDGELSQILRIENYNRFIAQSGIEYLNSLIAQINSAVNLYRQAHNVKLSFVPLLFKQILSDREQAFSLERIEKDADLDEKLRAFCERHIGNVEIRGETGDLFSRLKVLLTTLNDDCELYIDAASLSAIGNALTGNWSCFRDAMAAYANETLKNKSLREKYCKQPVYSFSEIKSWRVVRTDDDGNVQPVCLSDYWHGEKTLELFAAEKILRNRILEMVRVPHDKNFRERKNDVALVKDYLDAVVEILHLLKPLNVGSENGGDLDLLGTLTEFYEALSPVIPLYNQIRNYVTQKPSDIGKIKLMFNNPTLADGWDLNKEKDYTAVIFCRNGMYYLGIMNPKSKTDFNSLATDSSSDCYQKMVYKQLQNPNQMLPKVFFSAEKIKFFAPSEELLRRYKAGEYKKGEKFDLAYCHELIDFFKRSIDRHEKWSKFEFKFSETSAYSGINEFYREVAEQGYKMSFVNIPVKAVDQLVEDGKLFLFQIWNKDFLEKSTGTPNKFTLYWKALFDRQNLSDVVFKLNGEAELFLREPAITEPVVHRSGEKLVNKTVVAAVDGNGVAIRNSIPDSVYMEIYNHVNGMEDGTLSPAAREHLNRFPRLDWEPGMGLEATVKRTVVKDVKFQLVKDKRFTERKFSFHVPITVNFKSPGLKGAKLNEMVWEFLKDNPDVNVIGIDRGERNLIYVNCIDQKGRILLQKSFNIVGGFDYHQKLDLREKERGQARKSWTEIGTIKELKAGYLSGVVYEIARLMVEYNAIVVMEDLNGGFKRSRTGIEKQIYQKFEKALIDKLNYLVFKNESDWHVPGGLLNGYQLTGPLESFAKLGKQCGWLFYVPAAYTSKIDPSTGFVSLFKLSNYTNTEKRKAFFENFESIVYQAERDAFVFAFDYKKFKDVQSCWKTSWEIYSAKRRLVYSSRSRQIGEINPTRFIKRALDKRGVVLSDGFDLKHYITSVEAVNENAAFFKDIFDAFGTTLQMRNSSGEEDYIESPVLNENGQFFDSRKAGKEWPRDADSNGAYHIALKGLLRMKSGQTAKLKRLDWFEFVQRRGFITE

SEQ ID NO: 786 - protein, 1255 aa, unidentified
  REGION 1..1255: note = Description of Unknown:uncultivated organism sequence
  REGION 1..1255: note = Category: MG59 effectors
  REGION 1..1255: note = Description: MG59-7 effector
MTKMTDFTKLYQLSHTLKFELRPIGKTSENLQNSGLLEEDFKRSQDYVEVKSVLDEVHKKFLQDVLSDCDLSWQELADALKIFQVNKDRKVLEDVQKKYRKLLADRFNKNKFFKTLTEATPSKLFKSLLAEPDMAERKVETFKRFACYFKGYQETRKNIYSAEAQQTAAAYRAVNENFVKYLRVVELYENFRKNFPELAEEIGRRTAELTDGELSQILRIENYNRFIAQSGIEYLNSLIAQINSAVNLYRQAHNVKLSFVPLLFKQILSDREQVFTLERIEKDADLDEKLRAFCEQHIGNVEIRGETGDLFSRLKVLLTTLNDDCELCIDAASLSAIGNALSGNWSCFRDAMTAYANETLKNKSLREKYCKQPVYSFSEIKSWRVVRTDDDGNVQPVCLSDYWHGEKALELFATEKILRNKILEMVRVPHDKNFRERKNDVALVKDYLDAVVEILHLLKPLNVGSENGGDLDLLGILTEFYEALSPVIPLYNQIRNYVTQKPSDIGKIKLMFSNPTLADGWDLNKEKDNTAVIFYRNGMYYLGIMNPKSKTDFDNLATDSSSDCYQKMVYKLLPGPNKMLPKVFFADKNIDFFAPSEELLRRYKAGEHLKGEKFDLAYCHKLIDFFKRSITRHEEWSKFDFQFSETSAYAGIDEFYREVAEQGYKMSFVNIPVKAVDQLVEDGKLFLFQIWNKDFSEKSTGTPNKFTLYWKALFDRQNLSDVVFKLNGEAELFLREPAITEPVVHRSGEKLVNKTVVAAVDGNGMAIRNSIPDAVYTEIYKHVNGMEEGTLSPAAREHLNRFPRLDWEPGMGLEATVKRTVVKDVKFQLVKDKRFTERKFSFHVPITVNFQSPGLKGAKLNEMVWEFLKDNPDVNVIGIDRGERNLIYVNCIDLKGRILLQKSFNIVGGFDYHQKLDMRERERGQARKSWNEIGTIKELKAGYLSGIVYEIARLMVEYNAIVVMEDLNGGFKRSRTGIEKQIYQKFEKALIDKLNYLVFKSESDWHVPGGLLNGYQLTGPLESFAKLGKQCGWLFYVPAAYTSKIDPSTGFVSLFKLSNYTNTEKRKAFFENFESIVYQTEQDAFVFAFDYKKFKDVESCWKTSWEVYSARRRLVYGRRSRQIEAINPTRLIKRALEQRGVVLSDGFDLKHYITSVEAVNENAAFFKDIFDAFGTTLQMRNSSGEEDYIESPVLNENGQFFDSRKAGKEWPRDADSNGAYHIALKGLLRMKSGQTAKLKRLDWFEFVQRRGFITE

SEQ ID NO: 787 - protein, 1255 aa, unidentified
  REGION 1..1255: note = Description of Unknown:uncultivated organism sequence
  REGION 1..1255: note = Category: MG59 effectors
  REGION 1..1255: note = Description: MG59-8 effector
MTKMTDFTKLYQLSHTLKFELRPIGKTSENLQNSGLLEEDFKRSQDYVEVKSVLDEVHKKFLQDVLSDCDLSWQELADALKIFQVNKDRKVLEDVQKKYRKLLADRFNKNKFFKTLTEATPSKLFKSLLAEPDMAERKVETFKRFACYFKGYQETRKNIYSAEAQQTAAAYRAVNENFVKYLRVVELYENFRKNFPELAEEIGRRTAELTDGELSQILRIENYNRFIAQSGIEYLNSLIAQINSAVNLYRQAHNVKLSFVPLLFKQILSDREQVFTLERIEKDADLDEKLRAFCERHIGNVEIRGETGDLFSRLKVLLTTLNDDCELYIDAASLSAIGNALTGNWSCFRDAMAAYANETLKNKSLREKYCKQPVYSFSEIKSWRVVRTDDDGNVQPVCLSDYWHGEKALELFATEKILRNKILEMVRVPHDKNFRERKNDVALVKEYLDAVVEILHLLKTLNVGSENGGDLDLLGTLTEFYEALSPVIPLYNQIRNYVTQKPSDIGKIKLMFNNPTLADGWDLNKEKDYTAVIFCRNGMYYLGIINPKSKTDFNSLATDSSTDCYQKMVYKQLQNPNQMLPKVFFSAEKIKFFAPSEELLRRYKAGEYKKGEKFDLAYCHELIDFFKRSIDRHEKWSKFEFKFSETSAYSGINEFYREVAEQGYKMSFVNIPVKAVDQLVEDGKLFLFQIWNKDFSEKSTGTPNKFTLYWKALFDRQNLSDVVFKLNGEAELFLREPAITEPVVHRPGEKLINKTVVVAIDGNGVAVRNSIPDSVYMEIYNHVNGMEDGTLSPAAREHLNRFPRLDWEPGMGLEATVKRTVVKDVKFQLVKDKRFTERKFSFHVPITVNFKSPGLKGAKLNEKVWEFLKDNPDVNVIGIDRGERNLIYVNCIDLKGRILLQKSFNIIGGFDYHQKLDLRERERGQARKSWNEIGTIKELKAGYLSGVVYEIARLMVEYNAIVVMEDLNGGFKRSRTGIEKQIYQKFEKALIDKLNYLVFKNESDWHVPGGLLNGYQLTGPLESFAKLGKQCGWLFYVPAAYTSKIDPSTGFVSLFKLSNYTNTEKRKAFFENFESIVYQTEQDAFVFAFDYKKFKDVESCWKTSWEVYSARRRLVYGRRSRQIEEINPTRLIKRALDKRGVVLSDGFDLKHYITSVEAVNENAAFFKDIFDAFGTTLQMRNSSGEEDYIESPVLNENGQFFDSRKAGKEWPRDADSNGAYHIALKGLLRMKSGQTAKLKRLDWFEFVQRRGFITE

SEQ ID NO: 788 - protein, 1255 aa, unidentified; identical to SEQ ID NO: 786
  REGION 1..1255: note = Description of Unknown:uncultivated organism sequence
  REGION 1..1255: note = Category: MG59 effectors
  REGION 1..1255: note = Description: MG59-9 effector

SEQ ID NO: 789 - protein, 1255 aa, unidentified; identical to SEQ ID NO: 786
  REGION 1..1255: note = Description of Unknown:uncultivated organism sequence
  REGION 1..1255: note = Category: MG59 effectors
  REGION 1..1255: note = Description: MG59-9 effector

SEQ ID NO: 790 - protein, 1280 aa, unidentified
  REGION 1..1280: note = Description of Unknown:uncultivated organism sequence
  REGION 1..1280: note = Category: MG59 effectors
  REGION 1..1280: note = Description: MG59-10 effector
MFKNFVGLYKMSKTLRFELKPVGATLANMKKSGVLERDFVRAEKYKMMKDILDLQHKALLERTLSSVDNFTRCMGEKERKKYAVILAENGVLNWEILAKAFEDFRTSSKDKESRDKLESVCASYRTLIAEIIKSDDKYKCLAASTPKDFIKEFLANEGSGDAAEKLAVETFNGFACYFTGFQENRSNIYSDKAQKTSAANRAVNENFPRYLKCCSLYDYVVKKYPDIIAEVELALGEKAKEFSASKCLTVGKYSDFLSQRGIEKINTLIGIFNQQINLKKQSDESARQDKKLGQMPVLYKQILSDRESASFSIEKFESDADVFSSIKNFGEFLKNNNVLTKLYNLIATVRIEDTIFVKRESLSEISNNLYGDWHELSAAIERVAEEKFSNITAKGHREKAIKQWISRNEYPLTDFVDAVRYDEKNNNWVTIDICDYWKNEKSKVLFELVESSWKALLPILDTDEKIGLRDRKDDVKAIKEYLDSILNVIRLVKPLSVGAELERDTDFYGQFDELYDILDDVVPLYNQARNYITSKPSEEKKLKLMFDSPTLADGWDQNQEEANKAVLLEKGGQFYLGIVNAKLGKKERPDFLKLRSRDSSNCYRKMVYKLLPGPNKMLPKVFFSNKGLPIYKPSPRLLERYKNGDYKKGATFDLQFCHQLIDFFKKSIAIHPDWSKFGFEFSPTSSYGGIDDFYREISNQGYKISFDSIDEKVIDSFVDSGALYLFKLHNKDFSSGSTGRQNLHTIYWRMLFASENLEDVIYKLNGEAELFYRRASIKNPYIHKFGKKLVNRIDREGKRIPDVAFGQLVKFADGEIAVGELSGVAKDLYDAGKVVMKDVKHEIIKDRRFAEDKFFFHVPITINAKANDKASRFNDFVNDAVRNFEDVNIIGIDRGERHLLYVTVIDNNGKILEQRSFNTIDIDRYDGKRIDVDYHAKLDQMEKDRDKARKSWSEIGKIKDLKSGYLSMVVHEIAKLMVKYNAIVVLEDLNGGFKRGRSAIEKQVYQKFEKAMIDKLNYLVFKDSEPLCLGGSLRGYQLADKFESFEKLGKQTGFIYYVPAAYTSKIDPTTGFTNIFDFKECTSAEGIKRFFNLFDSIKYSETDKAFIFAFDYNKFNTRFPSWNSKWEVYSASRRLVYSKDQKTDVEINPTDVIIDALVKRGVAITDEFNLGLYLKEMDATRENASLFKSVFYAFERTLQMRNSSAKTGEDYIESPVKNSSDGFFDSRKCGKELPENADANGAYHIALKGLMMVNELKTNETPKLAIKNEAWLEFVQRMRK

SEQ ID NO: 791 - protein, 1262 aa, unidentified
  REGION 1..1262: note = Description of Unknown:uncultivated organism sequence
  REGION 1..1262: note = Category: MG59 effectors
  REGION 1..1262: note = Description: MG59-11 effector
MAKNTKLSQFTGLYPVSKTLRFELKPMGKTLEKIKETGIIENDKKRHNDYFDAKKIIDKYHKYFIDAALSKFPRIDWNPLKEAIERSLDRSDASKKKLEKTQTEFRKKIAKALTTHDHYKELTASTPKELFLKVFPDHFGKQPAIDTFDGFSSYFTGFQENRQNIYSDEAISTAIPYRLVHDNFPKFLSNIEVYKTLKDNAPSVLSDAENELKDFLNGKSLANIFELNAYNDVLTQSGIDFFNQVIGGISGEGGEKKTRGINEFSNLYRQQHPEFAQKRLATKMIPLYKQILSDRETKSFILESYSTDSQVQESVKEFFESQILNCDIAGRKVNVLKELSSLIKRITEFDLGSIYVNQEELSNISLELFKSWNTINAILFKNAENRIGSAEKAANKKKIDAWMKNNEFSIATLNLAIAESDSEEISRVKIESYWNNFEAKVQSILCGDNRRNLDEFLSATFNENNALREDSKIIEKLKAFLDALIEIMHSIKPLISDAENRDLSFYNELTPLYDQLSLVVPLYNKIRNYATQKLTESEKFKLNFDNPTLADGWDQNKEDANTAILLLKNGLYYLGIMNAKNKPKIKDFKTSESEDCYDKMVYKLLPGPNKMLPKVFFSEKGLATFKPPKDILDGYNAGKHKKGDLFDIGFCHQLIDFFKESIAKHPDWKKFDFNFSDTSSYEDISGFYKEVTDQGYKITFSKIPTFQIDEWVNEGKLFLFQIYNKDFAPGAKGSPNLHTLYWKSVFSPENLKDVVVKLNGEAELFYRPSSVKKPYSHKVGEKLVNRIGKDGLPLPESVFGELFRYFNGKLDGELSDEAKRYLDVAVVKDVKHEIVKDRRYTQDKFEFHVPLTLNFKADSKNEYMNERVRQFLKDNPDVNIIGIDRGERHLLYMTLINQKGEILKQKSFNIVESVNYQAKLVQREKERDAARRSWSSVGKIKDLKEGFLSQVIHEITTTMIENNAIVVLEDLNFGFKRGRFCVERQVYQKFEKMLIDKLNYLVFKNKPEGDVGGVLKGYQLAEKFDSFQKLGKQSGFLFYIPAAYTSKIDPTTGFANLFNMTELTSAEKKKEFLSHFKDITYDGQNDRFSFSFDYKDFKCFQTDYIKKWTVYTQGKRIVYDKESKSAKEIFPVEIIKAALEKQNIALTDQLDVLSVINSVEASSKSASFFGDICYAFEKTLQMRNSIPNTDEDYLVSPVMNKRGEFYDSRSCGDTLPKNADANGAYHIALKGLYLIKNVFDAGGKDLKISHEDWFKFAQSRNC

SEQ ID NO: 792 - protein, 1271 aa, unidentified
  REGION 1..1271: note = Description of Unknown:uncultivated organism sequence
  REGION 1..1271: note = Category: MG59 effectors
  REGION 1..1271: note = Description: MG59-12 effector
MFEKFTGIYKVSKTLRFELKPIGKTAENMKKFNVLESDRVRDSQYERMKDILDAQHRALLERTLERVGKEEDVEDWVKLAEAYRKFRVGKKDKAARASLDKVLEAMRKSIVAAFGEDDLYKELVTESTPSKFIKRLVKDEMFKDSDEGRALDTFNGFACYFTGYQENRRNIYSDKPQTTATAYRAIDVNFPKFLDAVEVVRHIQDEYPKIIKLVEDELGDKLGGKRLATIFSVESYGSYLSQTGIDFFNLVLGGYAPKVGEKKRGLNEFINLELQQNECAASDAKLHKVAPLFKQILSDRESESFRFVAFEKDCDVIDAVKDFANRLEGDEIVGRLRKKLATLTKSEKIYVNGDASLTMVSKNLCGNWGALESCMRDAAEAKYKVLGTEKKIAKAVEEWMKSKAFALADLPDVTVADDKSEDGVKVYRVLDCWRGEPATAIFEALVTASAAVKGLPDNADDDEATLREDSKRVAVLKSYLDAVQDLLHLVKPLAVSAELDRDMNFYSEFDELYERLDEVVPLYNKVRNYVTKKVGEVEKMKLMFDCATLGDGWDLNKEQSNRCVILVKDGAYYLGIMRPRCKVSLDSLQSNSGADYKKMVYKYLPGPNKMLPKVVFSEKGKAKYKPSKELLDKYDKKCHIKSSPAFDIDFCHQLIDFFKDAINKNNDWSVFNFKFSPTKSYASIDGFYKEVTEQGYKIDFINVAIKDIDALVDRGDLFLFQIYNKDFAEGAKGRPNLHTLYWNAVFSPENLLNPIAQLNGGAELFCRPAAIKTPYAHEVGEKMLNRWTTAGEPIPETVFGELFKYINGRLSEIKLSAEAKSLLERKQLIIKPVKHRIVKDARYTCEKFFLHVPVAFNAFAGETYRFNDCVNAAVAANNNVNVIGLDRGERHLIYLTLINQKGEILLQKSFNTITGAAYDGHVREVDYQKKLTAMEKGRDAARKSWSEIGQIKDLKAGYISLVVHEIVSLMLKYDAIVVMEDLNFGFKRGRFKVERQVYQKFEKALIDKLNYLAFKDADTTSPGGVLKGYQLAAKFESFEKLGKQTGFVYYVPAGYTSKIDPTTGFTNLFNTKKCTSAAGIAEFFSRFDAITYDAGRNSFAFKFDYSNFKTSQTSWKKDWIVYSADRRLVFDVKTRVETEIHPTQIIFDALKKAGEKVADGYDLRAFLASVEPSKSNATIFRDIFYSFDRTLQMRNSCAATGEDYIASPVMNASGKFFDSRESGDDLPKNADANGAYHIALKGLYLVKNRLGKEKIDLKLTHEQWFEFVQNR

SEQ ID NO: 793 - protein, 1128 aa, unidentified
  REGION 1..1128: note = Description of Unknown:uncultivated organism sequence
  REGION 1..1128: note = Category: MG60 effectors
  REGION 1..1128: note = Description: MG60-1 effector
MVNLESFKNLYEVRKTVRFELKPYKKTREILKWDNNYQSLDSYIKHIKDWEFEDGFDWNDFCLWKYEDFLKESKKYYWFLLQINAEIQKWRNETTKKNIYFDFKKSKGIFKNIPSLKKIQWFEWLKSKLLEIQDEYQNYFNFFDQLQDKQHKNEKKSDISIHLRKIAYLNRNLFTIFNFFDIYKTHKEILDEYKEIIDYDFEKLNNSIIASHENEISGACFWKFTFNKFALFRREASPLKENFEANKQVLQKAVATMVENGEIVNDNWTIAGINTNQIHSLTLQKKNCYSLKFEEEIWTLQGRLEKFNFNRNLDEVISELDDINGQLLNQYIQNFVNGYKNDENVLEVSFYTDHEGNKIFDKSKKYDSYENGQKKEKFYPSLVKLDLEQFVEAQKRNQIKIQPGQTLKWYQYLNLLWKADLTDEEKEQKKIVNKFLQILFKQKFINPDYNTIKEFRDTLAKHRWKLRQNVRTSEREFIQEAMVRYYGQILEKNGCYFVALFDKDKLQNDIKNIVTDSQIKDKWMEGNYFKIYKYSQLSFSALEKLCLSKDWDLLSNSSLQKAWDKYKNQKKDIEWRCDFHKNWQDKSCTSCKSNEMQMRRSFLKAFKMHILQALEKLKNDEKYKWEDWSYLYWELKQKNSVEDIVSFINQKFYKLEEKYIEQEEVFKLADTWEILLFQVYSKDFNIFNSDFVSDEENLRDYEKDTWESQKTIGTSKREDGKQENLFTTYFKNIFKDDWETFLGQEWGIFFRKADSESDKKRFRSDKFFISLDILFNKGKQNNNAKLCESKEEKSKKHVKNTTLNIFNSIKNKDEITIMWIDRGSLSDELSVKNTKISMLWYVIITLRKEDKQYVLKEIKKSWDINWFIRGKGGGWKIVGKGQNMSSETNAKDYIDFKKILSNLKEEIQKELEKNNVKRNILKIIDKKEWITSLLISAISQLIQEYNVDYIALENLDNIYEDDKSFKKIMEERTLSTYLYQNLEVQLFKKLNYIYLKNEKVQDRQIFPICSIDEVKNLDSKNFFKIKESSNYDDYKMIWNIVFVKTSGTSSTCFNCENTIKKHGVVCKNCKISVKHDGSKLDLKDYKAKFVSKNILEKQNIQQDFNNDARAWLYIAKKAKEYLEYLFSH

SEQ ID NO: 794 - protein, 770 aa, unidentified
  REGION 1..770: note = Description of Unknown:uncultivated organism sequence
  REGION 1..770: note = Category: MG60 effectors
  REGION 1..770: note = Description: MG60-2 effector
LVKESKNNKNIKLFNLAYEWPLLNFVNENYRISNLEKKYLNLVQKLLIDLKDKDYKIWKNHKTWKYNLKNLSFLWDNFGLWDNSENKKIKNLEDLKIYFNDSWYKVIQKDVDLEKILKQVKAWELEIFQIKSKDMPFHKDFINDKNCWIIEEAKNEKSDGFKKDLNTLYFEQFFQDIAEWNKKTRIGADFKIRWINSSENNDYGSFWGKEKNQLRHLSNKENIEKFQNRFKRDRYSIEFSINLNATNHLTEEDFNTELSNKLKEKRETWSLRILSLDHGESSFLTYKIFEFSGENLEDIQIINTWWNFDNFQQEWNWPNRLQKNIQIDEKLVSYEGQEILDNYITKYHLMIQDQKRERQVEEAIKHFAKKSISKIKEIISADTVDKNKEWVSDMTKENVKKFIQYTIGYKEVFSLSNEENSIRNKNKGSNKSIENKKNGVEYSKRIEEFFQNKRLDVISLWEDTIRFDKINIFHILDYEFHFSYIKQEEWFIQKFPDQENIKEKIDTYLKQIQELLHDESKLIAFCNEVKKSFDWVSLADIDKLYNTPFYSYKTNFSLQLEQINNLKKWYVSALIGTISKWVRNWDVDVIALENNLLYYGVDNSKSFQKHMWAENHATFVEALINKLSFCLDKETNESYQFCYPIKVAERSQKFKNKNNGILIFVDEGITSLICPKCGQKLNRSKQDGDDHLHHNDKNPAWDKCQKEPFEIQKSKNIVGEYQGMRFHDWDDLATYNIAKKAKEYLESLPKKEDSEWSWKISGNITFTQSK

SEQ ID NO: 795 - protein, 1122 aa, unidentified
  REGION 1..1122: note = Description of Unknown:uncultivated organism sequence
  REGION 1..1122: note = Category: MG60 effectors
  REGION 1..1122: note = Description: MG60-3 effector
MEDLKNLFEVKKTVRFELKPYIETRKYLKWNNDYSTLNSYISHIKMEEFEKWFDWNEFCKSQYSDFLDKTEYISEFLEEVINELNKKNNDKKRKSIQFNFKWFKWVFKNIPSLKNIESFPRLKEKIEEMTESYKSSITFFDFKKDNDDKQSNQKQSDVSKELRKLAYLNRNFLTIFKYLWSNNGNETDEGILKKYEEVKNKLWENFKKLNSSIIASHQNETSGACIWKYTLNKYSLFRRETRKLKEKSRKSKKAIDKDVDFIIKNWIYDDKWFEIKLKKEDITNITLKTDFSDNFEKHIESLWLQYKLENFNFNRSLDEVIEELDLINAQLLNTYITYFKEEYEEFWESLLDIEFQTEFKIDNEWNNKPFNIYNNKSKPPKIRKLWYFSNEEGKYITLNQWQTLEWYEYLNLLDLEQKDLTDEEKYQKKLANKFLQIIFKQDFINRDYNNIKQFRDKLSKYRGKLRQDVKNSEREFISEGMIRYFWSILEKDWNYFLALTEKVDINWENKIDSIENIEIENTLNDNCIEWYFKIYKYHQLSFSAIEKLCLLKDWPDADNEKLIKYWDKYKYQKKDFKDYKDKSDFLSLFKKQIIDLVYLLKSDNKYNWYDFSSFLPKIEKFNSVEQIIEFIDHNFYKLEEKYISEEKLFKLADNKDILLFQIYNKDFNIYDEIFLSNEENIKEEKYSEKRKLLEIIDRKKDAKPNLFTLYWKDIFKNEAFLGQEWGVFFRKADLEKEEKRFRNNKFLVSFDVRFYKWKTIWDVKICDKKAQKTEKSYKKITLNYFNEIINKDKITILGIDRWSISSAINEKTKIAMLWFCVITLKKEKSNYILEDIVRTWDINWLIKETIKERNVNYIEFWKPVKKASGIKIDIDFKNVLLELKNNIMQEIEKKWQDRRDLQRILDKKIWLTSFLVNEIQKVIVEYDVNYVALENLDNIFNSTNKISFKKELEINTLSNYLYQNFETQLLNKLQLFTTKTNYNNKKQFIPNFKIDELKELPSNNWFLHTKTWKTIEHDFKDFKILWNTIFVWTAGTSSECFNCWEKIKKHWLICKNCNIDDRLKLKDYQENFVSKSILQNMDLQSDSKWKKLFNNDVRAWLVIAKKAKEYLEFLEKQKNNNS

SEQ ID NO: 796 - protein, 1165 aa, unidentified
  REGION 1..1165: note = Description of Unknown:uncultivated organism sequence
  REGION 1..1165: note = Category: MG60 effectors
  REGION 1..1165: note = Description: MG60-4 effector
MLQFADLKKKQITICQKLIPIGKTRENIDTFNAMANDEYVSDNKNEIKKLIKEMARFEIDEKLSNIKGSLDFTNLFTLMNKVDESENKEEILQELFFERAALAKTISSELNFKYTSAKTITEKLPKFISNNYDGDEKEKYLELVDKVKSRQAMFNRFEESIDFIAGELIKKNTLVYRLLVENSQIFLSNYKRIKEQDISSIITNLDVDDSIKTVLQNQCISFTPDNYNELLTQAKIDKYNYCISMINSELNVFCSVNKLSYSSYELKKLYKMILCEKDLLFEKINKFTDDEQVIDTYNDFITNVNDSNLFEKINSSAMDYDNIYIRPNFINAYSNITYGKWNIVSDCIKAHVEDLRLAGKNKITYEKYVENISIVKIDTIVNDYSSELGVKVNGRDYIEIIKEQLLHKYKEVTNDNISLKSDASIVSETIRKELDYALGTIRLLKLFDFENENFNSANEMALNEILDTLNPANLLYNMARNYITQKPSQKSKLNLVFDTNGFAGGWSESVESQKRVTLLKDDEGNKYLGIYNLNGCRANNTSVAAVVKNIQENLDTNSTKYYEKMIYSAVPDAAKDIPRLFINKSENNELIKKFKNKEHKENEEFKNELIEFIKRQIALHPTWSKYEFVYKDNYGSYKDFCNDINKQGYMLNWEKIDKSIIDNYVESGCIYLFRIHNNDYSKYKKTYSKVKAHTQYLDYLFSDENSKTKLIKLLGGAEVFYREPQIKNPYMHKKGSVLVNKKYKNGSPIGNEYKDLVIKAQTTALDNVFTKVSSRYIVKDNRYRKEQFELHFPILIGEERATDYEKICKNYIKNSNHTIVIGRGKNHLLYVSIYENNKVINAFPLDTVNGTNFKAKLEQIEELKNEQRKTWKNISSNRELLNGYVSAAIAPITDMVLKYKATVVIEIGDSSSKSRNLLPNRAYKIFKEALMKKLAFLTDKNKEMDEPGGLLHPYHLVNIDTRNPNRSINAAQNGIVMQVPAFYCALTDPESNLCNLTYAKTLKEKKQVLKKIGEIKYNKDEDIFTFIYDISKFNKDMKGVYECNSNGLRLIYNNNSEEKINLSQYLKNMLQCKSIDYKSGIINYDSEDKESIEAMFLIIRYTLQMLNKTFYISPVTNLTVQSNDCTESMINQNMYNRFLLLKDNLLLNKPTKYLSIKDVYSKLKP

SEQ ID NO: 797 - protein, 1165 aa, unidentified
  REGION 1..1165: note = Description of Unknown:uncultivated organism sequence
  REGION 1..1165: note = Category: MG60 effectors
  REGION 1..1165: note = Description: MG60-5 effector
MLQFADLKKKQITICQKLIPIGKTRENIDTFNAMANDEYVSDNKNEIKKLIKEMARFEIDEKLSNIKGSLDFTNLFTLMNKVDESENKEEILQELFFERAALAKTISSELNFKYTSAKTITEKLPKFISNNYDGDEKEKYLELVDKVKSRQAMFNRFEESIDFIAGELIKKSTLGYRLLVENSQIFLSNYKRIKEQDILSIMTNLDVDDSIKTVLQNQCISLTPDNYNELLTQAEIDKYNYCISMINSELNVFCSVNKLSYSSYELKKLYKMILCEKDLLFEKINKFTDDEQVIDTYNDFITNVNDSNLFEKINSSAMDYDNIYIRPNFINAYSNITYVKWNIVSDCIKAHVEDLRLAGKNKITYEKYVENISIVKIDTIVNDYSSELGVKVNGRDYIEIIKEQLLHQYKEVTNDNISLKSDASIVSETIRKELDYALGTIRLLKLFDFENENFNSANEMALNEILDTLNPANLLYNMARNYITQKPSQKSKLNLVFDTNGFAGGWSESVESQKRVTLLKDDEGNKYLGIYNLNGCRTNNTSVAAVVKNIQENLDTNSTKYYEKMIYSAVPDAAKDIPRLFINKSENNELIKKFKNKEHKENEEFKNELIEFIKRQIALHPTWSKYEFVYKDNYGSYEDFCNDINKQGYMLNWKKIDKSIIDNYVESGCIYLFRIHNNDYSKYKKTYSKVKAHTQYLDYLFSDENSKTKLIKLLGGAEVFYRKPQIKNPYMHKKGSVLVNKKYKNGSPIGNEYKDLVIKAQTTALDNVFTKVSSRYIVKDNRYRKEQFELHFPILIGEERATDYEKICKNYIKNSNHTIVIGRGKNHLLYVSIYENNKVINAFPLDTVNGTNFKAKLEQIEELKNEQRKTWKNISSNRELLNGYVSAAISPITDMVLKYKATVVIEIGDSSSKSRNLLPNRAYKIFKEALMKKLAFLTDKNKEMDEPGGLLHPYHFVNIDARNPNRSINAAQNGIVMQVPAFYCALTDPESNLCNLTYAKTLKEKKQVLKKIGEIKYNKDEDIFTFIYDISKFNKDMKGVYECNSNGLRLIYNNNSEEKINLSQYLKNMLQCKSIDYKSGIINYDSEDKESIEAMFLIIRYTLQMLNKTFYISPVTNLTVQSNDCTESMINQNMYNRFLLLKDNLLLNKPIKYLSIKDVYSKLKP

SEQ ID NO: 798 - protein, 1174 aa, unidentified
  REGION 1..1174: note = Description of Unknown:uncultivated organism sequence
  REGION 1..1174: note = Category: MG60 effectors
  REGION 1..1174: note = Description: MG60-6 effector
MNNLVKEQMAGLNKKTLTICQKLIPVGKTRENIDRFKAMEEDEFIKANREKVNVLIKKAAFEKIDNDLGSISKDIDFSDMFDLMGKYLECEGEGIEEISDKLFAERINLSTKLTSVFDFKFEGKDTIKVLLPEYLEKHDMDNKEELLELVEKVKSRQSMFNRYEGHIDSMLENVHKKGKFVYRILYENAIIFYNNIKKIKAFDYESVILNLEDEKNIKNNFLTKGFDSYNGFIRQSQINVYNYCVGAINYELNNYCQKNKLNYDKLELKKLNKMPLAETESFFEKIPTFDKDSDVIDAYNSVVCNINKEKITLDDKKAKSDEIIIKGSSIAKYSYNVYGNWKIVRDCLQLHCSDMVTAAKLKKSEKTLYDEYVNEGISVNLIHNIVTEYAPDLNISCTEVPLTQKIDTLMSGSFSECDYPKVSLKMNDCKEANYIRVTLDRILEARRLLCIYNTESVEFDMEFAELIESYLDILSPAILLYNMCRNYILAKPSARKKTSLTFNCTAFAQGWSEGVEYSKRVSLFKDEKENKYLAIYNALGCKESNMSVTGLVSEIYDNMTTEKQDDCYMKLVQNKTGNVSQALPRLFLNPTLSDEDRARFKAKEYNNDKEFLNHIINVVKTKIAEHETWKKYNFSFKDNYESYAEFVNDIQEQGYKTEWRYIKKSIIDDYVDGGMIYFFRIYNQDYSEFKSSDKLDIQTRYLNYLFSEENCDTDIVKLLANAEVFYREPQITNPYVHKQGSILVNKHYKDGKTVGVEYESIVKNIGDYNNVITKVAKHDIIKDKRYTVEQFELHMPLCIDNIRKETKKYDELSRKYIKESKNIITITKSRNHLLYVCVFDEKRNLLEQRSLDIANNVNYKEKIEIKEELKKINMESWKSVGSNQTIIEGYISCAIKDITDLVLKYDAVVVMEEESANADRNLLKNRNYKKFKTALINKLCYLVDNTKEDFEDGGTFKPYNLCNIEKEKDYKKIWNGIVIQVPAYYLSNKDVDSNFIELADTFANTNIQKKNVVKKFSDLRFNRNTKLFELKFESAKFKEDFKEVFICDSSGNRIVQNKKGVNEVNLTGTIKSELKKIGLEYATGENIFDYVDLKNKNHVTTLHKIIRLILQMYNVGANNSYFYSPVSHSLIRTDKDIYEVITCINLYERAMRVKKKISKDGKVKFKNLADIVIG

SEQ ID NO: 799 - protein, 1035 aa, unidentified
  REGION 1..1035: note = Description of Unknown:uncultivated organism sequence
  REGION 1..1035: note = Category: MG60 effectors
  REGION 1..1035: note = Description: MG60-7 effector
VKDSEIWYAIKIVSKLIIDNDFIKKDTELHNRLSQINRYNPNFWNFFELNTLNPFTVNRWKISEIINSYEISLNQYKETLVNLNKEAYTIANAILSDRYFENCRNQKESDGTVRYLFHIFSNCKNSSEKNVWQINHLILLVNKYESLKNGKKKYTNDEIELKIKRLNKELRQLAKVRSELLWYQIHLIDNFQTEKFSFLIQSWKYYFVWMKKMWWENNLSQFQEFIDGLESGDDKLLYLDSMTWGGFKRLFLSKQSDVVFTDGIRIKDLNRTILAKEEEILQLKKWIIEKIEKDINIYISKVTNDIFNEINSKEKIKFIEYLSQKWKKVDNLFKLWKKNRKQLIYGKELKEFGNSLYNFDSIKEQFNLDKLEKEYSDLVQKLLIKIKDKKYEIWKNNFKSLSFLWDNFKDRKFENLDDLKNYFNDSWYKVIVKNVNLEKILKQVKAWELEIFQIKSKDMPFHQDFINDKNCWIIEGVKTEKGGSFKKDLNTLYFEQFFQDIAEWNKNTRIGADFKIRWINSSENNDYKSFWKKEKNQLRHSNNKENIEKFKNRFKRDRYSIEFSINLNATNHLTEEDFNTKISNKLKEKRETWSLRILSLDHGESSFLTYKIYQVEGNKYSIINQWWNFDNFKEVQDWEDKTTKRQENMQIDEEKVLYKDQKILDSYITKYHAMIQDQKRERQVEEAIKHFARKSISKIKEIISADTIDKNKEWVSDTTKANVKKFIQRSIDKTWNKEKDSIVSVLGKFYFDYNKYSFKKYFPDQENIKEKIDTYLKEIQELLDDESKLIAFCNEVKKSFDWVSLADIDKLYNTPFYSYKTNFSLQLEQINNLKKWYVSALIGTISKWVRNWDVDVIALENNLLYYGVDNSKSFQKHMWAENHATFAEALINKLSFCLDKETSESYQFCYPIKVKDRKKLKDKNNGILFFVDQDTTSLICPQCEGKLKRDKADWEDYLYHNDENLAWDGCEEDPFEIKKSEGKKWEYNWIIFENWDDLATYNIGRKGVLMLEKIKENPEETDLLIRDNDWDGLVK

SEQ ID NO: 800 - protein, 1189 aa, unidentified; identical to SEQ ID NO: 690
  REGION 1..1189: note = Description of Unknown:uncultivated organism sequence
  REGION 1..1189: note = Category: MG60 effectors
  REGION 1..1189: note = Description: MG60-8 effector

SEQ ID NO: 801 - protein, 1144 aa, unidentified
  REGION 1..1144: note = Description of Unknown:uncultivated organism sequence
  REGION 1..1144: note = Category: MG60 effectors
  REGION 1..1144: note = Description: MG60-10 effector
MDKYQLTRTIRFKLKRFNGALQTEVDIAKKSTSDQELEKLLEELSMNMNSYNQRWSDFLYKLHEGKKNRRILNRIQVTPKWLELYARPFLYHKTSRPKHGKPLLTDYHGLPDYIENRLEEWQHLRETLDKLRTRPEHHQARRSEYALLIEKINIPQNFPFFYALADYAQDKDNEKYKNELIVIGERIYSLLSSLRKAYAPAQHTGIEIARASLNYFTINKKPKEYDDEIEQWLEEQNQEYTLADIKSKLSLNPIIIKPDIRDSLPDKATLGEWYSHLKTFKAEQRSALDNCMITSKSIEEWPILFKKINTNKAKELISLTSKITSNANKINNLYQILNDKKKSKRAKDVADKELKTIRNNQIQIKRKRGSIISKAPDFKNFVDAYATIAKENGKIKAKIRGLKKERQDSQLLNYWALLLENCKRHELLLIPRKNRKKVYKILEKLPKTNDKGEASVIYFKSLTLRALHKQIFSEDSTLKQNVVQQLKHDFPEMEGAYSMKDWEESKVVSLYQKVLKYCNDGTLSIDVGDFNIEELVSSSYSTIDKFRIALEKQCYIKRCLIDKSLYQELREREEFHLLSIESKDLNSSKPIQAMNEHTQLWKQFWSADNSKEFFPIRLNPEIKIRFREPKDTRIAKYRKKSGKYEKESGNYNPKKKNRYLHDQLTLEVTISENATGLRQELAFTKPHGLKEALDEYNQSFNKSYYPRNKLDDICFFGIDRGHTELATLLIIKKPNDNQASFQKFTTYRLIDLSHSRNYTTPERVEKTKYAKNNISDFIPDIENEDIFEKRETASLDLTTAKLIKGYIIENGDVNSYLNLKMLSAKRRIWEKHSISKIPEDISISLDQETGYFRFDTEIEEFKNPRKLYYFREELSDYLSEEDIKKELNSYLNKLRTKNQERDLLTLEKINHLRDAISSNITGILAYLLRKKEFIPGILVLEDLNTRLLESHFKDKSNEILGRRLEWKIYNKLSKMNLAPPQIKESTLLREDKKYKVKQFGSVLFVDETGTSNECPNCNKKPTDNFKEKSEKDEQKRLFELNKFQYKKYHCYHCGYDTKTNQMEFTDINNPDDLACFNIAKRGYEYILNPPKPKKTILKKTYSPKGKKQQGRKQAKNPPRTRKKPNKAATHNPFANLKDMMKKDN

SEQ ID NO: 802 - protein, 1143 aa, unidentified
  REGION 1..1143: note = Description of Unknown:uncultivated organism sequence
  REGION 1..1143: note = Category: MG60 effectors
  REGION 1..1143: note = Description: MG60-11 effector
MKTFAYKQQKSLTFGLVTKKNDPFIKDKKNNFTIQCREQEIKFNCDAGDRIYGDNLGGLQRIFHYMQNILHTIFTKEPYHRFTFSYEFTLVERKKLQTGRIAEKALKDKIWRKYEKQFQNLLNNISLFDEILEENENNFSKISHIVRIIRYINGDTQKIEHCISNYTYFGDKIEKKSALEEFKNFIQKNGDFGELLEFYSKLDKEQFEEYKIALNPVILNTHSEVNQQNWTQELDNLKMSLEALERKNNFNKNTKRFFEEDLEAYINYILYQKNFFKQSKNVEYKKNTQRIYEKYSNLSSNARYPEELVIDFIEGNEIDLENPYKVAQEELDKYLQQQESINSLKNLKSNINFVQLKTFLYQLTWKRAEIKENNKKSEEKLDYQKLSEYIVIIKGEINSRLKNTNYRYGEFIKSGGIKAQTAQKLGQKYGEYMQKLNFDKELKGYTHFGFIVKKGKRFFIKPYKKQDILNENQGFTLQNAENLLKEKVDVKGEYTAFLFQSLTLKGLLKLIFIKNAFNLDFRKEYKEIYQIWKQKKYIKDKSQSTKLIDFLIKILASNKGKELFPYVDNDFKKGDQYSKFQEFEKDLLKNSYKVKKYQCNFDENELIELDIVDRKFEYNDAVEPRLKRQNDIQILVEGFFSKQNFSFTRLLPEIKIFVRYQKLFDDMKKRVVSGMDNNGDKYKKEINEKKRFYKSVSKASFMLELNPCEIAGNPQKEKKEYQDYIIDLYKKRKDFHIISIDIGENSFATLGVYNSDLAPQKINVKWLPQQNENQNKDIIDITDLKIEKGEIVQINTKNSEKYKSYKNMFENILRSQIYLKDILEQVGEIDLKNENYNNIAKKIGESINRISELRFNTCNIIDEVKQAFPLLKNGLKQFLFSYIKSLHNGQDKAINITQYYHQIFEKLELQKVINFKDAFGANFVGVMKEILNRYPGIIVFESLHIGNNYDSYNDVIKKRLQNTTSEKSKEFRTFGTYIGMYIVQSLVNSFSKIIDIKNEKVNQLIYWEKNYETTIGKEKYSNNGILFFVDEKNTSSVCPICNGNFIQKIEKNGEVIEQENKYIKKLFGHGRGKEFENSMHHINDENDENYQKGKWKSGNLEKGDCDYHIGNKNYPEFEFIKSGDDLATYNIAKKAKEYLEKKQ

SEQ ID NO: 803 - protein, 1174 aa, unidentified
  REGION 1..1174: note = Description of Unknown:uncultivated organism sequence
  REGION 1..1174: note = Category: MG60 effectors
  REGION 1..1174: note = Description: MG60-12 effector
MQNYKITKTIRFKLEANPEQTEALLNQVEKSNQAFDLVFFTSKLKNFADGMRDYLMFQKGKEPEKWQFRKNFTIKKDWLKVYAKEELANIKQKQKEEQDKKSRRQPIQLNEGAKEIIQKSLGEVYAIYQELIQDVSKELNERARRERTGLLLKRLQEKNNLPLLCDLTEHISSGNETDNSIYELLKEKEMLQKELLQGIAEFLPAQSSGLPIAKATFNYYTINKKPTDYAQKIEEQLKELSISDYSKKIQINSKLFLGNDNFKKVMEDIRNRLKKDNITHLLFGHVPASISLGYEYRSLRQILKNIKAEQKKKFNELMMEDDFTYDKLKKEQDLYLFTSIKKEQFDEYLDKTRKIQELADKINDKSLSKEEKENLTSKKQTIAKKRGELLRDKFIDWKKFMEIYRSVAQKHGKILASLKGIEKEKVESQLLKYWALILKVNAQYKLVLIPRDKVQDAKKWIENHKNNKKTDTQELPQLYWFESLTFKSLQKLCWGHAETDNNEFRKNIISIIPKNKNNKPYTGEHEFEGKEQDKINFYKKVLQDKYTRDVVHLPFAQIDKEIISKNFDTLEDFKITLEKICYRRQVILNQDAEETLTKQFKAQILNITSLDLSRKSNESALKPHTQIWKNFWSDSNEKQHFDIRLNPEITITYRKPKPSRVHKYGKNSQNYDEKKKNRYLNPQFTLVTTMSEHCNAPQKNLSFITEEELKKEIDTFNQKFREKNQIKFAIGLDNGETELSTLGIFVPDFNKNTNEERLAQLRKVQEYGFEALTIKNLNYAERDYNGNPRKMIDNPSYFLNKSLYMRTFIKTEQEYERMFAEQFEKKHLLSLDLSAAKVICGHIVTNGDTRALFNLWMRHAERLIYFANDHIKEETAKKVLIKTIQELLPAEKEKLAESISKEKKYAKLSEQEKLRYFTWLFEDRKLYSFNEEENKKFNDILERKGNYAIGTVFSVTYLGEELVDVKSVFDIRLIFKKREEFYSILSEEEIMKELSRYNTNRTSHDLSNQELDLKLKTYKETIVANAIGVIDFLYKQYKQRFGGEGLIVKEDFDTSKIQEDLERFSGNIYRILERKLYQKFQNYGLVPPIKSLLSLRNQKVALDSIFNLGVVSFANPDKTSQQCPVCLEGKLYHGKKCDKCGFRATMMHSNDGIAGYNIAKRGFNNFQSLLPLKQ

SEQ ID NO: 804 - protein, 1147 aa, unidentified
  REGION 1..1147: note = Description of Unknown:uncultivated organism sequence
  REGION 1..1147: note = Category: MG60 effectors
  REGION 1..1147: note = Description: MG60-13 effector
MKTFAYKQQKSVTFGLIGKEGNPFVKEKKNNFKIKYREQEINFNCDARDRIYGDNLGGLQRIFHYMQNILHMIFAKEPYHRFTFSYEFTLVERKKLQTRRIAEKALKDKIWRKYEKQFQKLLNNISLFDEILEEKEDNFSKISHIVRIIRYINGDTQKLEHCISNYTYFGDKIEKKSALEEFKNFIQKNGDFGELLEFYSKLDKEQFEEYKIALNPAILNTHSEVNQQNWTQELDSLKRSLEALERKNNFNKNIKRFFEEDLEAYINYILYQKNFFKQSKNVEYKNKTQRIYEKYSNLSSNARYQEELVIDFIEGNEIDLENPYKVAQEELDKYLQQQESINSLKNLKSNINFVQLKTFLYQLTWKRAEIKENNKKSEEKLDYQKLSEYIVIIKGEINSRLENANYRYGEFIKRDGIKAQTAQKLGQKYGEYMQKLNFDKELKGYTHFGFIVRKGKRFFIRTYKKEDILNKNQGFTLQDAENLLKEKRDVKGEYTAFLFQSLTLKGLLKLIFIKNAFNLDFKEEYKIYQIWKQKKYIKDRFQSTKLIDFLIKILTSNKGKELFPYVDNYFKKGNQYSKFQEFEKDLLKNSYKVKKYQCNFDESELIELDIVDRKFEHNDAVEPRLKRQNDIQILVEGFFSKQNFSFIRLLPEIKIFVRYQKLFNDMKKRVVSGIDSNGDRYEKEINEKERFYKTISKASFMLELNPCRIGGTPQKEKKEYQDYIIDLYEKREDFHIISIDIGENSFATLGVYDRDLMPKKIDVKWLPQQNENQNKDIIDITDLKIEKGEIVQTNTKNSEKYKSYKNMFENILRYQIYLKDILEQVGEIELKKENYNNIAQKIEESINRISELRFNTGNIIDEVKQDFPLLKNGLKQLLFSYIQNLHNGQDKTINITQYYHQIFEKLELQKVINFKDAFGANFVGVMKEILNRYPGIIVFESLHTGNNYDSYNDVIKKRLQNTTSEKSKEFRTFGTYIGMYIVQSLVNSFSKIIDIKNEKVNQLIYWEKNYETTIGKEKYSNNGILFFVDEKNTSSVCPICNGNFIQKIKKNGEVIEQENKNIKKLFGHGRGKEFETSMHHINDENNKNYQRGKWKSGNLEKGDLCDYGIGNKNYPEFEFIKSGDDLATYNIAKKAKEYLESLSKKED

SEQ ID NO: 805 - protein, 1092 aa, unidentified
  REGION 1..1092: note = Description of Unknown:uncultivated organism sequence
  REGION 1..1092: note = Category: MG60 effectors
  REGION 1..1092: note = Description: MG60-14 effector
MLENLTNLYEVIKTLKFELKPSKFTLKRCDFDRAFEADPHALFEKLSSVHRFQEQILDLLKTSSKKIVIHKNLIKLIDADYFYQLKSKAISSNNTIAVLSQDFQEEFFNYIKEKFNRLHSTNYSLDYLLWADYLENPTTIDKKPTKSEIAFATKRYVHAIEKVEEILSNLIYKTNIDREIESLLANYYNNQDLKPLLKVAKSYLQSYSPTSFQVSKFGFNAKAIQKKVDVEKMEQEISLEKKMLDLEEKKIIATQIFDDYAKKFVQEKIKSDPKLLALRENQTASLDEIKRAKEYLKYLKEDFDYQKILKERSKARKEKRDSMIKFTDREYCELKLAKTDASVVYGRAKQAFFAKQQELYSQQALTHYARILRSENYFVAMIDRDDVSFLERLTNDKVNNEKFEILRYASLTARAVEKLIFEKNALKFNIYDKEYKECKMIREKRSYKEKNEDSRSKNEKQKENLKKLVLFLNSAIEQLNKKLEIFDWKPFLINDFDNFSEFQKYITENCYIARREAIDKQTIYDLDQKKLNFYQIFNKDFSVDPYCATTERDRSSTIKNINLQSKKNLFTLYWQSLYTENSTIRLNPESNLYFRPSRVRTEIDLCNDCEASKLRYRQNKIIGDFQLVFYPTKELPFDQLQQKILKNSEKSYAIGIDLGENSLATICLVDNEKKVVLDGNNKPIIKDLSMINNKDFVEVEDCFIDKPYERKQKLLIGTETKPYMLGRHFPKHLQNKVIAEMSQDMLFEVLQILESLAPEKLIVDKQNKVFDYNYAFEHLKAINKIRYHLQVFNHTNDEMRILEKDLLASIKIRFVKIVSYITQMAKKYNAIIVFENLDQEIGRIKRYLFSEQSYAKVSPKEERMYKGISPYQLMQDKIIQKCNYLLTKQEIKGMQISPRLKRQEDIKQLTLLKDKNCAWGKIIFVNEEDSSKECPNCGFVPKYSSNINIKDDIELMANKKDKKVFSFAGNQLLSERREAYQKISDIDKKKALLIETRVKTFLKSYMDIQGDPMICVNCGYDTRKTKRVEKYNLKSCDEIAAYIIAKRLEFMENKYKTQEVSISVGDSYNKPSDGEQDDSCVSGVKLSNISFS

SEQ ID NO: 806 - protein, 341 aa, unidentified
  REGION 1..341: note = Description of Unknown:uncultivated organism sequence
  REGION 1..341: note = Category: MG60 effectors
  REGION 1..341: note = Description: MG60-15 effector
MFENILRYQIYLKDILEQVGEIELKKENYNNIAQKIEESINRISELRFNTGNIIDEVKQDFPLLKNGLKQLLFSYIQNLHNGQDKTINITQYYHQIFEKLELQKVINFKDAFGANFVGVMKEILNRYPGIIVFESLHTGNNYDSYNDVIKKRLQNTTSEKSKEFRTFGTYIGMYIVQSLVNSFSKIIDIKNEKVNQLIYWEKNYETTIGKEKYSNNGILFFVDEKNTSSVCPICNGNFIQKIKKNGEVIEQENKNIKKLFGHGRGKEFETSMHHINDENNKNYQRGKWKSGNLEKGDLCDYGIGNKNYPEFEFIKSGDDLATYNIAKKAKEYLESLSKKED

SEQ ID NO: 807 - protein, 1123 aa, unidentified
  REGION 1..1123: note = Description of Unknown:uncultivated organism sequence
  REGION 1..1123: note = Category: MG60 effectors
  REGION 1..1123: note = Description: MG60-16 effector
MLENLTNLYEVIKTLKFELKPSKFTLKRCDFDRAFEADPHALFEKLRSVHRFQEQILDLLGKTSSKKIVIHKNLIKLIDADYFYQLKSKAISSNNTIAVLSQDFQEEFFNYIKEKFNRLHSTNYSLDYLLWADYLENPTTIDKKPTKSEIAFATKRYVHAIEKVEEILSNLIYKTGNIDREIESLLANYYNNQDLKPLLKVAKSYLQSYSPTSGFQVSKFGFNAKAIQKKVDVEKMEQEIGSLEKKMLDLEEKKIIATQIFDDYAKKFVQEKIKSDPKLLALRENQTASLDEIKRAKEYLKYLKEGDFDYQKILKERSKARKEKRDSMIKFTGDREYCELKLAKTDASVVYGRAKQAFFAKQQELYSQQALTHYARILRSEGNYFVAMIDRDDVSFLERLGTNDKVNNEKFEILRYASLTARAVEKLIFEKNALKFNIYDKEYKECKMIREKRSYKEKGNEDSRSKNEKQKENLKKLVLFLNSAIEQLNKKLEGGIFDWKPFLIGNDFDNFSEFQKYITENCYIARREAIDKQTIYDLDQKGKLNFYQIFNKDFSVDPYCATTERDRSSTIKNINLQSKKNLFTLYWQSLYTENSGTIRLNPESNLYFRPSRVRTEIDLCNDCEASKLRYRQNKIIGDFQLVFYPTKELPFDQLQQKILKNSEKSYAIGIDLGENSLATICLVDNEKKVVLDGNNKPIIKDLSMINNKGDFVEVEDCFIDGKPYERKQKLLIGGTETKPYMLGRHFPKHLQNKVIAEMSQDMLFEVLQILESLAPEKLGIVDKQGNKVFDYNYAFEHLKAINKIRYHLQVFNHTNDEMRILEKDLLASIKIRGGFVGKIVSYITQMAKKYNAIIVFENLDQEIGRIKGRYLFSEQSYAKVSPKEERMYKGISPYQLMQDKIIQKCNYLLTKQEIKGGMQISPRLKRQEDIKQLTLLKDKNCAWGKIIFVNEEDSSKECPNCGFVPGKYSSNINIKDDGIELMANKKDKKVFSFAENQLLSERREAYQKISDIDKKKALLIETRVGKTFLKSYMDIQGDPMICVNCGYDTRKTKRVEKYNLKSCDEIAAYIIAKRGLEFMENKGYETQEVSISVGGDSYNKPSDGEQDDSCVSGVKLSGNISFS

SEQ ID NO: 808 - protein, 1123 aa, unidentified
  REGION 1..1123: note = Description of Unknown:uncultivated organism sequence
  REGION 1..1123: note = Category: MG60 effectors
  REGION 1..1123: note = Description: MG60-17 effector
MLENLTNLYEVIKTLKFELKPSKFTLKRCDFDRAFEADPHALFEKLRSVHRFQEQILDLLGKTSSKKIVIHKNLIKLIDADYFYQLKSKAISSNNTIAVLSQDFQEEFFNYIKEKFNRLHSTNYSLDYLLWADYLENPTTIDKKPTKSEIAFATKRYVHAIEKVEEILSNLIYKTGNIDREIESLLANYYNNQDLKPLLKVAKSYLQSYSPTSGFQVSKFGFNAKAIQKKVDVEKMEQEIGSLEKKMLDLEEKKIIATQIFDDYAKKFVQEKIKSDPKLLALRENQTASLDEIKRAKEYLKYLKEGDFDYQKILKERSKARKEKRDSMIKFTGDREYCELKLAKTDASVVYGRAKQAFFAKQQELYSQQALTHYARILRSEGNYFVAMIDRDDVSFLERLGTNDKVNNEKFEILRYASLTARAVEKLIFEKNALKFNIYDKEYKECKMIREKRSYKEKGNEDSRSKNEKQKENLKKLVLFLNSAIEQLNKKLEGGIFDWKPFLIGNDFDNFSEFQKYITENCYIARREAIDKQTIYDLDQKGKLNFYQIFNKDFSVDPYCATTERDRSSTIKNINLQSKKNLFTLYWQSLYTENSGTIRLNPESNLYFRPSRVRTEIDLCNDCEASKLRYRQNKIIGDFQLVFYPTKELPFDQLQQKILKNSEKSYAIGIDLGENSLATICLVDNEKKVVLDGNNKPIIKDLSMINNKGDFVEVEDCFIDGKPYERKQKLLIGGTETKPYMLGRHFPKHLQNKVIAEMSQDMLFEVLQILESLAPEKLGIVDKQGNKVFDYNYAFEHLKAINKIRYHLQVFNHTNDEMRILEKDLLASIKIRGGFVGKIVSYITQMAKKYNAIIVFENLDQEIGRIKGRYLFSEQSYAKVSPKEERMYKGISPYQLMQDKIIQKCNYLLTKQEIKGGMQISPRLKRQEDIKQLTLLKDKNCAWGKIIFVNEEDSSKECPNCGFVPGKYSSNINIKDDGIELMANKKDKKVFSFAENQLLSERREAYQKISDIDKKKALLIETRVGKTFLKSYMDIQGDPMICVNCGYDTRKTKRVEKYNLKSCDEIAAYIIAKRGLEFMENKGYETQEVSISVGGDSYNKPSDGEQDDSCASGVKLSGNISFS

SEQ ID NO: 809 - protein, 1123 aa, unidentified
  REGION 1..1123: note = Description of Unknown:uncultivated organism sequence
  REGION 1..1123: note = Category: MG60 effectors
  REGION 1..1123: note = Description: MG60-18 effector
MLENLTNLYEVIKTLKFELKPSKFTLKRCDFDRAFEADPHALFEKLRSVHRFQEQILDLLGKTSSKKIIIHKNLIKLIDADYFYQLKSKAISSNNTIAVLSQDFQEEFFNYIKEKFNRLHSTNYSLDYLLWADYLENPTTIDKKPTKSEIAFATKRYVHAIEKVEEILSNLIYKTGNIDREIESLLANYYNNQDLKPLLKVAKSYLQSYSPTSGFQVSKFGFNAKAIQKKVDVEKMEQEIGSLEKKMLDLEEKKIIATQIFDDYAKKFVQEKIKSDPKLLALRENQTASLDEIKRAKEYLKYLKEGDFDYQKILKERSKARKEKRDSMIKFTGDREYCELKLAKTDASVVYGRAKQAFFAKQQELYSQQALTHYARILRSEGNYFVAMIDRDDVSFLERLGTNDKVNNEKFEILRYASLTARAVEKLIFEKNALKFNIYDKEYKECKMIREKRSYKEKGNEDSRSKNEKQKENLKKLVLFLNSAIEQLNKKLEGGIFDWKPFLIGNDFDNFSEFQKYIIENCYIARREAIDKQTIYDLDQKGKLNFYQIFNKDFSVDPYCATTERDRSSTIKNINLQSKKNLFTLYWQSLYTENSGTIRLNPESNLYFRPSRVRTEIDLCNDCEASKLRYRQNKIIGDFQLVFYPTKELPFDQLQQKILKNSEKSYAIGIDLGENSLATICLVDNEKKVVLDGNNKPIIKDLSMINNKGDFVEVEDCFIDGKPYERKQKLLIGGTETKPYMLGRHFPKHLQNKVIAEMSQDMLFEVLQILESLAPEKLGIVDKQGNKVFDYNYAFEHLKAINKIRYHLQVFNHTNDEMRILEKDLLASIKIRGGFVGKIVSYITQMAKKYNAIIVFENLDQEIGRIKGRYLFSEQSYAKVSPKEERMYKGISPYQLMQDKIIQKCNYLLTKQEIKGGMQISPRLKRQEDIKQLTLLKDKNCAWGKIIFVNEEDSSKECPNCGFVPGKYSSNINIKDDGIELMANKKDKKVFSFAENQLLSERREAYQKISDIDKKKALLIETRVGKTFLKSYMDIQGDPMICVNCGYDTRKTKRVEKYNLKSCDEIAAYIIAKRGLEFMENKGYETQEVSISVGGDSYNKPSDGEQDDSCVSGVKLSGNISFS

SEQ ID NO: 810 - protein, 552 aa, unidentified
  REGION 1..552: note = Description of Unknown:uncultivated organism sequence
  REGION 1..552: note = Category: MG60 effectors
  REGION 1..552: note = Description: MG60-19 effector
MEQHNFDFNEKDLVELDMVYRTFEHVKGVEPKLKRNDDFKLFVNGFFDKQDFDLIRMIPETKVFVRYQRNYDEPKKEKRGKKENIIPEERFYNTVIKGAFNFELKPLEADKNIAREKKKILKDILSKYENDDNFYITTIDIGENSLATLGVYDKNLKPQKLEYFSKDGEKITKEILDITNLKIKKGEIIEQDTDFSQKYKAYKYMFENIILWQIYLKEILEAIEEIEVIEQNYGEIKNRIGKAVNGSEIKNFVSKKKDDYDIKYIVGAFPELKEGLNNFLVNFIKKEYEGEKINFAEDKKVYHEIFQKLELQKVVDFKKAFGSNFVGVIKKIFRQYPGIIVFESLHTGDSYDGFNKIIKKKIKKVSSEKSHQFTSFGTYIGTKIVNLLFNKFTKDISENFNKIEQLVILDKNYENSVKLNSKEDKFINNGVLFFVHEKNTSKACPYCNERLTIENKEKGTLENIDDTKNLYGHGKGKEFEHSMCHINDVSDQNYENGKWTSGTLEGGKMCDFRIGNETYEKEFGFIHSGDELATYNIAKKAKEYLDFLKENN

SEQ ID NO: 811 - protein, 1112 aa, unidentified; identical to SEQ ID NO: 137
  REGION 1..1112: note = Description of Unknown:uncultivated organism sequence
  REGION 1..1112: note = Category: MG60 effectors
  REGION 1..1112: note = Description: MG60-20 effector

SEQ ID NO: 812 - protein, 1229 aa, unidentified
  REGION 1..1229: note = Description of Unknown:uncultivated organism sequence
  REGION 1..1229: note = Category: MG60 effectors
  REGION 1..1229: note = Description: MG60-21 effector
MQKTVFNDLKNIFKVTKTIELELKPIDKNNEIMEDKEINEIYGGFINEGCFLDREMPKVKDMIDNTIKRDIDYNLANVKINEDLLRNYYALHVQSISDDNADLLNEAKKKLYSDFGKQFVYNVKEGAKFINFLLSEYSHDETVYNILLPFKGKGTLFDDFIKTRKHIFSNEDKHGTVSFRLLDENINLYIYNIGVFNQALDIITKTSSFNKENANIWSTIEGYNSVLTQSSILSYNASIGEYNMAINEYNSKLGKETKKIPLFKALNKMILSDGESISFYNEVYTNNVAMFKDVRNIYTTLEKSFEKFADTLRGFNNFDLRYVYVSNKSIEGISSKMYGDYSLIGGLLKKNDFSKTESISIDNLNKCLCETDKKFDDYINIVFNWDNNGNSVFKLIKDSFNSLTCLKKGNDEAVLTDEDKVSLNEFMNLINDFKFFIKPFIISDTVLTDDDFYYTLNSLWETYKEYDKVYNKVRNWVTRKPYNDKQYRLYFGKSNLMNGFTHSQNQRQYNAYIFRKKNYIDEYDYYLGVSHNTKLFNETPSSEEDISEFECFNFFQTDNKGFYKIYKSCNNVKYKDEDCPKLFATFNDVIKRYNLSEGASHSKESESLEAYIKRLRNYYSEDFKSLLSIEESRGVYDMVFKHFKNTIAVQASKLSTFENLYKKCDDYTIDLLCEEIEKATKATIKEWTPISKNEMYEARNDINKPLYLMKITNKDLSFAEKLEKGLRQNKRGKDSLYTTYFKKLMNCEDGYKISVGKIFYRPKTEGLNERTFRHKANVAINNKNRNNAKKQSVFPYEIVKDKRFTRNMFKLQLSFDMNSELDSPQKANKIINETVIEKIKNGEIKHILGIDRGERNLLYATLIDFNGNIILQKALDKIGNVDYNELLTYREKDNKLRKKSWQTNGSIKELKNGFLSNAINEIVKIVFEYNAIIVMEDLTNGFKHSRSKVEKQVYENFEQSLTKKLSFCYLKGYNTESNGSRDAYQLSCPKDKIDNNSQNGIIFYVNPSYTSKIDPVSGFINVFNTRYENVKKAISFFEAFDDITYDENNENFIFNADLTKFKNNVTLPSGMKTNWKLSTHGERIRTYCDDKHANHWANENIILSDYFKKTFDELNINYQNNIKEQITSLKEKKDFEKLLDCMKLMLQMRNSIINSKVDYIISPVVDENGNYYDSRRSDGLLPIDADANGAFNIARKGLLTTRNLYNNTKKIMVDKKQWLNFVQNNFCKP

SEQ ID NO: 813 - protein, 771 aa, unidentified
  REGION 1..771: note = Description of Unknown:uncultivated organism sequence
  REGION 1..771: note = Category: MG60 effectors
  REGION 1..771: note = Description: MG60-22 effector
MANKRTDTTINLNKTVIMLTNMLPEVRAMFQAGIRQAQAYADLVNKWICSNLTNKIGEVLLPYIDNKNCVYYELCYKYKEAPLYTIFMKGKFDLNSRNNALYCAVVAQNIDNYSGNIFGFSQSDYRRNGYCKVVFSNYATKMSSLKPSIKKVTINEESTEETIQSQVIYEMFTNGRQWGKPEYFAEHLKYLEMKDNVSDKLMFRMKTLCEYYQTHTDLIDTMAMNAGVEALKQFEGLKLNRDKFSMTITTNSTSPYTLTRVAGTCAYNLHIPCRKRSYDIRLWGNRQTVRWVNGELVDIADIINQHGQTIIFTIKNGNVYVHIPYGLNFEKTEHEIKNVVGVDVNTKHMLMQTSIKDNGWVKGYVNIYKALVEDEEFVKYISKSDLKLYKDLSKYVSFCPLELNLLYTRYLSKKGLPFNEADNNAEKCVEKVLNNLVKQYEGDDVHVVNYIHNVKKLRALCKASFVLYKKYAELQKAFDDAQGYNDQSTETKETMDKRRWENPFIQTREAQELIAKMDNAVAGIIGCRDNIITYAYKVFGDNNYDTVGLENLTTSQFDNYSTVKSPKSLLSYYGLLGQQVDSDKYNAVMTESNKDWYDFKTDGDGNITDITLTAAGEAQKAKSLFNNKVLKNIHFADVKDKFIQLGNNGSIQTVLVPPSYTSQMDSKTHTIYVKETVDPKNKNKKKLKLVDKKLVRHGQEYHKNGLNADINAALNIAYIVENQEMREVMCLHPSKKDGVYDQPFLKATTKYPATVAGILLKMGKTTNWGEK

SEQ ID NO: 814 - protein, 1141 aa, unidentified
  REGION 1..1141: note = Description of Unknown:uncultivated organism sequence
  REGION 1..1141: note = Category: MG60 effectors
  REGION 1..1141: note = Description: MG60-23 effector
MINLENFKNLYEVRKSARFKIVPKKIFKQKEDRGSVYNTEDIVKQYKGIIKDLESILYYENFVPETQPLSNKLWDLFDFSKFESELEENEEISSLKNKESSDLIRIKHAWLQKYFTNDWHENKDSIISKRWDPKRNIEVKMKNWTTIWSVKFLKEFFESFFTDANKYFDVISKLLQVQDFERNRQSDIKLALQTIQWKDHLYKIYQLFEWGYIEHKNDNTSINELQEKLKVFKNNVNNYIENCRINDSFGLPLEYVSLNYYTRRKTQKDYDEEILKKSESLKKKFDWDLWELYWISKELEISDLYNNMKLFKANQKSAFLQLLQSQTPFSKLKNNFEYIDNKWERYSDYKIQLFDDITEENYNEMKDLTFQIEKSDDKKTRKELKEKRWKYFLFYCKKYEKFCDWYFYPKKGEDRKFFNWYKQVAMEFWKRKAEILSLEREKILAERERWYGFLSKDASNNYYINTFDIENTKNAYDFFSNQSQKQWEITYYILSSITLRALEKLCFSKSSNFYKWNIVQKIDGKFLKIQEVTGNKIFKSKRELEEEENLIEFFAEVLRLQNTLWIKFKSEKSLDNLKHCENMSDFEILLKQETYVLDEYKISKEDFEKALEKFKWNSFLIIDKDSDNHNKNSVFSQWWTRFWQKNNTENYILRINPELIISFRKWDTERFKGKISFHRRKNDAYMVSFSFSHFSDKSYITSEFIDDAERKENLKKFNDLYNENVTLEYIYWIDKWTNELVTLWIFKRWKNWLEKVDISEKIPVYRITKKGLKYFEDTETRDSNEKKKRYLSKNVSYFLKDLENNELFEKLDIDSCLWDLTYAKIIKWNIILNADIFTTVNLYKVTAKRFLNDAAFRGKIKNNTVLFDDENKSFYFEYENRWKLQKQNIFYWKDDFDYLPCDDIFQNLKEEVQNELNMYLTSISNEEDISMQRVNNYKNAISANIVWIITELQKHFNGYICYETLDAGQIEKKWFNTFIWNTLNEKIYNKLQLSLEVPPILKKFRTDIWAKETIQHWKIIYVNEKNTSSACPACNKTLLKIDENWILVDKDDKEVFKLFWHLTEFENAMHHINDENDENFQKWKWESGDLEKGGCDYHIGNENYPEFEFIKSWDDLATYNIAKKAKEYLESLSKKVIPQWS

SEQ ID NO: 815 - protein, 1203 aa, unidentified
  REGION 1..1203: note = Description of Unknown:uncultivated organism sequence
  REGION 1..1203: note = Category: MG60 effectors
  REGION 1..1203: note = Description: MG60-24 effector
MKHEITKTISAELKPFGNTNISDLKIYIDKDENLCVQRANAIKVLDERHKAFMSNTINTKLDFTTLESLMQRTGNEKEQNKERKSLCEQLIKFLKSRNEAEFKMLTASTPSKLINCIYKADNTIECLAPFANFSTYLSDYNTARKNIYAENNTSGSLGCRIITENFSIFIKNKHKYQKLVSEYASIIKDVVDNLPELHDFISKFASTNDYMTFSVQDNIVKYNAIVGEINKNINLYIQQHPDENKSPKKLHMKKLFKQILFDSESLFAVAPKITEEAELKELINTLWEEILQNGKVLDEVMELLKNIRQYDLSEIYITKNMATKLMYWKYNDSAYVRFIAKNITSNIVPISDVMEHIGLETYLQPMSGYKKDALLSYSAIKSFNEIMNNRVAVDRVHCFMNSLNDFRRIAEFITIDESLLSDDEFYDTYTELKGIMRLVSKAYDTVRNFINQRPKDISKKMKLVFGYADFMNGWDYDKIVNNVYGGAMFKKGNRIYIGLKPENDLFKKIRDVQEGEETMQFVKYKQLNPNQQIPRLFHKTEWIDKYTRQENPRANIQKILDKKVADKKYEYTEKESAALIKYYIYCLIESDYAEMYNLEFSDATEYKNINNFFETIKKSTYKIEFIDVALSQIEEWIDNKKIFMFSVHTKDYQPGAYGSKELFTMFLEQLFSEDNLKSNIIRLCGASTVMFRKQTIKNPYVHYKGSILLNKRDKDGNPIPSEIYLNLRDYLNGKLTKSELSKEEIAYLDRIKYKTAKEDIIKDRRYTEDKMFINLPITINKGCKLEINEFNKAIRKRAKYIISLDRGERNLLYYTVMDFKGNIIEEGSLNIIDGYNYQMKLSQLEKERKDEQRNWQATSQIKHIKNGYVGKAVYKICRLVIKYEGAIIAMESLNKTFCVKRDAAIGPSVYQYFQNALLKKLSYLVLKDRKPTEEGGILNGYQLTYCPDKIEDKLVQYGIVFFVNAGYTSKIDPVTGLTNQFKFDEYNTNEKATEFVKSFDYIRVNDNDVAEFGFKYSNFESFCGSNKNKKGKKEEADEAGKYCEREWNCIINGSRIISNKNKETKFWEYHNEDMRVELDKFCEKYNISKEHGTDIKSEMLLICESKPAMCKEFVSLIKKVMQLRNSNRNTGEDYIISPAMNRCGTYDSRNPGNAEKSLPTNGDSNGSRNIGIKCIMSLDMLKEQDKFFFNNEYYFCGLKKFSE

SEQ ID NO: 816 - protein, 1197 aa, unidentified
  REGION 1..1197: note = Description of Unknown:uncultivated organism sequence
  REGION 1..1197: note = Category: MG60 effectors
  REGION 1..1197: note = Description: MG60-25 effector
MFKQEITKTLSAALLPYGQTDVSSLQEVIDRDKKRHKYRKDIIKMIDERHKALLSKIKDAPLEFHRLEELLRKRNKDKKDTAARKELEAEQKALCQILIDWLSSNNRMEFAYLTASTPAKIVSEMFAKNPENKKLEVFDKFCTYLSDYSAARNTIYGTANKAGSVGCRLVTENFPIFIKNKDVYAKLSEEYPEILKTVAKNLPEQSGYIGAFASTDDYMMFSVQDGIKNYNAIVGETNKVINLYIQANPDTKTALKKLRMKNFYKQILFDDEALVAAAFPRIYSVKEFASLVHTIWEDVLDSGKVLDDMMVLLKNIRNYDTTGIFIKKNKIAFVSDKLYGEWNRIKDTIGETKDDYTALEALIFSDADFDNLFKDLNKFKSEAVLAYVEVNKFADDEMMSEDAVPHITELMYALNDFRKLVDIIAIPDDNVNSDPDFYNKYKEYSEKTAAIKSAYSTAYTFVTQRPEDISKKFRLSFDYSTFMKGWDIDKITKNEYGATMFSKDGRLFVGVTNKEKCPDFDDIHPANPGEETFRMLSYKKLGNSSRQIKHMFINDSTPDNIRKIVLGKKDDEAYEHSDMVKVIDYYKKCLVSRYSGIYDFNFSETSDYKTINDFFAEVDKFTYKVSFIDIPASQIDEWIAEKKLFMFIVHTKDYKVGAYGTKELFTIFFENLFTEDNLKNDVIRLAGGSSIVMRPKAVENPYRHKVGSILLNKRDKDGKPVPNKIYVSLSKYLNGRLKKKDLSRDALAYLDKVVWHKHQKEHIAVEDIVKDKRYTTDAFILHLPITINPGCRANEYEINEDARKNAKHTIGIDRGERNLLYVNVTDCRTNKVVEHRSLNEIEGYDYQLRLTQLEKERQDQQRNWRTQSQIKHLKKGYVGKAVHIICELMLKYENSIVVMEALPKEMMQKRGSAFGAVYSQFQQALLNKLSYLVVKDRKPLEKGGILNGYQFTIPPKTLEDKPRQYGSVLFVPPGYTSSIDPVTGFTNIFMYKKYDSSNKKAKNFTAKFDSIRINEDGIPELKFDYSNFKTFQKWPDRQWTCIIDGKRILRQKNQKTGVWEYEDVNVREAFNKLFGKYSKLEPGTDVKELIGKIRKTDADIDVKFVKLMKTVFRLRNSNPNTGEDYIISPALDVHGKTFDSRDQRNLELGLPVNGDSNGARNIALKGAMTLHNAGVTGKLVAVGNSEWMQNVQRFSSE

SEQ ID NO: 817 - protein, 1191 aa, unidentified
  REGION 1..1191: note = Description of Unknown:uncultivated organism sequence
  REGION 1..1191: note = Category: MG60 effectors
  REGION 1..1191: note = Description: MG60-26 effector
MLSNMHETTVNINKTSMNQFTNLFQVHKTVKFDLRPIGKTAELINSDGFLVSDDKEKAMAYLVVKCLIDEYYQKEVIAPILDNIKDNKEWNGLLEKYDKAKDGLERNAISKKLAGVIDKSKPTKPTAKALYTPLKDYVLTLKNAELQLILKDLQYDEVVIGGKTLRAAWNKELKEFVELAIDKFKNFTPYFETLATNIEQVFSGKKNGVAHRIVYQNLYTFIRNKKALDDLKIMVDEFSGEKEMLVGDFSYCLHQSGIDKYNKYIGQLVQRLKEYSDAHPKFSMWHKRFKKLNKQILSPQITPSWLPAAFTNDEMMVVAIRAFVNNTSPYLPALEEIIRQIATYDDHIFIYRKSLRSIAAQMTGDYTALDGSFEIPKSSSQKESLSLRWMSNEMKNKYFLYLNNSLSSALQSLKKSSSDAQDFLNLKKAGNNDYRRNNQASVCILRLMESYKQLYRLLRPLTGTGDENDRNEDFYGDFMPIVEALQPINNLFDSVRNWLTKASFSNDSYPVYLGKATLLDNWTNKVVFLKKDGKYFFLMLNGIQKDELQGGSTFDTIVYLPYSQAANRIDANLTRQFVFSKKPNASKGRNEPTMAKFVREHKAELAKEWERIKDGKYKVSDNKEEVEHAIRYFQKCLNMHPDYKNFDFGFLPAEEYDNYTSFVESLKGKLFRIEEKTASWESIIQLVEEGKVYLFQLYNKDYADNRASNSTSNLHTLYWESIFCQKNLLSYDFKLEEPKLYFREKADVVQKTGNIQSVPLRYQKPKIHLHIPILMNANAHKLKDLNLLVLEQIQNGYFSHIIGIDRGERNLLYYSVLDMNGNIVEQNSLNIINGINYHEKLMEKEVELDDERKKWKVRTGIRKLKEGYLGHAIHQLTNLIVEKNAILVLEDLSDSFKRGRQKKDMQIYQLFEKMLIEKLSFMVSKNVCNLNQEGCTFKALQLADPKIEMPKTGVKQNGIVFFVPPEYTSAIDPVTGFCNLFDRDRVKDIRNLLACFKSISYNSDKEWFEFEWDYQEVLQYTRLEQCANSFPWVTCSYGNRIEWSGSKSCHNLKCENVSLTSGFKALLGKYRVDYHSGANLKEMLRTINKKDDIKELKRLFFLMLSLRNKPDKDTDYILSPVQDVNGVFFDSRKMNKETKPQLPKNGDANGAYNIARKGLLSINKLNNGNNETLSIEEWVLSAKSNKVKLQT

SEQ ID NO: 818 - protein, 1200 aa, unidentified
  REGION 1..1200: note = Description of Unknown:uncultivated organism sequence
  REGION 1..1200: note = Category: MG60 effectors
  REGION 1..1200: note = Description: MG60-27 effector
MKKELAKTLSAELKPYGNTDINALKDIIANDETRFNARKEVIKLIDERHKAFLYHIKDVSLSFDKLEALVIEYNKDKKNNDVKKKLETFQKIMCDALINQLSSKYSEEFKRLIAPTPANIIAQLIAEYPDNENIRMFDRFCSYLIDYCTARRTMYSSKNVPNSAGHRLITENFSLFVKNKNAYTKLSNSYPSIVETVSKNLPELSEWSSSFANTSDYMEKFSVQDGITKYNAIVGEFNKAINLHIQNNPDDKKSLKSLRMKTLRKQILFDSESLFQTVAKIYTPAELKSTIQTLWEDVLENGNVLERMIALLGKFDQFDMKGVFFKKNKVGIISKQLFDGEPLKIRTALKEKYGKKDMEKRNYFPFQDIFDSEPESDIQKFFRDLNGYLSEARISFATINSSDDIMSESTLEYVKNFMDNLNDFRRISEVIAITDESTADTEFYNSYVELSEKMFVIKRAYNTVKNFVCQRPKDISKKFPLTFEYPEFMKGWDFDKTIKNIYGVMMFIKDGRIYIGVSNKKDAPNYKNIRPVSAGEESFRMVLYKQFKPNIQFPNMFNKDAPEDINKIFKSKKDKKSYDRKDTLKVIDYYKRRFIEKYVKIYDFKFSETSDYKNINDFYDEVSKFTYRISFIDVPTSQIDEWIDNKNLFMFVVSTKDYALGAHGSKELFTMYLESLFSEDNLKNDIIRLNGNSSIVMRPRVIDNPYKHKAGSVLLNKRDNDGNPIPNEIYTRLVKYLNGNLAKEELSENEASFLDKISHQKKSYDIVKDRRYTEDKFIIHLPITINHGCTISDKDFNTEIRKKFIANPDAHIIGIDRGERHILYVNVMDRNGKTVFEESLNVLDGYDYQMKLTQLEKQRRNQQRNWKTAGQIAHLKEGYVGKAVYEVCRLMLKYNAIVVMESLNKKFTTSRSAAFGPAVYAQFQRALLNKLNYLVLKERSPMEKGGILNGYQLAYLPKEGIGDNPVQFGSVFFVPAGYTSKIDPVTGFTSLFDFSEYETSNEKASKFTSSFDSIRINEENIPEVQFTYPKFKTHVKWPERKWSCAIKGERILSRKNQKTGYWEYNTVDVREEFDKLFENHGKKLEPGTDIKALMTEIRKSDASIDKEFVKLMKTVMHMRNSNPETGEDYILSPALDKYGKTFDSRNKENSSLGRPTNGDSNGARNIALKGLMMLNNEKDSGKFKCIKNEEWFRNIQKFSE

SEQ ID NO: 819 - protein, 1330 aa, unidentified
  REGION 1..1330: note = Description of Unknown:uncultivated organism sequence
  REGION 1..1330: note = Category: MG60 effectors
  REGION 1..1330: note = Description: MG60-28 effector
MEQFTNLYNVQRTLCFELEPVGVLPEKVQELLAIDKERNLLAPQVKEMMNELHKSFITRTLRNIMLIKDDEEEDISNAKSLIKIKDLLHSTCQLYAIPAKNDKDKDELEQKQAEFRNIISLLFTKDDFYAKLFGKDILDELHNHFTNDEGKLEILDKFKGFLGYFDTFRTNRKNMYVDAENETAIPFRIVNQNLPKFCDNLVAYQRLKSSDLAKCIATVYSDFEDMLNVESLDEYFCVDNYLNCLCQTDIQTYNYIIGGREQEGTKQLLKGLNQHINEFNQTHSKAERLPLFKPLFKQILSDKEKVSWLSEEFKTDRDMLQAIDQCYQDLAIILMGNEECSLPVLLKNISSFNQDGIYISNGKALNLISKRLYSGYSVITDALKQVWKANHERGRRESEENYEKKCNDTIKKTSSFSLSAINQALGITTGDGTNTIATYFAKFGSERECGKTYVQELSELYNEALSALHTKDKDIVNDDEKVGAIKALLDHLKCIQHFIEPLHMKNVEENADAEFYNIFDDIYEQLDNKLTGLYNRVRNRMSRKPYNDDKFQIFFENNSQVLRGWMDSKTENSDNGTQYGGYLFRKINEIGEYDYFLGVSKNVNLFRRFNEVAVADYSEYQRLNYCQLKSETFYGACYKSAVGNDFEQDKSRLTDMILKLCYKHGSENLQDAINKERRKSDPKKSKLSSPKSLLELIEKKDSECYEKILKNKSFLELDALVIESIKKTMASVNVKYLQNLANNDYDSFIQAMEVVDKGCKFGKIFDYFTISQSELDAALEDESKRLYLFKITNKDLSYSKNYKQRKSRGTDNLHTMFFKALMEGGYGTYDIGTGSLYYREMTPGLAKYKPTHPQNIPIDKKSDFFRKRGKQSVFEYDIQKDKRFTRNMFKFHLSINANYTCGNANKIMLNMLNTKVIDAIRNGRFKHIIGIDRGERHLLYVTVINLNGDIVEQFSMNIMESEKLIDGEPVVTNYKSLLDAKMNLRTEQKRTWRRQESIKDLKEGYLSQAVHKLTKLIVDKYQAIVVLENLSKGFMQTQIESAVYAKFEQMLITKLNLYIDKQKDKNAIGGLYHPLQLTSPYKSKSTASIQNGIIFYIPAWCTSKIDPVTGFVNYIRPKYENIQAAREFLSKFDDIRYNPEHDYFEFHIKDYTAFNPKAKSSRQDWIICTNGDRIRNFRDPNNNEWTSEKINLTREFKKLFESYKIDYNCNLLALILIQDKKDFFSNSNVKEPSLFPLLQLTLQLRNSFIKSDVDYILSPVADKNGCFYDSSKCGACLPNNADANGAFNIARKGLILVNRILSTPINEKLSLAISNEDWLNYAQSQQLSND

SEQ ID NO: 820 - protein, 767 aa, unidentified
  REGION 1..767: note = Description of Unknown:uncultivated organism sequence
  REGION 1..767: note = Category: MG60 effectors
  REGION 1..767: note = Description: MG60-29 effector
MAHKKQKEENEIIKTISLKVKDYAGYPIVEAMREYTKYYNKISQWINSNLLTINIGELSAFMPDECKTHNYYTYMMSPDWVNEPLYKMFMKGFHTQHCDNILFNVVKTLNIDEYTGNSLGLSASCFRRSGYFQNVVSNYKSKFANPHISIRRKNLSDLPTEDELLEQCIYEIQNGLSSKTKWEEQIEYLKERDDSKQIYLTRLNTLFTYYKANKDFVDEQMQIKSVESLANFGGCVRKNDKLSMNLVFSSNSPYKVVLNEKRNGYILSYSNNFSIELYGNRMGLLNGVEMFNIVDKHSNNITFKMDNDELFVNIPVSVNFVKKANETNKVVGVDVNLKHSIFATNIIDDGKLDGFVNIYRELLSDVDFVKSCHNDLLNFILDVEKYAFFMPLELGLLSSRVMNQCGYSTIGKYEKLFTTEEHFLRVLRQLEKRFQESGENQKRIYIENVIKMRAQLKAYVTLKYAYNKANKDYDLKMGFVDESTANKETMDQRRFENQFVNTDTAQEILGKMRRIANVITSCRNNIICYMYKIFENNGYGVVALEKLQSSQMKKEKRIPSLLSLLKKHKVEGYTINELKDKSVFKFIERGYYTFDFDDDNKITGVQFSDAGEAVNIETELHNLALKTIHFADAKDYFVTLSNNGSVSVALVPSQFTSQMDSTKHVLYAKKNNKGKLGIVSEHEVRPKQERHINGLNGDYNAACNIAYIFENDEWRNAFMKMNPNEYGKALFETNIESTSTIINTLKKINPDNIISFDECEKTKKVAA

SEQ ID NO: 821 - protein, 1180 aa, unidentified
  REGION 1..1180: note = Description of Unknown:uncultivated organism sequence
  REGION 1..1180: note = Category: MG60 effectors
  REGION 1..1180: note = Description: MG60-30 effector
MNQFTNLFQVHKTVKFDLRPIGKTAELINSDGFLVSDDKEKAMAYLVVKCLIDEYYQKEVIAPILDNIKDNKEWNGLLEKYDKAKDGLERNAISKKLAGVIDKSKPTKPTAKALYTPLKDYVLTLKNAELQLILKDLQYDEVVIGGKTLRAAWNKELKEFVELAIDKFKNFTPYFETLATNIEQVFSGKKNGVAHRIVYQNLYTFIRNKKALDDLKIMVDEFSGEKEMLVGDFSYCLHQSGIDKYNKYIGQLVQRLKEYSDAHPKFLMWHKRFKKLNKQILSPQITPSWLPAAFTNDEMMVVAIRAFVNNTSPYLPALEEIIRQIATYDDHIFIYRKSLRSISAQMTGDYITLDGSFEIPKSSSQKESLSLRWMSNEMKNKYFLYLNNSLSSALQSLKKASSDAQDFLNLKKAGNNDYRRNNQASVCILRLMESYKQLYRLLRPLTGTGDEDDRNEDFYGDFMPIVEALLPINNLFDSVRNWLTKASFSNDSYPIYLGKATLLDNWTNKVVFLKKDGKYFFLMLNGIQKDELQGGSTFDTIVYLPYSQAANRIDANLTRQFVFSKKPNASKGRNEPTMAKFVREHKAELANEWECIKDGKYKVSDSKEEVEHAIRYFQKCLNMHPDYKNFDFGFLPVEEYDNYTSFVESLKGKLFRIEEKTASWESIIQLVEEGKVYLFQLYNKDYADNRASNSTSNLHTLYWESIFCQKNLLSYDFKLEEPKLYFREKADVVQKTGNIHSVPLRYQKPKIHLHIPILMNANAHKSKDLNLLVLEQIQNGYFSHIIGIDRGERNLLYYSVLDMNGNIVEQNSLNIINGINYHEKLMEKEVELDDERKKWKVRTGIRKLKEGYLGHAIHQLTNLIVEKNAILVLEDLSDSFKRDRQKIDMQIYQLFEKMLIEKLSFMVSKNVCDVNQEKSTFRALQLADPKIEMSKTGIKQNGIVFFVPPEYTSAIDPVTGFCNLFDRDCVKDIRNLFACFKSISYNSGKDWFEFKWDYHDVMRYTRLAQCATPYSWVACSFGNRIEWSGSKSYHNLKCENVSLTSGFKALLDKYRVEYRSGENLKEMFGAINKKDDIKELKRLFFLTLSLRNKPDGDTDYILSPVQDVNGTFFDSRSVNKESLPQLPENGDANGAYNIARKGLLSINKLNNGNNEAISIEEWIQSAKYVKIKFTGPTLCV

SEQ ID NO: 822 - protein, 1321 aa, unidentified
  REGION 1..1321: note = Description of Unknown:uncultivated organism sequence
  REGION 1..1321: note = Category: MG60 effectors
  REGION 1..1321: note = Description: MG60-31 effector
MKQFTNLYNVQKTLCFELQPEGKLPETVHELLAKDEERYRLAPKVKEMMNDLHKSFITQTLQNIEVTKNGEKEEVSKAKSQIKELLYSIYHLYRRTNKSDEDKDELRQKQAELRYCLSLIFTKDSFYANLFSKSIIGELRNQFSDDRDKTEILDKFKGFWGYFDTFCTNRKNMYVADEQETAIPFRIANQNFPKFCDNLAVYQRIKSSVLVDCMTKVYSDFEDMLNVANLDEYFCIDNYLHCLCQTDIQAYNYIIGGREQEGTKVLLKGLNQYINEYNQTHSKMERLPLFKPLFKQILSGKEKVSWLPEEFKSDAEMLQAIDLCYKQLEVYLFDNENRSLSELLHNIGSFNPDGIYVQNGDSLNLISKRIYGNYSVISDALKQVWKRTHVKGKRESEEKYEKKCSDAIKRISAFSFSTINQALGIKSGNEKRTITDYFANFGSERESGKTYIQELSELYKDAKSALNTKDEDIINDDAKVGAIRGLLDQLKTILHFIEPLHMKNVEENSDADFYNIYDQIYEKLDKVTNLYNRVRNRLSRKPYNNNKYPIYFENNSKLLGGWPDSCTESSDNGTQYGGYLFRKLNEIGEYDYFLGISSNVKLFRRFKKVVPSDRSEFQRLNYYQLKSQTFYGGCYKTAIGHDFDEDKTKLIMCILKVCNHFASPELLDAINKEKLKDPKKSKLNSPKSFLDLIEKKDFECYEKIVVNKSFRKLDAIVTENIKKTMASVNIQFLQDAANNDYNSFLQAMDVVEKGCAAEKIFEFFPISQSELETALNSDSKRLFLFRITNKDLSYSQNYKQRKSRGTDNLHTMFFKALMEGGYGTYDLGTGSLYFREMTPGLAKGDPTHPKNVLIEKKSSFFRKQKKQSIFKYDIQKDRRYTRDMFKFHLSIKANYTCGNANETILNQKVIEAIRNGEVKHIIGIDRGERHLLYVTVIDLNGKLVDKFSMNIMESEKIIDGEKVKTDYKSLLDSRMNLRTEQKRTWRHQDNIKDLKEGYLSQVIHKLTKMIVDNQAIVVLENLSKGFMQTQIESSVYAKFEQMLITKLNLYIDKQKDKNQPGGLYKPLQLTSPYKSRTNARIQNGVVFYIPAWNTSKIDPVTGFVNFIHPKYENIMAAREFIGKFDNICYNVEQDYFEFHIKNYTAFNPKAKSSRQDWVICTKGKRIRNFRDPDNNNEWTSEEIDLTKEFKVLFDDYGIDYHSHLFDYILKQGKKDFFYNDNEKERKQSLFPLLKLMLQLRNSFIKSDIDYIISPVADKNGVFYDSRTCAAYLPDNADANGAFNIARKGLMLVKRILSTPIDKKISLTISNEEWLHYAQPKD

SEQ ID NO: 823 - protein, 1177 aa, unidentified
  REGION 1..1177: note = Description of Unknown:uncultivated organism sequence
  REGION 1..1177: note = Category: MG60 effectors
  REGION 1..1177: note = Description: MG60-32 effector
MEHLTNLFQVHKTVKFELRPIGKTEDLINKNGFLLSDDKERAMAYQVVKCLIDDYYQKEVIAPLLEKVKDNEDWNHNLVAYGDASDSNTRRAISQKLAAIIIKAKPNEPSANLLYTQLHNYLQKQNTGDLCHILKDLQYDEIAIKDRTLKAAWNYKLKDFVQDAIDKFNGFTLYFSALAVNMKQLFSRKKNGLAHRIIYQNLYTFVRNKRALDDLRVVIAEFRDEKDIAVTDFSNYLLQDGIDKYNKYIGQLIQRLKEYEDSHPNSSRWHRRFKQLNKQILSPRIAPDWLPAAFTNDEMMVVAICAFMKSVNPQLSALKEIINQIDTYNGPIFIYRKSLRSIAVQMTGDYKGLDDAFVIPKGYSKSESLSLQWTTPEVKQEFLGFLKDNLSAKLLSIQQASCEADEFLNLKKAEGNDYRRNNKASVSINKLMNAYKQLYNLLRPLTGTGDEEVRDEDFYGSYMPIVDALQPINELFDSVRNWLTKTAYSNESYPTYLGVATILKNWSSKAVYLKKDRKYYFCLASTKGEEKRDIHDILKKIWISNNCPKDAVIYLTRTQSPERITANLPRIFIRSKEADKVNSFVEKHPELKTEWEKLKGGGYKSPELKNEAISYFQKCLQLHDDYKYYKYHFRPAKEYDDYDSFVNSLKKEALFFFEEKPICWNELLQLVDDGKVYLFQLYNKDYADNRPGNSTPNLHTLYWEAVFSQQNRLSYDFKLEEPKLYFREKADVVQRTGDIHSVPLRYQTPKMHLHIPILMNANAQNTVDVNQLVLEQIQAGTFSHIIGIDRGERNLLYYSVLNMNGSIVEQESLNVINDVDYHKLLMEKEADLDDEQRKWKARSGIRKLKEGYLSHALHQLTNLIRKYNAILFVEDLDKAFKHSRQKIDMQIYQLFEKMLIEKLSFWVDKKVSDGNHAGSTFCALQLATPGLKQEEKGVRQNGILFFVPPEYTSAIDPVTGFCNLFDREHVKDVRRIFAHFKRVSYNVDKDWFEFEWDYQDVLQYTRLKECATPQPWVVCSMGERIEWTGSERYRNQKCESVDLTTEFKILFEKYNIQYVNGEDLKDAIASINKKEDINELKRLFFLTVSLRNKPNKDTDYILSPVCDANGVFFDSRLVNSEALAKLPVDGDANGAYNIGRKGLLSINKLKNGINEPLSLEEWVQSARQEIYQTTNQT

SEQ ID NO: 824 - protein, 782 aa, unidentified
  REGION 1..782: note = Description of Unknown:uncultivated organism sequence
  REGION 1..782: note = Category: MG60 effectors
  REGION 1..782: note = Description: MG60-33 effector
MAGHSKIKENHIMKAFLMKVKETRKNQWQSNFIRSEIAKFTNYYNGLSKFIADRLLDDMVTTLAPLIEEKKRDSEYYKYLTNGDWDGKPLYFIFKEGFNSTNADNILANSLVRVYCEQNYTGNGFGLSYSYYVVIGFAKEVIANYRSSFQKPKVKIKKKKLSENPTEDELIEQCIYTIYYEFNEKKDIKKWKDEIKFLKERGESKETRLKRIQTLFEFYKDKNHKELVDERVANLVVDNIKEFGGCKRDIGCPSMGIQIQHNFDISINEKRNGYTICFGPNKKNLTKLEVFGNRMVLLNGEEIVDLPNTHGEKLTLIDRGNAIYAALTAQVPFEKHMPDGNKTVGIDLNLKHSVFATSIVDNGKLAGYISIYKELLKDDEFVKYCPKDLLRFMKDASKYVFFAPIEIELLRSRVIYNKGYACVENYENVYKAEVAFVNVIKRLQSQCEANGDAQGALYMSYLSKMRAQLKNYINLKLAYYDHQSAYDLKMGFNDISAESKETIDERRKLFPFSKEKEAQEILAKMKNISNVIIACRNNIAVYMYKMFERNGYDFIGLEKLESSQMKKRQSRSFPTVKSLLNYHKLAGMTMDEIKKQEVSSNIKKGFYDLEFDADGKLYGAKYSNKGNVHFIEDEFYISGLKAIHFADMKDYFVRLSNNGKVSVALVPPSFTSQMDSVEHKFFMKKNANGKLIVADKKDVRSCQEKHKINGLNADYNAACNIGFIVEDDYMRESLLGSPTGGTYDTAYFDTKIQGSKGVYDKIKENGETYIAVLSDDVITAEE

SEQ ID NO: 825 - protein, 1318 aa, unidentified
  REGION 1..1318: note = Description of Unknown:uncultivated organism sequence
  REGION 1..1318: note = Category: MG60 effectors
  REGION 1..1318: note = Description: MG60-34 effector
MQQFTNLYNVQKTLCFELQPEGTLPEKVQELLANDKERYLLAPIVKEMMNELHKSFITQTLRNIVVEIKSDNEEIRNAKLLTKELLYTIYQLYKKANKSDEEKEELEQKQTELRICLSLVFTKDNFYGNLFNKEIMKELRNQVSNDEEKLNILDKFKGFFGYFDTFCTNRKNMYVADEQETAIPFRIANQNLPKFCDNLAVYQRLKSSSLSNCIATVYTDFEDMLNVASLDEYFCIDNYLHCLCQTDIQAYNYIIGGREQEGTNVLLKGLNQYINEYNQKNPKTERLPLFKPLFKQILSDKEKVSWLPEEFESDAEMLQAIKLCFKELEGFLCDKGSHSLPLLLQNIGSFKQDAIYIQNGEPLNLISKRLYGNYSVISDALKQVWKRDHVKGKRESEEKYEKKCSDAIKKISAFSFSTINQALGIMSGNEKRTIADYFANFGSERECGKTYIQELNELYKDAEPILNTKDKDIINDDTKVGAIKALLDQLKAILHFIEPLHMKNVEENSNTDFYNTYDQIYEQLDKVTSLYNQVRNRLSRKPYSNNKYPIYFENNSKLLGGWPDSCTETSDNGTQYGGYLFRKQNEIGEYDYFLGISANVKLFRRFKEVSPSDRSEYHRLNFYQLKTQTFYGGCYKTAIGHDFDEDKTKLITCILNNCNHYASSVLLDAINKEKSKVNSKLGSPKSLLELIEKKDMECYEKIVTDKQFRILDAMITGNIKKTMASVNIQFLQDAANNGYDSFIQAMNIVEKGCADERGFEYFPISQSELDAALTSNSKRLFLFKITNKDLSYSQNYKQRKSRGTDNLHTMFFKALMEGGYGTYTLGTGSLYFREETPGLAKDKPTHPQNVPIEKKSVFFRKQKKQSVFEYDIQKDRRFTRNMFKLHLSVKANYTCGNANETALNLKVIDAIRRGGIKHIIGIDRGERHLLYVTVIDFNGRLVDKFSMNIIESEKSIDGETVKTDYKNLLDSRMNLRTEQKRTWRRQENIKDLKEGYLSQVVHKLTKMIVDNQAIVVLENLSKGFMQTQIESSVYAKFEQMLITKLNLYIDKQKDKNQPGGLYMPLQLTSPYKSRANASIQNGVVFYIPAWNTSKIDPVTGFVNFLHPKYENIQNARDFISKFDNIYYDSDKGYFVFHISNYTAFNPKARCSRQNWDICTVGKRIRNYRDPDNNNEWKSEEIELTKEFKVLFDEYGIDYHSNLLDSILIQDNKSFFYNEDVRKPSLFPLIKLMVQLRNSFIKSDVDYISSPVADTKGIFYDSNNCGSHLPNNADANGAFNIARKGLMLVERITATPPEKKLSLIITNEEWLHYAQSQNK

SEQ ID NO: 826 - protein, 1197 aa, unidentified
  REGION 1..1197: note = Description of Unknown:uncultivated organism sequence
  REGION 1..1197: note = Category: MG60 effectors
  REGION 1..1197: note = Description: MG60-35 effector
MNKIEIQKTLRAELKPYGKTDVNSFKDVIERDRTRYESKREVMSMIDERHKTFLSCITDAPLDFTHLEDVLSKFNTNKKDTTLKKELESLQKEMCAELVEWIASNNKAEFTRLTAATPAGIITELSLQYPENKKLSLFTNFASYLIDYSNARSNMYSKANKHGSIAHRLITENFQIFVRNKTAYMQLLEKIPNFKSDVQEALPQFADVISAFASTDKYMMFASQDGIMRYNAVAGKINEIINLHIQENPDDKKSFKKLRTKQLYKQLLFDAESVLQKFRKIHDEDELREVMKTLWEETLDFGKTIEELDELLCTIDNYDKNGIFIKKRGLSGLSKYIHDDYLTVSKQLKKKYGKNAMKTHESFQLSDIAEKNVSLNDFFSDLKKYQSIALITYALINSSDDLLSDKSICDIHDFMENLNNFCRLSGIIATTDNPEADAQFYNNYDERAEKTSAIKNAFNAVKSFVCRRPKDIEMKFPLTFNYPHFMEGWDFDKIVNNVYGATLFTKDNRIYVGVLNRKAGMKFDDIRPAKPGEEFFHMVVYKQFGKPDKQLPNLFKSTAPEEIAILMDAKKEGRPYDMAKLIDYYKRCLKERYGNLYDLKFSETSEYKTFDDFTREVVQCTYHISFIDVPASQIDEWIETKKMYMFIVSTKDYAAGAHGSKELFTIFLENIFSKDNMHNDIIRLNGGARIMMRPKVLDKSFTHKKGSILLCKRDVLGNPIPSEAYDLLSRHLNGWTRSDEKNLAQKTMAEYKDIIRYKTAKYDIVKDKRYTRDMFTISLPITINAGYKIHYAEFNREVRRKFMKSDNAHIIGIDRGERNMLYITIIDKNGKTVLQKSLNMMDGYDFHMKLEQLENQRRDNQRNWKASGNIKHLKDGYSGKAVYEIYRLMLEYNAIIVMENLNEKFMTSRNAAFGTAVYTNFQNALINKLSYIVLKERKPMDEGGILNGYQFAYPVKEIGENVNQIGAVFFVPAGYTSKVDPITGFTSLIDFSDYESSDKKAAKFTNSFDSIRINEHGLLETKFKHDKFKTHIKNTGCEYTCIADGQRILTHKNQETGGWEYVDVDVRTEMNNMLEKYGISTSPGTDIKDEITKLRKNNPSIDKDFLTVMKTVMHMRNSNPHTGEDYIISPAVDKHGMTFDSRDIGNDAAGRPVNGDSNGARNIALKALIMLNNEQANGEFRSIKNTEWFSEIPKFSN

SEQ ID NO: 827 - protein, 758 aa, unidentified
  REGION 1..758: note = Description of Unknown:uncultivated organism sequence
  REGION 1..758: note = Category: MG60 effectors
  REGION 1..758: note = Description: MG60-36 effector
MLCQTGKSDTLFAYTVSPGKPERQGAGLAAEAVKEGKNMRIIKRSGTEVAFDITKIVAAVEKANKEVVETDRLSLEQIKEIAKKVTLTCSSMNRTFGVEEIQDLVENEIMEMQAFEVARKYITYRYKRALVRKANSTDEQILSLIECNNEEVKQENSNKNPVVNSVQRDYMAGEVSKDITKRFLLPEKIVKAHEAGIIHFHDSDYFAQHMHNCCLVNLEDMLQNGTVISETMIDRPKSFSTACNIATQSIAQIASSQYGGQSITLSHLAPFVDVSRKKYLKMVKEEYDAAGLQIDDSQIASIAELRVREEIKRGVQMIQYQVITLMTTNGQAPFVTVFMYLDEVPEGRTRDDLALVIEEMLTQRILGVKNEKGVYITPAFPKLIYVLEEDNVREGSKYWALTQLAAKCTAKRMVPDYISEKVMKKLKDGNCYPCMGCRSFLTVYHDESNRPKFYGRFNQGVVTLNLVDVACSSKGDMEQFWNILDERLQLCYEALMCRHNRLKGTPSDVAPILWQYGALARLKKGETIDKLLYNGYSTISLGYAGLCECTRYMTGLSHTNPEATPFALEVMQRLNDACAKWKAETNIDFSIYGTPLESTTYKFAKCLQKRFGKIEGVTDKNYITNSYHVHVTEEIDAFKKLTFESKFQELSPGGAVSYVEVPNMQNNIDAVLSVMQHIYDNIMYAELNTKSDYCQQCGFDGEIQISSDKEGKLIWRCPNCGNTDQDTMNVARRTCGYIGTQFWNQGRTQEIKERVLHL

SEQ ID NO: 828 - protein, 997 aa, unidentified
  REGION 1..997: note = Description of Unknown:uncultivated organism sequence
  REGION 1..997: note = Category: MG60 effectors
  REGION 1..997: note = Description: MG60-37 effector
MNSILDIAAQFLSENTNPIMESFHDESVDQAKKYIENNYDELYKFKGFQKFAPIKPSNLKEFANTKVRDIQRLIISPFIYAPRNELKWMNSYVLGLTRIMYKDLLYDKPKFKKNLLQDLKKIYLTAVYARQDGIANGDKSLMMDKNMNNLSFNELKTKFMPLFNHYYDIYKKNKQEYINIHTRNATTNTNLVANTAIKYDGAGNELNDTEYEEPYHENSFKIGKYNACLIPNHKAAATWNRFTNKTSDSNGCNWCITIPSTDDHWESYECGKTRTVYFCWTDNFLNLNIKDFNDGSAPYNEWGKSLMCVMVNDSDDINKFVCQVTSRYNHCNGKGENASSSLGFGDYFCGDPDSEGLAANLAQILGCSAEDIQEKFLFDGDMDASSEKGEQIYEDIAERINYYLERHNFNNLEVDTILPDNYVLATYSDKDYTVNVLLKNNTLVPNFIYTYIYPIYIGKTIDDCIFEVIDATAEYSDRTKNIAYGPNADTYFDHDMAEIIPIYKLNRSYSSEYNDEKYKTKHRIVALAPYHNHEYNLFDLDKKEFMLNDEFFIQSVFEKDGQLNLAITTGENSAERNISNVCVYNIDTKKTYYIKNEYLTDLQARLGDNYLRFNNAYMYANESNVILFDLLNMKPIEGNYTYVLESRIAFKDYLITLDESAKNFDYTIFYKGNVIDTFPARTHIYCPKDNTRSTDVFIINYNNDSESRIYYKGKLIYASNSETDNIKTSRGPFVIGNVLYVRLKEEKNITNDYSAQAFKLIDINTQKVITEDICMDGEYALETAVRKDIPVLAFKVNPKTNAIEYVVIDNNGKINNLNNEEDEFIDYNILKSGDSTVIASDSEIRINDGDANITMQYIKFYSNAKIKLYNPDGSIFYKPNDDDFQGLNYVSLAPLGYGFWLLTRKIKYSRIGLLEIHDIIDKNGKLIIGNTDSSPVSINIIDNFNENEDLLITATKYAKDIDSRDYSISKNGELKKLPYGWQSANENYIQNLAAYLL

SEQ ID NO: 829 - protein, 758 aa, unidentified
  REGION 1..758: note = Description of Unknown:uncultivated organism sequence
  REGION 1..758: note = Category: MG60 effectors
  REGION 1..758: note = Description: MG60-38 effector
MLCQTGKSDTLFAYTVSPGKPERQGAGLAAEAVKEGKNMRIIKRSGTEVAFDITKIVAAVEKANKEVVETDRLSLEQIKEIAKKVTLTCSSMNRTFGVEEIQDLVENEIMEMQAFEVARKYITYRYKRALVRKANSTDEQILSLIECNNEEVKQENSNKNPVVNSVQRDYMAGEVSKDITKRFLLPEKIVKAHEAGIIHFHDSDYFAQHMHNCCLVNLEDMLQNGTVISETMIDRPKSFSTACNIATQSIAQIASSQYGGQSITLSHLAPFVDVSRKKYLKMVKEEYDAAGLQIDDSQIASIAELRVREEIKRGVQMIQYQVITLMTTNGQAPFVTVFMYLDEVPEGRTRDDLALVIEEMLTQRILGVKNEKGVYITPAFPKLIYVLEEDNVREGSKYWALTQLAAKCTAKRMVPDYISEKVMKKLKDGNCYPCMGCRSFLTVYHDESNRPKFYGRFNQGVVTLNLVDVACSSKGDMEQFWNILEERLQLCYEALMCRHNRLKGTPSDVAPILWQYGALARLKKGETIDKLLYNGYSTISLGYAGLCECTRYMTGLSHTNPEATPFALEVMQRLNDACAKWKAETNIDFSIYGTPLESTTYKFAKCLQKRFGKIEGVTDKNYITNSYHVHVTEEIDAFKKLTFESKFQELSPGGAVSYVEVPNMQNNIDAVLSVMQHIYDNIMYAELNTKSDYCQQCGFDGEIQISSDKEGKLIWRCPNCGNTDQDTMNVARRTCGYIGTQFWNQGRTQEIKERVLHL

SEQ ID NO: 830 - protein, 1255 aa, unidentified
  REGION 1..1255: note = Description of Unknown:uncultivated organism sequence
  REGION 1..1255: note = Category: MG60 effectors
  REGION 1..1255: note = Description: MG60-39 effector
MNKILLTDAVPDIEKYWDYEANEGKKPSDFGASSSEKVWTKCPICGTSVKRNIRYTWEKDKNGVGHVIHCRTCGKRNNNNSLVVLFPDIKKHWIYEKNEHDPEYYSISSGKKVYTRCPSCGEERYIAICDLIVKRNDRYELTQCIECSPKRNVIGSIAKNYPDIDKYWDDSNASNPDEIALNSQEIIFIHCPTCDKVVKRKALNSFRRDDQTGLYMLLDCHKCATQKAGKIRGLNQSGALIDKCPEIEEWWDAENNTIEFKNITRGSHYEAQLKCPACHSSFTRQIHSFVNVKRDGRLLPVACPECGYSSKGDPKDNILKLCPEVEQWWDYEANSPYRPEQFSKGSQFQAHFICPDCGMHLYTGIHSLLKSDENGNLHIRHKGKCLKYRSMESDNNLVKQYPQIKEWWDYEENGKALPEEFTIYSGKRMHFICPQCGAKSYRRITDAFAIEANSGEPILFNCPYCRNKKVLAGKNSLLDTDPELAKEWSPNNNKKANEVLSKSFNRVQWICPNCKGEYSAIIRDRKVGDDACPYCKNDKVLTGFNSLQDKNPELAEEWSANNVLKANEVLPTSSSCVKWVCPTCRGEYSAIIRGRKVGDDACPYCRYDKLLPGYNSLLNTDPELAKEWSNSNDMKADEVLPTSSSRVKWVCPICRGEYSAIIRERKVGDDACPYCRYDKLLPGYNSLLNTDPELAKEWSNSNDMKADEVLPTSSSRVKWVCPTCKGEYSAIIRDRKVGDDACPYCRQTKLLKEQTSLGVINPELAKEWSANNVRKADEVLPTSSFRVKWVCPTCRGEYSAIIRDRKVGDDACPYCRKDKLLPGYNSLLDTNPELAKEWSDSNDLKADEVLPTSSSRALWICPTCRGEYYAAIRDRKVGDDACPYCRNDKLLPGYNSLLDTDPELAKEWSDSNDLKADEVLPTSSSRALWICPTCRGEYYAAIRDRKVGDDACPYCRNDKLLPGYNSLLDTDPELAKEWSDSNDLKADEVLPTSSSRALWICPTCRGEYYAAIRDRKVGDDACPYCRNDKLLPGYNSLLDTDPELAKEWSDSNDLKADEVLPTSSSRALWICPTCRGEYYAAIRDRKVGDDACPYCRNDKLLPGYNSLLDTDPELAKEWSDSNDLKADEVLPTSSSRALWICPTCRGEYYAAIRDRKVGDDACPYCRNDKLLPGYNSLKVRQPELVEREWCYPENILIGVYPDQILESYPGQAWWKCPTCKRKYLMSVKDRLMKQKRGHVACSQCRGRRWVRSFWV

SEQ ID NO: 831 - protein, 768 aa, unidentified
  REGION 1..768: note = Description of Unknown:uncultivated organism sequence
  REGION 1..768: note = Category: MG60 effectors
  REGION 1..768: note = Description: MG60-40 effector
MFCSCKKNLRVVIYIYDATKTYDCAKKLIVYKSIIKGAEVMKIIKRNGAEETFDRQKIKDAIAKANNETDGTPELTDRQIDYISLVIEDHCNEMNRALSVEEIQELVETHIILQGAPETAKRYIRYRFTRNLARASNTTDNQILSLIECNNEEVKQENSNKNPTVNSVQRDYMAGEVSKDLTKRILLPEDIVKAHEEGLIHFHDADYFAQHMHNCDLVNLEDMLQNGTVISGTMIEKPHSFSTACNIATQIIAQVASNQYGGQSISLAHLAPFVQISREKITRQVRAEMEEFGIDADDEQVKSLVEKRVRDEIKRGVQTIQYQVVTLLTTNGQAPFVTVFMYLNEAKNEQEKKDLAIIIEEVLKQRIKGTKNEVGVWVTPAFPKLIYVLEEDNITEDSRFWYLTKLAAECTAKRMVPDYISEKIMLKLKIDKNGNGNCYTCMGCRSFLTPYVDENGKPKYYGRFNQGVVTINLVDVACTAARDGNKSEEKFWQVLDERLELCHRALQCRHERLEGTLSDAAPILWQYGALARLKKGEPIDKLLHGGYSTLSLGYAGLWECVYEITGKKLTEKEGEEFGLRVMQRLNDACAEWKAAENIDYSIYGTPLESTTYKFAKCLQNRFGIIKGVTDRNYITNSYHIHVTEKIDAFSKLELESKFQKLSPGGAISYVEVPNMQQNIPAVLEVMKFIYNNIMYAELNTKSDYCQVCGYDGEIQIVEEDGKLVWRCPNCGNEDQSKMNVARRTCGYIGSQFWNQGRTQEIKERVLHL

SEQ ID NO: 832 - protein, 768 aa, unidentified
  REGION 1..768: note = Description of Unknown:uncultivated organism sequence
  REGION 1..768: note = Category: MG60 effectors
  REGION 1..768: note = Description: MG60-41 effector
MFCSCKKNLCVVIYIYDATKTYDCAKKLIVYKSIIKGAEVMKIIKRNGAEETFDRQKIKDAIAKANNETDGTPELTDRQIDYISLVIEDHCNEMNRALSVEEIQELVETHIILQGAPETAKRYIRYRFTRNLARASNTTDNQILSLIECNNEEVKQENSNKNPTVNSVQRDYMAGEVSKDLTKRILLPEDIVKAHEEGLIHFHDADYFAQHMHNCDLVNLEDMLQNGTVISGTMIEKPHSFSTACNIATQIIAQVASNQYGGQSISLAHLAPFVQISREKITRQVRAEMEEFGIDADDEQVKSLVEKRVRDEIKRGVQTIQYQVVTLLTTNGQAPFVTVFMYLNEAKNEQEKKDLAIIIEEVLKQRIKGTKNEVGVWVTPAFPKLIYVLEEDNITEDSRFWYLTKLAAECTAKRMVPDYISEKIMLKLKIDKNGNGNCYTCMGCRSFLTPYVDENGKPKYYGRFNQGVVTINLVDVACTAARDGNKSEEKFWQVLDERLELCHRALQCRHERLEGTLSDAAPILWQYGALARLKKGEPIDKLLHGGYSTLSLGYAGLWECVYEITGKKLTEKEGEEFGLRVMQRLNDACAEWKAAENIDYSIYGTPLESTTYKFAKCLQNRFGIIKGVTDRNYITNSYHVHVTEKIDAFSKLELESKFQKLSPGGAISYVEVPNMQQNIPAVLEVMKFIYNNIMYAELNTKSDYCQVCGYDGEIQIVEEDGKLVWRCPNCGNEDQSKMNVARRTCGYIGSQFWNQGRTQEIKERVLHL

SEQ ID NO: 833 - protein, 768 aa, unidentified
  REGION 1..768: note = Description of Unknown:uncultivated organism sequence
  REGION 1..768: note = Category: MG60 effectors
  REGION 1..768: note = Description: MG60-42 effector
MFCSCKKNLRVVIYIYNATKTYDCAKKLIVYKSIIKGAEVMKIIKRNGAEETFDRQKIKDAIAKANNETDGTPELTDRQIDYISLVIEDHCNEMNRALSVEEIQELVETHIILQGAPETAKRYIRYRFTRNLARASNTTDNQILSLIECNNEEVKQENSNKNPTVNSVQRDYMAGEVSKDLTKRILLPEDIVKAHEEGLIHFHDADYFAQHMHNCDLVNLEDMLQNGTVISGTMIEKPHSFSTACNIATQIIAQVASNQYGGQSISLAHLAPFVQISREKITRQVRAEMEEFGIDADDEQVKSLVEKRVRDEIKRGVQTIQYQVVTLLTTNGQAPFVTVFMYLNEAKNEQEKKDLAIIIEEVLKQRIKGTKNEVGVWVTPAFPKLIYVLEEDNITEDSRFWYLTKLAAECTAKRMVPDYISEKIMLKLKIDKNGNGNCYTCMGCRSFLTPYVDENGKPKYYGRFNQGVVTINLVDVACTAARDGNKSEEKFWQVLDERLELCHRALQCRHERLEGTLSDAAPILWQYGALARLKKGEPIDKLLHGGYSTLSLGYAGLWECVYEITGKKLTEKEGEEFGLRVMQRLNDACAEWKAAENIDYSIYGTPLESTTYKFAKCLQNRFGIIKGVTDRNYITNSYHIHVTEKIDAFSKLELESKFQKLSPGGAISYVEVPNMQQNIPAVLEVMKFIYNNIMYAELNTKSDYCQVCGYDGEIQIVEEDGKLVWRCPNCGNEDQSKMNVARRTCGYIGSQFWNQGRTQEIKERVLHL

SEQ ID NO: 834 - protein, 768 aa, unidentified
  REGION 1..768: note = Description of Unknown:uncultivated organism sequence
  REGION 1..768: note = Category: MG60 effectors
  REGION 1..768: note = Description: MG60-43 effector
MFCSCKKNLRVVIYIYNATKTYDCAKKLIVYKSIIKGAEVMKIIKRNGAEETFDRQKIKDAIAKANNETDGTPELTDRQIDYISLVIEDHCNEMNRALSVEEIQELVETHIILQGAPETAKRYIRYRFTRNLARASNTTDNQILSLIECNNEEVKQENSNKNPTVNSVQRDYMAGEVSKDLTKRILLPEDIVKAHEEGLIHFHDADYFAQHMHNCDLVNLEDMLQNGTVISGTMIEKPHSFSTACNIATQIIAQVASNQYGGQSISLAHLAPFVQISREKITRQVRAEMEEFGIDADDEQVKSLVEKRVRDEIKRGVQTIQYQVVTLLTTNGQAPFVTVFMYLNEAKNEQEKKDLAIIIEEVLKQRIKGTKNEVGVWVTPAFPKLIYVLEEDNITEDSRFWYLTKLAAECTAKRMVPDYISEKIMLKLKIDKNGNGNCYTCMGCRSFLTPYVDENGKPKYYGRFNQGVVTINLVDVACTAARDGSKNEEKFWQVLDERLELCHRALQCRHERLEGTLSDAAPILWQYGALARLKKGEPIDKLLHGGYSTLSLGYAGLWECVYEITGKKLTEKEGEEFGLRVMQRLNDACAEWKAAENIDYSIYGTPLESTTYKFAKCLQNRFGIIKGVTDRNYITNSYHIHVTEKIDAFSKLELESKFQKLSPGGAISYVEVPNMQQNIPAVLEVMKFIYNNIMYAELNTKSDYCQVCGYDGEIQIVEEDGKLVWRCPNCGNEDQSKMNVARRTCGYIGSQFWNQGRTQEIKERVLHL

SEQ ID NO: 835 - protein, 768 aa, unidentified
  REGION 1..768: note = Description of Unknown:uncultivated organism sequence
  REGION 1..768: note = Category: MG60 effectors
  REGION 1..768: note = Description: MG60-44 effector
MFCSCKKNLCVVIYIYDATKTYDCAKKLIVYKSIIKGAEVMKIIKRNGAEETFDRQKIKDAIAKANNETDGTPELTDRQIDYISLVIEDHCNEMNRALSVEEIQELVETHIILQGAPETAKRYIRYRFTRNLARASNTTDNQILSLIECNNEEVKQENSNKNPTVNSVQRDYMAGEVSKDLTKRILLPEDIVKAHEEGLIHFHDADYFAQHMHNCDLVNLEDMLQNGTVISGTMIEKPHSFSTACNIATQIIAQVASNQYGGQSISLAHLAPFVQISREKITRQVRAEMEEFGIDADDEQVKSLVEKRVRDEIKRGVQTIQYQVVTLLTTNGQAPFVTVFMYLNEAKNEQEKKDLAIIIEEVLKQRIKGTKNEVGVWVTPAFPKLIYVLEEDNITEDSRFWYLTKLAAECTAKRMVPDYISEKIMLKLKIDKNGNGNCYTCMGCRSFLTPYVDENGKPKYYGRFNQGVVTINLVDVACTAARDGNKSEEKFWQVLDERLELCHRALQCRHERLEGTLSDAAPILWQYGALARLKKGEPIDKLLHGGYSTLSLGYAGLWECVYEITGKKLTEKEGEEFGLRVMQRLNDACAEWKAAENIDYSIYGTPLESTTYKFAKCLQNRFGIIKGVTDRNYITNSYHIHVTEKIDAFSKLELESKFQKLSPGGAISYVEVPNMQQNIPAVLEVMKFIYNNIMYAELNTKSDYCQVCGYDGEIQIVEEDGKLVWRCPNCGNEDQSKMNVARRTCGYIGSQFWNQGRTQEIKERVLHL

SEQ ID NO: 836 - protein, 768 aa, unidentified
  REGION 1..768: note = Description of Unknown:uncultivated organism sequence
  REGION 1..768: note = Category: MG60 effectors
  REGION 1..768: note = Description: MG60-45 effector
MFCSCKKNLRVVIYIYDATKTYDCAKKLIVYKSIIKGAEVMKIIKRNGAEETFDRQKIKDAISKANNETDGTPELTDRQIDYISLVIEDHCNEMNRALSVEEIQELVETHIILQGAPETAKRYIRYRFTRNLARASNTTDNQILSLIECNNEEVKQENSNKNPTVNSVQRDYMAGEVSKDLTKRILLPEDIVKAHEEGLIHFHDADYFAQHMHNCDLVNLEDMLQNGTVISGTMIEKPHSFSTACNIATQIIAQVASNQYGGQSISLAHLAPFVQISREKITRQVRAEMEEFGIAADDEQVKSLVEKRVRDEIKRGVQTIQYQVVTLLTTNGQAPFVTVFMYLNEAKNEQEKKDLAIIIEEVLKQRIKGTKNEVGVWVTPAFPKLIYVLEEDNITEDSRFWYLTKLAAECTAKRMVPDYISEKIMLKLKIDKNGNGNCYTCMGCRSFLTPYVDENGKPKYYGRFNQGVVTINLVDVACTAARDGSKSEEKFWQVLDERLELCHRALQCRHERLEGTLSDAAPILWQYGALARLKKGEPIDKLLHGGYSTLSLGYAGLWECVYEITGKKLTEKEGEEFGLRVMQRLNDACAEWKAAENIDYSIYGTPLESTTYKFAKCLQNRFGIIKGVTDRNYITNSYHIHVTEKIDAFSKLELESKFQKLSPGGAISYVEVPNMQQNIPAVLEVMKFIYNNIMYAELNTKSDYCQVCGYDGEIQIVEEDGKLVWRCPNCGNEDQSKMNVARRTCGYIGSQFWNQGRTQEIKERVLHL

SEQ ID NO: 837 - protein, 760 aa, unidentified
  REGION 1..760: note = Description of Unknown:uncultivated organism sequence
  REGION 1..760: note = Category: MG60 effectors
  REGION 1..760: note = Description: MG60-46 effector
MLVVIYIYNATKTYDCAKKLIVHKSIIKGAEVMKIIKRNGAEETFDRQKIKDAIAKANNETDGTPELTDRQIDYISLVIEDHCNEMNRALSVEEIQELVETHIILQGAPETAKRYIRYRFTRNLARASNTTDNQILSLIECNNEEVKQENSNKNPTVNSVQRDYMAGEVSKDLTKRILLPEDIVKAHEEGLIHFHDADYFAQHMHNCDLVNLEDMLQNGTVISGTMIEKPHSFSTACNIATQIIAQVASNQYGGQSISLAHLAPFVQISREKITRQVRAEMEEFGIDADDEQVKSLVEKRVRDEIKRGVQTIQYQVVTLLTTNGQAPFVTVFMYLNEAKNEQEKKDLAIIIEEVLKQRIKGTKNEVGVWVTPAFPKLIYVLEEDNITEDSRFWYLTKLAAECTAKRMVPDYISEKIMLKLKIDKNGNGNCYTCMGCRSFLTPYVDENGKPKYYGRFNQGVVTINLVDVACTAARDGNKSEEKFWQVLDERLELCHRALQCRHERLEGTLSDAAPILWQYGALARLKKGEPIDKLLHGGYSTLSLGYAGLWECVYEITGKKLTEKEGEEFGLRVMQRLNDACAEWKAAENIDYSIYGTPLESTTYKFAKCLQNRFGIIKGVTDRNYITNSYHIHVTEKIDAFSKLELESKFQKLSPGGAISYVEVPNMQQNIPAVLEVMKFIYNNIMYAELNTKSDYCQVCGYDGEIQIVEEDGKLVWRCPNCGNEDQSKMNVARRTCGYIGSQFWNQGRTQEIKERVLHL

SEQ ID NO: 838 - protein, 768 aa, unidentified
  REGION 1..768: note = Description of Unknown:uncultivated organism sequence
  REGION 1..768: note = Category: MG60 effectors
  REGION 1..768: note = Description: MG60-47 effector
MFCSCKKNLCVVIYIYDATKTYDCAKKLIVYKSIIKGAEVMKIIKRNGAEETFDRQKIKDAIAKANNETDGAPELTDRQIDYISLVIEDHCNEMNRALSVEEIQELVETHIILQGAPETAKRYIRYRFTRNLARASNTTDNQILSLIECNNEEVKQENSNKNPTVNSVQRDYMAGEVSKDLTKRILLPEDIVKAHEEGLIHFHDADYFAQHMHNCDLVNLEDMLQNGTVISGTMIEKPHSFSTACNIATQIIAQVASNQYGGQSISLAHLAPFVQISREKITRQVRAEMEEFGIDADDEQVKSLVEKRVRDEIKRGVQTIQYQVVTLLTTNGQAPFVTVFMYLNEAKNEQEKKDLAIIIEEVLKQRIKGTKNEVGVWVTPAFPKLIYVLEEDNITEDSRFWYLTKLAAECTAKRMVPDYISEKIMLKLKIDKNGNGNCYTCMGCRSFLTPYVDENGNPKYYGRFNQGVVTINLVDVACTAARDGSKSEEKFWQVLDERLELCHRALQCRHERLEGTLSDAAPILWQYGALARLKKGEPIDKLLHGGYSTLSLGYAGLWECVYEITGKKLTEKEGEEFGLRVMQRLNDACAEWKAAENIDYSIYGTPLESTTYKFAKCLQNRFGIIKGVTDRNYITNSYHIHVTEKIDAFSKLELESKFQKLSPGGAISYVEVPNMQQNIPAVLEVMKFIYNNIMYAELNTKSDYCQVCGYDGEIQIVEEDGKLVWRCPNCGNEDQSKMNVARRTCGYIGSQFWNQGRTQEIKERVLHL

SEQ ID NO: 839 - protein, 768 aa, unidentified
  REGION 1..768: note = Description of Unknown:uncultivated organism sequence
  REGION 1..768: note = Category: MG60 effectors
  REGION 1..768: note = Description: MG60-48 effector
MFCSCKKNLCVVIYIYNATKTYDCAKKLIVYKSIIKGAEVMKIIKRNGAEETFDRQKIKDAIAKANNETDGTPELTDRQIDYISLVIEDHCNEMNRALSVEEIQELVETHIILQGAPETAKRYIRYRFTRNLARASNTTDNQILSLIECNNEEVKQENSNKNPTVNSVQRDYMAGEVSKDLTKRILLPEDIVKAHEEGLIHFHDADYFAQHMHNCDLVNLEDMLQNGTVISGTMIEKPHSFSTACNIATQIIAQVASNQYGGQSISLAHLAPFVQISREKITRQVRAEMEEFGIDADDEQVKSLVEKRVRDEIKRGVQTIQYQVVTLLTTNGQAPFVTVFMYLNEAKNEQEKKDLAIIIEEVLKQRIKGTKNEVGVWVTPAFPKLIYVLEEDNITEDSRFWYLTKLAAECTAKRMVPDYISEKIMLKLKIDKNGNGNCYTCMGCRSFLTPYVDENGKPKYYGRFNQGVVTINLVDVACTAARDGNKNEEKFWQVLDERLELCHRALQCRHERLEGTLSDAAPILWQYGALARLKKGEPIDKLLHGGYSTLSLGYAGLWECVYEITGKKLTEKEGEEFGLRVMQRLNDACAEWKAAENIDYSIYGTPLESTTYKFAKCLQNRFGIIKGVTDRNYITNSYHIHVTEKIDAFSKLELESKFQKLSPGGAISYVEVPNMQQNIPAVLEVMKFIYNNIMYAELNTKSDYCQVCGYDGEIQIVEEDGKLVWRCPNCGNEDQSKMNVARRTCGYIGSQFWNQGRTQEIKERVLHL

SEQ ID NO: 840 - protein, 768 aa, unidentified
  REGION 1..768: note = Description of Unknown:uncultivated organism sequence
  REGION 1..768: note = Category: MG60 effectors
  REGION 1..768: note = Description: MG60-49 effector
MFCSCKKNLRVVIYIYNATKTYDCAKKLIVYKSIIKGAEVMKIIKRNGAEETFDRQKIKDAIAKANNETDGTPELTDRQIDYISLVIEDHCNEMNRALSVEEIQELVETHIILQGAPETAKRYIRYRFTRNLARASNTTDNQILSLIECNNEEVKQENSNKNPTVNSVQRDYMAGEVSKDLTKRILLPEDIVKAHEEGLIHFHDADYFAQHMHNCDLVNLEDMLQNGTVISGTMIEKPHSFSTACNIATQIIAQVASNQYGGQSISLAHLAPFVQISREKITRQVRAEIEEFGIAADDEQVKSLVEKRVRDEIKRGVQTIQYQVVTLLTTNGQAPFVTVFMYLNEAKNEQEKKDLAIIIEEVLKQRIKGTKNEVGVWVTPAFPKLIYVLEEDNITEDSRFWYLTKLAAECTAKRMVPDYISEKIMLELKIDKNGNGNCYTCMGCRSFLTPYVDENGKPKYYGRFNQGVVTINLVDVACTAARDGNKSEEKFWQVLDERLELCHRALQCRHERLEGTLSDAAPILWQYGALARLKKGEPIDKLLHGGYSTLSLGYAGLWECVYEITGKKLTEKEGEEFGLRVMQRLNDACAEWKAAENIDYSIYGTPLESTTYKFAKCLQNRFGIIKGVTDRNYITNSYHIHVTEKIDAFSKLELESKFQKLSPGGAISYVEVPNMQQNIPAVLEVMKFIYNNIMYAELNTKSDYCQVCGYDGEIQIVEEDGKLVWRCPNCGNEDQSKMNVARRTCGYIGSQFWNQGRTQEIKERVLHL

SEQ ID NO: 841 - protein, 768 aa, unidentified
  REGION 1..768: note = Description of Unknown:uncultivated organism sequence
  REGION 1..768: note = Category: MG60 effectors
  REGION 1..768: note = Description: MG60-50 effector
MFCSCKKNLRVVIYIYDATKTYDCAKKIIVYKSIIKGAEVMKIIKRNGAEETFDRQKIKDAIAKANNETDGTPELTDRQIDYISLVIEDHCNEMNRALSVEEIQELVETHIILQGAPETAKRYIRYRFTRNLARASNTTDNQILSLIECNNEEVKQENSNKNPTVNSVQRDYMAGEVSKDLTKRILLPEDIVKAHEEGLIHFHDADYFAQHMHNCDLVNLEDMLQNGTVISGTMIEKPHSFSTACNIATQIIAQVASNQYGGQSISLAHLAPFVQISREKITRQVRAEMEEFGIDADDEQVKSLVEKRVRDEIKRGVQTIQYQVVTLLTTNGQAPFVTVFMYLNEAKNEQEKKDLAIIIEEVLKQRIKGTKNEVGVWVTPAFPKLIYVLEEDNITEDSRFWYLTKLAAECTAKRMVPDYISEKIMLKLKVDKNGNGNCYTCMGCRSFLTPYVDENGKPKYYGRFNQGVVTINLVDVACTAARDGSKSEEKFWQVLDERLELCHRALQCRHERLEGTLSDAAPILWQYGALARLKKGEPIDKLLHGGYSTLSLGYAGLWECVYEITGKKLTEKEGEEFGLRVMQRLNDACAEWKAAENIDYSIYGTPLESTTYKFAKCLQNRFGIIKGVTDRNYITNSYHIHVTEKIDAFSKLELESKFQKLSPGGAISYVEVPNMQQNIPAVLEVMKFIYNNIMYAELNTKSDYCQVCGYDGEIQIVEEDGKLVWRCPNCGNEDQSKMNVARRTCGYIGSQFWNQGRTQEIKERVLHL

SEQ ID NO: 842 - protein, 768 aa, unidentified
  REGION 1..768: note = Description of Unknown:uncultivated organism sequence
  REGION 1..768: note = Category: MG60 effectors
  REGION 1..768: note = Description: MG60-51 effector
MFCSCKKKLCVVIYIYDATKTYDCAKKLIVYKSIIKGAEVMKIIKRNGAEETFDRQKIKDAIAKANNETDGTPELTDRQIDYISLVIEDHCNEMNRALSVEEIQELVETHIILQGAPETAKRYIRYRFTRNLARASNTTDNQILSLIECNNEEVKQENSNKNPTVNSVQRDYMAGEVSKDLTKRILLPEDIVKAHEEGLIHFHDADYFAQHMHNCDLVNLEDMLQNGTVISGTMIEKPHSFSTACNIATQIIAQVASNQYGGQSISLAHLAPFVQISREKITRQVRAEMEEFGIAADDEQVKSLVEKRVRDEIKRGVQTIQYQVVTLLTTNGQAPFVTVFMYLNEAKNEQEKKDLAIIIEEVLKQRIKGTKNEVGVWVTPAFPKLIYVLEEDNITEDSRFWYLTKLAAECTAKRMVPDYISEKIMLKLKIDKNGNGNCYTCMGCRSFLTPYVDENGKPKYYGRFNQGVVTINLVDVACTAARDGNKSEEKFWQVLDERLELCHRALQCRHERLEGTLSDAAPILWQYGALARLKKGEPIDKLLHGGYSTLSLGYAGLWECVYEITGKKLTEKEGEEFGLRVMQRLNDACAEWKAAENIDYSIYGTPLESTTYKFAKCLQNRFGIIKGVTDRNYITNSYHIHVTEKIDAFSKLELESKFQKLSPGGAISYVEVPNMQQNIPAVLEVMKFIYNNIMYAELNTKSDYCQVCGYDGEIQIVEEDGKLVWRCPNCGNEDQSKMNVARRTCGYIGSQFWNQGRTQEIKERVLHL

SEQ ID NO: 843 - protein, 760 aa, unidentified
  REGION 1..760: note = Description of Unknown:uncultivated organism sequence
  REGION 1..760: note = Category: MG60 effectors
  REGION 1..760: note = Description: MG60-52 effector
MLVVIYIYNATKTYDCAKKLIVYKSIIKGAEVMKIIKRNGAEETFDRQKIKDAIAKANNETDGTPELTDRQIDYISLVIEDHCNEMNRALSVEEIQELVETHIILQGAPETAKRYIRYRFTRNLARASNTTDNQILSLIECNNEEVKQENSNKNPTVNSVQRDYMAGEVSKDLTKRILLPEDIVKAHEEGLIHFHDADYFAQHMHNCDLVNLEDMLQNGTVISGTMIEKPHSFSTACNIATQIIAQVASNQYGGQSISLAHLAPFVQISREKITRQVRAEMEEFGIDADDEQVKSLVEKRVRDEIKRGVQTIQYQVVTLLTTNGQAPFVTVFMYLNEAKNEQEKKDLAIIIEEVLKQRIKGTKNEVGVWVTPAFPKLIYVLEEDNITEDSRFWYLTKLAAECTAKRMVPDYISEKIMLKLKIDKNGNGNCYTCMGCRSFLTPYVDENGKPKYYGRFNQGVVTINLVDVACTAARDGNNSEEKFWQVLDERLELCHRALQCRHERLEGTLSDAAPILWQYGALARLKKGEPIDKLLHGGYSTLSLGYAGLWECVYEITGKKLTEKEGEEFGLRVMQRLNDACAEWKAAENIDYSIYGTPLESTTYKFAKCLQNRFGIIKGVTDRNYITNSYHIHVTEKIDAFSKLELESKFQKLSPGGAISYVEVPNMQQNIPAVLEVMKFIYNNIMYAELNTKSDYCQVCGYDGEIQIVEEDGKLVWRCPNCGNEDQSKMNVARRTCGYIGSQFWNQGRTQEIKERVLHL

SEQ ID NO: 844 - protein, 768 aa, unidentified
  REGION 1..768: note = Description of Unknown:uncultivated organism sequence
  REGION 1..768: note = Category: MG60 effectors
  REGION 1..768: note = Description: MG60-53 effector
MFCSCKKNLCVVIYIYDATKTYDCAKNLIVYKSIIKGAEVMKIIKRNGAEETFDRQKIKDAIAKANNETDGTPELTDRQIDYISLVIEDHCNEMNRALSVEEIQELVETHIILQGAPETAKRYIRYRFTRNLARASNTTDNQILSLIECNNEEVKQENSNKNPTVNSVQRDYMAGEVSKDLTKRILLPEDIVKAHEEGLIHFHDADYFAQHMHNCDLVNLEDMLQNGTVISGTMIEKPHSFSTACNIATQIIAQVASNQYGGQSISLAHLAPFVQISREKITRQVRAEMEEFGIDADDEQVKSLVEKRVRDEIKRGVQTIQYQVVTLLTTNGQAPFVTVFMYLNEAKNEQEKKDLAIIIEEVLKQRIKGTKNEVGVWVTPAFPKLIYVLEEDNITEDSRFWYLTKLAAECTAKRMVPDYISEKIMLKLKIDKNGNGNCYTCMGCRSFLTPYVDENGKPKYYGRFNQGVVTINLVDVACTAARDGSKSEEKFWQVLDERLELCHRALQCRHERLEGTLSDAAPILWQYGALARLKKGEPIDKLLHGGYSTLSLGYAGLWECVYEITGKKLTEKEGEEFGLRVMQRLNDACAEWKAAENIDYSIYGTPLESTTYKFAKCLQNRFGIIKGVTDRNYITNSYHIHVTEKIDAFSKLELESKFQKLSPGGAISYVEVPNMQQNIPAVLEVMKFIYNNIMYAELNTKSDYCQVCGYDGEIQIVEEDGKLVWRCPNCGNEDQSKMNVARRTCGYIGSQFWNQGRTQEIKERVLHL

SEQ ID NO: 845 - protein, 768 aa, unidentified
  REGION 1..768: note = Description of Unknown:uncultivated organism sequence
  REGION 1..768: note = Category: MG60 effectors
  REGION 1..768: note = Description: MG60-54 effector
MFCSCKKNLRVVIYIYNATKTYDCAKKLIVYKSIIKGAEVMKIIKRNGAEETFDRQKIKDAIAKANNETDGTPELTDRQIDYISLVIEDHCNEMNRALSVEEIQELVETHIILQGAPETAKRYIRYRFTRNLARASNTTDNQILSLIECNNEEVKQENSNKNPTVNSVQRDYMAGEVSKDLTKRILLPEDIVKAHEEGLIHFHDADYFAQHMHNCDLVNLEDMLQNGTVISGTMIEKPHSFSTACNIATQIIAQVASNQYGGQSISLAHLAPFVQISREKITRQVRAEMEEFGIAADDEQVKSLVEKRVRDEIKRGVQTIQYQVVTLLTTNGQAPFVTVFMYLNEAKNEQEKKDLAIIIEEVLKQRIKGTKNEVGVWVTPAFPKLIYVLEEDNITEDSRFWYLTKLAAECTAKRMVPDYISEKIMLELKIDKNGNGNCYTCMGCRSFLTPYVDENGKPKYYGRFNQGVVTINLVDVACTAARDGNKSEEKFWQVLDERLELCHRALQCRHGRLEGTLSDAAPILWQYGALARLKKGEPIDKLLHGGYSTLSLGYAGLWECVYEITGKKLTEKEGEEFGLRVMQRLNDACAEWKAAENIDYSIYGTPLESTTYKFAKCLQNRFGIIKGVTDRNYITNSYHIHVTEKIDAFSKLELESKFQKLSPGGAISYVEVPNMQQNIPAVLEVMKFIYNNIMYAELNTKSDYCQVCGYDGEIQIVEEDGKLVWRCPNCGNEDQSKMNVARRTCGYIGSQFWNQGRTQEIKERVLHL

SEQ ID NO: 846 - protein, 768 aa, unidentified
  REGION 1..768: note = Description of Unknown:uncultivated organism sequence
  REGION 1..768: note = Category: MG60 effectors
  REGION 1..768: note = Description: MG60-55 effector
MFCSCKKNLRVVIYIYDATKTYDCAKKLIVYKSIIKGAEVMKIIKRNGAEETFDRQKIKDAIAKANNETDGTPELTDRQIDYISLVIEDHCNEMNRALSVEEIQELVETHIILQGAPETAKRYIRYRFTRNLARASNTTDNQILSLIECNNEEVKQENSNKNPTVNSVQRDYMAGEVSKDLTKRILLPEDIVKAHEEGLIHFHDADYFAQHMHNCDLVNLEDMLQNGTVISGTMIEKPHSFSTACNIATQIIAQVASNQYGGQSISLAHLAPFVQISREKITRQVRAEMEEFGIDADDEQVKSLVEKRVRDEIKRGVQTIQYQVVTLLTTNGQAPFVTVFMYLNEAKNEQEKKDLAIIIEEVLKQRIKGTKNEVGVWVTPAFPKLIYVLEEDNITEDSRFWYLTKLAAECTAKRMVPDYISEKIMLKLKIDKNGNGNCYTCMGCRSFLTPYVDENGKPKYYGRFNQGVVTINLVDVACTAARDGSKSEEKFWQVLDERLELCHRALQCRHERLEGTLSDAAPILWQYGALARLKKGEPIDKLLHGGYSTLSLGYAGLWECVYEITGKKLTEKEGEEFGLRVMQRLNDACAEWKAAENIDYSIYGTPLESTTYKFAKCLQNRFGIIKGVTDRNYITNSYHIHVTEKIDAFSKLELESKFQKLSPGGAISYVEVPNMQQNIPAVLEVMKFIYNNIMYAELNTKSDYCQVCGYDGEIQIVEEDGKLVWRCPNCGNEDQSKMNVARRTCGYIGSQFWNQGRTQEIKERVLHL

SEQ ID NO: 847 - protein, 768 aa, unidentified
  REGION 1..768: note = Description of Unknown:uncultivated organism sequence
  REGION 1..768: note = Category: MG60 effectors
  REGION 1..768: note = Description: MG60-56 effector
MFCSCKKNLCVVIYIYNATKTYDCAKKLIVYKSIIKGAEVMKIIKRNGAEETFDRQKIKDAIAKANNETDGTPELTDRQIDYISLVIEDHCNEMNRALSVEEIQELVETHIILQGAPETAKRYIRYRFTRNLARASNTTDNQILSLIECNNEEVKQENSNKNPTVNSVQRDYMAGEVSKDLTKRILLPEDIVKAHEEGLIHFHDADYFAQHMHNCDLVNLEDMLQNGTVISGTMIEKPHSFSTACNIATQIIAQVASNQYGGQSISLAHLAPFVQISREKITRQVRAEMEEFGIDADDEQVKSLVEKRVRDEIKRGVQTIQYQVVTLLTTNGQAPFVTVFMYLNEAKNEQEKKDLAIIIEEVLKQRIKGTKNEVGVWVTPAFPKLIYVLEEDNITEDSRFWYLTKLAAECTAKRMVPDYISEKIMLKLKIDKNGNGNCYTCMGCRSFLTPYVDENGKPKYYGRFNQGVVTINLVDVACTAARDGSKSEEKFWQVLDERLELCHRALQCRHERLEGTLSDAAPILWQYGALARLKKGEPIDKLLHGGYSTLSLGYAGLWECVYEITGKKLTEKEGEEFGLRVMQRLNDACAEWKAAENIDYSIYGTPLESTTYKFAKCLQNRFGIIKGVTDRNYITNSYHIHVTEKIDAFSKLELESKFQKLSPGGAISYVEVPNMQQNIPAVLEVMKFIYNNIMYAELNTKSDYCQVCGYDGEIQIVEEDGKLVWRCPNCGNEDQSKMNVARRTCGYIGSQFWNQGRTQEIKERVLHL

SEQ ID NO: 848 - protein, 768 aa, unidentified
  REGION 1..768: note = Description of Unknown:uncultivated organism sequence
  REGION 1..768: note = Category: MG60 effectors
  REGION 1..768: note = Description: MG60-57 effector
MFCSCKKNLRVVIYIYNATKTYDCAKKLIVYKSIIKGAEVMKIIKRNGAEETFDRQKIKDAIAKANNETDGTPELTDRQIDYISLVIEDHCNEMNRALSVEEIQELVETHIILQGAPETAKRYIRYRFTRNLARASNTTDNQILSLIECNNEEVKQENSNKNPTVNSVQRDYMAGEVSKDLTKRILLPEDIVKAHEEGLIHFHDADYFAQHMHNCDLVNLEDMLQNGTVISGTMIEKPHSFSTACNIATQIIAQVASNQYGGQSISLAHLAPFVQISREKITRQVRAEMEEFGIDADDEQVKSLVEKRVRDEIKRGVQTIQYQVVTLLTTNGQAPFVTVFMYLNEAKNEQEKKDLAIIIEEVLKQRIKGTKNEVGVWVTPAFPKLIYVLEEDNITEDSRFWYLTKLAAECTAKRMVPDYISEKIMLKLKIDKNGNGNCYTCMGCRSFLTPYVDENGKPKYYGRFNQGVVTINLVDVACTAARDGNKSEEKFWQVLDERLELCHRALQCRHERLEGTLSDAAPILWQYGALARLKKGEPIDKLLHGGYSTLSLGYAGLWECVYEIKGKKLTEKEGEEFGLRVMQRLNDACAEWKAAENIDYSIYGTPLESTTYKFAKCLQNRFGIIKGVTDRNYITNSYHIHVTEKIDAFSKLELESKFQKLSPGGAISYVEVPNMQQNIPAVLEVMKFIYNNIMYAELNTKSDYCQVCGYDGEIQIVEEDGKLVWRCPNCGNEDQSKMNVARRTCGYIGSQFWNQGRTQEIKERVLHL

SEQ ID NO: 849 - protein, 768 aa, unidentified
  REGION 1..768: note = Description of Unknown:uncultivated organism sequence
  REGION 1..768: note = Category: MG60 effectors
  REGION 1..768: note = Description: MG60-58 effector
MFCSCKKNLCVVIYIYDATKTYDCAKKLIVYKSIIKGAEVMKIIKRNGAEETFDRQKIKDAIAKANNETDGTPELTDRQIDYISLVIEDHCNEMNRALSVEEIQELVETHIILQGAPETAKRYIRYRFTRNLARASNTTDNQILSLIECNNEEVKQENSNKNPTVNSVQRVYMAGEVSKDLTKRILLPEDIVKAHEEGLIHFHDADYFAQHMHNCDLVNLEDMLQNGTVISGTMIEKPHSFSTACNIATQIIAQVASNQYGGQSISLAHLAPFVQISREKITRQVRAEMEEFGIDADDEQVKSLVEKRVRDEIKRGVQTIQYQVVTLLTTNGQAPFVTVFMYLNEAKNEQEKKDLAIIIEEVLKQRIKGTKNEVGVWVTPAFPKLIYVLEEDNITEDSRFWYLTKLAAECTAKRMVPDYISEKIMLKLKIDKNGNGNCYTCMGCRSFLTPYVDENGKPKYYGRFNQGVVTINLVDVACTAARDGSKSEEKFWQVLDERLELCHRALQCRHERLEGTLSDAAPILWQYGALARLKKGEPIDKLLHGGYSTLSLGYAGLWECVYEITGKKLTEKEGEEFGLRVMQRLNDACAEWKAAENIDYSIYGTPLESTTYKFAKCLQNRFGIIKGVTDRNYITNSYHIHVTEKIDAFSKLELESKFQKLSPGGAISYVEVPNMQQNIPAVLEVMKFIYNNIMYAELNTKSDYCQVCGYDGEIQIVEEDGKLVWRCPNCGNEDQSKMNVARRTCGYIGSQFWNQGRTQEIKERVLHL

SEQ ID NO: 850 - protein, 861 aa, unidentified
  REGION 1..861: note = Description of Unknown:uncultivated organism sequence
  REGION 1..861: note = Category: MG60 effectors
  REGION 1..861: note = Description: MG60-59 effector
MHKPPKLKRFNQEVLSKYQIYNSIFMTLPFDTITKTGIFLPLFHEVCKTGFSKKKNPTEIVNYFFKTYQDNPTEQEKNDLLFQFIQYIERQIVLFDAIEDAAFTTVNNMDGVGTMRNTKEAAVRDNKKEALQKHLENFKIRLVLTAHPTQFYPGPVLGIITDLANAIEKNDLLLINKLLGQLGKTPFFKHEKPTPYDEAVSLIWYLENVFYHAIADTYNYIQNNIFDGRAINNEIINLGFWPGGDRDGNPFVTTETTLKVAKRLKQILLKNYYKDILVLKKRLTFKGVESIVLELEKLLFENSVNPDLNTMISKDEFLKKLYQIKHILTTEHSSLYLEEITDLINKVHLFGYHFASLDLRQDSRVHHNVFSTIVTELQEKGSGLFPKNYLSLSEKEQIKILSTVAADILPEEFSDEMASKTLSSIRAIKTIQNENGEKGAHRYIISNNQTALNMMETFAMFKLSGFEENFSVDIIPLFETIEDLENAAEVMQTLYANPVYRNHLTHRDNKQTIMLGFSDGTKDGGYFMANWSIFKAKESITKISRNYGIDVIFFDGRGGPPARGGGKTHEFYASLGQTIENKEIQLTIQGQTISANFGIENAAQYNIEQLLSAGIANEIFNTAKNNLTSEDTKIMNDLAKTSYKAYSEFKNHPKFLPYLENRSTLKYYSKTNIGSRPSKRSQSSTLNFSDLRAIPFVGSWSQLKQNVPGFYGVGTALKKYEDNGEFEKLKQFYNHSDFFKALIGNSMMSLSKSFFELTEYMAEDEEYGEFWKMIYEEYKTTKRLILKLTGYTELMQNNPVGKASINIRENIVLPLLTIQQYALLKIQELQKDNNNPKLVEVYEKMVTRSLFGNINASRNSA

SEQ ID NO: 851 - protein, 768 aa, unidentified
  REGION 1..768: note = Description of Unknown:uncultivated organism sequence
  REGION 1..768: note = Category: MG60 effectors
  REGION 1..768: note = Description: MG60-60 effector
MFCSCKKNLCVVIYIYDATKTYDCAKKSIVYKSIIKGAEVMKIIKRNGAEETFDRQKIKDAIAKANNETDGTPELTDRQIDYISLVIEDHCNEMNRALSVEEIQELVETHIILQGAPETAKRYIRYRFTRNLARASNTTDNQILSLIECNNEEVKQENSNKNPTVNSVQRDYMAGEVSKDLTKRILLPEDIVKAHEEGLIHFHDADYFAQHMHNCDLVNLEDMLQNGTVISGTMIEKPHSFSTACNIATQIIAQVASNQYGGQSISLAHLAPFVQISREKITRQVRAEMEEFGIAADDEQVKSLVEKRVRDEIKRGVQTIQYQVVTLLTTNGQAPFVTVFMYLNEAKNEQEKKDLAIIIEEVLKQRIKGTKNEVGVWVTPAFPKLIYVLEEDNITEDSRFWYLTKLAAECTAKRMVPDYISEKIMLKLKIDKNGNGNCYTCMGCRSFLTPYVDENGKPKYYGRFNQGVVTINLVDVACTAARDGNKSEEKFWQVLDERLELCHRALQCRHERLEGTLSDAAPILWQYGALARLKKGEPIDKLLHGGYSTLSLGYAGLWECVYEITGKKLTEKEGEEFGLRVMQRLNDACAEWKAAENIDYSIYGTPLESTTYKFAKCLQNRFGIIKGVTDRNYITNSYHIHVTEKIDAFSKLELESKFQKLSPGGAISYVEVPNMQQNIPAVLEVMKFIYNNIMYAELNTKSDYCQVCGYDGEIQIVEEDGKLVWRCPNCGNEDQSKMNVARRTCGYIGSQFWNQGRTQEIKERVLHL

SEQ ID NO: 852 - protein, 768 aa, unidentified
  REGION 1..768: note = Description of Unknown:uncultivated organism sequence
  REGION 1..768: note = Category: MG60 effectors
  REGION 1..768: note = Description: MG60-61 effector
MFCSCKKNLCVVIYIYDATKTYDCAKKLIVYKSIIKGAEVMKIIKRNGAEETFDRQKIKDAIAKANNETDGTPELTDRQIDYISLVIEDHCNEMNRALSVEEIQELVETHIILQGAPETAKRYIRYRFTRNLARASNTTDNQILSLIECNNEEVKQENSNKNPTVNSVQRDYMAGEVSKDLTKRILLPEDIVKAHEEGLIHFHDADYFAQHMHNCDLVNLEDMLQNGTVISGTMIEKPHSFSTACNIATQIIAQVASNQYGGQSISLAHLAPFVQISREKITRQVRAEMEEFGIDADDEQVKSLVEKRVRDEIKRGVQTIQYQVVTLLTTNGQAPFVTVFMYLNEAKNEQEKKDLAIIIEEVLKQRIKGTKNEVGVWVTPAFPKLIYVLEEDNITEDSRFWYLTKLAAECTAKRMVPDYISEKIMLKLKIDKNGNGNCYTCMGCRSFLTPYVDENGKPKYYGRFNQGVVTINLVDVACTAARDGSKSEEKFWQVLDERLELCHRALQCRHERLEGTLSDAAPILWQYGALARLKKGEPIDKLLHGGYSTLSLGYAGLWECVYEITGKKLTEKEGEEFGLRVMQRLNDACAEWKAAENIDYSIYGTPLESTTYKFAKCLQNRFGIIKGVTDRNYITNSYHIHVTEKIDAFSKLELESKFQKLSPGGAISYVEVPNMQQNIPAVLEVMKFIYNNIMYAELNTKSDYCQVCGYDGEIQIVEEDGKLVWRCPNCGNEDQSKMNVARRTCGYIGSQFWNQGRTQEIKERVLHL

SEQ ID NO: 853 - protein, 768 aa, unidentified
  REGION 1..768: note = Description of Unknown:uncultivated organism sequence
  REGION 1..768: note = Category: MG60 effectors
  REGION 1..768: note = Description: MG60-62 effector
MFCSCKKNLCVVIYIYDATKTYDCAKKSIVYKSIIKGAEVMKIIKRNGAEETFDRQKIKDAIAKANNETDGTPELTDRQIDYISLVIEDHCNEMNRALSVEEIQELVETHIILQGAPETAKRYIRYRFTRNLARASNTTDNQILSLIECNNEEVKQENSNKNPTVNSVQRDYMAGEVSKDLTKRILLPEDIVKAHEEGLIHFHDADYFAQHMHNCDLVNLEDMLQNGTVISGTMIEKPHSFSTACNIATQIIAQVASNQYGGQSISLAHLAPFVQISREKITRQVRAEMEEFGIDADDEQVKSLVEKRVRDEIKRGVQTIQYQVVTLLTTNGQAPFVTVFMYLNEAKNEQEKKDLAIIIEEVLKQRIKGTKNEVGVWVTPAFPKLIYVLEEDNITEDSRFWYLTKLAAECTAKRMVPDYISEKIMLKLKIDKNGNGNCYTCMGCRSFLTPYVDENGKPKYYGRFNQGVVTINLVDVACTAARDGSKSEEKFWQVLDERLELCHRALQCRHERLEGTLSDAAPILWQYGALARLKKGEPIDKLLHGGYSTLSLGYAGLWECVYEITGKKLTEKEGEEFGLRVMQRLNDACAEWKAAENIDYSIYGTPLESTTYKFAKCLQNRFGIIKGVTDRNYITNSYHIHVTEKIDAFSKLELESKFQKLSPGGAISYVEVPNMQQNIPAVLEVMKFIYNNIMYAELNTKSDYCQVCGYDGEIQIVEEDGKLVWRCPNCGNEDQSKMNVARRTCGYIGSQFWNQGRTQEIKERVLHL

SEQ ID NO: 854 - protein, 768 aa, unidentified
  REGION 1..768: note = Description of Unknown:uncultivated organism sequence
  REGION 1..768: note = Category: MG60 effectors
  REGION 1..768: note = Description: MG60-63 effector
MFCSCKKNLCVVIYIYDATKTYDCAKKLIVYKSIIKGAEVMKIIKRNGAEETFDRQKIKDAIAKANNETDGAPELTDRQIDYISLVIEDHCNEMNRALSVEEIQELVETHIILQGAPETAKRYIRYRFTRNLARASNTTDNQILSLIECNNEEVKQENSNKNPTVNSVQRDYMAGEVSKDLTKRILLPEDIVKAHEEGLIHFHDADYFAQHMHNCDLVNLEDMLQNGTVISGTMIEKPHSFSTACNIATQIIAQVASNQYGGQSISLAHLAPFVQISREKITRQVRAEMEEFGIDADDEQVKNLVEKRVRDEIKRGVQTIQYQVVTLLTTNGQAPFVTVFMYLNEAKNEQEKKDLAIIIEEVLKQRIKGTKNEVGVWVTPAFPKLIYVLEEDNITEDSRFWYLTKLAAECTAKRMVPDYISEKIMLKLKIDKNGNGNCYTCMGCRSFLTPYVDENGKPKYYGRFNQGVVTINLVDVACTAARDGSKSEEKFWQVLDERLELCHRALQCRHERLEGTLSDAAPILWQYGALARLKKGEPIDKLLHGGYSTLSLGYAGLWECVYEITGKKLTEKEGEEFGLRVMQRLNDACAEWKAAENIDYSIYGTPLESTTYKFAKCLQNRFGIIKGVTDRNYITNSYHIHVTEKIDAFSKLELESKFQKLSPGGAISYVEVPNMQQNIPAVLEVMKFIYNNIMYAELNTKSDYCQVCGYDGEIQIVEEDGKLVWRCPNCGNEDQSKMNVARRTCGYIGSQFWNQGRTQEIKERVLHL

SEQ ID NO: 855 - protein, 760 aa, unidentified
  REGION 1..760: note = Description of Unknown:uncultivated organism sequence
  REGION 1..760: note = Category: MG60 effectors
  REGION 1..760: note = Description: MG60-64 effector
MLVVIYIYNATKTYDCAKKLIVYKSIIKGAEVMKIIKRNGAEETFDRQKIKDAIAKANNETDGTPELTDRQIDYISLVIEDHCNEMNRALSVEEIQELVETHIILQGAPETAKRYIRYRFTRNLARASNTTDNQILSLIECNNEEVKQENSNKNPTVNSVQRDYMAGEVSKDLTKRILLPEDIVKAHEEGLIHFHDADYFAQHMHNCDLVNLEDMLQNGTVISGTMIEKPHSFSTACNIATQIIAQVASNQYGGQSISLAHLAPFVQISREKITRQVRAEMEEFGIAADDEQVKSLVEKRVRDEIKRGVQTIQYQVVTLLTTNGQAPFVTVFMYLNEAKNEQEKKDLAIIIEEVLKQRIKGTKNEVGVWVTPAFPKLIYVLEEDNITEDSRFWYLTKLAAECTAKRMVPDYISEKIMLKLKIDKNGNGNCYTCMGCRSFLTPYVDENGKPKYYGRFNQGVVTINLVDVACTAARDGNKSEEKFWQVLDERLELCHRALQCRHERLEGTLSDAAPILWQYGALARLKKGEPIDKLLHGGYSTLSLGYAGLWECVYEITGKKLTEKEGEEFGLRVMQRLNDACAEWKAAENIDYSIYGTPLESTTYKFAKCLQNRFGIIKGVTDRNYITNSYHIHVTEKIDAFSKLELESKFQKLSPGGAISYVEVPNMQQNIPAVLEVMKFIYNNIMYAELNTKSDYCQVCGYDGEIQIVEEDGKLVWRCPNCGNEDQSKMNVARRTCGYIGSQFWNQGRTQEIKERVLHL

SEQ ID NO: 856 - protein, 768 aa, unidentified
  REGION 1..768: note = Description of Unknown:uncultivated organism sequence
  REGION 1..768: note = Category: MG60 effectors
  REGION 1..768: note = Description: MG60-65 effector
MFCSCKKNLCVVIYIYDATKTYDCAKKLIVYKSIIKGAEVMKIIKRNGAEETFDRQKIKDAISKANNETDGTPELTDRQIDYISLVIEDHCNEMNRALSVEEIQELVETHIILQGAPETAKRYIRYRFTRNLARASNTTDNQILSLIECNNEEVKQENSNKNPTVNSVQRDYMAGEVSKDLTKRILLPEDIVKAHEEGLIHFHDADYFAQHMHNCDLVNLEDMLQNGTVISGTMIEKPHSFSTACNIATQIIAQVASNQYGGQSISLAHLAPFVQISREKITRQVRAEMEEFGIDADDEQVKSLVEKRVRDEIKRGVQTIQYQVVTLLTTNGQAPFVTVFMYLNEAKNEQEKKDLAIIIEEVLKQRIKGTKNEVGVWVTPAFPKLIYVLEEDNITEDSRFWYLTKLAAECTAKRMVPDYISEKIMLKLKIDKNGNGNCYTCMGCRSFLTPYVDENGKPKYYGRFNQGVVTINLVDVACTAARDGNKSEEKFWQVLDERLELCHRALQCRHERLEGTLSDAAPILWQYGALARLKKGEPIDKLLHGGYSTLSLGYAGLWECVYEITGKKLTEKEGEEFGLRVMQRLNDACAEWKAAENIDYSIYGTPLESTTYKFAKCLQNRFGIIKGVTDRNYITNSYHIHVTEKIDAFSKLELESKFQKLSPGGAISYVEVPNMQQNIPAVLEVMKFIYNNIMYAELNTKSDYCQVCGYDGEIQIVEEDGKLVWRCPNCGNEDQSKMNVARRTCGYIGSQFWNQGRTQEIKERVLHL

SEQ ID NO: 857 - protein, 769 aa, unidentified
  REGION 1..769: note = Description of Unknown:uncultivated organism sequence
  REGION 1..769: note = Category: MG60 effectors
  REGION 1..769: note = Description: MG60-66 effector
MKVIKRDGTIVEYDREKIRIAIEKANKEVSRKEKATDSEIEEIMSYIEDLKKGRILVEDIQDIIEEKLMEIKRYELAKKYITYRYTRALVRKANTTDQSIKELIEGESEYWNNENANKNARVVTTQRDYLAGITSTDITRRFLLPEDVVKAHDEGIIHFHDADYFAQNALTNCELINLEDMLQNGTIMNGVMIEKPHRFITACTIATQIILAVTSSTYGGATVSLAHLAPFVRSSYEKYYKKYKENGLSKEQCEKFAKEDTKKEVADGVQTFNYQVNSMTNTNGQAPFLSVCMYLGETDEYKEELAMIIEEFLNQRILGFKNEKGVYITPAFPKLLYVLEEDNIHENSKYWYLTELAAKCTAKRMVPDYISEKIMKQMKVDANGDGQCYPCMGCRSFLTPYIDPVTKKPKYYGRFNQGVVTINLVDVALSSGKDLKKFWKIYDERLELCHKALQARHERLAKATSDIAPILWQHGAFARLPKGASIHPLLHGGYSTISLGYAGLYECVKYMTGKSHTDNGDGKDFAIEVMKKMNEKCAEWKEAEDIDYSVYGTPIESTTYKFAKCLQKRFGKIKGITDKNYITNSYHVPVFEEIDAFSKLKLESEFQRLSPGGAISYVETPNLQNNLEVVLQIMKFIYDNIMYAELNTKSDYCQKCGYTGEILIDDNLEWYCPNCGNRDHNTLNVARRTCGYIGSNFWNKGRTQEIKERVLHIDNKDDDCDCDECNCDHANTDTSKEEKSEEKQMNFMDYDVEEEITKSKKHMKQPAMV

SEQ ID NO: 858 - protein, 768 aa, unidentified
  REGION 1..768: note = Description of Unknown:uncultivated organism sequence
  REGION 1..768: note = Category: MG60 effectors
  REGION 1..768: note = Description: MG60-67 effector
MFCSCKKNLCVVIYIYDATKTYDCAKKLIVYKSIIKGAEVMKIIKRNGAEETFDRQKIKDAIAKANNETDGTPELTDRQIDYISLVIEDHCNEMNRALSVEEIQELVETHIILQGAPETAKRYIRYRFTRNLARASNTTDNQILSLIECNNEEVKQENSNKNPTVNSVQRDYMAGEVSKDLTKRILLPEDIVKAHEEGLIHFHDADYFAQHMHNCDLVNLEDMLQNGTVISGTMIEKPHSFSTACNIATQIIAQVASNQYGGQSISLAHLAPFVQISREKITRQVRAEMEEFGIDADDEQVKSLVEKRVRDEIKRGVQTIQYQVVTLLTTNGQAPFVTVFMYLNEAKNEQEKKDLAIIIEEVLKQRIKGTKNEVGVWVTPAFPKLIYVLEEDNITEDSRFWYLTKLAAECTAKRMVPDYISEKIMLKLKIDKNGNGNCYTCMGCRSFLTPYVDENGKPKYYGRFNQGVVTINLVDVACTAARDGNKSEEKFWQVLDERLELCHRALQCRHERLEGTLSDAAPILWQYGALARLKKGEPIDKLLHGGYSTLSLGYAGLWECVYEIKGKKLTEKEGEEFGLRVMQRLNDACAEWKAAENIDYSIYGTPLESTTYKFAKCLQNRFGIIKGVTDRNYITNSYHIHVTEKIDAFSKLELESKFQKLSPGGAISYVEVPNMQQNIPAVLEVMKFIYNNIMYAELNTKSDYCQVCGYDGEIQIVEEDGKLVWRCPNCGNEDQSKMNVARRTCGYIGSQFWNQGRTQEIKERVLHL

SEQ ID NO: 859 - protein, 768 aa, unidentified
  REGION 1..768: note = Description of Unknown:uncultivated organism sequence
  REGION 1..768: note = Category: MG60 effectors
  REGION 1..768: note = Description: MG60-68 effector
MFCSCKKNLCVVIYIYNATKTYDCAKKLIVYKSIIKGAEVMKIIKRNGAEETFDRQKIKDAIAKANNETDGTPELTDRQIDYISLVIEDHCNEMNRALSVEEIQELVETHIILQGAPETAKRYIRYRFTRNLARASNTTDNQILSLIECNNEEVKQENSNKNPTVNSVQRDYMAGEVSKDLTKRILLPEDIVKAHEEGLIHFHDADYFAQHMHNCDLVNLEDMLQNGTVISGTMIEKPHSFSTACNIATQIIAQVASNQYGGQSISLAHLAPFVQISREKITRQVRAEMEEFGIAADDEQVKSLVEKRVRDEIKRGVQTIQYQVVTLLTTNGQAPFVTVFMYLNEAKNEQEKKDLAIIIEEVLKQRIKGTKNEVGVWVTPAFPKLIYVLEEDNITEDSRFWYLTKLAAECTAKRMVPDYISEKIMLKLKIDKNGNGNCYTCMGCRSFLTPYVDENGKPKYYGRFNQGVVTINLVDVACTAARDGNKSEEKFWQVLDERLELCHRALQCRHERLEGTLSDAAPILWQYGALARLKKGEPIDKLLHGGYSTLSLGYAGLWECVYEITGKKLTEKEGEEFGLRVMQRLNDACAEWKAAENIDYSIYGTPLESTTYKFAKCLQNRFGIIKGVTDRNYITNSYHIHVTEKIDAFSKLELESKFQKLSPGGAISYVEVPNMQQNIPAVLEVMKFIYNNIMYAELNTKSDYCQVCGYDGEIQIVEEDGKLVWRCPNCGNEDQSKMNVARRTCGYIGSQFWNQGRTQEIKERVLHL

SEQ ID NO: 860 - protein, 768 aa, unidentified
  REGION 1..768: note = Description of Unknown:uncultivated organism sequence
  REGION 1..768: note = Category: MG60 effectors
  REGION 1..768: note = Description: MG60-69 effector
MFCSCKKNLCVVIYIYDATKTYDCAKKLIVYKSIIKGAEVMKIIKRNGAEETFDRQKIKDAIAKANNETDGTPELTDRQIDYISLVIEDHCNEMNRALSVEEIQELVETHIILQGAPETAKRYIRYRFTRNLARASNTTDNQILSLIECNNEEVKQENSNKNPTVNSVQRDYMAGEVSKDLTKRILLPEDIVKAHEEGLIHFHDADYFAQHMHNCDLVNLEDMLQNGTVISGTMIEKPHSFSTACNIATQIIAQVASNQYGGQSISLAHLAPFVQISREKITRQVRAEMEEFGIAADDEQVKSLVEKRVRDEIKRGVQTIQYQVVTLLTTNGQAPFVTVFMYLNEAKNEQEKKDLAIIIEEVLKQRIKGTKNEVGVWVTPAFPKLIYVLEEDNITEDSRFWYLTKLAAECTAKRMVPDYISEKIMLKLKVDKNGNGNCYTCMGCRSFLTPYVDENGKPKYYGRFNQGVVTINLVDVACTAARDGSKSEEKFWQVLDERLELCHRALQCRHERLEGTLSDAAPILWQYGALARLKKGEPIDKLLHGGYSTLSLGYAGLWECVYEITGKKLTEKEGEEFGLRVMQRLNDACAEWKAAENIDYSIYGTPLESTTYKFAKCLQNRFGIIKGVTDRNYITNSYHIHVTEKIDAFSKLELESKFQKLSPGGAISYVEVPNMQQNIPAVLEVMKFIYNNIMYAELNTKSDYCQVCGYDGEIQIVEEDGKLVWRCPNCGNEDQSKMNVARRTCGYIGSQFWNQGRTQEIKERVLHL

SEQ ID NO: 861 - protein, 768 aa, unidentified
  REGION 1..768: note = Description of Unknown:uncultivated organism sequence
  REGION 1..768: note = Category: MG60 effectors
  REGION 1..768: note = Description: MG60-70 effector
MFCSCKKKLCVVIYIYNATKTYDCAKKLIVYKSIIKGAEVMKIIKRNGAEETFDRQKIKDAIAKANNETDGTPELTDRQIDYISLVIEDHCNEMNRALSVEEIQELVETHIILQGAPETAKRYIRYRFTRNLARASNTTDNQILSLIECNNEEVKQENSNKNPTVNSVQRDYMAGEVSKDLTKRILLPEDIVKAHEEGLIHFHDADYFAQHMHNCDLVNLEDMLQNGTVISGTMIEKPHSFSTACNIATQIIAQVASNQYGGQSISLAHLAPFVQISREKITRQVRAEMEEFGIDADDEQVKSLVEKRVRDEIKRGVQTIQYQVVTLLTTNGQAPFVTVFMYLNEAKNEQEKKDLAIIIEEVLKQRIKGTKNEVGVWVTPAFPKLIYVLEEDNITEDSRFWYLTKLAAECTAKRMVPDYISEKIMLKLKIDKNGNGNCYTCMGCRSFLTPYVDENGKPKYYGRFNQGVVTINLVDVACTAARDGSKSEEKFWQVLDERLELCHRALQCRHERLEGTLSDAAPILWQYGALARLKKGEPIDKLLHGGYSTLSLGYAGLWECVYEITGKKLTEKEGEEFGLRVMQRLNDACAEWKAAENIDYSIYGTPLESTTYKFAKCLQNRFGIIKGVTDRNYITNSYHIHVTEKIDAFSKLELESKFQKLSPGGAISYVEVPNMQQNIPAVLEVMKFIYNNIMYAELNTKSDYCQVCGYDGEIQIVEEDGKLVWRCPNCGNEDQSKMNVARRTCGYIGSQFWNQGRTQEIKERVLHL

SEQ ID NO: 862 - protein, 768 aa, unidentified
  REGION 1..768: note = Description of Unknown:uncultivated organism sequence
  REGION 1..768: note = Category: MG60 effectors
  REGION 1..768: note = Description: MG60-71 effector
MFCSCKKNLRVVIYIYNATKTYDCAKKLIVYKSIIKGAEVMKIIKRNGAEETFDRQKIKDAIAKANNETDGTPELTDRQIDYISLVIEDHCNEMNRALSVEEIQELVETHIILQGAPETAKRYIRYRFTRNLARASNTTDNQILSLIECNNEEVKQENSNKNPTVNSVQRDYMAGEVSKDLTKRILLPEDIVKAHEEGLIHFHDADYFAQHMHNCDLVNLEDMLQNGTVISGTMIEKPHSFSTACNIATQIIAQVASNQYGGQSISLAHLAPFVQISREKITRQVRAEMEEFGIAADDEQVKSLVEKRVRDEIKRGVQTIQYQVVTLLTTNGQAPFVTVFMYLNEAKNEQEKKDLAIIIEEVLKQRIKGTKNEVGVWVTPAFPKLIYVLEEDNITEDSRFWYLTKLAAECTAKRMVPDYISEKIMLELKIDKNGNGNCYTCMGCRSFLTPYVDENGKPKYYGRFNQGVVTINLVDVACTAARDGNKSEEKFWQVLDERLELCHRALQCRHERLEGTLSDAAPILWQYGALARLKKGEPIDKLLHGGYSTLSLGYAGLWECVYEITGKKLTEKEGEEFGLRVMQRLNDACAEWKAAENIDYSIYGTPLESTTYKFAKCLQNRFGIIKGVTDRNYITNSYHIHVTEKIDAFSKLELESKFQKLSPGGAISYVEVPNMQQNIPAVLEVMKFIYNNIMYAELNTKSDYCQVCGYDGEIQIVEEDGKLVWRCPNCGNEDQSKMNVARRTCGYIGSQFWNQGRTQEIKERVLHL

SEQ ID NO: 863 - protein, 768 aa, unidentified
  REGION 1..768: note = Description of Unknown:uncultivated organism sequence
  REGION 1..768: note = Category: MG60 effectors
  REGION 1..768: note = Description: MG60-72 effector
MFCSCKKNLCVVIYIYDATKTYDCAKKLIVYKSIIKGAEVMKIIKRNGAEETFDRQKIKDAIAKANNETDGTPELTDRQIDYISLVIEDHCNEMNRALSVEEIQELVETHIILQGAPETAKRYIRYRFTRNLARASNTTDNQILSLIECNNEEVKQENSNKNPTVNSVQRDYMAGEVSKDLTKRILLPEDIVKAHEEGLIHFHDADYFAQHMHNCDLVNLEDMLQNGTVISGTMIEKPHSFSTACNIATQIIAQVASNQYGGQSISLAHLAPFVQISREKITRQVRAEMEEFGIAADDEQVKSLVEKRVRDEIKRGVQTIQYQVVTLLTTNGQAPFVTVFMYLNEAKNEQEKKDLAIIIEEVLKQRIKGTKNEVGVWVTPAFPKLIYVLEEDNITEDSRFWYLTKLAAECTAKRMVPDYISEKIMLKLKIDKNGNGNCYTCMGCRSFLTPYVDENGKPKYYGRFNQGVVTINLVDVACTAARDGNKSEEKFWQVLDERLELCHRALQCRHERLEGTLSDAAPILWQYGALARLKKGEPIDKLLHGGYSTLSLGYAGLWECVYEITGKKLTEKEGEEFGLRVMQRLNDACAEWKAAENIDYSIYGTPLESTTYKFAKCLQNRFGIIKGVTDRNYITNSYHIHVTEKIDAFSKLELESKFQKLSPGGAISYVEVPNMQQNIPAVLEVMKFIYNNIMYAELNTKSDYCQVCGYDGEIQIVEEDGKLVWRCPNCGNEDQSKMNVARRTCGYIGSQFWNQGRTQEIKERVLHL

SEQ ID NO: 864 - protein, 768 aa, unidentified
  REGION 1..768: note = Description of Unknown:uncultivated organism sequence
  REGION 1..768: note = Category: MG60 effectors
  REGION 1..768: note = Description: MG60-73 effector
MFCSCKKNLCVVIYIYNATKTYDCAKKLIVYKSIIKGAEVMKIIKRNGAEETFDRQKIKDAIAKANNETDGTPELTDRQIDYISLVIEDHCNEMNRALSVEEIQELVETHIILQGAPETAKRYIRYRFTRNLARASNTTDNQILSLIECNNEEVKQENSNKNPTVNSVQRDYMAGEVSKDLTKRILLPEDIVKAHEEGLIHFHDADYFAQHMHNCDLVNLEDMLQNGTVISGTMIEKPHSFSTACNIATQIIAQVASNQYGGQSISLAHLAPFVQISREKITRQVRAEMEEFGIDADDEQVKSLVEKRVRDEIKRGVQTIQYQVVTLLTTNGQAPFVTVFMYLNEAKNEQEKKDLAIIIEEVLKQRIKGTKNEVGVWVTPAFPKLIYVLEEDNITEDSRFWYLTKLAAECTAKRMVPDYISEKIMLKLKIDKNGNGNCYTCMGCRSFLTPYVDENGNPKYYGRFNQGVVTINLVDVACTAARDGSKSEEKFWQVLDERLELCHRALQCRHERLEGTLSDAAPILWQYGALARLKKGEPIDKLLHGGYSTLSLGYAGLWECVYEITGKKLTEKEGEEFGLRVMQRLNDACAEWKAAENIDYSIYGTPLESTTYKFAKCLQNRFGIIKGVTDRNYITNSYHIHVTEKIDAFSKLELESKFQKLSPGGAISYVEVPNMQQNIPAVLEVMKFIYNNIMYAELNTKSDYCQVCGYDGEIQIVEEDGKLVWRCPNCGNEDQSKMNVARRTCGYIGSQFWNQGRTQEIKERVLHL

SEQ ID NO: 865 - protein, 768 aa, unidentified
  REGION 1..768: note = Description of Unknown:uncultivated organism sequence
  REGION 1..768: note = Category: MG60 effectors
  REGION 1..768: note = Description: MG60-74 effector
MFCSCKKNLCVVIYIYNATKTYDCAKKIIVYKSIIKGAEVMKIIKRNGAEETFDRQKIKDAISKANNETDGTPELTDRQIDYISLVIEDHCNEMNRALSVEEIQELVETHIILQGAPETAKRYIRYRFTRNLARASNTTDNQILSLIECNNEEVKQENSNKNPTVNSVQRDYMAGEVSKDLTKRILLPEDIVKAHEEGLIHFHDADYFAQHMHNCDLVNLEDMLQNGTVISGTMIEKPHSFSTACNIATQIIAQVASNQYGGQSISLAHLAPFVQISREKITRQVRAEMEEFGIAADDEQVKSLVEKRVRDEIKRGVQTIQYQVVTLLTTNGQAPFVTVFMYLNEAKNEQEKKDLAIIIEEVLKQRIKGTKNEVGVWVTPAFPKLIYVLEEDNITEDSRFWYLTKLAAECTAKRMVPDYISEKIMLKLKIDKNGNGNCYTCMGCRSFLTPYVDENGKPKYYGRFNQGVVTINLVDVACTAARDGNKSEEKFWQVLDERLELCHRALQCRHERLEGTLSDAAPILWQYGALARLKKGEPIDKLLHGGYSTLSLGYAGLWECVYEITGKKLTEKEGEEFGLRVMQRLNDACAEWKAAENIDYSIYGTPLESTTYKFAKCLQNRFGIIKGVTDRNYITNSYHIHVTEKIDAFSKLELESKFQKLSPGGAISYVEVPNMQQNIPAVLEVMKFIYNNIMYAELNTKSDYCQVCGYDGEIQIVEEDGKLVWRCPNCGNEDQSKMNVARRTCGYIGSQFWNQGRTQEIKERVLHL

SEQ ID NO: 866 - protein, 768 aa, unidentified
  REGION 1..768: note = Description of Unknown:uncultivated organism sequence
  REGION 1..768: note = Category: MG60 effectors
  REGION 1..768: note = Description: MG60-75 effector
MFCSCKKKLCVVIYIYDATKTYDCAKKSIVYKSIIKGAEVMKIIKRNGAEETFDRQKIKDAIAKANNETDGTPELTDRQIDYISLVIEDHCNEMNRALSVEEIQELVETHIILQGAPETAKRYIRYRFTRNLARASNTTDNQILSLIECNNEEVKQENSNKNPTVNSVQRDYMAGEVSKDLTKRILLPEDIVKAHEEGLIHFHDADYFAQHMHNCDLVNLEDMLQNGTVISGTMIEKPHSFSTACNIATQIIAQVASNQYGGQSISLAHLAPFVQISREKITRQVRAEMEEFGIDADDEQVKSLVEKRVRDEIKRGVQTIQYQVVTLLTTNGQAPFVTVFMYLNEAKNEQEKKDLAIIIEEVLKQRIKGTKNEVGVWVTPAFPKLIYVLEEDNITEDSRFWYLTKLAAECTAKRMVPDYISEKIMLKLKIDKNGNGNCYTCMGCRSFLTPYVDENGKPKYYGRFNQGVVTINLVDVACTAARDGNKSEEKFWQVLDERLELCHRALQCRHERLEGTLSDAAPILWQYGALARLKKGEPIDKLLHGGYSTLSLGYAGLWECVYEITGKKLTEKEGEEFGLRVMQRLNDACAEWKAAENIDYSIYGTPLESTTYKFAKCLQNRFGIIKGVTDRNYITNSYHIHVTEKIDAFSKLELESKFQKLSPGGAISYVEVPNMQQNIPAVLEVMKFIYNNIMYAELNTKSDYCQVCGYDGEIQIVEEDGKLVWRCPNCGNEDQSKMNVARRTCGYIGSQFWNQGRTQEIKERVLHL

SEQ ID NO: 867 - protein, 768 aa, unidentified
  REGION 1..768: note = Description of Unknown:uncultivated organism sequence
  REGION 1..768: note = Category: MG60 effectors
  REGION 1..768: note = Description: MG60-76 effector
MFCSCKKNLRVVIYICNAIKTYDRAKKLIVYKSIVKGVEVMKIIKRNGAEETFDRQKIKDAIAKANNETDGTPELTDRQIDYISLVIEDHCNEMNRALSVEEIQELVETHIILQGAPETAKRYIRYRFTRNLARASNTTDNQILSLIECNNEEVKQENSNKNPTVNSVQRDYMAGEVSKDLTKRILLPEDIVKAHEEGLIHFHDADYFAQHMHNCDLVNLEDMLQNGTVISGTMIEKPHSFSTACNIATQIIAQVASNQYGGQSISLAHLAPFVQISREKITRQVRAEMEEFGIAADDEQVKSLVEKRVRDEIKRGVQTIQYQVVTLLTTNGQAPFVTVFMYLNEAKNEQEKKDLAIIIEEVLKQRIKGTKNEVGVWVTPAFPKLIYVLEEDNITEDSRFWYLTKLAAECTAKRMVPDYISEKIMLKLKIDKNGNGNCYTCMGCRSFLTPYVDENGKPKYYGRFNQGVVTINLVDVACTAARDGNKSEEKFWQVLDERLELCHRALQCRHERLEGTLSDAAPILWQYGALARLKKGEPIDKLLHGGYSTLSLGYAGLWECVYEITGKKLTEKEGEEFGLRVMQRLNDACAEWKAAENIDYSIYGTPLESTTYKFAKCLQNRFGIIKGVTDRNYITNSYHIHVTEKIDAFSKLELESKFQKLSPGGAISYVEVPNMQQNIPAVLEVMKFIYNNIMYAELNTKSDYCQVCGYDGEIQIVEEDGKLVWRCPNCGNEDQSKMNVARRTCGYIGSQFWNQGRTQEIKERVLHL

SEQ ID NO: 868 - protein, 768 aa, unidentified
  REGION 1..768: note = Description of Unknown:uncultivated organism sequence
  REGION 1..768: note = Category: MG60 effectors
  REGION 1..768: note = Description: MG60-77 effector
MFCSCKKKLCVVIYIYDATKTYDCAKKLIVYKSIIKGAEVMKIIKRNGAEETFDRQKIKDAISKANNETDGTPELTDRQIDYISLVIEDHCNEMNRALSVEEIQELVETHIILQGAPETAKRYIRYRFTRNLARASNTTDNQILSLIECNNEEVKQENSNKNPTVNSVQRDYMAGEVSKDLTKRILLPEDIVKAHEEGLIHFHDADYFAQHMHNCDLVNLEDMLQNGTVISGTMIEKPHSFSTACNIATQIIAQVASNQYGGQSISLAHLAPFVQISREKITRQVRAEMEEFGIDADDEQVKSLVEKRVRDEIKRGVQTIQYQVVTLLTTNGQAPFVTVFMYLNEAKNEQEKKDLAIIIEEVLKQRIKGTKNEVGVWVTPAFPKLIYVLEEDNITEDSRFWYLTKLAAECTAKRMVPDYISEKIMLKLKIDKNGNGNCYTCMGCRSFLTPYVDENGKPKYYGRFNQGVVTINLVDVACTAARDGSKSEEKFWQVLDERLELCHRALQCRHERLEGTLSDAAPILWQYGALARLKKGEPIDKLLHGGYSTLSLGYAGLWECVYEITGKKLTEKEGEEFGLRVMQRLNDACAEWKAAENIDYSIYGTPLESTTYKFAKCLQNRFGIIKGVTDRNYITNSYHIHVTEKIDAFSKLELESKFQKLSPGGAISYVEVPNMQQNIPAVLEVMKFIYNNIMYAELNTKSDYCQVCGYDGEIQIVEEDGKLVWRCPNCGNEDQSKMNVARRTCGYIGSQFWNQGRTQEIKERVLHL

SEQ ID NO: 869 - protein, 768 aa, unidentified
  REGION 1..768: note = Description of Unknown:uncultivated organism sequence
  REGION 1..768: note = Category: MG60 effectors
  REGION 1..768: note = Description: MG60-78 effector
MFCSCKKNLCVVIYIYNATKTYDCAKKLIVYKSIIKGAEVMKIIKRNGAEETFDRQKIKDAIAKANNETDGTPELTDRQIDYISLVIEDHCNEMNRALSVEEIQELVETHIILQGAPETAKRYIRYRFTRNLARASNTTDNQILSLIECNNEEVKQENSNKNPTVNSVQRDYMAGEVSKDLTKRILLPEDIVKAHEEGLIHFHDADYFAQHMHNCDLVNLEDMLQNGTVISGTMIEKPHSFSTACNIATQIIAQVASNQYGGQSISLAHLAPFVQISREKITRQVRAEMEEFGIDADDEQVKSLVEKRVRDEIKRGVQTIQYQVVTLLTTNGQAPFVTVFMYLNEAKNEQEKKDLAIIIEEVLKQRIKGTKNEVGVWVTPAFPKLIYVLEEDNITEDSRFWYLTKLAAECTAKRMVPDYISEKIMLKLKIDKNGNGNCYTCMGCRSFLTPYVDENGKPKYYGRFNQGVVTINLVDVACTAARDGNKSEEKFWQVLDERLELCHRALQCRHERLEGTLSDAAPILWQYGALARLKKGEPIDKLLHGGYSTLSLGYAGLWECVYEITGKKLTEKEGEEFGLRVMQRLNDACAEWKAAENIDYSIYGTPLESTTYKFAKCLQNRFGIIKGVTDRNYITNSYHIHVTEKIDAFSKLELESKFQKLSPGGAISYVEVPNMQQNIPAVLEVMKFIYNNIMYAELNTKSDYCQVCGYDGEIQIVEEDGKLVWRCPNCGNEDQSKMNVARRTCGYIGSQFWNQGRTQEIKERVLHL

SEQ ID NO: 870 - protein, 763 aa, unidentified
  REGION 1..763: note = Description of Unknown:uncultivated organism sequence
  REGION 1..763: note = Category: MG60 effectors
  REGION 1..763: note = Description: MG60-79 effector
MKTIQQLYSIFVAFATVFLKNKYIIRTYKSNKKYLIDIRKMALLKDLYTRKEWGKMKVIKRDGRTIEFDREKIEVAIEKANKEVRGKEKATKDEINEIIAYIEDLGKKRMLVEDIQDVIEEKLMELDKYELAKKYIVYRYTRALVRKSNTTDESILGLIKNENKELAEENSNKNTMLASTQRDYIAGEVSRDLTKRILLPEKISKAHEEGILHFHDADYFVQPIFNCCLINIGDMLDNGTAMNGKMIETPKSFQVACTVTTQIIAAVASNQYGGQSVDLKHLGKYLRRSHDKFQKRLTEKYGGKLPKQTIDDMIRDRVKEELAAGVQTIQYQINTLMTTNGQSPFVTLFLHLEPDDEYIKENAMIIEEVLKQRIQGIKNEVGVYVTPAFPKLVYVLDEHNCLKGGKYDYLTRLAVKCSAKRMYPDYISAKKMKENYEGNVFSPMGCRSFLVPWKDENGNYKFEGRFNQGVVSINLPQIAIIAQGDEDKFWKLFDERLELCREALMCRHYALLGTSSDISPIHWQNGAIARLKKGEKIDKYLKDGYSTLSLGYIGIYETTKLIKGVSHTTPEGHDFAIKIMKYLKDRTNLWRKETGLGFSLYGTPAESLCYRFARIDKEKFGSIPDVTDKGYYTNSYHVDVREKIDAFHKLKFESEFQPLSAGGAISYIEVPNMKNNLTALEEVVKFIYDNIQYAEFNTKSDYCQVCGYDGEMIINDQNEWECPQCGNKDHNKMNVVRRTCGYLGENFWNVGKTKEIKSRVLHL

SEQ ID NO: 871 - protein, 768 aa, unidentified
  REGION 1..768: note = Description of Unknown:uncultivated organism sequence
  REGION 1..768: note = Category: MG60 effectors
  REGION 1..768: note = Description: MG60-80 effector
MFYSCKRNLCVVIYIYNATKTYDCAKKLIVYKSIIKGAEVMKIIKRNGAEETFDRQKIKDAIAKANNETDGTPELTDRQIDYISLVIEDHCNEMNRALSVEEIQELVETHIILQGAPETAKRYIRYRFTRNLARASNTTDNQILSLIECNNEEVKQENSNKNPTVNSVQRDYMAGEVSKDLTKRILLPEDIVKAHEEGLIHFHDADYFAQHMHNCDLVNLEDMLQNGTVISGTMIEKPHSFSTACNIATQIIAQVASNQYGGQSISLAHLAPFVQISREKITRQVRAEMEEFGIDADDEQVKSLVEKRVRDEIKRGVQTIQYQVVTLLTTNGQAPFVTVFMYLNEAKNEQEKKDLAIIIEEVLKQRIKGTKNEVGVWVTPAFPKLIYVLEEDNITEDSRFWYLTKLAAECTAKRMVPDYISEKIMLKLKIDKNGNGNCYTCMGCRSFLTPYVDENGKPKYYGRFNQGVVTINLVDVACTAARDGNKSEEKFWQVLDERLELCHRALQCRHERLEGTLSDAAPILWQYGALARLKKGEPIDKLLHGGYSTLSLGYAGLWECVYEIKGKKLTEKEGEEFGLRVMQRLNDACAEWKAAENIDYSIYGTPLESTTYKFAKCLQNRFGIIKGVTDRNYITNSYHIHVTEKIDAFSKLELESKFQKLSPGGAISYVEVPNMQQNIPAVLEVMKFIYNNIMYAELNTKSDYCQVCGYDGEIQIVEEDGKLVWRCPNCGNEDQSKMNVARRTCGYIGSQFWNQGRTQEIKERVLHL

SEQ ID NO: 872 - protein, 760 aa, unidentified
  REGION 1..760: note = Description of Unknown:uncultivated organism sequence
  REGION 1..760: note = Category: MG60 effectors
  REGION 1..760: note = Description: MG60-81 effector
MCVVIYIYDATKTYDCAKKLFVYKSIIKGAEVMKIIKRNGAEETFDRQKIKDAIAKANNETDGTPELTDRQIDYISLVIEDHCNEMNRALSVEEIQELVETHIILQGAPETAKRYIRYRFTRNLARASNTTDNQILSLIECNNEEVKQENSNKNPTVNSVQRDYMAGEVSKDLTKRILLPEDIVKAHEEGLIHFHDADYFAQHMHNCDLVNLEDMLQNGTVISGTMIEKPHSFSTACNIATQIIAQVASNQYGGQSISLAHLAPFVQISREKITRQVRAEMEEFGIAADDEQVKSLVEKRVRDEIKRGVQTIQYQVVTLLTTNGQAPFVTVFMYLNEAKNEQEKKDLAIIIEEVLKQRIKGTKNEVGVWVTPAFPKLIYVLEEDNITEDSRFWYLTKLAAECTAKRMVPDYISEKIMLELKIDKNGNGNCYTCMGCRSFLTPYVDENGKPKYYGRFNQGVVTINLVDVACTAARDGNKSEEKFWQVLDERLELCHRALQCRHERLEGTLSDAAPILWQYGALARLKKGEPIDKLLHGGYSTLSLGYAGLWECVYEITGKKLTEKEGEEFGLRVMQRLNDACAEWKAAENIDYSIYGTPLESTTYKFAKCLQNRFGIIKGVTDRNYITNSYHIHVTEKIDAFSKLELESKFQKLSPGGAISYVEVPNMQQNIPAVLEVMKFIYNNIMYAELNTKSDYCQVCGYDGEIQIVEEDGKLVWRCPNCGNEDQSKMNVARRTCGYIGSQFWNQGRTQEIKERVLHL

SEQ ID NO: 873 - protein, 763 aa, unidentified
  REGION 1..763: note = Description of Unknown:uncultivated organism sequence
  REGION 1..763: note = Category: MG60 effectors
  REGION 1..763: note = Description: MG60-82 effector
MKIIQQLYSIFVAFATVFLKNKYIIRTYKSNKKYLIDIRKMALLKDLYTRKEWGKMKVIKRDGRTIEFDREKIEVAIEKANKEVRGKEKATKDEINEIIAYIEDLGKKRMLVEDIQDVIEEKLMELDKYELAKKYIVYRYTRALVRKSNTTDESILGLIKNENKELAEENSNKNTMLASTQRDYIAGEVSRDLTKRILLPEKISKAHEEGILHFHDADYFVQPIFNCCLINIGDMLDNGTAMNGKMIETPKSFQVACTVTTQIIAAVASNQYGGQSVDLKHLGKYLRRSHDKFQKRLTEKYGGKLPKQTIDDMIRDRVKEELAAGVQTIQYQINTLMTTNGQSPFVTLFLHLEPDDEYIKENAMIIEEVLKQRIQGIKNEVGVYVTPAFPKLVYVLDEHNCLKGGKYDYLTRLAVKCSAKRMYPDYISAKKMKENYEGNVFSPMGCRSFLVPWKDENGNYKFEGRFNQGVVSINLPQIAIIAQGDEDKFWKLFDERLELCREALMCRHYALLGTSSDISPIHWQNGAIARLKKGEKIDKYLKDGYSTLSLGYIGIYETTKLIKGVSHTTPEGHDFAIKIMKYLKDRTNLWRKETGLGFSLYGTPAESLCYRFARIDKEKFGSIPDVTDKGYYTNSYHVDVREKIDAFHKLKFESEFQPLSAGGAISYIEVPNMKNNLTALEEVVKFIYDNIQYAEFNTKSDYCQVCGYDGEMIINDQNEWECPQCGNKDHNKMNVVRRTCGYLGENFWNVGKTKEIKSRVLHL

SEQ ID NO: 874 - protein, 769 aa, unidentified
  REGION 1..769: note = Description of Unknown:uncultivated organism sequence
  REGION 1..769: note = Category: MG60 effectors
  REGION 1..769: note = Description: MG60-83 effector
MKVIKRDGTIVEYDREKIRIAIEKANKEVSRKEKATDSEIEEIMSYIEDLKKGRILVEDIQDIIEEKLMEIKRYELAKKYITYRYTRALVRKANTTDQSIKELIEGESEYWNNENANKNARVVTTQRDYLAGITSTDITRRFLLPEDVVKAHDEGIIHFHDADYFAQNALTNCELINLEDMLQNGTIMNGVMIEKPHRFITACTIATQIILAVTSSTYGGATVSLAHLAPFVRSSYEKYYKKYKDNGLSKEQCEKFAKEDTKKEVADGVQTFNYQVNSMTNTNGQAPFLSVCMYLGETDEYKEELAMIIEEFLNQRILGFKNEKGVYITPAFPKLLYVLEEDNIHENSKYWYLTELAAKCTAKRMVPDYISEKIMKQMKVDANGDGQCYPCMGCRSFLTPYIDPVTNKPKYYGRFNQGVVTINLVDVALSSGKDLKKFWKIYDERLELCHKALQARHERLAKATSDIAPILWQHGAFARLPKGASIHPLLHGGYSTISLGYAGLYECVKYMTGKSHTDNGDGKDFAIEVMKKMNEKCAEWKDAEDIDYSVYGTPIESTTYKFAKCLQKRFGKIKGITDKNYITNSYHVPVFEEIDAFSKLKLESEFQRLSPGGAISYVETPNLQNNLEVVLQIMKFIYDNIMYAELNTKSDYCQKCGYTGEILIDDNLEWYCPNCGNRDHNTLNVARRTCGYIGSNFWNKGRTQEIKERVLHIDNKDDDCDCDECNCDHANTDTSKEEKSEEKQMNFMDYDVEEEITKSKKHMKQPAMV

SEQ ID NO: 875 - protein, 985 aa, unidentified
  REGION 1..985: note = Description of Unknown:uncultivated organism sequence
  REGION 1..985: note = Category: MG60 effectors
  REGION 1..985: note = Description: MG60-84 effector
MQEFAHKVAEEVMSKNTDMTVEDIQDLVVRRLMASKYKEVAKSYVEYRYLHELIRQSNTTDKTIKELIDGDNEYWNTENSNKNPRVVTTQRDYIAGVTSTDIARRLLLPKDVVTAHDEGIIHFHDMDYFAQKSLHNCFLKSTKFITKEGLRSFEDFNNGDIIEVLSIDGKYHKAVVKQYGVQPLYKYTFYNGKKENTHDVIATENHRWILKDGKETTNLKIGDKLCKAPVIYSQNLDWENLTENEQLMWCKGFGLGDGTKEYGTNSTRIRLCESKDLQYLNRFSISGCNIRNTKFKNEDREVVIYNYRKTIPEFNSIKELQCFINGLYCADGRKKQMVNGKYNFGLQSSSLEVINFLREMADTAGLYITKENERTGEITNFTTEQGRPYTILFSFNSDFDFHYTVLNKEFYGEDEVWCLEVEDTHNFILEYGIPTGNCELVNLEDMLQNGTVINGVKIEKPHRLLTAATISTQIITAVTSSSYGGCTINIAHLAPFVRDSFEYHKKKYLSRGFNEVDAEKYANEDTKKEVTDAVQTFNYQVNSMTNTNGQAPFLSVFMYLNDNPEYIKETAMLIEEFLKQRIVGFKNEVGHYVTPAFPKLLYVLDDNNITEDSKYWDLTVLAAKCTAKRMVPDYISAKIMRRDKVDKNGDGNVYGCMGCRSFLTPYVDLETNKPKYWGRFNQGVVTINLPDIALSSHGDFDEFWKLFNERTELCHKALKCRHERLALATADVAPILWRYGALARLPKGASIHPLLHNGYSTLSLGYAGLYECVKYMTGESHSHGKGFDFGIQVMQALNDKCKEWKADENIDYSLYRSPIETTTYKFAKCLKKRFGEIEGVTDKDYITNSYHINVREEIDPFDKLEIESKYQKLSPRGAISYIECADLTKNIPAVLEVLKFIYDHIMYAELNTKSDYCQVCGYEHEIEIVDEDGKLYWRCPNCGNTDQTKMNVARRTCGYIGSQFWNQGRTQEIKERYVHMDNHEE

SEQ ID NO: 876 - protein, 768 aa, unidentified
  REGION 1..768: note = Description of Unknown:uncultivated organism sequence
  REGION 1..768: note = Category: MG60 effectors
  REGION 1..768: note = Description: MG60-85 effector
MFCSCKNNLCVVIYIYDATKTYDCAKKLIVYKSIIKGAEVMKIIKRNGAEETFDRQKIKDAIAKANNETDGTPELTDRQIDYISLVIEDHCNEMNRALSVEEIQELVETHIILQGAPETAKRYIRYRFTRNLARASNTTDNQILSLIECNNEEVKQENSNKNPTVNSVQRDYMAGEVSKDLTKRILLPEDIVKAHEEGLIHFHDADYFAQHMHNCDLVNLEDMLQNGTVISGTMIEKPHSFSTACNIATQIIAQVASNQYGGQSISLAHLAPFVQISREKITRQVRAEMEEFGIDADDEQVKSLVEKRVRDEIKRGVQTIQYQVVTLLTTNGQAPFVTVFMYLNEAKNEQEKKDLAIIIEEVLKQRIKGTKNEVGVWVTPAFPKLIYVLEEDNITEDSRFWYLTKLAAECTAKRMVPDYISEKIMLKLKIDKNGNGNCYTCMGCRSFLTPYVDENGKPKYYGRFNQGVVTINLVDVACTAARDGSKSEEKFWQVLDERLELCHRALQCRHERLEGTLSDAAPILWQYGALARLKKGEPIDKLLHGGYSTLSLGYAGLWECVYEITGKKLTEKEGEEFGLRVMQRLNDACAEWKAAENIDYSIYGTPLESTTYKFAKCLQNRFGIIKGVTDRNYITNSYHIHVTEKIDAFSKLELESKFQKLSPGGAISYVEVPNMQQNIPAVLEVMKFIYNNIMYAELNTKSDYCQVCGYDGEIQIVEEDGKLVWRCPNCGNEDQSKMNVARRTCGYIGSQFWNQGRTQEIKERVLHL

SEQ ID NO: 877 - protein, 1032 aa, unidentified
  REGION 1..1032: note = Description of Unknown:uncultivated organism sequence
  REGION 1..1032: note = Category: MG60 effectors
  REGION 1..1032: note = Description: MG60-86 effector
MIVTKRDGRQVEFDKDKIVKAISKAFVEVYSTVTDEMSGFANKVATEISSKEADMTVEEIQDIVTKKLMLSRYKDVARRYIEYRYLHHLVRESNTTDKSIKELIDGENDYWNTENSNKNPRIVTTQRDYIAGITSTDIARRFLLPPEIVKAHDEGILHFHDMDYFAQKSLHNCFSGDTKLVTDLGVRSFNSFADGAVIKVKDKNGVWREATVKKYGKQKMFDVTFKTPKSEKTVTCTQNHRWILDTGEVTTNLQVGDKLFPLTDSASNYVPNTLEELRAFCFGFVLGDGCDCSDKGVQVRLCNDKNEYLEYFIKAGYKYYQVTNSNDYVAYNRTEYSKQSFLNNNAWKLLSLNQKIALFHGYYCADGRKNSHSISTTNNRLMAMIEEISALAGYYIGSKFEEHRHSNYVEDFSITTYSFIIEQKAKNWLWTVKEIKPHYNKKYKDNRQGRENSFKTCNPTMDAWCVEEPVTHTFTLSNGMVTGNCELVNLEDMLQNGTVINGVKIDKPHRLLTAATIATQIITAVTSSSYGGCSINLAHLAPFVRDSYEYHKNKYLKRGMNELDAEAFAGQDTDKEVSDAVQTFNYQVNSMTNTNGQAPFLSVFMYINDNMEYRAETVTLIAEFLRQRMIGFKNEVGHYVTPAFPKLLYVLDENNCEPNTEYWWLTKLAAECTAKRMVPDYISAKIMKRDKIDANGNGNVFACMGCRSFLTPYLDSNNKPKYWGRFNQGVVTINLPDVALSSKGDKEKFWQLFDERLELCHKAMQCRHERLALATSDVAPILWQHGALARLPKGASIHPLLHGGYSTLSLGYAGLYECVKYMTGESHSHGKGKEFGLAVMQHLNDKCNEWKEAEDIAYSPYGSPIESTTYKFAKCLKKRFGVIEGITDKDYITNSYHINVREEIDPFSKLAIEAEYQKLSQGGAISYIECADLTNNISAVLEVIKFIYNNIMYAELNTKSDYCQVCGYDGEIEIVDNNGTLSWRCPNCGNTDQTKMNVARRTCGYIGSQFWNQGRTQEIKERYVHLDNHEMK

SEQ ID NO: 878 - protein, 768 aa, unidentified
  REGION 1..768: note = Description of Unknown:uncultivated organism sequence
  REGION 1..768: note = Category: MG60 effectors
  REGION 1..768: note = Description: MG60-87 effector
MFCSCKKNLCVVIYIYNATKTYDCAKKLIVYKSIIKGAEVMKIIKRNGAEETFDRQKIKDAIAKANNETDGTPELTDRQIDYISLVIEDHCNEMNRALSVEEIQELVETHIILQGAPETAKRYIRYRFTRNLARASNTTDNQILSLIECNNEEVKQENSNKNPTVNSVQRDYMAGEVSKDLTKRILLPEDIVKAHEEGLIHFHDADYFAQHMHNCDLVNLEDMLQNGTVISGTMIEKPHSFSTACNIATQIIAQVASNQYGGQSISLAHLAPFVQISREKITRQVRAEMEEFGIDADDEQVKSLVEKRVRDEIKRGVQTIQYQVVTLLTTNGQAPFVTVFMYLNEAKNEQEKKDLAIIIEEVLKQRIKGTKNEVGVWVTPAFPKLIYVLEEDNITEDSRFWYLTKLAAECTAKRMVPDYISEKIMLKLKVDKNGNGNCYTCMGCRSFLTPYVDENGKPKYYGRFNQGVVTINLVDVACTAARDGSKSEEKFWQVLDERLELCHRALQCRHERLEGTLSDAAPILWQYGALARLKKGEPIDKLLHGGYSTLSLGYAGLWECVYEITGKKLTEKEGEEFGLRVMQRLNDACAEWKAAENIDYSIYGTPLESTTYKFAKCLQNRFGIIKGVTDRNYITNSYHIHVTEKIDAFSKLELESKFQKLSPGGAISYVEVPNMQQNIPAVLEVMKFIYNNIMYAELNTKSDYCQVCGYDGEIQIVEEDGKLVWRCPNCGNEDQSKMNVARRTCGYIGSQFWNQGRTQEIKERVLHL

SEQ ID NO: 879 - protein, 768 aa, unidentified
  REGION 1..768: note = Description of Unknown:uncultivated organism sequence
  REGION 1..768: note = Category: MG60 effectors
  REGION 1..768: note = Description: MG60-88 effector
MFCSCKKNLRVVIYIYNATKTYDCAKKSIVYKSIIKGAEVMKIIKRNGAEETFDRQKIKDAIAKANNETDGTPELTDRQIDYISLVIEDHCNEMNRALSVEEIQELVETHIILQGAPETAKRYIRYRFTRNLARASNTTDNQILSLIECNNEEVKQENSNKNPTVNSVQRDYMAGEVSKDLTKRILLPEDIVKAHEEGLIHFHDADYFAQHMHNCDLVNLEDMLQNGTVISGTMIEKPHSFSTACNIATQIIAQVASNQYGGQSISLAHLAPFVQISREKITRQVRAEMEEFGIDADDEQVKSLVEKRVRDEIKRGVQTIQYQVVTLLTTNGQAPFVTVFMYLNEAKNEQEKKDLAIIIEEVLKQRIKGTKNEVGVWVTPAFPKLIYVLEEDNITEDSRFWYLTKLAAECTAKRMVPDYISEKIMLKLKIDKNGNGNCYTCMGCRSFLTPYVDENGKPKYYGRFNQGVVTINLVDVACTAARDGNKSEEKFWQVLDERLELCHRALQCRHERLEGTLSDAAPILWQYGALARLKKGEPIDKLLHGGYSTLSLGYAGLWECVYEIKGKKLTEKEGEEFGLRVMQRLNDACAEWKAAENIDYSIYGTPLESTTYKFAKCLQNRFGIIKGVTDRNYITNSYHIHVTEKIDAFSKLELESKFQKLSPGGAISYVEVPNMQQNIPAVLEVMKFIYNNIMYAELNTKSDYCQVCGYDGEIQIVEEDGKLVWRCPNCGNEDQSKMNVARRTCGYIGSQFWNQGRTQEIKERVLHL

SEQ ID NO: 880 - protein, 768 aa, unidentified
  REGION 1..768: note = Description of Unknown:uncultivated organism sequence
  REGION 1..768: note = Category: MG60 effectors
  REGION 1..768: note = Description: MG60-89 effector
MFCSCKKNLCVVIYIYDATKTYDCAKKLIVYKSIIKGAEVMKIIKRNGAEETFDRQKIKDAIAKANNETDGTPELTDRQIDYISLVIEDHCNEMNRALSVEEIQELVETHIILQGAPETAKRYIRYRFTRNLARASNTTDNQILSLIECNNEEVKQENSNKNPTVNSVQRDYMAGEVSKDLTKRILLPEDIVKAHEEGLIHFHDADYFAQHMHNCDLVNLEDMLQNGTVISGTMIEKPHSFSTACNIATQIIAQVASNQYGGQSISLAHLAPFVQISREKITRQVRAEMEEFGIAADDEQVKSLVEKRVRDEIKRGVQTIQYQVVTLLTTNGQAPFVTVFMYLNEAKNEQEKKDLAIIIEEVLKQRIKGTKNEVGVWVTPAFPKLIYVLEEDNITEDSRFWYLTKLAAECTAKRMVPDYISEKIMLKLKIDKNGNGNCYTCMGCRSFLTPYVDENGKPKYYGRFNQGVVTINLVDVACTAARDGNKSEEKFWQVLDERLELCHRALQCRHERLEGTLSDAAPILWQYGALARLKKGEPIDKLLHGGYSTLSLGYAGLWECVYEITGKKLTEKEGEEFGLRVMQRLNDACAEWKAAENIDYSIYGTPLESTTYKFAKCLQNRFGIIKGVTDRNYITNSYHIHVTEKIDAFSKLELESKFQKLSPGGAISYVEVPDMQQNIPAVLEVMKFIYNNIMYAELNTKSDYCQVCGYDGEIQIVEEDGKLVWRCPNCGNEDQSKMNVARRTCGYIGSQFWNQGRTQEIKERVLHL

SEQ ID NO: 881 - protein, 768 aa, unidentified
  REGION 1..768: note = Description of Unknown:uncultivated organism sequence
  REGION 1..768: note = Category: MG60 effectors
  REGION 1..768: note = Description: MG60-90 effector
MFCSCKKNLCVVIYIYDATKTYDCAKKLIVYKSIIKGAEVMKIIKRNGAEETFDRQKIKDAIAKANNETDGTPELTDRQIDYISLVIEDHCNEMNRALSVEEIQELVETHIILQGAPETAKRYIRYRFTRNLARASNTTDNQILSLIECNNEEVKQENSNKNPTVNSVQRDYMAGEVSKDLTKRILLPEDIVKAHEEGLIHFHDADYFAQHMHNCDLVNLEDMLQNGTVISGTMIEKPHSFSTACNIATQIIAQVASNQYGGQSISLAHLAPFVQISREKITRQVRAEMEEFGIDADDEQVKSLVEKRVRDEIKRGVQTIQYQVVTLLTTNGQAPFVTVFMYLNEAKNEQEKKDLAIIIEEVLKQRIKGTKNEVGVWVTPAFPKLIYVLEEDNITEDSRFWYLTKLAAECTAKRMVPDYISEKIMLKLKVDKNGNGNCYTCMGCRSFLTPYVDENGKPKYYGRFNQGVVTINLVDVACTAARDGSKSEEKFWQVLDERLELCHRALQCRHERLEGTLSDAAPILWQYGALARLKKGEPIDKLLHGGYSTLSLGYAGLWECVYEITGKKLTEKEGEEFGLRVMQRLNDACAEWKAAENIDYSIYGTPLESTTYKFAKCLQNRFGIIKGVTDRNYITNSYHIHVTEKIDAFSKLELESKFQKLSPGGAISYVEVPNMQQNIPAVLEVMKFIYNNIMYAELNTKSDYCQVCGYDGEIQIVEEDGKLVWRCPNCGNEDQSKMNVARRTCGYIGSQFWNQGRTQEIKERVLHL

SEQ ID NO: 882 - protein, 768 aa, unidentified
  REGION 1..768: note = Description of Unknown:uncultivated organism sequence
  REGION 1..768: note = Category: MG60 effectors
  REGION 1..768: note = Description: MG60-91 effector
MFCSCKKNLRVVIYIYNATKTYDCAKKLIVYKSIIKGAEVMKIIKRNGAEETFDRQKIKDAIAKANNETDGTPELTDRQIDYISLVIEDHCNEMNRALSVEEIQELVETHIILQGAPETAKRYIRYRFTRNLARASNTTDNQILSLIECNNEEVKQENSNKNPTVNSVQRDYMAGEVSKDLTKRILLPEDIVKAHEEGLIHFHDADYFAQHMHNCDLVNLEDMLQNGTVISGTMIEKPHSFSTACNIATQIIAQVASNQYGGQSISLAHLAPFVQISREKITRQVRAEMEEFGIDADDEQVKSLVEKRVRDEIKRGVQTIQYQVVTLLTTNGQAPFVTVFMYLNEAKNEQEKKDLAIIIEEVLKQRIKGTKNEVGVWVTPAFPKLIYVLEEDNITEDSRFWYLTKLAAECTAKRMVPDYISEKIMLKLKIDKNGNGNCYTCMGCRSFLTPYVDENGKPKYYGRFNQGVVTINLVDVACTAARDGSKSEEKFWQVLDERLELCHRALQCRHERLEGTLSDAAPILWQYGALARLKKGEPIDKLLHGGYSTLSLGYAGLWECVYEITGKKLTEKEGEEFGLRVMQRLNDACAEWKAAENIDYSIYGTPLESTTYKFAKCLQNRFGIIKGVTDRNYITNSYHIHVTEKIDAFSKLELESKFQKLSPGGAISYVEVPNMQQNIPAVLEVMKFIYNNIMYAELNTKSDYCQVCGYDGEIQIVEEDGKLVWRCPNCGNEDQSKMNVARRTCGYIGSQFWNQGRTQEIKERVLHL

SEQ ID NO: 883 - protein, 763 aa, unidentified
  REGION 1..763: note = Description of Unknown:uncultivated organism sequence
  REGION 1..763: note = Category: MG60 effectors
  REGION 1..763: note = Description: MG60-92 effector
MKIIQQLYSIFVAFATVFLKNKYIIRTYKSNKKYLIDIRKMALLKDLYTRKEWGKMKVIKRDGRTIEFDREKIEIAIEKANKEVRGKEKATKDEINEIIAYIEDLGKKRMLVEDIQDVIEEKLMELDKYELAKKYIVYRYTRALVRKSNTTDESILGLIKNENKELAEENSNKNTMLASTQRDYIAGEVSRDLTKRILLPEKISKAHEEGILHFHDADYFVQPIFNCCLINIGDMLDNGTAMNGKMIETPKSFQVACTVTTQIIAAVASNQYGGQSVDLKHLGKYLRRSHDKFQKRLTEKYGGKLPKQTIDDMIRDRVKEELAAGVQTIQYQINTLMTTNGQSPFVTLFLHLEPDDEYIKENAMIIEEVLKQRIQGIKNEVGVYVTPAFPKLVYVLDEHNCLKGGKYDYLTRLAVKCSAKRMYPDYISAKKMKENYEGNVFSPMGCRSFLVPWKDENGNYKFEGRFNQGVVSINLPQIAIIAQGDEDKFWKLFDERLELCREALMCRHYALLGTSSDISPIHWQNGAIARLKKGEKIDKYLKDGYSTLSLGYIGIYETTKLIKGVSHTTPEGHDFAIKIMKYLKDRTNLWRKETGLGFSLYGTPAESLCYRFARIDKEKFGSIPDVTDKGYYTNSYHVDVREKIDAFHKLKFESEFQPLSAGGAISYIEVPNMKNNLTALEEVVKFIYDNIQYAEFNTKSDYCQVCGYDGEMIINDQNEWECPQCGNKDHNKMNVVRRTCGYLGENFWNVGKTKEIKSRVLHL

SEQ ID NO: 884 - protein, 1291 aa, unidentified
  REGION 1..1291: note = Description of Unknown:uncultivated organism sequence
  REGION 1..1291: note = Category: MG60 effectors
  REGION 1..1291: note = Description: MG60-93 effector
MKLRKVYACILTLCMLVSMLPAFAADTDASCTHKWTEKVIKEANCTQTGLVKKTCELCGDFEYEKTPFKHGEGKEVVKDATCTKPETVGLYCEKCGELIGKVQEVGKALGHDLGKGTEKKADCAGPDRVEYTCKRCGETVVEAIEGGEAAKKHDWEAKIVPATCKTKGYEARVCKACGKVEKDKELPIDGNAHVAKLGKVIREATCTTNGLGRSVCELCGKELGYITIKAGHKYGDPICDEGKEVTCGKAGYGYYVCTVCGEETEKAEIPATGKHAFVDETDIPATCTEPEKIGRICKVCGAADGEVEEIGEALGHDWDDGVYTKADCLKAEREVFTCKRCGKTRDEFIPNGEAAKGHKFVDKIVAPTCKTKGYTERTCERCDLYEKINETEIDKDAHVAKLDKTIREATCTVNGLGRYTCELCGEYLGYRAIEAKHVYGEPIFDEGKEATCGKPGYGYYVCTVCNEKTEKTEIPATGKHQFVDEFVIPATCEEPMKVGRICKVCGKADGKVQEIDKPLGHAWDDGKYMAVDCEKAERVVYTCERCGEVKEEIIPNGEAAKGHKFVDKIVAPTCKTKGYTERTCERCDLYEKINETEIDKDAHVAKLDKTIREATCTVNGLGRYTCELCGEYLGYRAIEAKHVYGAPIFDEGKEATCGKDGYGYYVCTVCGEKTDKDVIPATGKHEFVDETVIPATCTEPEKVGRICKVCGKADGKVQEIDKPLGHDWDDGELKDADCEKAERVVTTCKRCGEIREDSFEGAKPATGHKLVEKIVAPTCKTKGYTERTCERCDLYEKINETEIDKDAHVAKLDKTIREATCTVNGLGRYTCELCGEYLGYRAIEAKHVYGEPIFDEGKEATCGKPGYGYYVCTVCNEKSEKTEIPATGKHQFVDEFVIDATCEEPMKVGRICKVCGKTDGEVKTVGEKLGHDWDDGELKDADCEKAERVVYTCKRCGETKEDVIGTEVLGHKYKEKVVEPTCKTKGYKAKVCSVCGNTEVIEELEPVAGNHVAKLDKVIREATCSANGLGRYVCAECGNYIGYRAIVVEHKWGEEYANEDATAIMHKCEVCGTVEVIWKDSSDECEDGKHVIVVDPAKAATCTETGLTEGKHCSVCDKVLVKQEVIPATGHTEVVDEAKAATCTEAGLTEGKHCSVCNAVLVKQEEIPALGHTEVVDEGKAATCTEAGLTEGKHCSVCSEVLVKQEEIPATGHVEEILPAVAPTDTEPGLTEGKKCSVCGKILVEQEVIPAHEHEHNYVLKGYDFNADFTKKVATYECTICGDTYTEEMDF

SEQ ID NO: 885 - protein, 874 aa, unidentified
  REGION 1..874: note = Description of Unknown:uncultivated organism sequence
  REGION 1..874: note = Category: MG60 effectors
  REGION 1..874: note = Description: MG60-94 effector
MKIIETKVFKGKNIYSLKKCIRLDVDLEGYCETPSKNIEDFNFNLVNMIPELRTHRCGIDEDEGFIKRLKEGTYLAHICEHIILAIQNKLGIDVHYGKSREIKEDHYYIVFQYIYENTALEVAKLAIDIINALINKIPINYDERIEFLKEILNNEILGPSTKSICDYANKVGLPIIKLGNGEFYQIGYGKQGRIIEASISPNTSCISVDIACDKMLTKELLRTQSIPVAKGSKVKNVINLLKEAEEIGYPVVLKPQYGNKGKGVILNLKSEKELLDAYRKIKDKFKDIIIEKYHKGKDFRVCVVNYKVVAVSLRIPPFVIGNGKDTIFELINKLNEDPLRGEDHEKPLTKVKLDEEVIDAISEQRKTLMEVLDKGEKIYLRKNANLSTGGEAIDFTDEICDENINLCIRIAKTLKLDICGIDICTDDISIPIYKNGVVMEVNAAPGLRMHLNPSKGKSRDIGKEIVNMIYNNKPCNIPIVAITGTNGKTTTTRLITHTLSKMGYCVGMTSSSGIYINDECIDVGDDTGFESAKSVLLNPDVEIAVLETARGGIIKKGLAYDLADVAVITNIREDHLGIDEINSMEDLCCVKSLVGEAVKDEGYVVINADDKWSKSILNRIKSRKVYFTLNSSNEILIKKNQDDIYVYLENEDIIIINQNKKYVLCNINEVPITMNGMLKFNIENILAATSALVAMKVDYCMIKNGITTYLLNSKKNSGRFNCYNVNGVNVILDYGHNTDGYIAVLSSVKKMSSKRIFGIVGIPGDRLNKSAEEIGCISAKYFDYIIVKEDKDLRGRKQGEIANLIVDGLIKENSNKKYEVILDEEVALIKALNMAEKGDTIVVFFEEIKPLLKVIEEIASFETKRKSDSYEALN

SEQ ID NO: 886 - protein, 777 aa, unidentified
  REGION 1..777: note = Description of Unknown:uncultivated organism sequence
  REGION 1..777: note = Category: MG60 effectors
  REGION 1..777: note = Description: MG60-95 effector
MPKSIDLITSIWYYVKGFVDKSYKFVTDTTRLTHPRNLRQRGMDMNIIKRNGSEAVFDLNKIIVAVSKANQACEKKELSQGQINDIAEYVEFKIGKANRALSVEEIQDIVEDQIMAQGAFEVAKRYVKYRYTRSLVRKANTTDNQILSLIECNNEEVKQENSNKNPTVNSVQRDYMAGEVSKDITKRILLPQDIVEAHENGIIHFHDADYFAQHMHNCDLVNLEDMLQNGTVISDTMIEKPHSFSTACNIATQIIAQVASSQYGGQSISLTHLAPFVQISREKIRKQVIDEAVDFGSELTEEKIDKITERRLRDEVSRGVQTIQYQVVTLLTTNGQAPFVTVFMYLNEAKNEQEKKDLALIIEETLKQRIQGVKNESGVWVTPAFPKLIYVLENDNVDEDSEYFYLTELAAKCTAKRMVPDYVSEKVMLDLKGDVYTPMGCRSFLTPDRFTEAGVGNIARAKNYVEGKKKYYGRFNQGVVTINLVDVACTSGGDMTKFWQIFDERLNLCYRALMCRHNRLKGTLSDAAPILWQHGALARLDKGEPIDRLLYDGYSTISLGYAGLYECTKYMTGKSHTDENGGKEFALSVMRHMNEACDKWKEETNIDFSIYGTPLESTTYKFAKCLQKRFGIIKGVTDKNYITNSYHVHVTEKIDAFTKLKFESEFQALSPGGAISYVEVPNMQDNIPAVLQVMRFIYDNIMYAELNTKSDYCQCCGYDGEIKIVEDEHGKLIWRCPNCGNEDQDKMNVARRTCGYIGTQFWNQGRTQEIKDRVLHL

SEQ ID NO: 887 - protein, 895 aa, unidentified
  REGION 1..895: note = Description of Unknown:uncultivated organism sequence
  REGION 1..895: note = Category: MG60 effectors
  REGION 1..895: note = Description: MG60-96 effector
MAKALLIAEKNSVARTINAYIKRYGFKDDVTCAALSGHLVHMVEPNKYCEEWDGKWNLEVLPMIPRDFKYEVINDDRIKKIYSDLKQVIRDNHYDYLINACDPEREGQAIFYYVYNKMGCKLPVKRYWENGQTDASVKHALNNLRDGLDETGYPNLKLLTQAAYLRGQFDWLVGMNFTRAASLTMNGVAKVGRVKTAVLKICVDLEKRIIDFVPKTSYGIKTEIAEDIEAINVERLEEDSRVKYVEANYETKEEASTICETLPKSMKLISKDTLRLKDNPDKLFSLGTLQVAASKEYGYSVEQTLAIAQSLYEKKILSYPRTSNPYISSNEASLFDEMLNAIKMIPGLEGVVTYIGDKKTQDRVKTNKMYVNDKETKEAGHYALIPTGERFNFDSLSSEEKSILKLVAYRFAAIFMPSGIDEKTTYIFDAGSKYFRTTIYNTLELGYRSIYNDTPKKSKKPNINKGDMIKVSCYELYEMTSTPPRRLTDGRLVDVMINPQKYLLDNHYKKIIKETKGLGTDATRANIINELAKDKYIEIKGKGNLIYATPTGIKIIENLGDMEITSVDLTAKWETKLYDVSTGKLSVDDFKSEMLEYIKRNTEVFKNKRFNAIGDKANGRESVGKCPSCGGNIFEALNSYYCENFKREGPGCKVILSKSIKGSKVTKANLKKILAGKESTEISLKIEKDGIIKSVKKKLYFNPDSGKIEFVRPQYKALTTCSFCGGIVNASDKAAICSGCGISFARKIKGAVLEDEDLISLYHGQPTKELRFSTIKDGIPKKFNASLIYNYEKRQLGFHYKEAKKFGKCPICGEGFTGPIEGKYGAYYKCSNKVCGLIIKEEIGGVKLTSSDIDILLKGDSLPVKEFKKNDGIGSYKAALFVNRETKKLDRKFSK

SEQ ID NO: 888 - protein, 1186 aa, unidentified
  REGION 1..1186: note = Description of Unknown:uncultivated organism sequence
  REGION 1..1186: note = Category: MG60 effectors
  REGION 1..1186: note = Description: MG60-98 effector
MMNKVLLTDAVPDIEKYWDYEANEGKKPSDFGASSSEKVWTKCPICGTSIRRNVRFTWEKDENGVGHVIHCRTCGKRNNNNSLVVLFPDIKKYWIYEKNEYDPEYYSISSGKKVYTSCPSCGEERYIAICDLIVKRNDRYELTQCIECSPKRNVIGSIAKNYPDIDKYWDDSNASNPNEIALNSQEIIFIHCPTCDKVVKRKALNSFRRDDQTGLYMLLDCHKCATQKAGKIRGLNQSGALIDKCPEIEEWWDAENNTIEFKNITRGSHYEAQLKCPACHSSFTRQIHSFVNVKRDGRLLPVACPECGYSTKGDPKDNILKLCPEIEQWWDYEANSPYRPEQFSKGSQFKAHFICPDCEMHLYTGIHSLMKSDENGNLHIRHKGKCLKFRLMESDNNLVKQYPQIKEWWDYEENGKALPEEFTIYSGKRMHFICPQCGAKSYRRITDAFAIEANSGEPILFNCPYCRNKKILAGKNSLLDTDPELAKEWSPNNNKKANEVLSKSFNRVQWICPNCKGEYSAIIRDRKVGDDACPYCKNDKVLPGFNSLQYKNPELAKEWSNSNDMKADEVLPTSSSRVKWVCPTCHGEYYAIIRGRKVGDDACPYCRKDKLLPGYNSLLNTDPELAKEWSNSNDMKADEVLPTSSSRVKWVCPTCHGEYSAIIRERKVGDDACPYCRNDKLLPGYNSLQDKKPELAKEWSTRNTLKADAVLFTSSSRAQWVCPTCHKEYSAIIRDRKLGDDSCPHCRQTKLLKEHTSLWVVNPELAKEWSDSNDLKADEVLPTSSFRVKWVCPTCRGEYYAIIRDRKVGDDACPYCRKDKLLPGYNSLLNTDPELAKEWSNSNDLKASEVLPTSSHRAQWVCPTCHGEYFAIIRDRKVGDDACPYCKNDKVLPGFNSLQYKNPELAKEWSNSNDMKADEVLPTSSSRVKWVCPTCRGEYYAAIRDRKVGDDACPYCRNDKLLPGYNSLLNTDPELAKEWSNSNDMKADEVLPTSSSRVKWVCPTCHGEYYAAIRDRKVGDDACPYCKNDKVLPGFNSLQYKNPELAKEWSNSNDMKADEVLPTSSSRVKWVCPTCRGEYYAAIRDRKVGDDSCPYCRNKKALAGLNSLLDMQPELVEREWCYPENILIGVYPDQILESYQGKAWWKCPICKRKYFMSVKDRLMKQKRGHVACPQCRGRRCVRSFWV

SEQ ID NO: 889 - protein, 824 aa, unidentified
  REGION 1..824: note = Description of Unknown:uncultivated organism sequence
  REGION 1..824: note = Category: MG60 effectors
  REGION 1..824: note = Description: MG60-99 effector
MKELNDSILALVMDDTEEKLMAENTEIDKEELGLACPKCGKRIIEDGTAYRCEAGDFKCGKEILGTEISRDELQKAIAGQSDELGFRSSKTGKTFLARLVLSEAKDSLDFRFSDRNGEDSGLKCPKCGGKIVDDGKAYKCESGDFKCWKIIRGHEITREELQKALDGKSDELGFTSRDSGKPYKGRLVLNEAKDGLAVKLDSRKSDDTGLKCPKCGGKIIDDGKAYKCESGDFKCWKSIRGHEVTRDELQKVIDEGSSDELDFTDQDTGKPYTARLKLSSDKKSVEVPKPEDTGEKCPNCRNKIMETDKAYWCESCNFTCDKEILGTRISHDDLHKIVEEGNSDELDFTDHDSGKSYKAHLNLSSDKQTVDVPKPEDTGEKCPNCRNKIMETDKAYWCESCNFTCDKEILGTRISHDQLHKIVEEGRSDELDFTDHDSGKSYKARLNLSEDNKTVVVPKPKDTGIKCPKCTMKIMETDRAYWCESEACDFTCDKEILDTKITRDELKKVVLNGKSGKLDFTDKDTKKPYKGRLVLNKKKNGLHVDKLDYMKVIFAVISFVVATISFIGIFLPDLFNMNKGSITRFETTLSDKKSAQKLEEFLDANVGKIVELTIHYKQNLVYGLVPWAKYSEDSYYGVKYDPAKDGSWWWDSASAAHDVTFSHFGDNNRFYVKSFLYDKNLFEVEYRDFGGIGYCDAITRYAYQLMIPYVKNDKLAFEWQRDREKSKDYVALPSPYWVLKGTFVVNVKKGEELTDNITTLYDEFQQRKLRSDYGKDYVVPEIAKILAVDPACGERTGNGDYSFSGKSFELEPLTQQQLLQMAYN

SEQ ID NO: 890 - protein, 768 aa, unidentified
  REGION 1..768: note = Description of Unknown:uncultivated organism sequence
  REGION 1..768: note = Category: MG60 effectors
  REGION 1..768: note = Description: MG60-100 effector
MFCSCKKNLCVVIYIYDATKTYDCAKKSIVYKSIIKGAEVMKIIKRNGAEETFDRQKIKDAIAKANNETDGTPELTDRQIDYISLVIEDHCNEMNRALSVEEIQELVETHIILQGAPETAKRYIRYRFTRNLARASNTTDNQILSLIECNNEEVKQENSNKNPTVNSVQRDYMAGEVSKDLTKRILLPEDIVKAHEEGLIHFHDADYFAQHMHNCDLVNLEDMLQNGTVISGTMIEKPHSFSTACNIATQIIAQVASNQYGGQSISLAHLAPFVQISREKITRQVRAEMEEFGIAADDEQVKSLVEKRVRDEIKRGVQTIQYQVVTLLTTNGQAPFVTVFMYLNEAKNEQEKKDLAIIIEEVLKQRIKGTKNEVGVWVTPAFPKLIYVLEEDNITEDSRFWYLTKLAAECTAKRMVPDYISEKIMLKLKIDKNGNGNCYTCMGCRSFLTPYVDENGKPKYYGRFNQGVVTINLVDVACTAARDGNKSEEKFWQVLDERLELCHRALQCRHERLEGTLSDAAPILWQYGALARLKKGEPIDKLLHGGYSTLSLGYAGLWECVYEITGKKLTEKEGEEFGLHVMQRLNDACAEWKAAENIDYSIYGTPLESTTYKFAKCLQNRFGIIKGVTDRNYITNSYHIHVTEKIDAFSKLELESKFQKLSPGGAISYVEVPNMQQNIPAVLEVMKFIYNNIMYAELNTKSDYCQVCGYDGEIQIVEEDGKLVWRCPNCGNEDQSKMNVARRTCGYIGSQFWNQGRTQEIKERVLHL

SEQ ID NO: 891 - protein, 768 aa, unidentified
  REGION 1..768: note = Description of Unknown:uncultivated organism sequence
  REGION 1..768: note = Category: MG60 effectors
  REGION 1..768: note = Description: MG60-101 effector
MFCSCKKNLRVVIYIYNATKTYDCAKKLIVYKSIIKGAEVMKIIKRNGAEETFDRQKIKDAIAKANNETDGTPELTDRQIDYISLVIEDHCNEMNRALSVEEIQELVETHIILQGAPETAKRYIRYRFTRNLARASNTTDNQILSLIECNNEEVKQENSNKNPTVNSVQRDYMAGEVSKDLTKRILLPEDIVKAHEEGLIHFHDADYFAQHMHNCDLVNLEDMLQNGTVISGTMIEKPHSFSTACNIATQIIAQVASNQYGGQSISLAHLAPFVQISREKITRQVRAEMEEFGIDADDEQVKSLVEKRVRDEIKRGVQTIQYQVVTLLTTNGQAPFVTVFMYLNEAKNEQEKKDLAIIIEEVLKQRIKGTKNEVGIWVTPAFPKLIYVLEEDNITEDSRFWYLTKLAAECTAKRMVPDYISEKIMLKLKIDKNGNGNCYTCMGCRSFLTPYVDENGKPKYYGRFNQGVVTINLVDVACTAARDGNKSEEKFWQVLDERLELCHRALQCRHERLEGTLSDAAPILWQYGALARLKKGEPIDKLLHGGYSTLSLGYAGLWECVYEITGKKLTEKEGEEFGLRVMQRLNDACAEWKAAENIDYSIYGTPLESTTYKFAKCLQNRFGIIKGVTDRNYITNSYHIHVTEKIDAFSKLELESKFQKLSPGGAISYVEVPNMQQNIPAVLEVMKFIYNNIMYAELNTKSDYCQVCGYDGEIQIVEEDGKLVWRCPNCGNEDQSKMNVARRTCGYIGSQFWNQGRTQEIKERVLHL

SEQ ID NO: 892 - protein, 768 aa, unidentified
  REGION 1..768: note = Description of Unknown:uncultivated organism sequence
  REGION 1..768: note = Category: MG60 effectors
  REGION 1..768: note = Description: MG60-102 effector
MFCSCKKNLRVVIYIYNATKTYDCAKKLIVYKSIIKGAEVMKIIKRNGAEETFDRQKIKDAIAKANNETDGTPELTDRQIDYISLVIEDHCNEMNRALSVEEIQELVETHIILQGAPETAKRYIRYRFTRNLARASNTTDNQILSLIECNNEEVKQENSNKNPTVNSVQRDYMAGEVSKDLTKRILLPEDIVKAHEEGLIHFHDADYFAQHMHNCDLVNLEDMLQNGTVISGTMIEKPHSFSTACNIATQIIAQVASNQYGGQSISLAHLAPFVQISREKITRQVRAEMEEFGIAAEDEQVKSLVEKRVRDEIKRGVQTIQYQVVTLLTTNGQAPFVTVFMYLNEAKNEQEKKDLAIIIEEVLKQRIKGTKNEVGVWVTPAFPKLIYVLEEDNITEDSRFWYLTKLAAECTAKRMVPDYISEKIMLKLKIDKNGNGNCYTCMGCRSFLTPYVDENGKPKYYGRFNQGVVTINLVDVACTAARDGNKSEEKFWQVLDERLELCHRALQCRHERLEGTLSDAAPILWQYGALARLKKGEPIDKLLHGGYSTLSLGYAGLWECVYEITGKKLTEKEGEEFGLRVMQRLNDACAEWKAAENIDYSIYGTPLESTTYKFAKCLQNRFGIIKGVTDRNYITNSYHIHVTEKIDAFSKLELESKFQKLSPGGAISYVEVPNMQQNIPAVLEVMKFIYNNIMYAELNTKSDYCQVCGYDGEIQIVEEDGKLVWRCPNCGNEDQSKMNVARRTCGYIGSQFWNQGRTQEIKERVLHL

SEQ ID NO: 893 - protein, 769 aa, unidentified
  REGION 1..769: note = Description of Unknown:uncultivated organism sequence
  REGION 1..769: note = Category: MG60 effectors
  REGION 1..769: note = Description: MG60-103 effector
MKVIKRDGTIVEYDREKIRIAIEKANKEVSRKEKATDSEIEEIMSYIEDLKKGRILVEDIQDIIEEKLMEIKRYELAKKYITYRYTRALVRKANTTDQSIKELIEGESEYWNNENANKNARVVTTQRDYLAGITSTDITRRFLLPEDVVKAHDEGIIHFHDADYFAQNALTNCELINLEDMLQNGTIMNGVMIEKPHRFITACTIATQIILAVTSSTYGGATVSLAHLAPFVRSSYEKYYKKYKDNGLSKEQCEKFAKEDTKKEVADGVQTFNYQVNSMTNTNGQAPFLSVCMYLGETDEYKEELAMIIEEFLNQRILGFKNEKGVYITPAFPKLLYVLEEDNIHENSKYWYLTELAAKCTAKRMVPDYISEKIMKQMKVDANGDGQCYPCMGCRSFLTPYIDPVTKKPKYYGRFNQGVVTINLVDVALSSGKDLKKFWKIYDERLELCHKALQARHERLAKATSDIAPILWQHGAFARLPKGASIHPLLHGGYSTISLGYAGLYECVKYMTGKSHTDNGDGKDFAIEVMKKMNEKCAEWKDAEDIDYSVYGTPIESTTYKFAKCLQKRFGKIKGITDKNYITNSYHVPVFEEIDAFSKLKLESEFQRLSPGGAISYVETPNLQNNLEVVLQIMKFIYDNIMYAELNTKSDYCQKCGYTGEILIDDNLEWYCPNCGNRDHNTLNVARRTCGYIGSNFWNKGRTQEIKERVLHIDNKDDDCDCDECNCDHANTDTSKEEKSEEKQMNFMDYDVEEEITKSKKRMKQPAMV

SEQ ID NO: 894 - protein, 1094 aa, unidentified
  REGION 1..1094: note = Description of Unknown:uncultivated organism sequence
  REGION 1..1094: note = Category: MG60 effectors
  REGION 1..1094: note = Description: MG60-105 effector
MTVTKRDGRKVKFDRSKIVKAITKAFVEVYPDELPADTYTFCAKIADDIEARKQDLTVEEIQDIVVRKLMASKYKDVATQYVQYRYQHELIRQSNTTDKTIKELLDGENEYWKTENSNKNPKVVTTQRDYIAGVTSTDITRRFLLPKDIVKAHDEGIIHFHDADYYAQLSLHNCELINLQDMLQNGTVINGVQIDKPHRLITAATISTQIITAVTSSSYGGATINLSHLAPFVRDSREWHRRKYLSRGMSDGEADSWAMEDTQKEIADAVQTFNYQVNSMTNTNGQAPFLSVFMYLNDDPEHQEETALLIEEFLRQRILGFKNESGHYITPAFPKLLYVLDENNITEESPYWYLTVLAAQCTAKRLVPDYISAKIMRRDKVDANGNGNVYGCMGCVAGDEVITYRMDGMVYTEAFSRAWNRLTRRFAPKIQPGRAIDKYIDLEGVEIYDAVAGWTRCLRMIRNENSEMLRLRFSNGRMLDCTPDHPFETENRGVVQAADLTEEDVIRVDKDSVWTVDTANGVDDYAWMLGLLLCDSSYVSTVRVSIAATGEEEIRDRFTQCAQKYWNAQINDVLHERGVKGTYRDLVIKGDGDGKATNICSELEALFEGRVKSKRHIPNEVFNWSYSARLSFMAGMIDADGYINDHFRVPVVQIGSTNKELAIQQALLAQTLGMRASIYQNHYKGKGRGDTIRYQVSFHPTAELVDRIACKKKQDKFNENELCNPCISLTDFATLTSRTELNEKMPSYDVTTASEHFTVSGIYSHNCRSFLTPYLDAEGKPKYWGRFNQGVVTINLPDVALSSGGDMTKFWELLDERLELCHRALQCRHERLALATADVAPILWRYGALARLPKGAPIHPLLHDGYSTLSLGYAGLYECVKYMTGESHSHGKGFDFGIQVMEKLNEYTAKWKAAEHIDYSLYGSPIETTTYKFATCLKRRFGEVEGITDHGYITNSYHINVRESIDPFEKLAIEAKYQKLSPGGAISYIECSDLTGNIDAVLEVLKFIYDNIMYAELNTKSDYCQVCGYEHEIEIVDNDGVLSWRCPNCGNTDQSKMNVARRTCGYIGTQYWNQGRTEEIRDRYVHLDNHEVGE

SEQ ID NO: 895 - protein, 768 aa, unidentified
  REGION 1..768: note = Description of Unknown:uncultivated organism sequence
  REGION 1..768: note = Category: MG60 effectors
  REGION 1..768: note = Description: MG60-106 effector
MFCSCKKNLCVVIYIYDATKTYDCAKKLIVYKSIIKGAEVMKIIKRNGAEETFDRQKIKDAIAKANNETDGTPELTDRQIDYISLVIEDHCNEMNRALSVEEIQELVETHIILQGAPETAKRYIRYRFTRNLARASNTTDNQILSLIECNNEEVKQENSNKNPTVNSVQRDYMAGEVSKDLTKRILLPEDIVKAHEEGLIHFHDADYFAQHMHNCDLVNLEDMLQNGTVISGTMIEKPHSFSTACNIATQIIAQVASNQYGGQSISLAHLAPFVQISREKITRQVRAEMEEFGIAADDEQVKSLVEKRVRDEIKRGVQTIQYQVVTLLTTNGQAPFVTVFMYLNEAKNEQEKKDLAIIIEEVLKQRIKGTKNEVGVWVTPAFPKLIYVLEEDNITEDSRFWYLTKLAAECTAKRMVPDYISEKIMLKLKIDKNGNGNCYTCMGCRSFLTPYVDENGKPKYYGRFNQGVVTINLVDVACTAARDGSKSEEKFWQVLDERLELCHRALQCRHERLEGTLSDAAPILWQYGALARLKKGEPIDKLLHGGYSTLSLGYAGLWECVYEITGKKLTEKEGEEFGLRVMQRLNDACAEWKAAENIDYSIYGTPLESTTYKFAKCLQNRFGIIKGVTDRNYITNSYHIHVTEKIDAFSKLELESKFQKLSPGGAISYVEVPNMQQNIPAVLEVMKFIYNNIMYAELNTKSDYCQVCGYDGEIQIVEEDGKLVWRCPNCGNEDQSKMNVARRTCGYIGSQFWNQGRTQEIKERVLHL

SEQ ID NO: 896 - protein, 1020 aa, unidentified
  REGION 1..1020: note = Description of Unknown:uncultivated organism sequence
  REGION 1..1020: note = Category: MG60 effectors
  REGION 1..1020: note = Description: MG60-107 effector
MVVIKRNSERVDFDPRKIEVAILKAFAEVRSESDDDIRECAKRIAHEIESTGKDLSVEEIQDMVEKKLMATKYKDVAKAYVEYRYKHKLIREFNTTDKTIKELLCGESDYWNNENSNKNARVVTTQRDYIAGITSTDIARRLLLPADVVEADDEGIIHFHDKDYFAQLSLHNCFDVTTRFITSNGVKAFSDFNDCDEATVLTHTGEWKRARVRKYGKQDLYRIVLKRGHGKEHIVYATANHRWFLQDGSVTTNLHVGDSLMKTPVIANVNLDDADVFEKQLWCKGFAFGDGQYCKAWDGTKIRLCGHKNKYARIFRAAGYTCTSPGNFENGDQEAHIPRYNKNEIPEMTPAETRYFVYGLLCADGDHPTSKGNTKANEFKGIQVTGEEKNFQVYNLLNIAGYYVSGYTDITGKTNYGERSDVTRRYAIQANQSHCNWKVQAIEYAKTDYVWCLNVEDCHSFVLEGGIVTGNCELVNLEDMLQHGTVLNGVMIRKPHRLLTATTIATQIITAVTSSSYGGCTINLSHLAPFVRDSYNAYVKKYRDRGVDEQTTKEWAELDTKKEIADSVQTFNYQCNSMTNTNGQAPFLSVFMYLNDAPEYQKETAMLIEEFLNQRLLGFQNETGHYVTPAFPKLLYVLDENNITEDSEYWYLTELAAKCTAKRMVPDYMSAKIMRRDKIDKNGNGNVYGCMGCRSFLTPYVDKDGKPKYWGRFNQGVVTINLPDIALSSGGDMEKFWKIFDERMALCHKALRCRHERLALATSDVAPILWQNGALARLPKGSPIHPLLHDGYSTLSLGYAGLYECVKYMTGESHSHGKGKEFGLRVMQTLNDFCKKWKEEESIDYSLYGTPIESTTYKFSKCLKKRFGIIEGITDKDYITNSYHISVREKIDPFEKLAIEAEYQKLSPGGAISYVECADLTQNPTAVLEVMRFIYDNIMYAELNTKSDYCQVCGYDGEIQIIDENGKLLWRCPNCGNEDQTKMNVARRTCGYIGTQFWNQGRTQEIKERYVHIDNHEVGE

SEQ ID NO: 897 - protein, 854 aa, unidentified
  REGION 1..854: note = Description of Unknown:uncultivated organism sequence
  REGION 1..854: note = Category: MG60 effectors
  REGION 1..854: note = Description: MG60-108 effector
MKVIKRNGSEVLYNQQKIKDAVSKANAEVSRVERLSQAQITAIANNVTKIIEQSSHAVSIEDIQNYVEKEIMAMRGYEVAQKYITYRYKRALARQSNTTDERILSIIGLENEEVKQENANKNPTINSTQRDYMAGEVSKDLTTRILLPQDIVDAHNNGLIHFHDADYYAQKMHNCFTGDTKFMTHKGAKRFDSFKDGESVFVRDMHNEIRKATVHIYGEQRVQKVTFKMLGKNKKKTVKCTPNHRWILEDKKVTTALKVGDVLFSNSYSHYEKWKVEKIEFKGIEKVYCVEEPITHSFTLEDGMVTGNCDLINLEDMLQNGTVISGTMIEKPHSFHTACNITTQVIAQVASSQFGGQSFSLAHLVPFVDISRKKIKKEILEENLINKIVESDEIINKKVEFRLKEEIKRGIQTIQYQILTLMTTNGQAPFVTMFLWLDEVEEGQARDDMAMLVEEVLNQRIQGVKNEKGVYITPAFPKVIYLLDEDNIHEDSKYYYLTELAAKCTAKRMVPDYISGKVMRELKDGDIYPCMGCRSFLTVDRTTENIANAKNYNPNKRKYYGRFNQGVVTINLVDVACSSYGNMNKFWKILDERLELCHRALQERHNRLLGTPSDVSPILWQHGALARLEKDEVIDKLLYGGYSTISLGYAGLYEMCMRMTGKSHTDPEAKPFALAVMQKLNDKCNEWKEKENIDYSLYGTPMESTTFKFARCLQRRFGIIKDVTDHDYITNSYHVNVRENIDAFTKLSFESEFQKLSPGGAISYVEVPNMQDNIPAVLAVLKHIYNNIMYAELNTKSDYCQVCGYEGEIQIVRDKHKKLIWKCPNCGNTDHNKMNTARRTCGYIGTNDFNQGVT

SEQ ID NO: 898 - protein, 778 aa, unidentified
  REGION 1..778: note = Description of Unknown:uncultivated organism sequence
  REGION 1..778: note = Category: MG60 effectors
  REGION 1..778: note = Description: MG60-109 effector
MFCSCKKKLCVVIYIYNATKTYDCAKKLIVYKSIIKGAEVMKIIKRNGAEETFDRQKIKDAIAKANNETDGTPELTDRQIDYISLVIEDHCNEMNRALSVEEIQELVETHIILQGAPETAKRYIRYRFTRNLARASNTTDNQILSLIECNNEEVKQENSNKNPTVNSVQRDYMAGEVSKDLTKRILLPEDIVKAHEEGLIHFHDADYFAQHMHNCDLVNLEDMLQNGTVISGTMIEKPHSFSTACNIATQIIAQVASNQYGGQSISLAHLAPFVQISREKITRQVRAEMEEFGIDADDEQVKSLVEKRVRDEIKRGVQTIQYQVVTLLTTNGQAPFVTVFMYLNEAKNEQEKKDLAIIIEEVLKQRIKGTKNEVGVWVTPAFPKLIYVLEEDNITEDSRFWYLTKLAAECTAKRMVPDYISEKIMLKLKIDKNGNGNCYTCMGCRSFLTPYVDENGKPKYYGRFNQGVVTINLVDVACTAARDGSKSEEKFWQVLDERLELCHRALQCRHERLEGTLSDAAPILWQYGALARLKKGEPIDKLLHGGVFFPLARHGGYSTLSLGYAGLWECVYEITGKKLTEKEGEEFGLRVMQRLNDACAEWKAAENIDYSIYGTPLESTTYKFAKCLQNRFGIIKGVTDRNYITNSYHIHVTEKIDAFSKLELESKFQKLSPGGAISYVEVPNMQQNIPAVLEVMKFIYNNIMYAELNTKSDYCQVCGYDGEIQIVEEDGKLVWRCPNCGNEDQSKMNVARRTCGYIGSQFWNQGRTQEIKERVLHL

SEQ ID NO: 899 - protein, 763 aa, unidentified
  REGION 1..763: note = Description of Unknown:uncultivated organism sequence
  REGION 1..763: note = Category: MG60 effectors
  REGION 1..763: note = Description: MG60-110 effector
MYIQPIITVSDTTHKFNFVKLFFQKNKNSLRDVWRGNGMKIIKRNGEEVVFDLKKIITAISKANNEVPPSEQLAGSTINSIAENIEKQCAAENHEMNVEAIQDLVEKAIMKAGAFDIAKKYITYRYQHQLMRRANSTDSQILSLLECNNEEVKQENSNKNSTVVSVQRDYMAGEVSKDITKRFLLDEDIVKAHEEGLIHFHDADYFAQHMHNCDLVNLEDMLQNGTVISGTKIDTPHSFSTACNIATQIIAQVASSQYGGQSISLAHLAPFVEVSRKKFQRETMRVEEQTGVKFTDEQFKKIVEMRIRDEITRGVQTIQYQVVTLMTTNGQSPFITVFMYLNEAKNEQEKADLAMIIEEMLKQRYQGVKNEKGFWVTPAFPKLIYVLEPDNIEPGSKYYSLTELAAKCTARRLVPDYISEKKMLELKVDANGNGNCYPCMGCRSFLTPYLDEHGKPKYYGRFNQGVVTINLVDVACSSNGDYKSFWEIFDERLELCHKALMRRHQRLLGTPSDVAPILWQHGALARLEKGETIDKLLFGGYSTISLGYAGLCECVRYMTGKPHTDPSATPFAIEIMKHLNEKCAEWKAESNIAFSLYGTPLESTTYKFAKCLKKRFGEIPGVTDKNYITNSYHVHVTEQMDAFTKLSFESQFQELSPGGAVSYVEVPNMENNIPAVMTLLKHIYENIMYAELNTKSDCCQKCGYTGEIQIVTDSDNKLVWQCPNCGNKDQATMNVARRTCGYIGTQYWNQGRTQEIKERVLHL

SEQ ID NO: 900 - protein, 758 aa, unidentified
  REGION 1..758: note = Description of Unknown:uncultivated organism sequence
  REGION 1..758: note = Category: MG60 effectors
  REGION 1..758: note = Description: MG60-111 effector
MRINMIIENYKKQYSFLAFSEKSWKSLSERITKLVENKTLNSVDEIRTYLDRILCSYIDKQISIGNIRIIHNMLILLKRRKLSYSNLLQEFLSQLEIYHIHMTESFYEVLKKESVLYQNIVKSLGISDLKFCELSAFWKEYSFYFKFSVHGKSLKEVKDIFDGYYYSLNVQEQKQVMDNMDSHLDQFRYLIYHASFLDGIYQVCYTKIRDISLSLFRKVIFSWSIDQLDLLIEEYCYNQIYGGSALEKYDKIWLLIKELKPQHDEKKKHLGNECLKIKGERRTLYSYFEKIKSNLSEEDKKVIDTLYVHLSKERQEGIDGYINGLYHQNDEVGRKASNDISMLKGQFKKYLINGCLKVKGERRTLYSYFEKIKSNLSAEDRGIIDILYTHLSKERQEGIDGYISGLYHQNDEVGRKASNDISILKRQFKKYLQSGCLNLKNEPHTLYFYFRMLKSDLSEEDKKVIDTLYAHLSKERQEAIDGYISGLYRYNDNMRRKASNDILILKRQFARYLAKGDLTIRSKDRSLYSCFEKIKSNLSEEDRRIIDILYNHLSKERQEGIDGYINGLYHQNDEVGRKASNDISTLKRQFKKYLESGCLNLKNEPHTLYFYFKMLKSDLSEEDKKVIDILYARLSKEKQEEINGYINGLYHQSDEVRKKARIDLLGLRRKFERYLKIESLEVCSKKQLEVKQVLLDALKVIEMSFYRLGYTTSEYLKYKNEKMIEIMNKGNFSHYNILYIFIMESFYFIKEQEKIRSL

SEQ ID NO: 901 - protein, 768 aa, unidentified
  REGION 1..768: note = Description of Unknown:uncultivated organism sequence
  REGION 1..768: note = Category: MG60 effectors
  REGION 1..768: note = Description: MG60-112 effector
MFCSCKKNLRVVIYIYDATKTYDCAKKLIVYKSIIKGAEVMKIIKRNGAEETFDRQKIKDAIAKANNETDGTPELTDRQIDYISLVIEDHCNEMNRALSVEEIQELVETHIILQGAPETAKRYIRYRFTRNLARASNTTDNQILSLIECNNEEVKQENSNKNPTVNSVQRDYMAGEVSKDLTKRILLPEDIVKAHEEGLIHFHDADYFAQHMHNCDLVNLEDMLQNGTVISGTMIEKPHSFSTACNIATQIIAQVASNQYGGQSISLAHLAPFVQISREKITRQVRAEMEEFGIAADDEQVKSLVEKRVRDEIKRGVQTIQYQVVTLLTTNGQAPFVTVFMYLNEAKNEQEKKDLAIIIEEVLKQRIKGTKNEVGVWVTPAFPKLIYVLEEDNITEDSRFWYLTKLAAECTAKRMVPDYISEKIMLKLKIDKNGNGNCYTCMGCRSFLTPYVDENGKPKYYGRFNQGVVTINLVDVACTAARDGSKSEEKFWQVLDERLELCHRALQCRHERLEGTLSDAAPILWQYGALARLKKGEPIDKLLHGGYSTLSLGYAGLWECVYEITGKKLTEKEGEEFGLRVMQRLNDACAEWKAAENIDYSIYGTPLESTTYKFAKCLQNRFGIIKGVTDRNYITNSYHIHVTEKIDAFSKLELESKFQKLSPGGAISYVEVPNMQQNIPAVLEVMKFIYNNIMYAELNTKSDYCQVCGYDGEIQIVEEDGKLVWRCPNCGNEDQSKMNVARRTCGYIGSQFWNQGRTQEIKERVLHL

SEQ ID NO: 902 - protein, 768 aa, unidentified
  REGION 1..768: note = Description of Unknown:uncultivated organism sequence
  REGION 1..768: note = Category: MG60 effectors
  REGION 1..768: note = Description: MG60-113 effector
MFCSCKKNLRVVIYIYNATKTYDCAKKLIVYKSIIKGAEVMKIIKRNGAEETFDRQKIKDAIAKANNETDGTPELTDRQIDYISLVIEDHCNEMNRALSVEEIQELVETHIILQGAPETAKRYIRYRFTRNLARASNTTDNQILSLIECNNEEVKQENSNKNPTVNSVQRDYMAGEVSKDLTKRILLPEDIVKAHEEGLIHFHDADYFAQHMHNCDLVNLEDMLQNGTVISGTMIEKPHSFSTACNIATQIIAQVASNQYGGQSISLAHLAPFVQISREKITRQVRAEMEEFGIAADDEQVKSLVEKRVRDEIKRGVQTIQYQVVTLLTTNGQAPFVTVFMYLNEAKNEQEKKDLAIIIEEVLKQRIKGTKNEVGVWVTPAFPKLIYVLEEDNITEDSRFWYLTKLAAECTAKRMVPDYISEKIMLKLKIDKNGNGNCYTCMGCRSFLTPYVDENGKPKYYGRFNQGVVTINLVDVACTAARDGNKSEEKFWQVLDERLELCHRALQCRHERLEGTLSDAAPILWQYGALARLKKGEPIDKLLHGGYSTLSLGYAGLWECVYEITGKKLTEKEGEEFGLRVMQRLNDACAEWKAAENIDYSIYGTPLESTTYKFAKCLQNRFGIIKGVTDRNYITNSYHIHVTEKIDAFSKLELESKFQKLSPGGAISYVEVPNMQQNIPAVLEVMKFIYNNIMYAELNTKSDYCQVCGYDGEIQIVEEDGKLVWRCPNCGNEDQSKMNVARRTCGYIGSQFWNQGRTQEIKERVLHL

SEQ ID NO: 903 - protein, 843 aa, unidentified
  REGION 1..843: note = Description of Unknown:uncultivated organism sequence
  REGION 1..843: note = Category: MG60 effectors
  REGION 1..843: note = Description: MG60-114 effector
MIKCIECGHTISERAKKCPKCGCPVEKDIEKKMCPECGQSVNKDLDKCSYCGYPFDLVQSIDDTNSSVNKVCPECGQSVNKDLNKCSYCGYPFDLVQSVDDANSSVNKVCPECGQSVNKDLNKCSYCGYPFDLVQSVDDANSSVNKVCPECGQSVNKDLNKCSYCGYPFDLVQSVGDANSSINKVCPECRQSVNKDLDKCSYCGYPFNLVQSVDDANSSVNKVCPECGKSFDDKCDVCPHCGCFYSYQHISQFENVELNKANIESSEPKQEHQSTTDIRKTLLKRNKTTIISLSMLTILIVVGGLLYYFLVNHSEKNDWNKFGLKGSACVLRVIISTQYGDNTELVRNEKKYYFSVNGYLEKEEIDYTYHWGYRQYVKGKIVEEKDFNGITYHYTYENPLIGISEDNREYHYDKEGRLIFSVLYGDSTVYRYDDEGFLKETEVLNFQGLDGCEIQTYSNPLHVDGITKVDEYGNWIERKYEYEGEGGMIYVTENREIEYYSESSQVGNYGEAISEVSIEEYPSQLPQNRKEALDILNLVLINSYKVEEDCESEYAIPVRIEGNAEIVGIQRKGYKDGYFPFTIYRLRQIANHWQIVNEKTINENEMDGQVLIFSAKRFGLADENMPELVRINNKDYFYFIYRIAELGNGCAGCGYLRLCLYNLDSHDVLSLNYAVYGEINELLKGEFVDLEKLESYPDENRFLQKKATELTCIYRPSEEDLDMDNPKNSVKRWLLDNPGKYEPQNTTIKYTYYNTSIFDWDNYNDEKENRIENDSFIVVHDWRGSVYAYDKEKKRYFVIYGIEINGGARKVSWDNRASDVVVIDTDWCGMRINLLSGKMELLE

SEQ ID NO: 904 - protein, 1081 aa, unidentified
  REGION 1..1081: note = Description of Unknown:uncultivated organism sequence
  REGION 1..1081: note = Category: MG60 effectors
  REGION 1..1081: note = Description: MG60-115 effector
MKSVIDFETRSPVDIKTCGAYAYAAHPDTEVMMLAVRICGQEARVWVAPAYRHFLDTELSDDELQDIINNCEEIAAHNAPFERAIWKFKMEPLWFKPLPLEKIRCTMSQALMCNLPRKLEQAVKVWRKDAPQKDNEGHKLMMKMSKPRKFRKAELSAFPDPEKAKATQEYVYAVLSKGGIPTIKNYHQYIVYPCDEPMFKRYVEYCRQDVVAEEVLFTELPPIPERELKVWRLDQTINDRGVGIDRFHAVKIMDMVNKVEDILTEEASEITYGAVSTMKSSKAIIEWLQSRGVDTDSASKQAISDLLERPDLPSDVRRFLEIRQTIAMSSTAKYQTMLCTSCYDGRAHGTMIYHGASTGRFSGALIQPQNLTRPSTNNMNIPEGSKPLDNYDISEMDVRLAASGNIDLIQQYWKDPKVLASDCLRAMIRASEGRVFMCADYSGIEARALAYLAGEEYVLQGFRDGLDPYKVAATTIYGVKYENVDKKQRQVGKTATLACFTADTKVYTRDGVKNIVDVTKDDYVWDGENWCLTDGAYYQGVKEVVNFLGVESTPDQKWLMGENIWVESDAGKVLLETFMEIFKSCHCVEKQEISCTQDASLAGENAMCRHGTYCLEEQLSALNADENLELKQSQNTIQWSSLTREDGLIDYTQQLADVIMKQIQHMNGMEPEELKYTMNGWKIKIPSLNICVELTIGTTQGMKSTALITTMDTCREMLGVSWDETIKETPQEIDLYRMVEELCALLIFGVSIAPNIEARELLVNYLEKESIPKKSSNQCRKESVVNTTKYITSKKFFTVEKNCLSMSFGKNMFRGTRKNLIFKLDSIKDRVLSTSSRTKKSDNKENVYDLLNCGDKSRFTISTSYGPRIVHNCGYGGGYGAFLRFGADRMGIDEEEGKKIISSWRDGHPMTVKLWNKLVEASVMAMTNKGEIYSYRGVSFRYHKRFLLMKLPSGRFLFYFDPKLEDVGMAWSTPERPAFKKLVTAMTLTPEKQFVRRPLNHLILSENLTQAFCRDLMVNALFNLEEAGYPVVFHVHDEIISEVPIGYGDIKEFEEIMCKLPLWAKDLPVKAEGWVGKFYRK

SEQ ID NO: 905 - protein, 965 aa, unidentified
  REGION 1..965: note = Description of Unknown:uncultivated organism sequence
  REGION 1..965: note = Category: MG60 effectors
  REGION 1..965: note = Description: MG60-116 effector
MSLKIEDLETFKRHRYAVSESLSTDIVGRDREIEEISSKIDSVYCLTITGPAGVGKSRLAVAAIEHYCASHTDFEVLCAKSFSDYISALDEAIEEGRRYIIFIDDANTYPRLIELLEFLKYRNQEGNIKAILTVRDYLKGCLDSDIYMGFYEVKPLNDKSIEDALVKNTTIRNEDWLKQIAKIANGNIRVAFLAANEAIKNNKSLGSIYNQKDVLNRFYKDEMSKIDHSESLLITAGVIAFFKSIYLEQLFYIVPILKSVNLSKKSFIENVNILIKMKIVDDYHDVVKIADQCFADFLLNYTIVEKRYLKIKDLLLVGFKYYKERIVESIHTILHVYNTEEFVDHLRKEVTDACNNLEDDVSLKHDLESCFVQVIPEYVSREYIEGVENYSDKKDIKWLINVFSGLAFSNYNEIANKGILKLLKKTKNKTKEVYDAIKNTYEMRAERANERFQYQIALIKELQNGGLYNDEFNALVSSYLNFRFSYSCFTSKREMMHYTFSVDDNTAGILELRSTCWGYLFNCELSKAIDSIMDFANRHYIERNLEIIKNDLRCINTYLCEHDQSGFLNSVLYVKFIDEAKEYCFTDLLTANEKYLDFLDIVFERKLLGANYEGYEARYKNRVADYYNLHKDDIYDILNETDLFLNKYYKYQKTRLVNALVEVVDKFSNALFFLCTKNGIFPHLVIEEFLKNRNLDEAYALINQIDDETIKDEYLYNFYSYLSKENIEKDYGFIGWMNSKGDFKTNRTYHRDAMSLKNIAEKCGLDYVALLRKLYSKEKYNKFIAKAYLSYLIDNVETFKELLSLNQNLAIKIYEFLIANGEKDYESSVLIEILDVKRSYIKVFAKAFIEEEYYNDCNLDFIFEKEYCDSFLDECMKVMLSQKINFAPFKLRILISRNINQPNMERWIEKYIESNYKEDNVIELFFQALSEIDHQHKNAYLVLYYQKGHDINVLRQAILKKIPFL

SEQ ID NO: 906 - protein, 754 aa, unidentified
  REGION 1..754: note = Description of Unknown:uncultivated organism sequence
  REGION 1..754: note = Category: MG60 effectors
  REGION 1..754: note = Description: MG60-117 effector
MNYEEKLTQLASDYADWWNKGYEMPSMTSNLYPYDNMFSPVRVNRLTLKNRLVMAPMGNICMCDETGRPNEKMLKYFEERAKGGVGLITTGLIPVTYGIDKSLIELGDLTYFPRIDRSRTVFAPWRDLAGMCHAHGSAIFIQLTAGLGRVGNPQCLTNQLKLPRSSSFNPNWYMKDVPCLRLSDISLNKIIKKIGQGSADAKACNLDGVYLHGHEGYLIEQIANKAFNHRKLGKFADPTVFGIEMVKEIRRRVGANFPIMYRIDLSLMLNATYKAKMDNVSPLKKFKNERRIEETLEYMRELVEAGVDMFDVDLGCYDNWWLPHPPSSMPSGCFLDISEIAKKYFADNNIKSNMGLEIPVVAVGKLGYPDFAEKALRDGKCDMIMLGRPLLADAEWCNKAYAGKVSDIRPCIGCQEACLNEFVEGGHPQCAVNPRTAFEEEYSPEIPKADVVKKVAVVGAGPAGIVAADTLIKRGHKVDLYEKSGEIGGSVIPGSKPMIKYEFKNYLDYLKGVVAKLEKNESFKLFMNTAADAQSLKEKGYDSIVIAAGTVQNRPPVEGINNKNVVFAVDVLNDRNIVKDAEDIVVIGGGVVGAETAYVLRYELKKNVKVVEMDKYIMNHVCTANRGHLIHYLEEGGVELLNMTTLKKVEDGKIVVEQNINKNVPNPYITWSPILPENVENPMDALRPIKNEPVTRELKADMVVLAAGNRSAIDIYYDCVKNHSAAEIFNVGDSFKGARVFEAVRSAYRKARSI

SEQ ID NO: 907 - protein, 754 aa, unidentified
  REGION 1..754: note = Description of Unknown:uncultivated organism sequence
  REGION 1..754: note = Category: MG60 effectors
  REGION 1..754: note = Description: MG60-118 effector
MNYEEKLTQLASDYADWWNKGYEMPSMTSNLYPYDNMFSPVRVNRLTLKNRLVMAPMGNICMCDETGRPNEKMLKYFEERAKGGVGLITTGLIPVTYGIDKSLIELGDLTYFPRIDRSRTVFAPWRDLAGMCHAHGSAIFIQLTAGLGRVGNPQCLTNQLKLPRSSSFNPNWYMKDVPCLRLSDISLNKIIKKIGQGSADAKACNLDGVYLHGHEGYLIEQIANKAFNHRKLGKFADPTVFGIEMVKEIRRRVGANFPIMYRIDLSLMLNATYKAKMDNVSPLKKFKNERRIEETLEYMRELVEAGVDMFDVDLGCYDNWWLPHPPSSMPSGCFLDISEIAKKYFADNNIKSNMGLEIPVVAVGKLGYPDFAEKALRDGKCDMIMLGRPLLADAEWCNKAYAGKVSDIRPCIGCQEACLNEFVEGGHPQCAVNPRTAFEEEYSPEIPKADVIKKVAVVGAGPAGIVAADTLIKRGHKVDLYEKSGEIGGSVIPGSKPMIKYEFKNYLDYLKGVVAKLEKNENFKLFMNTAADAQSLKEKGYDSIVIAAGTVQNRPPVEGINNKNVVFAVDVLNDRNIVKDAEDIVVIGGGVVGAETAYVLRYELNKNVKVVEMDKYIMNHVCTANRGHLIHYLEEGGVELLNMTTLKKVEDGKIVVEQNINKNVPNPYITWSPILPENVENPMDALRPIKNEPVTRELKADMVVLAAGNRSAIDIYYDCVKNHSADEIFNVGDSFKGARVFEAVRSAYRKARSI

SEQ ID NO: 908 - protein, 757 aa, unidentified
  REGION 1..757: note = Description of Unknown:uncultivated organism sequence
  REGION 1..757: note = Category: MG60 effectors
  REGION 1..757: note = Description: MG60-119 effector
MIQVIKRDGSKAKFEKDKIVIAIEKAMKSASGVFVKNQAMDIANEIESEALGEDAISIYKIEDMVYYKLIDRKNPATAKSYESYKSVQAYKREQNTSDEDILGLLNQTNIDVMDENSNKNPIIASTQRDLIAGEVAKDIAKRKLIPIDLVEAHNSGAIHIHDLDYLIQPIFNCCLVDMKDMLDNGTVVNDKMIETPKSFQVACNVMTQIIAQIASNQYGGQSINISCLSPYLKKSYDKNLKLSRSILDDDEKVVEMAEALTQRDLESGIQTIQYQINTLMTSNGQSPFVTLFMHTDENDPYLSSTVKIIEEILIQRIKGIKNEQGVYVTPAFPKLIYVLDENNVHEGSKYYKLTELAAKCTAKRMYPDYISAKKMRENYEGNVFSPMGCRAFLPPYKDENGNYKFDGRFNMGVATINLPQIGILADGDEDKFFEILDKRLDLIKQVGLLRYEHLSKVTSDSSPIHFRHGAIARLKRHQSIKPLLENGYATVTIGYIGIYEASILTTGESHTSKRGHDFAMKIMKVLNEKKEEWTKEYGIAFAVYGTPAESLTHRFASIDKERFGSIENVTDKGYYTNSFHVDVREKISVFDKFDFESEFQQLSTGGCISYAEIPNMTNNINAVMTMVKYIYDHIQYAEFNTKSDYCAECGFDGEILLDEDNNWYCPNCGNKDRNTLTVVRRTCGYLGENFWNEGRTKEIKARVLHIWDMGKLENMTLPMVLESGPLFSYQVAIGIVRIALIGTIWILTLVKSGMKRP

SEQ ID NO: 909 - protein, 1041 aa, unidentified
  REGION 1..1041: note = Description of Unknown:uncultivated organism sequence
  REGION 1..1041: note = Category: MG60 effectors
  REGION 1..1041: note = Description: MG60-120 effector
MVGRTAVHPSRKKEEKKRKGDERHMIKVKKRTGKIVDFDESRIANAVQGALTDIGHPDAQLAQEIAVEIHSGLIADGVESITIAGIQKRVETALMSRKQFDAARAYIEYRHRKDITRALKEKAEERNRNIMKLIRNDDDDIRKENSNKDTSLVSTRFSYMAEEANKEIASEILFDKDLIEAHKAGMIHIHDMGFAALPMHNCFTRTTRFVTTEGVKSFEDFIDGEEVTVLSKDGKWHKATVHNYGKQPMQKVLFKCLKSTKEVVCTPNHRWVLADGSVTTKLKEGMTLVQLPLYEISEPKTKKQCQAFALGFILGDGFDRGKFVEARLCGPKKKYADIFKKAGYHITYPDLDNGDARVRKAPSRKQSFLDGRCWQYLDLEDKQYLFLGLYAADGRDTENEYSGRFITSADERIMKMICDISATAGYHVSSVKKETHDTPYKKEAVLYTIRFRRWQNSGGNYWSVSQISSFEDREAWCIEEPDTHSFILDGGMVTGNCDVWNLDDMLQNGTVMNGIAISKPKSLATAVTIATQIVISIAASQYGGQTFSISALAPFVRVSYEKHLKEVEADAKGSGIVMTDDQVRFVAENRLRKEIKDAVQTLQYQLISCAVSNGQAPFVSVFMYLDEKPEYKKETAMLAEEILRQRYAGIPNKQGVPVSVAFPKLLFVLDEDNVPEDSEYHYLLKMAVKCSAKRMVPDYISAKKMKEYKEGNVFPCMGCRSFLSPWKDENGNYKFYGRFNQGVVTVNLVDAALSSGKDEARFWEIMKERTDLCYRALMTRHKLLLGTKSDVAPILWQHGALARLKPGEVIDPLLFGGYSTISLGYVGLYECTLYMTGHSHTSPEGKAFAMKVMKYLNDRCDEWRAATDIGFSVYGTPEETTTDKFAKCLKKRFGIVPGITDHDYVTNSYHVNPAEKIDAFSKLALEGEFQAYSLGGEISYVEVPNMEKNLAALESVVEFMYDNTVYAEVNTKSDYCQKCGYDGEMLIDPKRMEFYCPNCGNTDYATMNITRRVCGYLSTNFPTTHGRMADISARVLHLDAE

SEQ ID NO: 910 - protein, 751 aa, unidentified
  REGION 1..751: note = Description of Unknown:uncultivated organism sequence
  REGION 1..751: note = Category: MG60 effectors
  REGION 1..751: note = Description: MG60-121 effector
MEENVQTNVIKRNGEEVTFDIEKIFNAIAKANKEVDPIHQMSDVQIRAVSENVAREVRKAPHAVNVEDIQDMVETGIMEMRGFEVAQKYVRYRYKRTLARKSNTTDDGILALIEQNNEEVKQENSNKNPVINSTQRDYMAGEVSRDLSRRILLPEEVVRAHEAGIIHFHDSDYYAQKEHNCDLINLEDMLQNGTVISETLIEKPHSFYTAANVTTQIVAQVASNQYGGQSFTLAHLAPFVDISRKKLRKQTAEELQAVGEEIDEKKVESIAEIRLKDEVTRGIQTIQYQLITLMTCNGQAPFVTMFMYLDEVPEGQTREDLAMLIEEVLRQRMQGVKNEKGVWITPAFPKLIYVLDEDNITEDSRYWYLTKLAAECTAKRMVPDYISAKKMKELKGDVYPCMGCRSFLTPDNEQQPEGLCNDGNKAEAGDYTPGQHKYYGRFNQGVVTINLVDVACSAVKEAEKAGTDKFDEFWKILDDRLELCHRALRCRHERLMGTPSDVAPILWQYGALARLKKGEKIDKLLFGNYSTISLGYAGLYEMCVEMTGKSHTDEEAKPFALKVMQTLNDYCMKWRKAENISYSLYGTPMESTTYKFAKCLQKRFGIIKDVTDHNYITNSYHVNVREKIDAFRKLEFESEFQKLSPGGAISYVEVPNLQDNIPAVLSVMQFIYENIMYAELNTKSDYCEVCGYDGEIQIHEDEHGKLIWVCPNCGNTDQTKMSVARRTCGYIGTQFWNQGRTQEIKDRVLHL

SEQ ID NO: 911 - protein, 768 aa, unidentified
  REGION 1..768: note = Description of Unknown:uncultivated organism sequence
  REGION 1..768: note = Category: MG60 effectors
  REGION 1..768: note = Description: MG60-122 effector
MFCSCKKNLCVVIYIYDATKTYDCAKKLIVYKSIIKGAEVMKIIKRNGAEETFDRQKIKDAIAKANNETDGTPELTDRQIDYISLVIEDHCNEMNRALSVEEIQELVETHIILQGAPETAKRYIRYRFTRNLARASNTTDNQILSLIECNNEEVKQENSNKNPTVNSVQRDYMAGEVSKDLTKRILLPEDIVKAHEEGLIHFHDADYFAQHMHNCDLVNLEDMLQNGTVISGTMIEKPHSFSTACNIATQIIAQVASNQYGGQSISLAHLAPFVQISREKITRQVRAEMEEFGIAADDEQVKSLVEKRVRDEIKRGVQTIQYQVVTLLTTNGQAPFVTVFMYLNEAKNEQEKKDLAIIIEEVLKQRIKGTKNEVGVWVTPAFPKLIYVLEEDNITEDSRFWYLTKLAAECTAKRMVPDYISEKIMLKLKIDKNGNGNCYTCMGCRSFLTPYVDENGKPKYYGRFNQGVVTINLVDVACTAARDGNKSEEKFWQVLDERLELCHRALQCRHERLEGTLSDAAPLLWQYGALARLKKGEPIDKLLHGGYSTLSLGYAGLWECVYEITGKKLTEKEGEEFGLRVMQRLNDACAEWKAAENIDYSIYGTPLESTTYKFAKCLQNRFGIIKGVTDRNYITNSYHIHVTEKIDAFSKLELESKFQKLSPGGAISYVEVPNMQQNIPAVLEVMKFIYNNIMYAELNTKSDYCQVCGYDGEIQIVEEDGKLVWRCPNCGNEDQSKMNVARRTCGYIGSQFWNQGRTQEIKERVLHL

SEQ ID NO: 912 - protein, 760 aa, unidentified
  REGION 1..760: note = Description of Unknown:uncultivated organism sequence
  REGION 1..760: note = Category: MG60 effectors
  REGION 1..760: note = Description: MG60-123 effector
MCVVIYIYNATKTYDCAKKLIVYKSIIKGAEVMKIIKRNGAEETFDRQKIKDAIAKANNETDGTPELTDRQIDYISLVIEDHCNEMNRALSVEEIQELVETHIILQGAPETAKRYIRYRFTRNLARASNTTDNQILSLIECNNEEVKQENSNKNPTVNSVQRDYMAGEVSKDLTKRILLPEDIVKAHEEGLIHFHDADYFAQHMHNCDLVNLEDMLQNGTVISGTMIEKPHSFSTACNIATQIIAQVASNQYGGQSISLAHLAPFVQISREKITRQVRAEMEEFGIAADDEQVKSLVEKRVRDEIKRGVQTIQYQVVTLLTTNGQAPFVTVFMYLNEAKNEQEKKDLAIIIEEVLKQRIKGTKNEVGVWVTPAFPKLIYVLEEDNITEDSRFWYLTKLAAECTAKRMVPDYISEKIMLKLKIDKNGNGNCYTCMGCRSFLTPYVDENGKPKYYGRFNQGVVTINLVDVACTAARDGSKSEEKFWQVLDERLELCHRALQCRHERLEGTLSDAAPILWQYGALARLKKGEPIDKLLHGGYSTLSLGYAGLWECVYEITGKKLTEKEGEEFGLRVMQRLNDACAEWKAAENIDYSIYGTPLESTTYKFAKCLQNRFGIIKGVTDRNYITNSYHIHVTEKIDAFSKLELESKFQKLSPGGAISYVEVPNMQQNIPAVLEVMKFIYNNIMYAELNTKSDYCQVCGYDGEIQIVEEDGKLVWRCPNCGNEDQSKMNVARRTCGYIGSQFWNQGRTQEIKERVLHL

SEQ ID NO: 913 - protein, 763 aa, unidentified
  REGION 1..763: note = Description of Unknown:uncultivated organism sequence
  REGION 1..763: note = Category: MG60 effectors
  REGION 1..763: note = Description: MG60-124 effector
MKMIQQLYSIFVAFATVFLKNKYIIRTYKSNKKYLIDIRKMALLKDLYTRKEWGKMKVIKRDGRTIEFDREKIEVAIEKANKEVRGKEKATKDEINEIIAYIEDLGKKRMLVEDIQDVIEEKLMELDKYELAKKYIVYRYTRALVRKSNTTDESILGLIKNENKELAEENSNKNTMLASTQRDYIAGEVSRDLTKRILLPEKISKAHEEGILHFHDADYFVQPIFNCCLINIGDMLDNGTAMNGKMIETPKSFQVACTVTTQIIAAVASNQYGGQSVDLKHLGKYLRRSHDKFQKRLTEKYGGKLPKQTIDDMIRDRVKEELAAGVQTIQYQINTLMTTNGQSPFVTLFLHLEPDDEYIKENAMIIEEVLKQRIQGIKNEVGVYVTPAFPKLVYVLDEHNCLKGGKYDYLTRLAVKCSAKRMYPDYISAKKMKENYEGNVFSPMGCRSFLVPWKDENGNYKFEGRFNQGVVSINLPQIAIIAQGDEDKFWKLFDERLELCREALMCRHYALLGTSSDISPIHWQNGAIARLKKGEKIDKYLKDGYSTLSLGYIGIYETTKLIKGVSHTTPEGHDFAIKIMKYLKDRTNLWRKETGLGFSLYGTPAESLCYRFARIDKEKFGSIPDVTDKGYYTNSYHVDVREKIDAFHKLKFESEFQPLSAGGAISYIEVPNMKNNLTALEEVVKFIYDNIQYAEFNTKSDYCQVCGYDGEMIINDQNEWECPQCGNKDHNKMNVVRRTCGYLGENFWNVGKTKEIKSRVLHL

SEQ ID NO: 914 - protein, 754 aa, unidentified
  REGION 1..754: note = Description of Unknown:uncultivated organism sequence
  REGION 1..754: note = Category: MG60 effectors
  REGION 1..754: note = Description: MG60-125 effector
MKVVKRDGKIVDFDEDRIRIAIGKANNEVDDSDKATEEEIDEIVKKIRTLKRKRILVEDIQDMIEDGLMNYKRFNLAREYITYRYNRALVRKANTTDQTIKELVDGESEYWNTENSNKNSKVVTTQRDYLAGITSTDITRRFLLPQDVVKAHDEGIIHFHDADYFAQNALTNCCLINLNDMLQNGTVINGMMIEKPHRFITACTIATQIILGVSSSQYGGCTITLTHLAPFVRDSYNRALKKYKERGLSQKEAEKFAELDTRKEIADGVQTFNYQVNSMTNTNGQAPFLSVCMYLGETKEYKKELALIIEEFLNQRILGFKNEKGVYITPAFPKLLYVLEEDNIHKDSPYWYLTELAAKCTAKRMVPDYISEKKMKEYKINQYGEGDCYPCMGCRSFLTPDRIKGNVAKAKDYVEGKGKYYGRFNQGVVTINLPDVALSSKKDEKEFWKIFDERLEICHKALRCRHERLAKITSDAAPLLWQHGAYARLGKGEKILPLLKGGYSTLSLGYAGLYECVKYMTGDSHTDGGKGEEFGLKVMQYMNDKCNKWKKEEDIDYSLYGSPIESTTYKFAKCLKKRFGTVKGITDRKYITNSYHVPVFEEIDAFSKLKLESKFQRLSPGGAISYVETPNLQNNIEVVEQIIEYIYNNIMYAELNTKSDYCQKCGYTGEILIDDNLEWYCPNCGNRDHDTLNVARRTCGYIGTNFWNKGRTEEIKERVLHIDNKDYVDTKAPKVEAKEEKKEKAKEKVSVSAN

SEQ ID NO: 915 - protein, 768 aa, unidentified
  REGION 1..768: note = Description of Unknown:uncultivated organism sequence
  REGION 1..768: note = Category: MG60 effectors
  REGION 1..768: note = Description: MG60-126 effector
MFCSCKKNLRVVIYIYNATKTYDCAKKLIVYKSIIKGAEVMKIIKRNGAEETFDRQKIKDAIAKANNETDGTPELTDRQIDYISLVIEDHCNEMNRALSVEEIQELVETHIILQGAPETAKRYIRYRFTRNLARASNTTDNQILSLIECNNEEVKQENSNKNPTVNSVQRDYMAGEVSKDLTKRILLPEDIVKAHEEGLIHFHDADYFAQHMHNCDLVNLEDMLQNGTVISGTMIEKPHSFSTACNIATQIIAQVASNQYGGQSISLAHLAPFVQISREKITRQVRAEMEEFGIDADDEQVKSLVEKRVRDEIKRGVQTIQYQVVTLLTTNGQAPFVTVFMYLNEAKNEQEKKDLAIIIEEVLKQRIKGTKNEVGVWVTPAFPKLIYVLEEDNITEDSRFWYLTKLAAECTAKRMVPDYISEKIMLKLKIDKNGNGNCYTCMGCRSFLTPYVDENGKPKYYGRFNQGVVTINLVDVACTAARDGNKSEEKFWQVLDERLELCHRALQCRHERLEGTLSDAAPILWQYGALARLKKGEPIDKLLHGGYSTLSLGYAGLWECVYEITGKKLTEKEGEEFGLRVMQRLNDACAEWKAAENIDYSIYGTPLESTTYKFAKCLQNRFGIIKGVTDRNYITNSYHIHVTEKIDAFSKLELESKFQKLSPGGAISYVEVPNMQQNIPAVLEVMKFIYNNIMYAELNTKSDYCQVCGYDGEIQIVEEDGKLVWRCPNCGNEDQSKMNVARRTRGYIGSQFWNQGRTQEIKERVLHL

SEQ ID NO: 916 - protein, 1323 aa, unidentified
  REGION 1..1323: note = Description of Unknown:uncultivated organism sequence
  REGION 1..1323: note = Category: MG60 effectors
  REGION 1..1323: note = Description: MG60-127 effector
MSNFESYLNQFRVQKGEACNYTGMTINRGSFYIPEENRTTFLSKYYDHVFKQGGSSDLIERHSDLCCVLYDLDMKIDKESEERGYTREIINSFIEISTRIMKKYFDLPVSAYQCFVLEKDKPTVKKECKKDGVHLMFPYIVTEPSIQHLIRDEIVIEAKHLFEECLNTIEDIVDISVLDKNGWMLLGSSKIDGLPYNLTGIWSYENIEDVGNTFPNRVETSEYYTPSLDLVTLLSIRRFTLADITNFKSDMQDFLESWIDDFNTIQEEKNNIHTRRFHGNINKDMKVNMKTVQSLVSILSTDRAKNYEEWIELGFCLHTISDELLQTWIEFSERVDDYRETASADCSARWGKMRETGLGLGTLHMWAKADNYKAYLEIIQNDLEYFIVKTVNSALSNKDDAKDKAKKEVNISDVIFNVVLALKQKYYHYFICSSYEKKHWYEFEDIRWVEGDADVGLKRKIREDLYDDYVAVSTKYRKLSERFQNDHPNKEKYELISAEVFKVAQKLRDATFRKRLLEEASEQLYWSRDRSKQLSSSKFEEILDVNEKLIGMKNGVYDLEKQCFREARCEDYVSLSADIEYQEYFWNDEIIQDINTFISQVLTNKDVRDYVLQTFAMCLDGQIYNEHFHIYTGCHAKGSEILMHDGTIANVENVKVGDMLMGPDSKPREVHELVNGYSQMYEIIPSKGEPFVVNEDHIMVLKATTINNVVKCKNEKRFKLSWHERDIFGFPVSKCKNFPYNGRLKYKKNVIYYKTEDDARNAIEIYRNDLIMNNLNYIKNGDVIEIPLKEYIKRMKKINGAKNYFLFKEGVDFPEKDVKIDPYMLGYWLGDGTSKAFAITTMDDIVIDYFDQKTVVDENMDKKVYHKKNNKAKTIYYSSKEKKHGKNRLLNSMKEYNIYNNKHIPSVYKFNNRQTRLELLAGLIDSDGHYNVKSKHYEITLKIEKLIDDTVYLARSLGFAVTKRTVKKTCTNNGKTGMYFNVLICGNNLNEIPVLIERKIARDRLKKKDPLRFGFKVNKLENDQYYGFKLNQDHLYLAGDFFVHHNCGSNGKSKILELFELSFGQYCSKLSIAALTQKRVSSSAATPEIARLRGRRFVVLQEPGENEILNVGLMKEMTGGDKIVARSLNKDPIEFKPQFNMILTCNQRPKIPSDDQGSWRRIRVVEFTSKFTANPDPNDPNQFMIDTDLTSKLKKWGKPFFWILTQYYKEFKKNGYKEPAEVTAATNEYQKEQDAYSEFVTDCLKLDKTSYADVKEVYTVFQEYVRYNNDQKPSKKAFEKYMNTRFGKFGRHRDSKCWKGFKIDEAALNENYGISENPEDELL

SEQ ID NO: 917 - protein, 787 aa, unidentified
  REGION 1..787: note = Description of Unknown:uncultivated organism sequence
  REGION 1..787: note = Category: MG60 effectors
  REGION 1..787: note = Description: MG60-128 effector
MLYDDQPISQDEEDKLNRTPFVDEIVELIDRYTEYDEKKDNHDGLVIGLEGAWGSGKTSALNLLENRFRDKNERYVVQRLDSWLAMDCTTLAAEFFKTLGAATIESGISSEYETLLQRIVRNVCGYTLRLVTWIKLKKLPKIGPKIVAHIDKMEPSKWVRKTPAHVLKFGKNVIRSSTISLKVIKIDFGKIIKDTTIRKEKEDLRVDLSKSKKYIIYMIDDIDRLNNDEIAFVMQLVKNIADFPKVIYILAYDRNIVAEALQRIDGKNGRDFMEKIIQVPIQMPEFGKAGLLRYFCDELRTIVQSESSSQNKVRFDTSQGKIIMDKVYMSIEPYLKNFRDCKRLLNAYQIRYYICSRFCAPDDLLCIVVLETFEPGAITYLINHYNAFYSSLLPESRNVSATDIKNYRDEIKQEASCSERALKILASLFPAFATKINETTSAQLINGKALIENRISERENFLSYFILSPNENAVFSDVIKDLLLNWQEEDIAEQLKQWARGGKLQSALLKIGAYCDLYNQDIKLERDRWMPILHGISSVQNIRLYANQTYTWADVPWAVVEKIIDLPIFGGNPDHVNIDTAGWIVDIFRDENVSLETLEVLMWHIGSGYEWARPESYADSAPEVEEDLFMSCKELFVRRLKGNLSKEGFFDSVMINLFLAHLMKEDMAYLNQYLASLSTIESIYPWLKVALEEETHRKFYGLKRRAWHHKDDLLAITPKSYAALVDKELDQIPEDWLSDQKWTTLVLYDAYVHQETWTQTKGAFIKEESLEEYGNKVYHARKNKKVN

SEQ ID NO: 918 - protein, 768 aa, unidentified
  REGION 1..768: note = Description of Unknown:uncultivated organism sequence
  REGION 1..768: note = Category: MG60 effectors
  REGION 1..768: note = Description: MG60-129 effector
MFCSCKKNLCVVIYIYDATKTYDCAKKLIVYKSIIKGAEVMKIIKRNGAEETFDRQKIKDAISKANNETDGTPELTDRQIDYISLVIEDHCNEMNRALSVEEIQELVETHIILQGAPETAKRYIRYRFTRNLARASNTTDNQILSLIECNNEEVKQENSNKNPTVNSVQRDYMAGEVSKDLTKRILLPEDIVKAHEEGLIHFHDADYFAQHMHNCDLVNLEDMLQNGTVISGTMIEKPHSFSTACNIATQIIAQVASNQYGGQSISLAHLAPFVQISREKITRQVRAEMEEFGIAADDEQVKSLVEKRVRDEIKRGVQTIQYQVVTLLTTNGQAPFVTVFMYLNEAKNEQEKKDLAIIIEEVLKQRIKGTKNEVGVWVTPAFPKLIYVLEEDNITEDSRFWYLTKLAAECTAKRMVPDYISEKIMLKLKIDKNGNGNCYTCMGCRSFLTPYVDENGKPKYYGRFNQGVVTINLVDVACTAARDGSKSEEKFWQVLDERLELCHRALQCRHERLEGTLSDAAPILWQYGALARLKKGEPIDKLLHGGYSTLSLGYAGLWECVYEITGKKLTEKEGEEFGLRVMQRLNDACAEWKAAENIDYSIYGTPLESTTYKFAKCLQNRFGIIKGVTDRNYITNSYHIHVTEKIDAFSKLELESKFQKLSPGGAISYVEVPNMQQNIPAVLEVMKFIYNNIMYAELNTKSDYCQVCGYDGEIQIVEEDGKLVWRCPNCGNEDQSKMNVARRTCGYIGSQFWNQGRTQEIKERVLHL

SEQ ID NO: 919 - protein, 768 aa, unidentified
  REGION 1..768: note = Description of Unknown:uncultivated organism sequence
  REGION 1..768: note = Category: MG60 effectors
  REGION 1..768: note = Description: MG60-130 effector
MFCSCKKNLCVVIYIYDATKTYDCAKKLIVYKSIIKGAEVMKIIKRNGAEETFDRQKIKDAISKANNETDGTPELTDRQIDYISLVIEDHCNEMNRALSVEEIQELVETHIILQGAPETAKRYIRYRFTRNLARASNTTDNQILSLIECNNEEVKQENSNKNPTVNSVQRDYMAGEVSKDLTKRILLPEDIVKAHEEGLIHFHDADYFAQHMHNCDLVNLEDMLQNGTVISGTMIEKPHSFSTACNIATQIIAQVASNQYGGQSISLAHLAPFVQISREKITRQVRAEMEEFGIDADDEQVKSLVEKRVRDEIKRGVQTIQYQVVTLLTTNGQAPFVTVFMYLNEAKNEQEKKDLAIIIEEVLKQRIKGTKNEVGVWVTPAFPKLIYVLEEDNITEDSRFWYLTKLAAECTAKRMVPDYISEKIMLKLKIDKNGNGNCYTCMGCRSFLTPYVDENGKPKYYGRFNQGVVTINLVDVACTAARDGNKSEEKFWQVLDERLELCHRALQCRHERLEGTLSDAAPILWQYGALARLKKGEPIDKLLHGGYSTLSLGYAGLWECVYEITGKKLTEKEGEEFGLRVMQRLNDACAEWKAAENIDYSIYGTPLESTTYKFAKCLQNRFGIIKGVTDRNYITNSYHIHVTEKIDAFSKLELESKFQKLSPGGAISYVEVPNMQQNIPAVLEVMKFIYNNIMYAELNTKSDYCQVCGYDGEIQIVEEEGKLVWRCPNCGNEDQSKMNVARRTCGYIGSQFWNQGRTQEIKERVLHL

SEQ ID NO: 920 - protein, 987 aa, unidentified
  REGION 1..987: note = Description of Unknown:uncultivated organism sequence
  REGION 1..987: note = Category: MG60 effectors
  REGION 1..987: note = Description: MG60-131 effector
MKKIIMACFLSVLCFQGFALTGFDADYNAALKRAKDNSKPIFILFTGSDWCSWCVKFEKEVLSKSEFLDYATNTWELVVADFPQKKKIAPELKKQYQALQKKYAVRGFPTVMLIDAKGKELCSAGYSKGGAKVWLEKFLNKLKITPLVEQYLAPIEKKVRVISEESRDEITAKVKSLEPTDYKKWLQEYKSIANKYLPKVKAISDELAKLNVPDEILEKKEELSEEVNFMMMSLESAAKMDVEKEAKRIEELRKESESTKKVERKINRVTVPKAGEGKVDSEYFAKVAMPFYKKHIVDTFVPTKKMDKKTADDVRKVRWALARYLSTGRLEFPTGEECALAEKLWRKKFRDPAVAMLFYHSLFSDAQYWRGRRIFSDAIKIHNFKREPIFGFILKSYLCKAEKHRLKVRKSDPVKPYQDACAELEKYTTDKIVDVFKKADYRILERLEELIIIPPSLSKKVGNEYLSRCMIAERAMNAAFEARGSGWASDVTEEGWKGFQDNNEIAASNLLAAVKMRPEGARAPMMLARLSGSSCVVSEADTYSWCSLAVSNSLDECAEQIQHFVHFRTSRWGGSTAFLRDFLMQCATNVDVRSTFSYAAAAAAFRKILVAEADNSVQSNALERFITPDMRTALYGMFDAYAAAPETEFMPSADMFRGMGMSLALQFRDWPKVRKYYKMIKKPLKHHVDSTWLIRTYAPAINNTHVSYLFRVLGQSKYAEQFLEAEEAVAAKDYEKAYKLYSNLQNIEKPSDGEKYIAAEGYYTMRRVIEEKKGGWVNLMPSKTGGEAIHFWGMTFLDGDGKARCHDNTRSYYRVKKPIPGIGSEFEGTIHFEKDDKNRKVWNIGWGLARVYSGFCADNNSWAYPYIAFTRDEKGDHYAIDTFTNENSNRENFKDEDKWVQLGRAPYLMVAQGDLEKSDSHSFKLLTTEDKIEIFIDRKLVYSSMLDDIINVSYMRDRIQPNGDVLPVWKVFTGSSFSDYRYRRLVK

SEQ ID NO: 921 - protein, 768 aa, unidentified
  REGION 1..768: note = Description of Unknown:uncultivated organism sequence
  REGION 1..768: note = Category: MG60 effectors
  REGION 1..768: note = Description: MG60-132 effector
MFCYCKKKLCVVIYIYNATKTYDCAKKLIVYKSIIKGAEVMKIIKRNGAEETFDRQKIKDAIAKANNETDGTPELTDRQIDYISLVIEDHCNEMNRALSVEEIQELVETHIILQGAPETAKRYIRYRFTRNLARASNTTDNQILSLIECNNEEVKQENSNKNPTVNSVQRDYMAGEVSKDLTKRILLPEDIVKAHEEGLIHFHDADYFAQHMHNCDLVNLEDMLQNGTVISGTMIEKPHSFSTACNIATQIIAQVASNQYGGQSISLAHLAPFVQISREKITRQVRAEMEEFGIDADDEQVKSLVEKRVRDEIKRGVQTIQYQVVTLLTTNGQAPFVTVFMYLNEAKNEQEKKDLAIIIEEVLKQRIKGTKNEVGVWVTPAFPKLIYVLEEDNITEDSRFWYLTKLAAECTAKRMVPDYISEKIMLKLKIDKNGNGNCYTCMGCRSFLTPYVDENGKPKYYGRFNQGVVTINLVDVACTAARDGSKSEEKFWQVLDERLELCHRALQCRHERLEGTLSDAAPILWQYGALARLKKGEPIDKLLHGGYSTLSLGYAGLWECVYEITGKKLTEKEGEEFGLRVMQRLNDACAEWKAAENIDYSIYGTPLESTTYKFAKCLQNRFGIIKGVTDRNYITNSYHIHVTEKIDAFSKLELESKFQKLSPGGAISYVEVPNMQQNIPAVLEVMKFIYNNIMYAELNTKSDYCQVCGYDGEIQIVEEDGKLVWRCPNCGNEDQSKMNVARRTCGYIGSQFWNQGRTQEIKERVLHL

SEQ ID NO: 922 - protein, 1292 aa, unidentified
  REGION 1..1292: note = Description of Unknown:uncultivated organism sequence
  REGION 1..1292: note = Category: MG60 effectors
  REGION 1..1292: note = Description: MG60-133 effector
MKLRKVYACILTLCMLVSMLPAFAADTDASCTHKWTEKVIKEANCTQTGLVKKTCELCGDFEYEKTPFKHGEGKEVVKDATCTKPETVGLYCEKCGELIGKVQEVGKALGHDLGKGTEKKADCAGPDRVEYTRKRCGETVVEAIEGGEAAKEHDWEAKIVPATCKTKGYEARVCKACGKVEKDKELPIDENAHVPKLGKVIREATCTTNGLGRSVCELCGKELGYITIKAGHKYGDPICDEGKQVTCGKAGYGYYVCTVCGEETEKAEIPATGKHTFVDETDIPATCTEPEKIGRICKVCGAADGKVEEIGEALGHDWDDGVYTKADCLKAEREVFTCKRCGKTRDEFIPNGEAAKGHKFVDKIVAPTCKTKGYTERTCERCDLYEKINETEIDKDAHVAKLDKTIREATCTVNGLGRYTCELCGEYLGYRAIEAKHVYGAPIFDEGKEATCGKDGYGYYVCAVCGEETEKDVIPATGKHEFVDETVIPATCTEPEKVGRICKVCGKADGKVQEIDKPLGHDWDDGELKDADCEKAERVVYTCERCGEVKEEIIPNGEAAKGHKFVDKIVAPTCKTKGYTERTCERCDLYEKINETEIDKDAHVAKLDKTIREATCTVNGLGRYTCELCGEYLGYRAIEAKHVYGAPIFDEGKEATCGKDGYGYYVCAVCGEETEKDVIPATGKHEFVDETVIPATCTEPEKVGRICKVCGKADGKVQEIDKPLGHDWDDGELKDADCEKAERVVYTCERCGEVKEEIIPNGEAAKGHKFVDKIVAPTCKTKGYTERTCERCDLYEKINETEIDKDAHVAKLDKTIREATCTVNGLGRYTCELCGEYLGYRAIEAKHVYGAPIFDEGKEATCGKDGYGYYVCTVCGEKSEKTEIPATGKHQFVDEFVIDATCEEPMKVGRICKVCGKVDGEVKTVGEKLGHDWDDGELKDADCEKAERVVYTCKRCGETKEDVIGTEVLGHKYKEKVVEPTCKTKGYKAYVCSVCGDAEVIEELEPVAGNHVAKLDKVIREATCSANGLGRYVCAECGDYIGYRAIVAEHKWGEEYANANATAIMHECQVCGKVEIIWQDPDFKECEEGKHEIVNDPARAATCTVNGLTAGKHCVVCGKILAQQTVIPALGHTEVVDEGKEATCTEAGLTEGKHCSVCSEVLVKQEEIPALGHTEVVDEGKAATCTEAGLTEGKHCSVCSEILVKQEEIPATGHVEEILPAVAPTDTEPGLTEGKKCSVCGKILVEQEVIPAHGHEHSYVLKGYDFNADFTKKVATYECTICGDTYTEEMDF

SEQ ID NO: 923 - protein, 768 aa, unidentified
  REGION 1..768: note = Description of Unknown:uncultivated organism sequence
  REGION 1..768: note = Category: MG60 effectors
  REGION 1..768: note = Description: MG60-134 effector
MFCSCKKNLRVVIYIYNATKTYDCAKKLIVYKSIIKGAEVMKIIKRNGAEETFDRQKIKDAIAKANNETDGTPELTDRQIDYISLVIEDHCNEMNRALSVEEIQELVETHIILQGAPETAKRYIRYRFTRNLARASNTTDNQILSLIECNNEEVKQENSNKNPTVNSVQRDYMAGEVSKDLTKRILLPEDIVKAHEEGLIHFHDADYFAQHMHNCDLVNLEDMLQNGTVISGTMIEKPHSFSTACNIATQIIAQVASNQYGGQSISLAHLAPFVQISREKITRQVRAEMEEFGIDADDEQVKSLVEKRVRDEIKRGVQTIQYQVVTLLTTNGQAPFVTVFMYLNEAKNEQEKKDLAIIIEEVLKQRIKGTKNEVGVWVTPAFPKLIYVLEEDNITEDSRFWYLTKLAAECTAKRMVPDYISEKIMLKLKVDKNGNGNCYTCMGCRSFLTPYVDENGKPKYYGRFNQGVVTINLVDVACTAARDGSKSEEKFWQVLDERLELCHRALQCRHERLEGTLSDAAPILWQYGALARLKKGEPIDKLLHGGYSTLSLGYAGLWECVYEITGKKLTEKEGEEFGLRVMQRLNDACAEWKAAENIDYSIYGTPLESTTYKFAKCLQNRFGIIKGVTDRNYITNSYHIHVTEKIDAFSKLELESKFQKLSPGGAISYVEVPNMQQNIPAVLEVMKFIYNNIMYAELNTKSDYCQVCGYDGEIQIVEEDGKLVWRCPNCGNEDQSKMNVARRTCGYIGSQFWNQGRTQEIKERVLHL

SEQ ID NO: 924 - protein, 794 aa, unidentified
  REGION 1..794: note = Description of Unknown:uncultivated organism sequence
  REGION 1..794: note = Category: MG60 effectors
  REGION 1..794: note = Description: MG60-135 effector
MNIFIFYFFFSLHFLRSKFFLYKLPLSKGGVQKGLDFDLVFLSKIDILEVQLIKIVECSTIFWIDKGECIMKVIKRSGEEVIFDVHKIENAIRKANKATSHSQMSEATILKISKQVEAQCEAMKRSPSVEEIQDMVETAIMKEQYYSVAHNYITYRYERALVRKANSTDQQILSLLERNNEEVKQENSNKNPLVNSVQRDYMAGEVSKDITKRFLLPQDIIEAHEQGLIHFHDSDYFAQHMHNCCLVNLEDMLQNGTVISETMIEKPHSFSTACNIATQIIAQVASSQYGGQSITLSHLAPFVQISREKARKEVKDEFEAMNMDVSEEKINQIAEMRVLREIEKGVQMIQYQVITLMTTNGQAPFVTVFMYLDEVEEGQTRDDLALIIEEVLKQRMQGVKNEKGVWITPAFPKLIYVLEEDNIHKTSKYYYLTELAAKCTAKRMVPDYISEKMMKQLKVDQNGDGQCYPCMGCRSFLTPYVDENGKPKYYGRFNQGVVTINLVDVACSSKGDEKRFWKIMDERLDLCYRALMCRHNRLKGTPSDVAPILWQNGALARLEKGETIDKLLYGGYSTISLGYAGLCECVQYMTGVPHTEEPGTSFGLKVMQYLNDACAKWKKENNMDFSLYGTPMESTTYKFAKKLQDRFGIIPKVTDKNYITNSYHVHVTEEINAFDKLTFEAQFQKLSPGGAISYVEVPNMENNIPAVLAVIEHIYDHIMYAELNTKSDYCQICGYTGEIQIVEDENHKLVWECPNCGNRDQEKMNVARRTCGYIGTQFWNQGRTQEIKERVLHL

SEQ ID NO: 925 - protein, 763 aa, unidentified
  REGION 1..763: note = Description of Unknown:uncultivated organism sequence
  REGION 1..763: note = Category: MG60 effectors
  REGION 1..763: note = Description: MG60-136 effector
MMRVVKRDGKIVDFDESRIKIAIGKANNEVDESQRATEEEIEKIVEYVKKVKKDRILVEDIQDIIENKLMEYKRFELAKAYITYRYSRALVRKANTTDQTVKELVEGNSEYWNNENSNKNARVVTTQRDYLAGITSTDITRRLLLPPEIVKAHDEGIIHFHDADYFAQNALTNCCLINLNDMLQNGTVINGVMIEKPHRFVTACTIATQIILGVSSSQYGGCTVTLTHLAPFVRDSYNRALKKYQDRNLPEEECKKFAMQDTKKEIADGVQTFNYQVNSMTNTNGQAPFLSVNMYLGETDEYKDELAMIIEEFLRQRMLGFKNEKGVYITPAFPKLLYVLEEDNIHKDSKYWYLTELAAKCTAKRMVPDYISEKMMKKLKINQYGEGDCYPCMGCRSFLTPDRVKGNVAKAKDYVEGKGKYYGRFNQGVVTINLPDVALSSKKDEKEFWKIFDERLELCHEALQLRHKRLSGITSDVAPLLWQYGAYARLDKGEKLDKLLHGGYSTLSLGYAGLYECVKYMTGDSHTDGGKGEKFALEVMQHMNDKCAEWKKAEDIDYSLYGTPIESTTYKFAKCLKKRFGTVEGVTDRNYITNSYHVPVFEEIDAFSKLKLESEFQRLSPGGAISYVETPNLQNNIEVVEQIIEFIYNNIMYAELNTKSDYCQKCGYTGEILIDDNLEWYCPNCGNRDHRTLNVARRTCGYIGTNFWNKGRTQEIKERVLHIDNKDFDAEKCTKCDENVEKHEKKTRAKVSAKEKAMASVHA

SEQ ID NO: 926 - protein, 1231 aa, unidentified
  REGION 1..1231: note = Description of Unknown:uncultivated organism sequence
  REGION 1..1231: note = Category: MG60 effectors
  REGION 1..1231: note = Description: MG60-137 effector
MSLKIEDLETFKRHRYAVSESLSTDIVGRDREIEEISSKIDSVYCLTITGPAGVGKSRLAVAAIEHYCANHTDFEVLCTKSFSDYISALDEAIEEGRKYVIFIDDANTYPSLIELLEFLKYRNQEGNIKAILTVRDYLKGCLDSDIYMEFYEVKPLNDKSIEDALVKNTTIRNEDWLKQIAKIANGNIRVAFLAANEAIKNNKSLDSIYNQKDVLNRFYKDEISKIDHSESLLITAGIIAFFKSIYLEQLFYIVPILKSVNLSKKSFIENVNILIKMEIVDNYHDVVKIADQCFADFLLNYTIVEKRYLKIKDLLLVGFKYYKERIVESIHTILHVYNTEEFVDHLRKEVTDACNNLEDDVSLKHGIESCFAQVIPEYVSREYIEGVEKYSDQKDIKWLINVFSGLAFSNYNEIANKGVLKLLKKTKNKTKEVYDAIKNTYEMRAERANERFQYQIALIKELQNGGLYNDEFNALVSSYLNFRFSYSCFTSKREMMHYTFSVDDNTAGILELRSACWGYLFNCELSKAIDSIMDFANRHYIERNLEIIKNDLRCINTYLCEHDQSGFLNSVLYVKFIDEAKEYCFTDLLTANKKYLDFLDIVFERKLLGKNYEGYEARYKNRVTDYYNLHKDDIYDILNETDLFLNKYYKYQKTRLVNALVEVVDKFSNALFFLCTKNGIFPHLVIEEFLKNRNLDEVYALINQIDDETIKDEYLYNFYSYLSKENIEKDYGFIGWINSKGDFKTNRTYHRDAVSLNNIAEKCGLDYVALLKKLYSKEKYNKFIAKAYLSYLIDNVETFKELLSLNQNLAIKIYEFLIANGEKDYESSVLIEILDVKRSYIKVFAKAFIKEEYYNDCNLDFIFEKEYCDSFFNECMKVMLSQKTNSASSKLRILISKNINQPNMERWIEKYIESNYKEDNVIELFFQALSEIDHQHKNAYLVLYYQKGHDINVLRQAILNKSHSYSNAKEHFGNEIKWLETLKKSLLNWNNTEEVKFIDTVIDDYKVQIKNDEIESLVDYGNQNILNELRERDLKMEVSLKDAFELYQSDEKFRDMLSSGYLSYKDGSFVNGKNDPVEFIEKLKDKKIISVEIKPVDEVGRLDYEQYLSSMKSIAKEFDNPKLASLNDYLNALIDERGWKAQEFKENTFLSRDIFSKIRNNKKNKMDKKTLVQILIGLQVSKRERDYLLELNQTSLSKYVKEDVLYSFILDAKLDIGVADELLRDIGEDGF

SEQ ID NO: 927 - protein, 768 aa, unidentified
  REGION 1..768: note = Description of Unknown:uncultivated organism sequence
  REGION 1..768: note = Category: MG60 effectors
  REGION 1..768: note = Description: MG60-140 effector
MFCSCKKNLRVVIYIYNATKTYDCAKKLIVYKSIIKGAEVMKIIKRNGAEETFDRQKIKDAISKANNETDGTPELTDRQIDYISLVIEDHCNEMNRALSVEEIQELVETHIILQGAPETAKRYIRYRFTRNLARASNTTDNQILSLIECNNEEVKQENSNKNPTVNSVQRDYMAGEVSKDLTKRILLPEDIVKAHEEGLIHFHDADYFAQHMHNCDLVNLEDMLQNGTVISGTMIEKPHSFSTACNIATQIIAQVASNQYGGQSISLAHLAPFVQISREKITRQVRAEMEEFGIAADDEQVKSLVEKRVRDEIKRGVQTIQYQVVTLLTTNGQAPFVTVFMYLNEAKNEQEKKDLAIIIEEVLKQRIKGTKNEVGVWVTPAFPKLIYVLEEDNITEDSRFWYLTKLAAECTAKRMVPDYISEKIMLKLKIDKNGNGNCYTCMGCRSFLTPYVDENGKPKYYGRFNQGVVTINLVDVACTAARDGNKSEEKFWQVLDERLELCHRALQCRHERLEGTLSDAAPILWQYGALARLKKGEPIDKLLHGGYSTLSLGYAGLWECVYEITGKKLTEKEGEEFGLRVMQRLNDACAEWKAAENIDYSIYGTPLESTTYKFAKCLQNRFGIIKGVTDRNYITNSYHIHVTEKIDAFSKLELESKFQKLSPGGAISYVEVPNMQQNIPAVLEVMKFIYNNIMYAELNTKSDYCQVCGYDGEIQIVEEDGKLVWRCPNCGNEDQSKMNVARRTCGYIGSQFWNQGRTQEIKERVLHL

SEQ ID NO: 928 - protein, 818 aa, unidentified
  REGION 1..818: note = Description of Unknown:uncultivated organism sequence
  REGION 1..818: note = Category: MG60 effectors
  REGION 1..818: note = Description: MG60-141 effector
MKDYEITDKEGYAKQGLENYVKDWKIFIDTCSILHPAAEKFWVHVIPYLDEYKNKIIIPFRSVEELEKHAKNTERPKLAEDAKNSLKKVKQLVAAGYVEIRGEKTDNFADNVFQVVFTKFRLNHKMLLITQDNGLARDIYALNGSKSVKAYPVHVKQINQYGYLSNFQWGDENGHAEKNELRRSTGAAASKPSTAPKSAPKSVTVTETEADIDDDDAFEVCTAVTKISDAPLGVSHVPKENETVYAGSAPVKLMRALAAGGEGVIYQTNTPYVAKIYKKEKLTKRRYEKIKRMLSHSFSCEGICYPIAALYNSKKEFVGYLMPKAKGKELQKSIFIKPLFLKNFPNWKKRDTVELCITILKKIQYLHDKNIIMGDINPSNILVVSPKEVYFVDTDSYQIEDFPCPVGTVNYTAPEIQRKHFANFLRTEGNENFAVATLLFMIMLPGKPPYSQQGGEDPIDNIIKMDFSYPFGDNTNRKTPDGPWRYIWSHLTYDLKKAFYNTFRGDGEHASESTRLSADEWLPIFTYYLELLDSGKFGKQDPMSEELFPTRHKKNPKAEYVTCKLCGNEVEEHQCQNGICRPCLNRGEVYRCARCGREIMYTNYQKYIKNAKKHDVCPECFRYRREIRMRPTCIDCGTQFAISNSEYEFLKSKGFEVPKRCKACRERKKNQSQTPIPLPFHRPTMTRVPTVPSRPTPTPTPKPKPKGGTFCFITTAVCEYYGKDDRCAELNALRNFRDTWLTHQPDGPALIAEYYRSAPLLVSKMKQSEHFGAYCQTLWEDYLKPCLAYIRENAYEACKQRYIDMVHYMESEFKTKTI

SEQ ID NO: 929 - protein, 832 aa, unidentified
  REGION 1..832: note = Description of Unknown:uncultivated organism sequence
  REGION 1..832: note = Category: MG60 effectors
  REGION 1..832: note = Description: MG60-142 effector
MSLSFFATCPKGLENLLLRELVTLGACEVKETVAGVSFKGDFTLGMRVCLWTRLASRVLLEISEFYAGTDTDLYLGALAVDYEKYFEVSNTIAVSFKGTSEAIRNTQYGALKIKDAVCDYFLKRNGIRPNVDKDNPDILITCHLDRKDNAHLLFDLSGNALHMRDFNRHTGMAPLKENLACAMLLRSGYNGSNLVDPMCGSGTLLLEAAAMATDTAPGICRDHYGFLQLKLCDRSAYTSLVEEMHKRSREGMLKFKQSGYKLFGFDADERIIDIALENAKKSGFADIIRFQVQSVETLVNPFDDLNDETQNKNAPSLFVITNPPYGQRMGNFNELISLYTKLGAVFKEQFRGAVCAVISSSEDLLSCLRLHADKIYKLYNGELLCQLRIFSIRQGEEGSESLSKDNLATDFANRLRKNLLKMNKWAKTLGLEAYRVYDADVPEYAAAIDYYKGYYVISTYKAQNKVSEKIEKRHELDMLGATIEVTGVSGSKVILKSREVKKGNSQYERLREDNSALIEIREGPFAFKVNLYDYLDTGLFLDGRLIRQYLYEHASNCSVLNLFAYTCSASVAAALGGASLITSVDMSKTYLEWGYENLLLNQIEAHSHEFIQADVLAFVSKDPEHKYDLIYVDPPTFSNSKRMQNTFDVRRDHLQLLGNLTRFLRDGGEVVFCTNLRSFRIDERLDEFGYSVTDLSSKTLPFDFKRNEHIHHCYSLIYHEKERRCEPVAFVSSNVNPKWSKVLHGIKKTNEQEIIPKNKSVNGRPSRASTTVRFNASGMTEIHTDGNRDTSAFRHNNKRNFKSSKLRPAALRPKSSAKPRVFGPEGVKEGVQ

SEQ ID NO: 930 - protein, 1179 aa, unidentified
  REGION 1..1179: note = Description of Unknown:uncultivated organism sequence
  REGION 1..1179: note = Category: MG60 effectors
  REGION 1..1179: note = Description: MG60-143 effector
MINLESFKNLYEVRKTVRFSLLKQNYDDVFKCEENVLKDISFLNTLVWYEWQIIKIQKKEDWKLLQDLLSKDIFEDVIKNAFQILKNQICTVIYNKVVFDTKKSEQKQRYKIYLKTATWKELSAFIPTDYDKNSDYIPEENFYKVKDSEIWYAIKIVSKLIIDNDFIKKDTELHNRLSQINRYNPNFWNFFELNTLNPFTVNRWKISEIINSYEISLNQYKETLVNLNKEAYTIANAILSDRYFENCRNQKESDGTVRYLFHIFSNCKNSSEKNVWQINHLILLVNKYESLKNGKKKYTNDEIELKIKRLNKELRQLAKVRSELLWYQIHLIDNFQTEKFSFLIQSWKYYFVWMKKMWWENNLSQFQEFIDGLESGDDKLLYLDSMTWGGFKRLFLSKQSDVVFTDGIRIKDLNRTILAKEEEILQLKKWIIEKIEKDINIYISKVTNDIFNEINSKEKIKFIEYLSQKWKKVDNLFKLWKKNRKQLIYGKELKEFGNSLYNFDSIKEQFNLDKLEKEYSDLVQKLLIKIKDKKYEIWKNNFKSLSFLWDNFKDRKFENLDDLKNYFNDSWYKVIVKNVNLEKILKQVKAWELEIFQIKSKDMPFHQDFINDKNCWIIEGVKTEKGGSFKKDLNTLYFEQFFQDIAEWNKNTRIGADFKIRWINSSENNDYKSFWKKEKNQLRHSNNKENIEKFKNRFKRDRYSIEFSINLNATNHLTEEDFNTKISNKLKEKRETWSLRILSLDHGESSFLTYKIYQVEGNKYSIINQWWNFDNFKEVQDWEDKTTKRQENMQIDEEKVLYKDQKILDSYITKYHAMIQDQKRERQVEEAIKHFARKSISKIKEIISADTIDKNKEWVSDTTKANVKKFIQRSIDKTWNKEKDSIVSVLGKFYFDYNKYSFKKYFPDQENIKEKIDTYLKEIQELLDDESKLIAFCNEVKKSFDWVSLADIDKLYNTPFYSYKTNFSLQLEQINNLKKWYVSALIGTISKWVRNWDVDVIALENNLLYYGVDNSKSFQKHMWAENHATFAEALINKLSFCLDKETSESYQFCYPIKVKDRKKLKDKNNGILFFVDQDTTSLICPQCEGKLKRDKADWEDYLYHNDENLAWDGCEEDPFEIKKSEGKKWEYNWIIFENWDDLATYNIGRKGVLMLEKIKENPEETDLLIRDNDWDGLVK

SEQ ID NO: 931 - protein, 750 aa, unidentified
  REGION 1..750: note = Description of Unknown:uncultivated organism sequence
  REGION 1..750: note = Category: MG60 effectors
  REGION 1..750: note = Description: MG60-144 effector
MIGILRLNLPLNWKREAIAVPEEAKTHVHVIKRNGEEVTFDLSKIENAIKAANNEVDKLHQLNEYQVHAIADNLEKQIESMSHAVHVEDIQDMVETGIMEMRGYEVAQKYVRYRYKRELARKSNTTDNGILALIDHMNEEVNQENSNKNPVINSTQRDYMAGEVSKDLTKRMLLPEDIVEAHEAGIIHFHDSDYYAQKEHNCDLINLEDMLQNGTVISETMIEKPHSFFTACNVTTQIVAQVASNQYGGQTFTLSHLAPFVDVSRKKLRAQVIEERKDCGESLDDAIIDKITEKRLLNEVKSGIQTIQYQLITLMTCNGQAPFVTMFMYLDEVPEGQTRDDLALIIEEVLNQRIKGVKNEKGIWITPAFPKLIYVLDEDNITTDSKYWYLTELAAKCTAKRMVPDYISAKVMREMKDGDVYPCMGCRSFPTKEDGIRNPDGSRKYYGRFNQGVVTINLVDVACSSYGDMDKFWKILDERLELCHKALRCRHERLLGTISDVAPILWQHGALARLKKGEKIDKLLFGGYSTISLGYAGLCEMCVRMIGKTHTSEEGKKFALAVMQKLNDKCAEWKAAENISYSVYGTPMESTTYKFAKNLQKRFGIIPGVTDKNYITNSYHVHVTEHIDAFSKLKFESEFQKLSPGGAISYVEVPNLQNNIDAVLEVMKFIYDNILYAELNTKSDYCEKCGYDGEIKIVTDDYGKLVWECPNCGNRDQNTLFVARRTCGYIGTQFWNQGRTQEIKDRVLHL

SEQ ID NO: 932 - protein, 750 aa, unidentified
  REGION 1..750: note = Description of Unknown:uncultivated organism sequence
  REGION 1..750: note = Category: MG60 effectors
  REGION 1..750: note = Description: MG60-145 effector
MIGILRLNLPLNWKREAIAVPEEAKTHVHVIKRNGEEVTFDLSKIENAIKAANNEVDKLHQLNEYQVHAIADNLEKQIESMSHAVHVEDIQDMVETGIMEMRGYEVAQKYVRYRYKRELARKSNTTDNGILALIDHMNEEVNQENSNKNPVINSTQRDYMAGEVSKDLTKRMLLPEDIVEAHEAGIIHFHDSDYYAQKEHNCDLINLEDMLQNGTVISETMIEKPHSFFTACNVTTQIVAQVASNQYGGQTFTLSHLAPFVDVSRKKLRAQVIEERKDCGESLDDAIIDKITEKRLLTEVKSGIQTIQYQLITLMTCNGQAPFVTMFMYLDEVPEGQTRDDLALIIEEVLNQRIKGVKNEKGIWITPAFPKLIYVLDEDNITTDSKYWYLTELAAKCTAKRMVPDYISAKVMREMKDGDVYPCMGCRSFPTKEDGIRNPDGSRKYYGRFNQGVVTINLVDVACSSYGDTDKFWKILDERLELCHKALRCRHERLLGTISDVAPILWQHGALARLKKGEKIDKLLFGGYSTISLGYAGLCEMCVRMIGKTHTSEEGKKFALAVMQKLNDKCAEWKAAENISYSVYGTPMESTTYKFAKNLQKRFGIIPGVTDKNYITNSYHVHVTEHIDAFSKLKFESEFQKLSPGGAISYVEVPNLQNNIDAVLEVMKFIYDNILYAELNTKSDYCEKCGYDGEIKIVTDDYGKLVWECPNCGNRDQNTLFVARRTCGYIGTQFWNQGRTQEIKDRVLHL

SEQ ID NO: 933 - protein, 768 aa, unidentified
  REGION 1..768: note = Description of Unknown:uncultivated organism sequence
  REGION 1..768: note = Category: MG60 effectors
  REGION 1..768: note = Description: MG60-146 effector
MFCSCKKKLCVVIYIYNATKTYDCAKKLIVYKSIIKGAEVMKIIKRNGAEETFDRQKIKDAIAKANNETDGTPELTDRQIDYISLVIEDHCNEMNRALSVEEIQELVETHIILQGAPETAKRYIRYRFTRNLARASNTTDNQILSLIECNNEEVKQENSNKNPTVNSVQRDYMAGEVSKDLTKRILLPEDIVKAHEEGLIHFHDADYFAQHMHNCDLVNLEDMLQNGTVISGTMIEKPHSFSTACNIATQIIAQVASNQYGGQSISLAHLAPFVQISREKITRQVRAEMEEFGIAADDEQVKSLVEKRVRDEIKRGVQTIQYQVVTLLTTNGQAPFVTVFMYLNEAKNEQEKKDLAIIIEEVLKQRIKGTKNEVGVWVTPAFPKLIYVLEEDNITEDSRFWYLTKLAAECTAKRMVPDYISEKIMLKLKIDKNGNGNCYTCMGCRSFLTPYVDENGKPKYYGRFNQGVVTINLVDVACTAARDGNKSEEKFWQVLDERLELCHRALQCRHERLEGTLSDAAPILWQYGALARLKKGEPIDKLLHGGYSTLSLGYAGLWECVYEITGKKLTEKEGEEFGLRVMQRLNDACAEWKAAENIDYSIYGTPLESTTYKFAKCLQNRFGIIKGVTDRNYITNSYHIHVTEKIDAFSKLELESKFQKLSPGGAISYVEVPNMQQNIPAVLEVMKFIYNNIMYAELNTKSDYCQVCGYDGEIQIVEEDGKLVWRCPNCGNEDQSKMNVARRTCGYIGSQFWNQGRTQEIKERVLHL

SEQ ID NO: 934 - protein, 768 aa, unidentified
  REGION 1..768: note = Description of Unknown:uncultivated organism sequence
  REGION 1..768: note = Category: MG60 effectors
  REGION 1..768: note = Description: MG60-147 effector
MFCYCKKKLCVVIYIYNATKTYDCAKKLIVYKSIIKGAEVMKIIKRNGAEETFDRQKIKDAIAKANNETDGTPELTDRQIDYISLVIEDHCNEMNRALSVEEIQELVETHIILQGAPETAKRYIRYRFTRNLARASNTTDNQILSLIECNNEEVKQENSNKNPTVNSVQRDYMAGEVSKDLTKRILLPEDIVKAHEEGLIHFHDADYFAQHMHNCDLVNLEDMLQNGTVISGTMIEKPHSFSTACNIATQIIAQVASNQYGGQSISLAHLAPFVQISREKITRQVRAEMEEFGIDADDEQVKSLVEKRVRDEIKRGVQTIQYQVVTLLTTNGQAPFVTVFMYLNEAKNEQEKKDLAIIIEEVLKQRIKGTKNEVGVWVTPAFPKLIYVLEEDNITEDSRFWYLTKLAAECTAKRMVPDYISEKIMLKLKIDKNGNGNCYTCMGCRSFLTPYVDENGKPKYYGRFNQGVVTINLVDVACTAARDGSKSEEKFWQVLDERLELCHRALQCRHERLEGTLSDAAPILWQYGALARLKKGEPIDKLLHGGYSTLSLGYAGLWECVYEITGKKLTEKEGEEFGLRVMQRLNDACAEWKAAENIDYSIYGTPLESTTYKFAKCLQNRFGIIKGVTDRNYITNSYHIHVTEKIDAFSKLELESKFQKLSPGGAISYVEVPNMQQNIPAVLEVMKFIYNNIMYAELNTKSDYCQVCGYDGEIQIVEEDGKLVWRCPNCGNEDQSKMNVARRTCGYIGTQFWNQGRTQEIKERVLHL

SEQ ID NO: 935 - protein, 816 aa, unidentified
  REGION 1..816: note = Description of Unknown:uncultivated organism sequence
  REGION 1..816: note = Category: MG60 effectors
  REGION 1..816: note = Description: MG60-148 effector
MQTNKQLNLAFDFVQYTGQNIFLTGKAGTGKTTFLKSLKEKSPKRMIVVAPTGVAAINAGGVTIHSFFQLSFAPQIGLENVQEKQNRFNKEKINIIRSLDLLVIDEISMVRADILDAIDRVLRRFRNRNRPFGGVQVLMIGDLQQLAPVVKNDEWNLLKREYETVYFFSSKALRETSYVSIELTHVFRQQDDKFIAILNKVRNNQLDQNALEALNNRFIPNFEPDDSEGFITLCTHNLHAHRINEAKLIQLKTNKQLFTAEVEGKFPEYSYPTEFKLEVKVGAQVMFVKNDPEPEKLFYNGKIGQVTRINQDIIYVICPDEEEEIAVTQLLWENVKYTIDKNSAEISESVEGSFYQYPLKLAWAITIHKSQGLTFERAIIDAEASFAHGQVYVALSRCKTLEGMVLSSQISNRSIINDGTVSGFIQNVEENQPGDKELNDSKLAYQKDLLIDVFRFENVKMQVNIISKLLRENSSAIPEVVTEHIRKIKSAVYSDLVDVSEKFRNQITQLLSVQPDIEQNQKLLERVSKAADYFSEKVKAILIDDFAKADLDVDNRTLRKQLKNSSGRLTEETELKLASFEICRTGFNVKQLLDTRAKTLIENNKPAPKKQKAKEIINLESIPHPELYNTLREWRLEKASELEKPAFFVFSQKTLIEMVNYLPVETATLKLINGFGSRKIEQFGADIIQIIQNYCDENNVQRMEIPLKEVKEKKPKIDTKKASFELYQSGKTVAEVAKERALTTSTIENHLAHYVKLGELDISKLISKEKLKIITDYFEKAESKSFGDAKAALGDNVSYGELRMGLSYLESLNEKK

SEQ ID NO: 936 - protein, 768 aa, unidentified
  REGION 1..768: note = Description of Unknown:uncultivated organism sequence
  REGION 1..768: note = Category: MG60 effectors
  REGION 1..768: note = Description: MG60-149 effector
MFCSCKKNLCVVIYIYDATKTYDCAKKLIVYKSIIKGAEVMKIIKRNGAEETFDRQKIKDAIAKANNETDGTPELTDRQIDYISLVIEDHCNEMNRALSVEEIQELVETHIILQGAPETAKRYIRYRFTRNLARASNTTDNQILSLIECNNEEVKQENSNKNPTVNSVQRDYMAGEVSKDLTKRILLPEDIVKAHEEGLIHFHDADYFAQHMHNCDLVNLEDMLQNGTVISGTMIEKPHSFSTACNIATQIIAQVASNQYGGQSISLAHLAPFVQISREKITRQVRAEMEEFGIDADDEQVKSLVEKRVRDEIKRGVQTIQYQVVTLLTTNGQAPFVTVFMYLNEAKNEQEKKDLAIIIEEVLKQRIKGTKNEVGVWVTPAFPKLIYVLEEDNITEDSRFWYLTKLAAECTAKRMVPDYISEKIMLELKIDKNGNGNCYTCMGCRSFLTPYVDENGKPKYYGRFNQGVVTINLVDVACTAARDGNKSEEKFWQVLDERLELCHRALQCRHERLEGTLSDAAPILWQYGALARLKKGEPIDKLLHGGYSTLSLGYAGLWECVYEITGKKLTEKEGEEFGLRVMQRLNDACAEWKAAENIDYSIYGTPLESTTYKFAKCLQNRFGIIKGVTDRNYITNSYHIHVTEKIDAFSKLELESKFQKLSPGGAISYVEVPNMQQNIPAVLEVMKFIYNNIMYAELNTKSDYCQVCGYDGEIQIVEEDGKLVWRCPNCGNEDQSKMNVARRTCGYIGSQFWNQGRTQEIKERVLHL

SEQ ID NO: 937 - protein, 768 aa, unidentified
  REGION 1..768: note = Description of Unknown:uncultivated organism sequence
  REGION 1..768: note = Category: MG60 effectors
  REGION 1..768: note = Description: MG60-150 effector
MFCSCKKNLRVVIYIYDATKTYDCAKKLIVYKSIIKGAEVMKIIKRNGAEETFDRQKIKDAIAKANNETDGTPELTDRQIDYISLVIEDHCNEMNRALSVEEIQELVETHIILQGAPETAKRYIRYRFTRNLARASNTTDNQILSLIECNNEEVKQENSNKNPTVNSVQRDYMAGEVSKDLTKRILLPEDIVKAHEEGLIHFHDADYFAQHMHNCDLVNLEDMLQNGTVISGTMIEKPHSFSTACNIATQIIAQVASNQYGGQSISLAHLAPFVQISREKITRQVRAEMEEFGIAADDEQVKSLVEKRVRDEIKRGVQTIQYQVVTLLTTNGQAPFVTVFMYLNEAKNEQEKKDLAIIIEEVLKQRIKGTKNEVGVWVTPAFPKLIYVLEEDNITEDSRFWYLTKLAAECTAKRMVPDYISEKIMLKLKIDKNGNGNCYTCMGCRSFLTPYVDENGKPKYYGRFNQGVVTINLVDVACTAARDGSKNEEKFWQVLDERLELCHRALQCRHERLEGTLSDAAPILWQYGALARLKKGEPIDKLLHGGYSTLSLGYAGLWECVYEITGKKLTEKEGEEFGLRVMQRLNDACAEWKAAENIDYSIYGTPLESTTYKFAKCLQNRFGIIKGVTDRNYITNSYHIHVTEKIDAFSKLELESKFQKLSPGGAISYVEVPNMQQNIPAVLEVMKFIYNNIMYAELNTKSDYCQVCGYDGEIQIVEEDGKLVWRCPNCGNEDQSKMNVARRTCGYIGSQFWNQGRTQEIKERVLHL

SEQ ID NO: 938 - protein, 844 aa, unidentified
  REGION 1..844: note = Description of Unknown:uncultivated organism sequence
  REGION 1..844: note = Category: MG60 effectors
  REGION 1..844: note = Description: MG60-151 effector
MPLDERIARLKKKLLTSPYEVCMARAYHFTQAYKETEGLDPAMRNALALKKTLENQKIFIYPDEFLAGSKTEKFLAGPLSVERGDFLRTLQMEMDILHLKQRPFLITEEEKKLFREVILPYWDGKTLRDHKAKEWEKKGLIDRKQGFFKRLFRMIKFMRYVGRENLRKIAGANRKAPLTFRRLKNLHALRYELACNNPSPAVFCFDVQGHLSLGVNKVIENGMDGIIKKAEDRLKRLEVEEPYNEKKKNFLKAVIISLESAIRYSERFAKLAEEMAKKTEDEKEKSRLLLIAKHCRHVPRYKPRTFHEALQSAWITHLVGEIQYGTHEVFAPGRIDQFLYPFYENDIRSGRITRDEAKALIQEFLIKLESNVEPIPEVGMETNAVLGNSQHVVTIGGLKRDGEDGTNELSYLILEAYEEMGGAVNQLAVRISKKTPFDFLKRACAVFRKANGIAFYNDEAIIEGLLADGMSIEDARDYCIVGCIETSGQSNTHGCVGGHELVLPVVLMQTLTRGKEPPPFIGQKEGIDCGDPSSFKTFEDFISAFKKQLAHQIKILVEATEGKDKAYREILPAPYVSALMDDCIEKAMDVTEGGARYDFTSIDVRGLATLVDSLLAIKRFVYEKKELSLTEFIKIIRNNFKGHEVLRQRIINEAPKFGRGDREADEMAKNVLHWIYEISQRYRNIRGGRFRVCYYSYGNHVIDGFMLGATPDGRLKGEPISNGVSPVNMGDFSCGPMGPMRSVAKFPPREISSGIALNMRFHPSFIKTQEGLITFAKMIKTYFEMGGMHIQPNVVSSETLRDAQKNPERYRDLIVKVSGYSAYFTDLGKSIQEDIISRYEFCRS

SEQ ID NO: 939 - protein, 1216 aa, unidentified
  REGION 1..1216: note = Description of Unknown:uncultivated organism sequence
  REGION 1..1216: note = Category: MG60 effectors
  REGION 1..1216: note = Description: MG60-152 effector
MKRSFILFLLFILIVAIFVLPSLFTSSPKVQHLLKDTVSRELKAKVNYSDITWYWFPLPHLAFREAKVESPNFILYGSNAEIYPDWLSMLHGRFGVAGISLDDFHLLIKKISNDQDTSPNLPRWIKVRNGFIEISKNVSLPFPFPFKDRRPYIKKLYGKIGIDGPSVRLDLKGNTRQAQLIELKGNADLHQLTYSLKGHLRQFDLSALKINKLTKVKQFPHYGFINLDFSVSGNGVERSEGHIKAYSNCFVSGKSKKRVSAIFSCGSLELRYKYADGEANVVLESLDFKHPRLHLTGTLHFWKKDGLPWLKVDAKGRRLDLAEIRKVLLALSIRDKDVDDYCNVIRAGTVNWARVHLDAPASKWHSLSDMYIEGRAEDVKVYVKDEDFFVDSVSGPFEIVDGVLHVKEGLARLRNTKGSSGRLIFGLSKGREQFKLDIVLSAPPEDVKWALMKFTHEDTLHRELKRLSKLSGRIVGRLIIGDKKHDKKVKVQVQEARLSAFYKTLGAKVSIVQAHARYFDDTFSVSNFSGGVGPNFFKDVSAKVSWKDGHFKIKVNRGMGSVLAESILDFCNRFNLGQEFIDKYHVSASGRFRVKRLNLFFDAKVPSSFSYLVAGSPLGVSVETSLLPHKVFLKGGKLLVSTDKVSASRLKLSMAGSRFAIGLDLDHNHFHRWSGSVKVSGPIRRNLWKWLEKKGVELDEFTPRVPFFVRDFKLRFTKGEPREFVGTLYWKDDGISLFINARKSKGLFDLKRLSINAAGKRAELSFLKALGIKKRFSLGFKGELLGDTLDSILVENNMLDGRLQGDFSFGFSAHEKKAYSIDGRIHIEGFRWIWGLNDNLRFKKLDIEANKSHRGNISGLIRLFDDKIGINGTFKNGVGRLVCSLNLSAPVLSSQTISFIQKMSEAQKGTDAGTSSLSDQEQAKLFRELAKRLDLKIGFKVKEARYAVTDFSKEKKQGSHEVVLKNLKGNAEVQKSRLKRLEAFSDDTCGLDVYLKKERIGDRVISEFSVITPKGRQALFEQVLDCLGVEQDLITGPVTFNLYLRGGERVLLGNGNLGIKAKDGYIHRFGLISKIFSVVNIVDIFSLNKGLLEGTSPYKKMLIDAKIASGRVHLEKAYIKGSGINFYGTGDVYLDSKMLDLIIFVQPLKTVDTIITSLPIIGGIIGGKNKSLFAIPVKVSGDWNDPKVDTLQTKTVTDIFKKLIFNVLTAPFSLGH

SEQ ID NO: 940 - protein, 813 aa, unidentified
  REGION 1..813: note = Description of Unknown:uncultivated organism sequence
  REGION 1..813: note = Category: MG60 effectors
  REGION 1..813: note = Description: MG60-153 effector
MQTNKQLDLAFDFVQFTGQNIFLTGKAGTGKTTFLKSLKEKSPKRMIVVAPTGVAAINAGGVTIHSFFQLSFAPQIGLENVQEKQNRFNKEKINIIRSLDLLVIDEISMVRADILDAIDRVLRRFRNRNRPFGGVQVLMIGDLQQLAPVIKNDEWNLLKREYETVYFFSSKALRETSYVSIELTHVFRQQDDKFIAILNKVRNNQLDQNALESLNERYIPNFKPDDSEGFITLCTHNLHAHRINEAKLIQLKTNKQLFTAKVEGKFPEYSYPTEFKLEVKVGAQVMFVKNDPEPEKLFYNGKIGQVTRINQDIIYVICPDEEEEIAVTQLLWENVKYTIDKKTAEISESVEGSFYQYPLKLAWAITIHKSQGLTFERAIIDAEASFAHGQVYVALSRCKTLEGMVLSSQISNRSIINDGTVSGFIQNVEENQPGDKELSDSKLAYQKDLLLDVFRFENIKMHVNIISKLLRENSSAIPEVVTEHIRKIKSAVYSDLVDVSEKFQNQITHLLSAQPDIEQNPKLLERVSKAAGYFSEKVKAILIDNFSKADLDVDNRTLRKQLKNSSGRLTEETELKLASFEICKAGFQVKQLLDTRAKTLIDNNKPTSKKQKAKEIINLESIPHPELYNTLRAWRLEKASELEKPAFFVFSQKTLIEMVNYLPVETATLKLINGFGSRKIEQFGADIIQIIQKYCDENNVQRMEIPLKEVVEKKPKIDTKKLSFELYQAGKIVAEIAKERALTTNTIENHLAHYVKLGELDISKLISKEKLKIITDYFEKAESKSFGEAKTALGEQVSYGELRMGLSYFESRE

SEQ ID NO: 941 - protein, 750 aa, unidentified
  REGION 1..750: note = Description of Unknown:uncultivated organism sequence
  REGION 1..750: note = Category: MG60 effectors
  REGION 1..750: note = Description: MG60-154 effector
MVKKFLSKGAYHYQNDFFNDKIGFVILGGNMMRVIKRNGHTVDFDATKIENAILKAMKCGSGIIDEQCAKDIAREIEEWHRYSDGDISIYRIEGQVFEKLIEKGQILTAKAYEGYRKVREFQRETNTIDNEIYGIVNQTNKEAMEENSNKDATVLATQRDLIAGEFSKDYCRRLLLPPKIVQAHDDGIIHFHDMDYYIQKMHNCDLVNLKDMFAQGTVINDKLIETPKSLQTACTVATQIVQQVANGQYGGQTISLAHLSPYVRISYEKHKKNVINEGKMIGIDYSDEQIEKIAKSRLKDEIKAGIQTIQYQINTFSTTNGQAPFLSVFMYLKEEPEYIEETAMLIEETLRQRYVGMKNPVGAYVTPAFPKLLYVLDDNNVPQDSKYRYLTDLAVKCVAKRMMPDFISAKIMRENYEGQVFPCMGCRSFLSPWKDENGEYKWYGRFNQGVVTLNLADAGLSADHNLDNFWKILDERLELCKEALLLRHESLKGTIADVSPIHWRYGALARLKSGEKIDKLLENGYSTISLGYIGLYECVVALIGQTHTSKEGNELATKIMERLREACDSWKEETGLGFGLYGTPAESTTYTFARALKKRFGIVPGVTDKDYLTNSYHVNVREHIDAFSKLEVEAKFQKLSSGGAISYVEVTNMSQNLDALSALIDYMYETIQYAEINTKSDYCQECGFDGEILLDENREWYCPNCGNRNHKTLNVCRRTCGYLGDNFWNQGRTQEIAERFVHLDNHLYGE

SEQ ID NO: 942 - protein, 768 aa, unidentified
  REGION 1..768: note = Description of Unknown:uncultivated organism sequence
  REGION 1..768: note = Category: MG60 effectors
  REGION 1..768: note = Description: MG60-155 effector
MFCSCKKNLRVVIYIYNATKTYDCAKKLIVYKSIIKGAEVMKIIKRNGAEETFDRQKIKDAISKANNETDGTPELTDRQIDYISLVIEDHCNEMNRALSVEEIQELVETHIILQGAPETAKRYIRYRFTRNLARASNTTDNQILSLIECNNEEVKQENSNKNPTVNSVQRDYMAGEVSKDLTKRILLPEDIVKAHEEGLIHFHDADYFAQHMHNCDLVNLEDMLQNGTVISGTMIEKPHSFSTACNIATQIIAQVASNQYGGQSISLAHLAPFVQISREKITRQVRAEMEEFGIAADDEQVKSLVEKRVRDEIKRGVQTIQYQVVTLLTTNGQAPFVTVFMYLNEAKNEQEKKDLAIIIEEVLKQRIKGTKNEVGVWVTPAFPKLIYVLEEDNITEDSRFWYLTKLAAECTAKRMVPDYISEKIMLKLKIDKNGNGNCYTCMGCRSFLTPYVDENGKPKYYGRFNQGVVTINLVDVACTAARDGNKSEEKFWQVLDERLELCHRALQCRHERLEGTLSDAAPILWQYGALARLKKGEPIDKLLHGGYSTLSLGYAGLWECVYEIKGKKLTEKEGEEFGLRVMQRLNDACAEWKAAENIDYSIYGTPLESTTYKFAKCLQNRFGIIKGVTDRNYITNSYHIHVTEKIDAFSKLELESKFQKLSPGGAISYVEVPNMQQNIPAVLEVMKFIYNNIMYAELNTKSDYCQVCGYDGEIQIVEEDGKLVWRCPNCGNEDQSKMNVARRTCGYIGSQFWNQGRTQEIKERVLHL

SEQ ID NO: 943 - protein, 769 aa, unidentified
  REGION 1..769: note = Description of Unknown:uncultivated organism sequence
  REGION 1..769: note = Category: MG60 effectors
  REGION 1..769: note = Description: MG60-156 effector
MKVIKRDGTIVEYDREKIRIAIEKANKEVSRKEKATDSEIEEIMSYIEDLKKGRILVEDIQDIIEEKLMEIKRYELAKKYITYRYTRALVRKANTTDQSIKELIEGESEYWNNENANKNARVVTTQRDYLAGITSTDITRRFLLPEDVVKAHDEGIIHFHDADYFAQNALTNCELINLEDMLQNGTIMNGVMIEKPHRFITACTIATQIILAVTSSTYGGATVSLAHLAPFVRSSYEKYYKKYKENGLSKEQCEKFAKEDTKKEVADGVQTFNYQVNSMTNTNGQAPFLSVCMYLGETDEYKEELAMIIEEFLNQRILGFKNEKGVYITPAFPKLLYVLEEDNIHENSKYWYLTELAAKCTAKRMVPDYISEKIMKQMKVDANGDGQCYPCMGCRSFLTPYIDPVTKKPKYYGRFNQGVVTINLVDVALSSGKDLKKFWKIYDERLELCHKALQVRHERLAKATSDIAPILWQHGAFARLPKGASIHPLLHGGYSTISLGYAGLYECVKYMTGKSHTDNGDGKDFAIEVMKKMNEKCAEWKEAEDIDYSVYGTPIESTTYKFAKCLQKRFGKIKGITDKNYITNSYHVPVFEEIDAFSKLKLESEFQRLSPGGAISYVETPNLQNNLEVVLQIMKFIYDNIMYAELNTKSDYCQKCGYTGEILIDDNLEWYCPNCGNRDHNTLNVARRTCGYIGSNFWNKGRTQEIKERVLHIDNKDDDCDCDECNCDHANTDTSKEEKSEEKQMNFMDYDVEEEITKSKKHMKQPAMV

SEQ ID NO: 944 - protein, 868 aa, unidentified
  REGION 1..868: note = Description of Unknown:uncultivated organism sequence
  REGION 1..868: note = Category: MG60 effectors
  REGION 1..868: note = Description: MG60-157 effector
MRVIPKDTKLRATVYKNFTIWDIFVAIGVIGIEVLIGFSNLPGKVWIMLVAGVIMAPLFFPTDDGGRFYQNIVSMIQFRFMKKAYVGAEIKRFVPYKEIRDDGIIVYPDYFARVISVGQTEFRLLDEGMQNTKIAYFERVLKLTDIGASMDIVKIDRPINFDAFSASLFERVEKEKNELKKAVLEDRISQIDRLNNETKQFRPYYYIVIYDAKEDSLKDNTDTAVQMLNQMGLDSVILGQKEVVNFLKYCHTRFFDEREIDNVEPKDYVDYIMPKKLKFAGRNYTVDDVKAFTMTISDYPLSVANAWGSEIFNIDNTKVVLKIRPVDRLKAVKRIDKVVMELGSREENIRKASELIAKESHVESMGATLMSLQNENEVLFDCSLTVTAFNNANEDQLSFRKSIRHRIIQEGFKINNLSSQQINGFLASNISQVRSLKRYERGINSSSLAAVFPFVETSIIDEPNGIILGCNSHPVALDITKRDGSHTNSNVLILGKPGSGKTYAVKSIITQLYADNWRIHVLDVENEFSTLAKNVGGMIIDVGSATQGRINPFHIYGLLTDDGKQASPENIFDAHLIALESFFKIILEGISSDALEYINNLVVKCYEKRGITKSTDCSKFTAAQFPTFDDLMKILQEQPREGINPLDLANLQRAETYVAKFASGGRYASLWNGPSTLTTSSQFTVFNFQSLLSNKNTVVANAQMLLVMRYLEQEVINARDQNRDGKNLIRTAIVAEEAHAFTDPKFPVALDFLYQMAKRIRKYAGALFFITQNLRDGRSTPEIEAKTTAIFNCCQYSFIFSLPPQDINDLVELYKSSGGINEAEQQEIVTNQQGTAFLISSATERTSFSIVTTGVVESLFIREDEKQL

SEQ ID NO: 945 - protein, 773 aa, unidentified
  REGION 1..773: note = Description of Unknown:uncultivated organism sequence
  REGION 1..773: note = Category: MG60 effectors
  REGION 1..773: note = Description: MG60-158 effector
MSAAYGITIFSVRRVDFACQSPTTGHRKGLTSMKIIKRNGSEAVFDIMKIITAVTKANNVVKEDEQLTPMQIRRIAESVENSCLGMNRALSVEEIQDLVEHQIMAHGAYEVAKQYITYRYTRSLVRKSNTTDEKILSLIESNNEEVKQENSNKNPTVNAVQRDYMAGEVSKDLTARMLLPKEIVDAHEAGIIHFHDADYFAQHMHNCDLVNLEDMLQNGTVISGTLIEKPHSFSTACNISTQIIAQIASNQYGGQSISLTHLAPFVDISRQKIRKTVLEEIRTLGAAPDEAAISKVVEDRLREEIRRGVQTIQYQVVTLMTTNGQAPFITVFMYLGEARNEQEKHDLAIIIEETLKQRIEGVKNEKGVWITPAFPKLIYVLEEDNIHEGTKYWELTKLAARCTAKRMVPDYISEKKMRELKLSKGETPGHGDVYTCMGCRSFLTPDRSGNGWNNIANAGNYEPGKPKYYGRFNQGVVTINLVDVALSSGGAVDKFWRIFDERLELCYEALMCRHNRLKGTLSDAAPILWQYGALARLGKGEPIDKLLYGGYSTISLGYAGLYECVKYMTGKSHTDPAATPFALEVMQHMNDKCAEWKQKENIDFSLYGTPLESTTYKFAKCLQKRFGIIEGITDKNYITNSYHIHVSEHINAFDKLAFESQFQALSPGGAISYVEVPNMQNNIDAVLQVMQFIYENIMYAELNTKSDYCQICGFDGEIEIKEDKDGKLVWTCPQCGNTDQSKMNVARRTCGYIGTQYWNQGRTQEIRDRVLHL

SEQ ID NO: 946 - protein, 756 aa, unidentified
  REGION 1..756: note = Description of Unknown:uncultivated organism sequence
  REGION 1..756: note = Category: MG60 effectors
  REGION 1..756: note = Description: MG60-159 effector
MSFYDRRTTWLTPCGFTYSKADPLRDKDTLSERTRTIMKIIKRNGSEAEFDKNKIIRAISKANITVDESIRLTGKQIDRIAESVVLSCERLGRSPGVEEVQDMVEHQIMAHGAFEVAKNYITYRYTHDLIRRSNTTDEKILSLIECNNEEAKQENSNKNPVINSTQRDYMAGEVSRDLTDRLLLPPDIVKAHEEGIIHFHDTDYFAQHMHNCDLVNLEDMLQNGTVVTGTMLERPHSFSTACNIATQIIAQVASNQYGGQSISLAHLAPFVQVSREKIRRSVIAESKDFEIPLNEEQITNIVERRLREEISRGVQTIQYQVLTLLTTNGQAPFVTVFMYLGEAKNEREKKDLAMIIEETLEQRYKGVKNETGVWVTPAFPKLIYVLEEDNITEDSEYWYLTKLAAKCTAKRLVPDYISEKKMKELKEGNCFPVMGCRSALSPWKDENGNYKFYGRFNQGVVTLNLVDIACSSGGNYDKFWKIFDERLDLCYRALMCRHNRLMGTLSDAAPILWQYGACARLKKGEPIDKLLVGGYSTISLGYAGLCECVRYMTGKSHTDPSATPFALEVMRHMNDACEKWKKETTIGFGLYGTPLESTTYKFAKCLQKRFGIIPGVTDKGYITNSYHVHVTEHIDAFEKLKFESQFQALSTGGAISYVEVPNMQQNLDAVLEIIKFIYDNIMYAELNTKSDYCQVCGYDGEIEIKERDGKLVWVCPNCGNDDQNKMNVARRTCGYIGTQFWNQGRTQEIKERVLHL

SEQ ID NO: 947 - protein, 753 aa, unidentified
  REGION 1..753: note = Description of Unknown:uncultivated organism sequence
  REGION 1..753: note = Category: MG60 effectors
  REGION 1..753: note = Description: MG60-160 effector
MLEIVKRDCSKTNFDKQKIFNAIMKAMKSGSGIVKSEIAEKIANEIEHEAKSMEEIDIYQIEAMVFQKLIENNQILTAKAYESYRSVREFQRNTTNSTDDVILELLAGQSEYWNEENSNKNAMLITTQRDYIAGIESEDISKRMLLTPEIVHAQENGIAHFHDIDYFAMKAMYNCCLINLEDMLQNGTVISNVLIEKPHSFSTACNVATQIIAQVASSQFGGQTISLSHLAPFVDISRQRIKKQVEKELINANLSSVEYHNLVDSIVAERLKEEIKKGVQTIQYQVVTLMTTNGQAPFLSVFMYLNEVKDKQTKHDLAMLIEEVLLQRIQGVKNEKGVWVTPAFPKLLYVLEEDNIHKDSPYYYLTELAAKCTAKRMVPDYISEKKMKEYKIDKNGKGQCFPAMGCRSFLSPYLDKNNQPKYYGRFNQGVVTINLADVALSALKEYEESKFNLHDTSVESIFWKVLDERLELCHRTLRLRHERLKGTVSDVAPILWQHGAIARLDKGEKIDKLLYNDYSTISLGYAALYECVKTITGHSLTDNGIGEKFGLQVMQRLTDKCNQWKEEENIGYSVYGTPLESTTYKFAKCLRKRFGVIEGITDRDYVTNSYHIPVFENINAFDKLLIESKFQKLSAGGAISYVEVPNLTDNIEIVIQIIQYIYEHIMYAELNTKSDYCHVCGYDKEIEIVTDENTGKLIWKCPQCGNTDQRKMSVTRRTCGYLGSNFWNQGRTQEIKERVLHIDDIDLNESENV

SEQ ID NO: 948 - protein, 1045 aa, unidentified
  REGION 1..1045: note = Description of Unknown:uncultivated organism sequence
  REGION 1..1045: note = Category: MG60 effectors
  REGION 1..1045: note = Description: MG60-161 effector
MIKVIKRDCSEIQFDKNKISKAILKAMKNGSGIIKPKIADDIANEIEQYCIDNQFDNIDISDIESIVYDKLISKKQRLTAKAYEGYRRIREFQRENVNTTDEEIEELLTGTSEYWMNENSNKDEKLVTTQRDYMAGIVSKDMSRRYLLTPEIVQAHDEGIIHFHDVDYFGQKTLHNCFSADTEFVTSCGVKKFSDFHDGDNVVVLDKDGMWRNATVKQFGKQEMYDVTFQSTRRTKTVTCTKNHRWILNDGSVTTNLKIGDSLIGLKDMLCTYKTETYDECNLFALGFLIGDGCDHNSANYYQVRLCGHKIEYADIFKKAGYKIDNIGDTNDLIAYKTGTIKQDFINSKAWKYMDRKSRALLFLGLYAADGTVNANKICTTDERIAEFIRDNSCLCGYHITSETTEIRDTNYKKDSKLIAFRFSKHQPMNQLWKVKSIVPHYNYHYENRGNKKEENAPINAWCVVEPITHSFTLSNGMVTGNCDLIDLEDMLQNGTVISGTLIEKPHSFSTACNIATQIIAQVASSQYGGQTITLSHLAPFVDVSRKKIREEVEEELNYINGGGIYKDQLSTIDEITESRLAKEVKKGVQTIQYQVVTLMTTNGQAPFLSVNMYLNEVKDEQTKADLALIIEEVLKQRIQGVKNEQGVWITPAFPKLLYVLEDDNIHEGDKYWYLTKLAAQCTAKRMVPDYISEKKMLEYKVDKNGNGNCYPCMGCRSFLTPYVDTNGKPKYYGRFNQGVVTINLPDIALSSNGDVETFWEIFDERTELCHKALQIRHKRLEGTPSDVAPILWRYGALARLKKGEVIDKLLHGGYSTLSLGYAGLYECVKFMTGNSHTDGDKGEKFGLEVMQALNDKCNKWKKEENIDYSLYGSPIESTTYKFAKCLKKRFGVIEGITDRDYITNSYHVPVFEKIDPFTKLSIESKFQKLSPGGAISYIECADLTHNTEAVLKVMQFIYDNIMYAELNTKSDYCQVCGYDGEIKIVDENNELIWECPNCGNRDKNKMNVARRTCGYIGSNFWNKGRTEEIAERYVHLDDHEHEVE

SEQ ID NO: 949 - protein, 921 aa, unidentified
  REGION 1..921: note = Description of Unknown:uncultivated organism sequence
  REGION 1..921: note = Category: MG60 effectors
  REGION 1..921: note = Description: MG60-162 effector
MKIVKRNGTEVEFDIKKIINAITKANETVEEKDKLSIEEIKNISDCVMVRVSQLPVDTNVEVIQDIVEEELDKHNASYTLKRNYMLYRYQHNELRKSNTIDKTILSLIKCENEDIKQENSNKNPVIISTQRDYMAGEVSKDLMRRYFIDPDLMKAHDEGLIHIHDMDYILQNCHNCDLINLEDMLNNGTVISGTAIDKPHSFSTACNIATQIIAQVASSQYGGQSITLSHLAPFVDVSRKAILKELKEEFPSIDEDKLKEVCHRRLLKEINKGVQIIQYQVVTLMTTNGQAPFITVFMYLNECKDEQTKNDLALIIEEVLKQRIIGVKNEKGVYITPAFPKLIYVLQEDNIEKGSKYYYLTELAAKCTAKRMVPDYISEKIMKEMKEGQVYPSMGAVVPESKVYWKIDGKAYYGPIEKMYHSMIDRYDDLEEDCQFGQEGNPNKDINLKDYNVEIYDNGAGKYVKCLMMNMNLASQFRMYKIRTYNPIDDTDINLVVTHDHPMMKLKSEFDPNLVTIDWNDPKDIDNKCEEIQAEYLKTGDYVFFTKEQRGIRTVEIVDQTIPKPVQILKVPIINNYDFVYDVTTETEHFMVNNLWSHNCRSFLTPWKDKNGKYKFYGRFNQGVCTINLIDVACSSGKNIDKFWKIFDERLDMCRRVLMIKHNRLLGTVSDVAPILWQNGALARLNKGEKIDKLLYGGYSTISLGYAGLYECVYYMTGKSHTDPSVKDFALSIMQHMNDICNKWKKETNIGFSVYGTPLESVTYKFAKCLKKRFGEIPEVTDHNYITNSYHCNVREHINAFDKLTMESEFQRLSPGGAISYVEVPNMQNNIPAVLQLLKHIYNTIMYAEINTKSDYCHECGYTGEIVIEENKDHKLIWKCPNCGNTDQTKMNVARRTCGYIGTNFWNQGRTQEIKDRVLHL

SEQ ID NO: 950 - protein, 768 aa, unidentified
  REGION 1..768: note = Description of Unknown:uncultivated organism sequence
  REGION 1..768: note = Category: MG60 effectors
  REGION 1..768: note = Description: MG60-163 effector
MFCSCKKNLCVVIYIYNATKTYDCVKKLIVYKSIIKGAEVMKIIKRNGAEETFDRQKIKDAIAKANNETDGTPELTDRQIDYISLVIEDHCNEMNRALSVEEIQELVETHIILQGAPETAKRYIRYRFTRNLARASNTTDNQILSLIECNNEEVKQENSNKNPIVNSVQRDYMAGEVSKDLTKRILLPEDIVKAHEEGLIHFHDADYFAQHMHNCDLVNLEDMLQNGTVISGTMIEKPHSFSTACNIATQIIAQVASNQYGGQSISLAHLAPFVQISREKITRQVRAEMEEFGIDADDEQVKSLVEKRVRDEIKRGVQTIQYQVVTLLTTNGQAPFVTVFMYLNEAKNEQEKKDLAIIIEEVLKQRIKGTKNEVGVWVTPAFPKLIYVLEEDNITEDSRFWYLTKLAAECTAKRMVPDYISEKIMLKLKIDKNGNGNCYTCMGCRSFLTPYVDENGKPKYYGRFNQGVVTINLVDVACTAARDGSKSEEKFWQVLDERLELCHRALQCRHERLEGTLSDAAPILWQYGALARLKKGEPIDKLLHGGYSTLSLGYAGLWECVYEITGKKLTEKEGEEFGLRVMQRLNDACAEWKAAENIDYSIYGTPLESTTYKFAKCLQNRFGIIKGVTDRNYITNSYHIHVTEKIDAFSKLELESKFQKLSPGGAISYVEVPNMQQNIPAVLEVMKFIYNNIMYAELNTKSDYCQVCGYDGEIQIVEEDGKLVWRCPNCGNEDQSKMNVARRTCGYIGSQFWNQGRTQEIKERVLHL

SEQ ID NO: 951 - protein, 773 aa, unidentified
  REGION 1..773: note = Description of Unknown:uncultivated organism sequence
  REGION 1..773: note = Category: MG60 effectors
  REGION 1..773: note = Description: MG60-164 effector
MSAAYGITIFSVRRVDFACQSPTTGHRKGLTSMKIIKRNGSEAVFDIMKIITAVTKANNVVKEDEQLTPMQIRRIAESVENSCLGMNRALSVEEIQDLVEHQIMAHGAYEVAKQYITYRYTRSLVRKSNTTDEKILSLIESNNEEVKQENSNKNPTVNAVQRDYMAGEVSKDLTARMLLPKEIVDAHEAGIIHFHDADYFAQHMHNCDLVNLEDMLQNGTVISGTLIEKPHSFSTACNISTQIIAQIASNQYGGQSISLTHLAPFVDISRQKIRKTVLEEIRTLGAAPDEAAISKVVEDRLREEIRRGVQTIQYQVVTLMTTNGQAPFITVFMYLGEARNEQEKHDLAIIIEETLKQRIEGVKNEKGVWITPAFPKLIYVLEEDNIHEGTKYWELTKLAARCTAKRMVPDYISEKKMRELKLSKGETPGHGDVYTCMGCRSFLTPDRSGNGWNNIANAGNYEPGKPKYYGRFNQGVVTINLVDVALSSGGAVDKFWRIFDERLELCYEALMCRHNRLKGTLSDAAPILWQYGALARLGKGEPIDKLLYGGYSTISLGYAGLYECVKYMTGKSHTDPAATPFALEVMQHMNDKCAEWKQKENIDFSLYGTPLESTTYKFAKCLQKRFGLVEGITDKNYITNSYHIHVSEHINAFDKLAFESQFQALSPGGAISYVEVPNMQSNIDAVLQVMQFIYENIMYAELNTKSDYCQICGFDGEIEIKEDKDGKLVWTCPQCGNTDQSKMNVARRTCGYIGTQYWNQGRTQEIRDRVLHL

SEQ ID NO: 952 - protein, 756 aa, unidentified
  REGION 1..756: note = Description of Unknown:uncultivated organism sequence
  REGION 1..756: note = Category: MG60 effectors
  REGION 1..756: note = Description: MG60-165 effector
MQQSIFDVCVIIGLWFKKKRRSEVFTMKVIKRDGHIVDYSPDKIEEAVSKANLEVSEEDRVSDIQIRNIIKYIEGLHKKRMLVEDIQDVIEKRLMTLGKYELAKEYITYRYTRELVRRSNTTDKSIKELIDGESEYWNTENSNKNAKVVTTQRDYLAGITSTDITRRFLLPEDIVTAHDQGIIHFHDADYFAQNALHNCDLINLDDMLQNGTNINGVMIEKPHRFLTAMTIATQLITAVSSSQYGGCTITLTHLAPFVRSSKEFYLKKYKNRKLTKAQVEKFANEDLKKEITDGVQTFQYQINSMTTTNGQAPFLSVCMYLGETEEYKDELAMIIEEVLKQRMEGMKNEKGVYITPAFPKLLYVLEEENINPKGKYYYLTELAARCTAKRMVPDYISEKVMKENKINSLGNGECFPCMGCRSFLTPDRMFNVGNISKALNYVENKGKYYGRFNQGVVTINLPDVALTSGKDMELFWKVFDDRLELCHRALQIRHKRLSKVTSDVAPILWQHGALARLEKGESIHELLHHGYSTISLGYAGLYECVKYMTGHSHTDNGKGHEFALEVMQHMNDKCNEWKEAEDIDYSLYGTPIESTTYKFAKCLRDRFGKIKGITDRDYITNSYHVPVFEEIDAFTKLKLESEFQRLSPGGAISYIETPNLENNIDVVMEVINFIYENIMYAELNTKSDYCQKCGYNGEILLDDDLEWYCPECGNRDHDTLNVARRTCGYIGTNFWNKGRTQEIKERVVHIDNKDDE

SEQ ID NO: 953 - protein, 1231 aa, unidentified
  REGION 1..1231: note = Description of Unknown:uncultivated organism sequence
  REGION 1..1231: note = Category: MG60 effectors
  REGION 1..1231: note = Description: MG60-166 effector
MSLKIEDLETFKRHRYAVSESLSTDIVGRDREIEEISSKIDSVYCLTITGPAGVGKSRLAVAAIEHYCASHTDFEVLCTKSFSDYISALDEAIEEGRRYIIFIDDANTYPRLIELLEFLKYRNQEGNIKAILTVRDYLKGCLDSDIYMGFYEVKPLNDKSIEDALVKNTTIRNEDWLKQIAKIANGNIRVAFLAANEAIKNNKSLGSIYNQKDVLNRFYKDEMSKIDHSESLLITAGVIAFFKSIYLEQLFYIVPILKSVNLSKKSFIENVNILIKMKIVDDYHDVVKIADQCFADFLLNYTIVEKRYLKIKDLLLVGFKYYKERIVESIHTILHVYNTEEFVDHLRKEVTDACNNLEDDVSLKHDLESCFVQVIPEYVSREYIEGVENYSDKKDIKWLINVFSGLAFSNYNEIANKGILKLLKKTKNKTKEVYDAIKNTYEMRAERANERFQYQIALIKELQNGGLYNDEFNALVSSYLNFRFSYSCFTSKREMMHYTFSVDDNTAGILELRSTCWGYLFNCELSKAIDSIMDFANRHYIERNLEIIKNDLRCINTYLCEHDQSGFLNSVLYVKFIDEAKEYCFTDLLTANEKYLDFLDIVFERKLLGANYEGYEARYKNRVADYYNLHKDDIYDILNETDLFLNKYYKYQKTRLVNALVEVVDKFSNALFFLCTKNVIFPHLVIEEFLKNRNLDEAYALINQIDDETIKDEYLYNFYSYLSKENIEKDYGFIGWMNSKGDFKTNRTYHRDAMSLKNIAEKCGLDYVALLRKLYSKEKYNKFIAKAYLSYLIDNVETFKELLSLNQNLAIKIYEFLIANGEKDYESSVLIEILDVKRSYIKVFAKAFIEEEYYNDCNLDFIFEKEYCDSFLDECMKVMLSQKINFAPFKLRILISRNINQPNMERWIEKYIESNYKEDNVIELFFQALSEIDHQHKNAYLVLYYQKGHDINVLRQAILKKSHSYSNAKEHFGNEIKWLETLKKSLLNWNNTEEVKFIDTVIDDYKVRIKNDEIESLVDYGNQNILNELRERDFKTEVPLKDAFELYQSNKKFRDMLSSGYLSYKDGSFVNGKNDAVKFIDKLKDKKIICVEIKPVDKVGRLDYEQYLSSMKSIAKEFDNPKLVSLNDYLNALIAERKWNAQEFKDYTFLSRDIFSKIRNNKKNKMDKRTLVQILIGLRVSKRERDYLLELNQTSLSKYVKEDVLYSFILDAKLDIEVADELLRDIGEDGF

SEQ ID NO: 954 - protein, 783 aa, unidentified
  REGION 1..783: note = Description of Unknown:uncultivated organism sequence
  REGION 1..783: note = Category: MG60 effectors
  REGION 1..783: note = Description: MG60-167 effector
MMRVVKRDGKIVDFDESRIKIAIGKANNEVDESQRATEEEIEKIVEYVKKVKKDRILVEDIQDIIENKLMEYKRFELAKAYITYRYSRALVRKANTTDQTVKELVEGNSEYWNNENSNKNARVVTTQRDYLAGITSTDITRRLLLPPEIVKAHDEGIIHFHDADYFAQNALTNCCLINLNDMLQNGTVINGVMIEKPHRFVTACTIATQIILGVSSSQYGGCTVTLTHLAPFVRDSYNRSLKKYQDRNLPEEECKKFAMQDTKKEIADGVQTFNYQVNSMTNTNGQAPFLSVNMYLGETDEYKDELAMIIEEFLRQRMLGFKNEKGVYITPAFPKLLYVLEEDNIHKDSKYWYLTELAAKCTAKRMVPDYISEKMMKKLKINQYGEGDCYPCMGCRSFLTPDRVKGNVAKAKDYVEGKGKYYGRFNQGVVTINLPDVALSSKKDEKEFWKIFDERLELCHEALQLRHKRLSGITSDVAPLLWQYGAYARLNKGEKLDKLLHGGYSTLSLGYAGLYECVKYMTGDSHTDGGKGEKFALEVMQHMNDKCAEWKKAEDIDYSLYGTPIESTTYKFAKCLKKRFGTVEGVTDRNYITNSYHVPVFEEIDAFSKLKLESEFQRLSPGGAISYVETPNLQNNIEVVEQIIEFIYNNIMYAELNTKSDYCQKCGYTGEILIDDNLEWYCPNCGNRDHRTLNVARRTCGYIGTNFWNKGRTQEIKERVLHIDNKDFDAEKCTKCDEEANVASKCCNDSNESTECDKNVEKHEKKTRAKVSAKEKAMASVHA

SEQ ID NO: 955 - protein, 818 aa, unidentified
  REGION 1..818: note = Description of Unknown:uncultivated organism sequence
  REGION 1..818: note = Category: MG60 effectors
  REGION 1..818: note = Description: MG60-168 effector
MQTNKQLDLARNFVQYTGQNIFLTGKAGTGKTTFLKSLKEHSPKRMIVVAPTGVAAINAGGVTIHSFFQLSFAPQIGLENDRDKQNRFNKEKISIIRSLDLLVIDEISMVRADTLDAIDRVLRRFRSKSKPFGGVQVLMIGDLQQLAPVVKNEEWGLLRREYETVFFFSSKVLRKTSFVSIELTEVFRQHDDKFISILNKVRDNQLDQKSLEALNKRYLPGFVPGEDEGFITLCTHNIQAHRINESKLIQLKTDKKSYTAEIEGKFPEYSYPTDFKLVVKPGAQVMFVKNDPEPEKRFYNGKIGKITRFEEDVIYVNCPGDMEEIAVTPLLWENVKYTIDTKTAEISESVEGTFMQYPLKLAWAITIHKSQGLTFEKAIIDAGASFAHGQVYVALSRCKTLEGMVLSTPISERSIINDGTVSGFIQNVEENQPGEIELKNAKLAYQKELLFDIFSFETVKMQVNIINKLLRENSSSVPEVVVEHLKKIKSAVYSDLVEVAEKFQKQISTLLKDQPDVEQNNQLLERISKAATYFSEKTETIIETDFTRADLEVDNRVLRKQLKNSSTKLLEEANLKQVSFAICKNGFNVKELLTERAKAIVANNKPAGKKKKAKEIVNPENIPHPELYNTLREWRLEKAHEIEKPAFVVFSQKTLVELVNYLPVETATLKLINGFGERKIEQFGAGIIEIIRDYCDKNNIQRAEIPLKEGKEKKPKIDTKKVSFEMFKEGKTVEEIAVERALTPGTIENHLAHFVRLGELDIKLILDNDKLKKITDYFKSTKNKSFGDAKAHFGDAISYGELRMGLSYLESLEQTQSK

SEQ ID NO: 956 - protein, 753 aa, unidentified
  REGION 1..753: note = Description of Unknown:uncultivated organism sequence
  REGION 1..753: note = Category: MG60 effectors
  REGION 1..753: note = Description: MG60-169 effector
MKKLNIDHAQRSLILSRLEEKGIQEFVEFLQSKFKSESITRIMGSSHLFINSCPLCGHVGCFNIDSTMGIFNCFSCRGSGNAADLPMLFTNDIQEGLQALQEFTGLTLQLDKEDVQAQRKTNLYADVTEIYHKQLLDNEVVLNYLIQVRKRQIETIEKMQTGFCTSRADTSSQLKELGYSDEEKSKVLVPEGLFVYPYPDRYGVIQRFNTKNYFKATMRVSDGTQKVIEGYSIDKKKLLFNPNQKYAYGIIVEGEQDFAAIIENGDGNVVAMGGSPSADQINELRQFKKLYLCFDSDEPGKAFTQKVNNTLPDVKIYSIEIPHGYKDIDEYYTSYSNPVPVQSLLDSAQELINTESHGSVINNKVMLKNRDWQIEFDLTQLDIAKQMYKGNLKNTVNGKIVDNKNSIFLPNGMPKPLIEYADKLSQTIDEHYNCNFNKKTLFELSDIFYFSYNKPDIIKAAAVQLLEIEDKKERDACIASLTDKSFRNSVVREIIATENEMLKDQAVHYPLIKPGQAYIISEENPVAYIYFNKSEDDGKGNLIEMPCLLSSDKRIITLSDYTKVSPNQIVIVDGRFRLRDVIKGPLLSTDFCSLKQGYAKRYIEGEIEQEYLKPEYIIRKFEELFAKVYYNPDSNIYKVLALFSYATYLADLFGVLPYIYCTAQKGSGKSTILALLSKLCFNSVFVTDVTTASFIRISNLCATLIVDEFEGHSSRSKNQEDDLIPLIKSGYSKSSGGATRTNIEETYILLLKW

SEQ ID NO: 957 - protein, 844 aa, unidentified
  REGION 1..844: note = Description of Unknown:uncultivated organism sequence
  REGION 1..844: note = Category: MG60 effectors
  REGION 1..844: note = Description: MG60-170 effector
MPLDERIGRLKKKLLTSPYEVCMARAYHFTQAYKETEGLDPAIRNALALKKTLENQKIFIYPDEFLAGSKTEKFLSGPLSVERGDFLRTLQMEMDILHLKQRPFLITEEEKKLFREVILPYWDGKTLRDHKAKEWEKKGLIDRKQGFFKRLFRMIKFMRYVGRENLRKIAGANRKAPLTFRRLKNLHALRYELACNNPSPAVFCFDVQGHLSLGVNKVIENGMEGIIKKAEDRLKRLEVEEPYNEKKKNFLKAVTISLESAIRYSEKFAELSEEIAKKTEDEKEKNRLLLIAKHCRHVPRYKPRTFHEALQSAWITHLVGEIQYGTHEVFAPGRIDQFLYPFYENDIKSGRITRDEAKALIQEFLIKLESNVEPIPEVGMETNAVLGNSQHVVTIGGLKKDGEDGTNELSYLILEAYEEIGGAVNQLAVRISKKTPFDFLKRACAVFRKANGIAFYNDEAIIEGLLADGMSIEDARDYCIVGCIETSGQSNTHGCVGGHELVLPVVLIQTLTRGKEPPPFIGQKEGIDCGDPSSFKTFEDFISAFKKQLAHQIKILVEATEGKDKAYREILPAPYVSALMDDCIEKTMDVTEGGARYDFTSIDVRGLATLVDSLLAIKRFVYEKKELSLTDFIKIIRNNFKGHEVLRQRIINEAPKSGRGDGEADEMAKNVLHWIYEISQRYRNIRGGRFRVCYYSYGNHVIDGFMLGATPDGRLKGEPISNGVSPVNMGDFSCGPMGPMRSVAKFPPREISSGIALNMRFHPSFIKTEEGLITFAKMIKTYFEMGGMHIQPNVVSSETLMDAQKNPERYRDLIVKVSGYSAYFTDLGKSIQEDIISRYEFCRS

SEQ ID NO: 958 - protein, 625 aa, unidentified
  REGION 1..625: note = Description of Unknown:uncultivated organism sequence
  REGION 1..625: note = Category: MG60 effectors
  REGION 1..625: note = Description: MG60-171 effector
MQEEYLFKDNETICAFLKRLKDKDIASYKEILNETHCSKAYNDLKEHILQTLASLNRVKKAQELSKHKEYDLIRIYEEIQSMPSALFSYFKVSMNDIEAAMSASKKRLYLFKISNKDLSYAETSSQGKRKSRGRENLHTMYLKALLDGNKAFDIGSGSIYFRRKTDFGYTKETWEKGHHYAELKDRFLYPIISKRRYTVDHLQFHLSMTINYNADKNCKNINEMVNETIRNGAIEHIIGIDRGERNLLYASVIDLHGNIIEQCSLNIIPNKHNDLGTDYLKLLKERESIRQEERRSWDSIEKINELKTGYVSQAVHQVVKMVLKYHAIIVLEDLNEGFIRSRQKRERTVYAQFEKQLIEKLNYLVDKGIAEGEPGSATNGYQLTNPTNNNVKSNQSGILFYIPAWNTSNIDPTTGFVNLFNLRYQNREKTREFFDKFKSIKYNSEKKWLEFTFDYNDFTSKGKETQTIWTVCTYGPRIEAHKDSPKIWKKKTVEDINNKWLGFFNKWNITISEDLKEQIVKQDKKEFYKHLLDLFKLTLQMRNSDDKDDYIISPVMNTAHKFFKSCKDDTTLPIDADANGAYNIARKGLMWIKQMKDYKDTKKFKPDLKNRKWLNFAQQKPYKDE

SEQ ID NO: 959 - protein, 763 aa, unidentified
  REGION 1..763: note = Description of Unknown:uncultivated organism sequence
  REGION 1..763: note = Category: MG60 effectors
  REGION 1..763: note = Description: MG60-172 effector
MMRVVKRDGKIVDFDESRIKIAIGKANNEVDESQRATEEEIEKIVEYVKKVKKDRILVEDIQDIIENKLMEYKRFELAKAYITYRYSRALVRKANTTDQTVKELVEGNSEYWNNENSNKNARVVTTQRDYLAGITSTDITRRLLLPPEIVQAHDEGIIHFHDADYFAQNALTNCCLINLNDMLQNGTVINGVMIEKPHRFVTACTIATQIILGVSSSQYGGCTVTLTHLAPFVRDSYNRSLKKYQDRNLPEEECKKFAMQDTKKEIADGVQTFNYQVNSMTNTNGQAPFLSVNMYLGETDEYKDELAMIIEEFLKQRMLGFKNEKGVYITPAFPKLLYVLEEDNIHKDSKYWYLTELAAKCTAKRMVPDYISEKMMKKLKINQYGEGDCYPCMGCRSFLTPDRVKGNVAKAKDYVEGKGKYYGRFNQGVVTINLPDVALSSKKDEKEFWKIFDERLELCHEALQLRHKRLSGITSDVAPLLWQYGAYARLNKGEKLDKLLHGGYSTLSLGYAGLYECVKYMTGDSHTDGGKGEKFALEVMQHMNDKCAEWKKAEDIDYSLYGTPIESTTYKFAKCLKKRFGTVEGITDRNYITNSYHVPVFEEIDAFSKLKLESEFQRLSPGGAISYVETPNLQNNIEVVEQIIEFIYNNIMYAELNTKSDYCQKCGYTGEILIDDNLEWYCPNCGNRDHRTLNVARRTCGYIGTNFWNKGRTQEIKERVLHIDNKDFDAEKCTKCDENVEKPEKKTRAKVSAKEKAMASVHA

SEQ ID NO: 960 - protein, 783 aa, unidentified
  REGION 1..783: note = Description of Unknown:uncultivated organism sequence
  REGION 1..783: note = Category: MG60 effectors
  REGION 1..783: note = Description: MG60-173 effector
MMRVVKRDGKIVDFDESRIKIAIGKANNEVDESQRATEEEIEKIVEYVKKIKKDRILVEDIQDIIENKLMEYKRFELAKAYITYRYSRALVRKANTTDQTVKELVEGNSEYWNNENSNKNARVVTTQRDYLAGITSTDITRRLLLPPEIVKAHDEGIIHFHDADYFAQNALTNCCLINLNDMLQNGTVINGVMIEKPHRFVTACTIATQIILGVSSSQYGGCTVTLTHLAPFVRDSYNRSLKKYQDRNLPEEECKKFAMQDTKKEIADGVQTFNYQVNSMTNTNGQAPFLSVNMYLGETDEYKDELAMIIEEFLKQRMLGFKNEKGVYITPAFPKLLYVLEEDNIHKDSKYWYLTELAAKCTAKRMVPDYISEKMMKKLKINQYGEGDCYPCMGCRSFLTPDRVKGNVAKAKDYVEGKGKYYGRFNQGVVTINLPDVALSSKKDEKEFWKIFDERLELCHEALQLRHKRLSGITSDVAPLLWQYGAYARLDKGEKLDKLLHGGYSTLSLGYAGLYECVKYMTGDSHTDGGKGEKFALEVMQHMNDKCAEWKKAEDIDYSLYGTPIESTTYKFAKCLKKRFGTVEGITDRNYITNSYHVPVFEEIDAFSKLKLESEFQRLSPGGAISYVETPNLQNNIEVVEQIIEFIYNNIMYAELNTKSDYCQKCGYTGEILIDDNLEWYCPNCGNRDHRTLNVARRTCGYIGTNFWNKGRTQEIKERVLHIDNKDFDAEKCTKCDEEANVVSKCCNDSNESTECNKNVEKHEKKTRAKVSAKEKAMASVHA

SEQ ID NO: 961 - protein, 1222 aa, unidentified
  REGION 1..1222: note = Description of Unknown:uncultivated organism sequence
  REGION 1..1222: note = Category: MG60 effectors
  REGION 1..1222: note = Description: MG60-174 effector
MLESFKDLYEVRKTVRFSLLKQNYEDFCKFENNILKDISFLNSLLKFEDEIKNIQKSNGKKMQDLLSKDILEDIIKNSFQTLKNQICSVIYNKVVFDTKTSERNKRYLIYIKTETWENLDFFIPKDYNNNWNYIPEEDFYKVKDSEIWYAIKFISKLIIDNELIPFNEGKFRNKLKNINKYNSNFWNFFELNTLNPFTVNRWKISEIVNSYELSLSQYKETLEDLNKEASTIANTILSDRYFENCRNQNESDGTVRYLFHIFSNCKNSSEKNIWQINHLILLVNKYESLKNGKKKYTNDEIEPKIKRLNKELRQLAKVRSELLWYQIHLIDNFQTEKFSFLIQSWKYYFVGMKKIWWENNLSQFQEFIDGLEGGNDKLLYLDSMTWGWFKKLFLSKQSDVVFTDGTRIKDLNGSILAKEEEILQLKKWIIEKIEKDINTFISKVTNDIFNEINSKEKIKFIEYLSQKWKKVDNLFKLWKKNKKQLIYGKELKEFCNSLYNFDSIKETYNLTKLEKEYLNQVMILLQTIKDKKYKIGTVEKDLSFLWGGFVEKAFDILDDLKNYFNDLGYKVIQKDVDLEKMLKQVKTWELEIFQIKSKDMPFHQDFINDRNCWIIEEVKNEKSDGFKKDLNTLYFEEFFKDIKNNNRNSRIWADFKIRWINSSENNDYESFWKKEKNQLRHSNNKENIEKFKNRFKRDRYSIEFSINLNATNHLTEEDFNTKISNKLKEKRETWSLRILSLDHGESSFLTYKIYQVEGNKYSIINQGWNFDNFKEIQDWEDKTTKRQENIQIDEKAIPYKDQKILDNYITKYHAMIQDQKRERQVEEAIKHFARKSISKIKEIISADTVDKNKEWVSDITKANVKKFIQYAIGHKEVFSLSNEENSIRNKNKGSNKSIENKKNGVEYSKRIEEFFQNKRLDVISLWEDTIRFDKINIFHILDYEFHFSYIKQEEWFIQQFPDQENIKEKIDYYLNQIQELLDDENKLIAFCNEIKNSFDGKSLADIDKLYNTPFYAYKNNFSLQLEQINNLKKWYASVLVGTISKRIMNGEVDIIVLENNLLYYGVDNSESFQKHMWAENHATFAEALINKLSFCLDKETSESYQFCYPIKVTERPQKFKNKNNGILFFVDENTTSLICPKCDQKLNRSKQDGDDHLHHNNKNPAWDECKKEPFEIQKSKNIVGEYQGMLFHDWDDLATYNIAKKALEYLEYLESQNNDETK

SEQ ID NO: 962 - protein, 885 aa, unidentified
  REGION 1..885: note = Description of Unknown:uncultivated organism sequence
  REGION 1..885: note = Category: MG60 effectors
  REGION 1..885: note = Description: MG60-175 effector
MKIIKRDGTIVDYDPEKIRVAIGKANNEVSKKEKATEEDINNIISYIEDLKKSRILVEDIQDIIEKKLMEIGKYQLAKQYITYRYTRALVRKANTTDQSIKELIDGESEYWNTENSNKNARVVTTQRDYLAGITSTDITRRFLLPEDVVKAHDEGIIHFHDADYFAQNALHNCDLINLEDMLQNGTSINGVMIEKPHRFLTAMTIATQIITAVNSSQYGGVTVTMTHLAPFVRESYKRILKKYQDRKFSKEDCEKYAKEDLRKEVKDGVQTFQYQINSMTTTNGQAPFLSVCLYLGETEEYKEELAMIIEEVLKQRTLGMKNEKGVYITPAFPKLIYVLEEDNMHENSKYWYLTELAAKCTAKRMVPDYISEKKMLELKVDKNGEGHCYPCMGCRSFLTPYVDPKTNKPKYYGRFNQGVVTINLVDAALSSGKDMEKFWKLFDERLELCHKALKIRHERLSKATSDVAPILWQHGALARLKKGESIHPLLHGGYSTLSLGYAGLYECVKYMTGHSHTDNGVGKEFGLKVMQKLNDKCKEWKEQEDIDYSVYGTPIESTTYKFSKCLRKRFGKIKGITDRDYITNSYHVPVFEEIDAFSKLKLESEFQQLSPGGAISYVETPNLQDNLEVVLQIIKFIYNNIMYAELNTKSDYCQKCGYDGEILIDDNLEWYCPNCGNRDHDTLNVARRTCGYIGSNFWNKGRTLINLYLPEIIAFKRGMINMRYNKIRKMDIADGPGVRVSIFMQGCTFNCKNCFNPETHDFNGGKEFTDSTINRVLELCENENIEGLSILGGEPMNPKNIEGTTKLAKAFKQKFPDKNLWAWSGFRFDKELKDKEVVKYLDVLVDGQYMDDLHNPTLKWKGSSNQRVINVQESLKKNEVILMQS

SEQ ID NO: 963 - protein, 755 aa, unidentified
  REGION 1..755: note = Description of Unknown:uncultivated organism sequence
  REGION 1..755: note = Category: MG60 effectors
  REGION 1..755: note = Description: MG60-176 effector
MHELIEKREPKEEKPMKIIKRNGAEVVFDIDKIIMAVTKANDAVDEKVRMTPLQIERISQSVQIACEEMGRSPSVEEIQDLVEKAIMAHGAFEVAKEYITYRYTRSLLRQSNTTDDRILSLIECNNEEVKQENANKNPTINAVQRDYMAGEVSKDITSRILLPKEVVDAHEAGIIHFHDADYYAQHMHNCDLVNLEDMLQNGTVISGTLIEKPHSFSTACNIATQIIAQVASNQYGGQSISLTHLAPFVQVSREKIRKTVEREMAAFGVAPAEETISKVVEDRLREEVRRGVQTIQYQVVTLMTTNGQAPFITVFMYLNEAKSEQEKKDLAMIIEETLRQRYEGVKNEKGVWITPAFPKLIYVLEEDNVREGTPYWYLTRLAAQCTAKRMVPDYISEKKMREYKLSKGETPGHGDVYTCMGCRSFLTPDRSGNGWDNVARAGNYEPGKPKYYGRFNQGVVTINLVDVALSSGRDMTKFWEVFEDRLELCHRALRCRHERLKGTLSDAAPILWQYGALARLPKGEPIDKLLYGGYSTISLGYAGLYECVKYMTGKSHTDDEAKPFALSVMQKMNDKCLQWKTAENIDYSLYGTPLESTTYKFAKCLQKRFGLIPGITDKSYITNSYHVHVTEPIDAFTKLRFEAEFQQLSPGGAISYVEVPNMQNNIDAVLEVMQFIYDNIMYAELNTKSDYCQVCGYDGEIEIKEDDGKLVWVCPQCGNTDQNKMNVARRTCGYIGTQFWNQGRTQEIKDRVLHL

SEQ ID NO: 964 - protein, 768 aa, unidentified
  REGION 1..768: note = Description of Unknown:uncultivated organism sequence
  REGION 1..768: note = Category: MG60 effectors
  REGION 1..768: note = Description: MG60-177 effector
MFCSCKKNLRVVIYIYDATKTYDCAKKLIVYKSIIKGAEVMKIIKRNGAEETFDRQKIKDAIAKANNETDGTPELTDRQIDYISLVIEDHCNEMNRALSVEEIQELVETHIILQGAPETAKRYIRYRFTRNLARASNTTDNQILSLIECNNEEVKQENSNKNPTVNSVQRDYMAGEVSKDLTKRILLPEDIVKAHEEGLIHFHDADYFAQHMHNCDLVNLEDMLQNGTVISGTMIEKPHSFSTACNIATQIIAQVASNQYGGQSISLAHLAPFVQISREKITRQVRAEMEEFGIAADDEQVKSLVEKRVRDEIKRGVQTIQYQVVTLLTTNGQAPFVTVFMYLNEAKNEQEKKDLAIIIEEVLKQRIKGTKNEVGVWVTPAFPKLIYVLEEDNITEDSRFWYLTKLAAECTAKRMVPDYISEKIMLKLKIDKNGNGNCYTCMGCRSFLTPYVDENGKPKYYGRFNQGVVTINLVDVACTAARDGNKSEEKFWQVLDERLELCHRALQCRHERLEGTLSDAAPILWQYGALARLKKGEPIDKLLHGGYSTLSLGYAGLWECVYEITGKKLTEKEGEEFGLRVMQRLNDACAEWKAAENIDYSIYGTPLESTTYKFAKCLQNRFGIIKGVTDRNYITNSYHIHVTEKIDAFSKLELESKFQKLSPGGAISYVEVPNMQQNIPAVLEVMKFIYNNIMYAELNTKSDYCQVCGYDGEIQIVEEDGKLVWRCPNCGNEDQSKMNVARRTCGYIGSQFWNQGRTQEIKERVLHL

SEQ ID NO: 965 - protein, 1488 aa, unidentified
  REGION 1..1488: note = Description of Unknown:uncultivated organism sequence
  REGION 1..1488: note = Category: MG60 effectors
  REGION 1..1488: note = Description: MG60-178 effector
MKVNDSSLIDCYTRLPSHTARNIRELVESANLESRNALWREIDRFMTDISTAIQPFVFFIIGEWGEGKTTAFEGYLKFESEKANIQSTLISARTLFNCLKKIKEKEILESNVTSAILVAAILWAIVDEEKARGTKSYNIPDPRSLSIRDAVDYVYNALDCLFSSMKPSNKRLVVFIDEFEEILTIREEEIKDLIISGIVEFIEGKLGIISEKGKYAGMFHLVVSVTPAAYHMLGKDKRLTQLIGRFKRRIYRYQLKSITKEEAYRYIIAAIKYSFNRKQFDIPFSSPGIINTCYFITKGNLGALTQLFNILLTQSRSESPYKCKMYRIDYKRFLKYVKGKTIFVYGDEAKIIDEKFFNMLRMLEEELRNYPNIRRNNLINIFDIIWLLSVEYEPKSKLEIMRKLGLQEVDDVDTCVNILNGLFRARKRKMGKTIYEVYYVPWYSGIEEDLRKLFSEMSAILNLKLDDETIEKIIDLLTFYEISDDRLIPYLIWPAQETDSYYLVELTEGLIQEEEAIEIRRQFIKYVKDEGIRRDKMLIISHEILKNLYPAPEITYLDFIIDRNDRMRLWREARRELINNLLPEEKYINALSKLFENQSPLYGLKYGSEVFYLLEHSTGDVKYEIPTLIRVFVRPPDEEEINKFVKFLKNFMPPLTLIFHAHGFQKVQETIKITCGKVLELCTLQFVLLSQTTLLQLISYLKAIEEEKNSSHKRLLDEDKLKIRFKEIFEELEFPKIISEIIRDGIDKGWIIRDLDLQSTSDPSNLVDAFICFLSYPKRKMTIGDVWNFYKQLNELKIFGTKPGFSPRDIESYQQFYNYAQDLIKNGFLKIDGQYVEPVLTKIEERILKIIDNYDSSPIPISELKERFVTIAKTSNLFKDVFLNALEKRGIIEIRKNLLFKADIAERQEKLQRLYNTFKARIEKLKEEKIINVFRFVVSTKERGCNVIDPFEIEKFVDKIYHKVEYAQLSDENLFLRLATFLINFLNYHLNERIGIFTLINKAYNEALKERALFKQEIDNVKKKIHKIVVFLSSISHVPIEQIQLDELTTLKEIHYDVESVFSKSPGKSEVKDAVSKDSEAYKKFWIKRVKELRSSPIEYDFLNYGYYQLIKKKEKSKQLLLKIKDLISRIEEKERNIGERFNKLQEYLIRIEKMKSVDNENEFLGPSFSGELAQLLEKNIKSPTFYFKDIKNLTDVKSFLDNFLKEMIDIFENIRISVESLSNLQQSEFLIKKLYDFQAKKYNLSKKFLENSSYSQQLIELWTQFEKSISDQLKALKDEYEKELRIIKKTYIGSAVVSRIQELAKKISDKLISLKEKIQTNTKKILSLVKESIDELEKLYKRADQLYFAIEAVVGDSSKKKEAEYLHDEITVVSKEWKQLEKIFVAENSDSAEIIEFKKFLDMKSLLFSSLQKLEEILLTSGRLDNLDLKIFEITKEISEKEQTNIPISSIISYILNNVNQKLTENEILFKLYKLSNYGLIQINVVA

SEQ ID NO: 966 - protein, 756 aa, unidentified
  REGION 1..756: note = Description of Unknown:uncultivated organism sequence
  REGION 1..756: note = Category: MG60 effectors
  REGION 1..756: note = Description: MG60-179 effector
MQQSIFLVCVIIGLWFKKKRRSEVFIMKVIKRDGHIVDYSPDKIEEAVNKANLEVSEEDRVSDIQIRNIIKYIEGLHKKRMLVEDIQDVIEKRLMTLGKYELAKEYITYRYTRELVRRSNTTDKSIKELIDGESEYWNTENSNKNAKVVTTQRDYLAGITSTDITRRFLLPEDIVTAHDQGIIHFHDADYFAQNALHNCDLINLDDMLQNGTNINGVMIEKPHRFLTAMTIATQLITAVSSSQYGGCTITLTHLAPFVRSSKEFYLKKYKERKLTKAQIEKFAMEDLKKEITDGVQTFQYQINSMTTTNGQAPFLSVCMYLGETEEYKEELAMIIEEVLKQRMEGMKNEKGVYITPAFPKLLYVLEEENINPKGKYYYLTELAARCTAKRMVPDYISEKVMKENKINSLGNGDCFPCMGCRSFLTPDRMFNVGNISKALNYVENKGKYYGRFNQGVVTINLPDVALTSGKDMELFWKVFDDRLELCHRALQIRHKRLSKVTSDVAPILWQHGALARLEKGESIHELLHHGYSTISLGYAGLYECVKYMTGHSHTDNGKGHDFAIEVMQYMNDKCSEWKEAEDIDYSLYGTPIESTTYKFAKCLRDRFGKIKGITDRDYITNSYHVPVFEEIDAFTKLKLESEFQRLSPGGAISYIETPNLENNIDVVMEVINFIYENIMYAELNTKSDYCQKCGYSGEILLDDDLEWYCPECGNRDHDTLNVARRTCGYIGTNFWNKGRTQEIKERVVHIDNKDDE

SEQ ID NO: 967 - protein, 774 aa, unidentified
  REGION 1..774: note = Description of Unknown:uncultivated organism sequence
  REGION 1..774: note = Category: MG60 effectors
  REGION 1..774: note = Description: MG60-180 effector
MEKKIGRNDPCPCGSGKKFKHCCGKTPVLRALTQEEWEELYHSLNQRLIQYLRQPRFVDDFESAWDLYWDGEYEIEELNRLSKWEMGTFVNFLVFGYLLLSSNRSVIDHFLNKYRADLTLPERTMLDNMRKAFYGVYEVQEVRPGQGMKVKNIFDGTEFEIKEISGSKETVKWDVISGYICKIGEHYEFTGFINFVPRQIVGSLQAMLLNEHRMYQDEIESVNFSVFLKNNAFIVDQFIREYDAKPPVIVNKEGDEIVLCKLTYKIREKEKVLEWFASNSMFDIIPEKGKKTGDSRAHYTWWLKGDVARRLMYSKKEIKEPYSVFADVVIEKTSMTVELTSERRRDIAKTYLKKQLGNLIRLTKTEIKSLEEAQDEHKGDLNLHQSEHDELMMDPEVQKLIKQRMENYYYEEWVDKPIPALGGLTPIEAYSEAPDELEELLKTFEQQELRNKSNLNVYHLDVDKLRAHIAKMARESTADIPDSNFGEEEKLLVSGITYRIMQQFEIDPDKKNEFVIKEDRMGIFWIDEHPIIGVILDIRKNTITVDVLGITDKIISTDDVLYIFPPEKEDILLMTIDNMMRGIARGFEFYQQHNLELTSKAGRAFHAMITMLPEICELIIATVEKYSNKEVNITMKELRKDQCGKTVFIMKRKTLELAEEDFFRAILYPEKFFGPYLKLPQSKIKKFTDRFVRFIAYMASMCLFSLEYKRRYEFDDQRFDNLFFFVYDKQSKVLAEQLLPILEINGGCTPKNIERLKAYIPLHNFRLLRKVTIP

SEQ ID NO: 968 - protein, 1231 aa, unidentified
  REGION 1..1231: note = Description of Unknown:uncultivated organism sequence
  REGION 1..1231: note = Category: MG60 effectors
  REGION 1..1231: note = Description: MG60-181 effector
MSLKIEDLETFKRHRYAVSESLSTDIVGRDREIEEISSKIDSVYCLTITGPAGVGKSRLAVAAIEHYCANHTDFEVLCTKSFSDYISALDEAIEEGRKYVIFIDDANTYPRLIELLEFLKYRNQEGNIKAILTVRDYLKGCLDSDIYMEFYEVKPLNDKSIEDALVKNTTIRNEDWLKQIAKIANGNIRVAFLAANEAIKNNKSLDSIYNQKDVLNRFYKDEISKIDHSESLLITAGIIAFFKSIYLEQLFYIVPILKSVNLSKKSFIENVNILIKMEIVDNYHDVVKIADQCFADFLLNYTIVEKRYLKIKDLLLVGFKYYKERIVESIHTILHVYNTEEFVDHLRKEVTDACNNLEDDVSLKHGIESCFAQVIPEYVSREYIEGVEKYSDQKDIKWLINVFSGLAFSNYNEIANKGVLKLLKKTKNKTKEVYDAIKNTYEMRAERANERFQYQIALIKELQNGGLYNDEFNALVSSYLNFRFSYSCFTSKREMMHYTFSVDDNTAGILELRSACWGYLFNCELSKAIDSIMDFANRHYIERNLEIIKNDLRCINTYLCEHDQSGFLNSVLYVKFIDEAKEYCFTDLLTANKKYLDFLDIVFERKLLGKNYEGYEARYKNRVTDYYNLHKDDIYDILNETDLFLNKYYKYQKTRLVNALVEVVDKFSNALFFLCTKNGIFPHLVIEEFLKNRNLDEVYALINQIDDETIKDEYLYNFYSYLSKENIEKDYGFIGWINSKGDFKTNRTYHRDAVSLNNIAEKCGLDYVALLKKLYSKEKYNKFIAKAYLSYLIDNVETFKELLSLNQNLAIKIYEFLIANGEKDYESSVLIEILDVKRSYIKVFAKAFIKEEYYNDCNLDFIFEKEYCDSFFNECMKVMLSQKTNSASSKLRILISKNINQPNMERWIEKYIESNYKEDNVIELFFQALSEIDHQHKNAYLVLYYQKGHDINVLRQAILNKSHSYSNAKEHFGNEIKWLETLKKSLLNWNNTEEVKFIDTVIDDYKVQIKNDEIESLVDYGNQNILNELRERDLKTEVSLKDAFELYQSDEKFRDMLSSGYLSYKDGSFVNGKNDPVKFIEKLKDKKIISVEIKPVDEVGRLDYEQYLSSMKSIAKEFDNPKLASLNDYLNALIDERGWKAQEFKENTFLSRDIFSKIRNNKKNKMDKKTLVQILIGLQVSKRERDYLLELNQTSLSKYVKEDVLYSFILDAKLDIGVADELLRDIGEDGF

SEQ ID NO: 969 - protein, 755 aa, unidentified
  REGION 1..755: note = Description of Unknown:uncultivated organism sequence
  REGION 1..755: note = Category: MG60 effectors
  REGION 1..755: note = Description: MG60-182 effector
MHELIEKREPKEEKPMKIIKRNGAEVVFDIDKIIMAVTKANDAVDEKVRMTPLQIERISQSVQIACEEMGRSPSVEEIQDLVEKAIMAHGAFEVAKEYITYRYTRSLLRQSNTTDDRILSLIECNNEEVKQENANKNPTINAVQRDYMAGEVSKDITSRILLPKEVVDAHEAGIIHFHDADYYAQHMHNCDLVNLEDMLQNGTVISGTLIEKPHSFSTACNIATQIIAQVASNQYGGQSISLTHLAPFVQVSREKIRKTVEREMAAFGVAPAEETISKVVEDRLREEVRRGVQTIQYQVVTLMTTNGQAPFITVFMYLNEAKSEQEKKDLAMIIEETLRQRYEGVKNEKGVWITPAFPKLIYVLEEDNVREGTPYWYLTRLAAQCTAKRMVPDYISEKKMREYKLSKGETPGHGDVYTCMGCRSFLTPDRSGNGWDNVARAGNYEPGKPKYYGRFNQGVVTINLVDVALSSGRDMTKFWEVFEDRLELCHRALRCRHERLKGTLSDAAPILWQYGALARLPKGEPIDKLLYGGYSTISLGYAGLYECVKYMTGKSHTDDEAKPFALSVMQKMNDKCLQWKTAENIDYSLYGTPLESTTYKFAKCLQKRFGLIPGITDKSYITNSYHVHVTEPIDAFTKLRFEAEFQQLSPGGAISYVEVPNMQNNIDAVLEVMQFIYDNIMYAELNTKSDYCQVCGYDGEIEIKEDDGKLIWVCPQCGNTDQNKMNVARRTCGYIGTQFWNQGRTQEIKDRVLHL

SEQ ID NO: 970 - protein, 768 aa, unidentified
  REGION 1..768: note = Description of Unknown:uncultivated organism sequence
  REGION 1..768: note = Category: MG60 effectors
  REGION 1..768: note = Description: MG60-183 effector
MFCSCKKKLCVVIYIYNATKTYDCAKKLIVYKSIIKGAEVMKIIKRNGAEETFDRQKIKDAIAKANNETDGTPELTDRQIDYISLVIEDHCNEMNRALSVEEIQELVETHIILQGAPETAKRYIRYRFTRNLARASNTTDNQILSLIECNNEEVKQENSNKNPTVNSVQRDYMAGEVSKDLTKRILLPEDIVKAHEEGLIHFHDADYFAQHMHNCDLVNLEDMLQNGTVISGTMIEKPHSFSTACNIATQIIAQVASNQYGGQSISLAHLAPFVQISREKITRQVRAEMEEFGIDADDEQVKSLVEKRVRDEIKRGVQTIQYQVVTLLTTNGQAPFVTVFMYLNEAKNEQEKKDLAIIIEEVLKQRIKGTKNEVGVWVTPAFPKLIYVLEEDNITEDSRFWYLTKLAAECTAKRMVPDYISEKIMLELKIDKNGNGNCYTCMGCRSFLTPYVDENGKPKYYGRFNQGVVTINLVDVACTAARDGNKSEEKFWQVLDERLELCHRALQCRHERLEGTLSDAAPILWQYGALARLKKGEPIDKLLHGGYSTLSLGYAGLWECVYEITGKKLTEKEGEEFGLRVMQRLNDACAEWKAAENIDYSIYGTPLESTTYKFAKCLQNRFGIIKGVTDRNYITNSYHIHVTEKIDAFSKLELESKFQKLSPGGAISYVEVPNMQQNIPAVLEVMKFIYNNIMYAELNTKSDYCQVCGYDGEIQIVEEDGKLVWRCPNCGNEDQSKMNVARRTCGYIGSQFWNQGRTQEIKERVLHL

SEQ ID NO: 971 - protein, 750 aa, unidentified
  REGION 1..750: note = Description of Unknown:uncultivated organism sequence
  REGION 1..750: note = Category: MG60 effectors
  REGION 1..750: note = Description: MG60-184 effector
MVKKFLSKGAYHYQNNFFNDKIGFVILGGNMMRVIKRNGHTVDFDATKIENAILKAMKCGSGIIDEQCAKDIAREIEEWHRYSDGDISIYRIEGQVFEKLIEKGQILTAKAYEGYRKVREFQRETNTIDNEIYGIVNQTNKEAMEENSNKDATVLATQRDLIAGEFSKDYCRRLLLPPKIVQAHDDGIIHFHDMDYYIQKMHNCDLVNLKDMFAQGTVINDKLIETPKSLQTACTVATQIVQQVANGQYGGQTISLAHLSPYVRISYEKHKKNVINEGKMIGIDYSDEQIEKIAKSRLKDEIKAGIQTIQYQINTFSTTNGQAPFLSVFMYLKEEPEYIEETAMLIEETLRQRYVGMKNPVGAYVTPAFPKLLYVLDDNNVPQDSKYRYLTDLAVKCVAKRMMPDFISAKIMRENYEGQVFPCMGCRSFLSPWKDENGEYKWYGRFNQGVVTLNLADAGLSADHNLDNFWKILDERLELCKEALLLRHESLKGTIADVSPIHWRYGALARLKSGEKIDKLLENGYSTISLGYIGLYECVVALIGQTHTSKEGNELATKIMERLREACDSWKEETGLGFGLYGTPAESTTYTFARALKKRFGIVPGVTDKDYLTNSYHVNVREHIDAFSKLEVEAKFQKLSSGGAISYVEVTNMSQNLDALSALIDYMYETIQYAEINTKSDYCQECGFDGEILLDENREWYCPNCGNRNHKTLNVCRRTCGYLGDNFWNQGRTQEIAERFVHLDNHLYGE

SEQ ID NO: 972 - protein, 768 aa, unidentified
  REGION 1..768: note = Description of Unknown:uncultivated organism sequence
  REGION 1..768: note = Category: MG60 effectors
  REGION 1..768: note = Description: MG60-185 effector
MFCSCKKKLCVVIYIYNATKTYDCAKKLIVYKSIIKGAEVMKIIKRNGAEETFDRQKIKDAIAKANNETDGTPELTDRQIDYISLVIEDHCNEMNRALSVEEIQELVETHIILQGAPETAKRYIRYRFTRNLARASNTTDNQILSLIECNNEEVKQENSNKNPTVNSVQRDYMAGEVSKDLTKRILLPEDIVKAHEEGLIHFHDADYFAQHMHNCDLVNLEDMLQNGTVISGTMIEKPHSFSTACNIATQIIAQVASNQYGGQSISLAHLAPFVQISREKITRQVRAEMEEFGIAADDEQVKSLVEKRVRDEIKRGVQTIQYQVVTLLTTNGQAPFVTVFMYLNEAKNEQEKKDLAIIIEEVLKQRIKGTKNEVGVWVTPAFPKLIYVLEEDNITEDSRFWYLTKLAAECTAKRMVPDYISEKIMLKLKIDKNGNGNCYTCMGCRSFLTPYVDENGKPKYYGRFNQGVVTINLVDVACTAARDGSKNEEKFWQVLDERLELCHRALQCRHERLEGTLSDAAPILWQYGALARLKKGEPIDKLLHGGYSTLSLGYAGLWECVYEITGKKLTEKEGEEFGLRVMQRLNDACAEWKAAENIDYSIYGTPLESTTYKFAKCLQNRFGIIKGVTDRNYITNSYHIHVTEKIDAFSKLELESKFQKLSPGGAISYVEVPNMQQNIPAVLEVMKFIYNNIMYAELNTKSDYCQVCGYDGEIQIVEEDGKLVWRCPNCGNEDQSKMNVARRTCGYIGSQFWNQGRTQEIKERVLHL

SEQ ID NO: 973 - protein, 755 aa, unidentified
  REGION 1..755: note = Description of Unknown:uncultivated organism sequence
  REGION 1..755: note = Category: MG60 effectors
  REGION 1..755: note = Description: MG60-186 effector
MHELIEKREPKEEKPMKIIKRNGAEVVFDIDKIIMAVTKANDAVDEKVRMTPLQIERISQSVQIACEEMGRSPSVEEIQDLVEKAIMAHGAFEVAKEYITYRYTRSLLRQSNTTDDRILSLIECNNEEVKQENANKNPTINAVQRDYMAGEVSKDITSRILLPKEVVDAHEAGIIHFHDADYYAQHMHNCDLVNLEDMLQNGTVISGTLIEKPHSFSTACNIATQIIAQVASNQYGGQSISLTHLAPFVQVSREKIRKTVEREMAAFGVAPAEETISKVVEDRLREEVRRGVQTIQYQVVTLMTTNGQAPFITVFMYLNEAKSEQEKKDLAMIIEETLRQRYEGVKNEKGVWITPAFPKLIYVLEEDNVREGTPYWYLTRLAAQCTAKRMVPDYISEKKMREYKLSKGETPGHGDVYTCMGCRSFLTPDRSGNGWDNVARAGNYEPGKPKYYGRFNQGVVTINLVDVALSSGRDMTKFWEVFEDRLELCHRALRCRHERLKGTLSDAAPILWQYGALARLPKGEPIDKLLYGGYSTISLGYAGLYECVKYMTGKSHTDDEAKPFALSVMQKMNDKCLQWKTAENIDYSLYGTPLESTTYKFAKCLQKRFGLVPGITDKSYITNSYHVHVTEPIDAFTKLRFEAEFQQLSPGGAISYVEVPNMQNNIDAVLEVMQFIYDNIMYAELNTKSDYCQVCGYDGEIEIKEDDGKLIWVCPQCGNTDQNKMNVARRTCGYIGTQFWNQGRTQEIKDRVLHL

SEQ ID NO: 974 - protein, 755 aa, unidentified
  REGION 1..755: note = Description of Unknown:uncultivated organism sequence
  REGION 1..755: note = Category: MG60 effectors
  REGION 1..755: note = Description: MG60-187 effector
MHELIEKREPKEEKPMKIIKRNGAEVVFDIDKIIMAVTKANDAVDEKVRMTPLQIERISQSVQIACEEMGRSPSVEEIQDLVEKAIMAHGAFEVAKEYITYRYTRSLLRQSNTTDDRILSLIECNNEEVKQENANKNPTINAVQRDYMAGEVSKDITSRILLPKEVVDAHEAGIIHFHDADYYAQHMHNCDLVNLEDMLQNGTVISGTLIEKPHSFSTACNIATQIIAQVASNQYGGQSISLTHLAPFVQVSREKIRKTVEREMAAFGVAPAEETISKVVEDRLREEVRRGVQTIQYQVVTLMTTNGQAPFITVFMYLNEAKSEQEKKDLAMIIEETLRQRYEGVKNEKGVWITPAFPKLIYVLEEDNVREGTPYWYLTRLAAQCTAKRMVPDYISEKKMREYKLSKGETPGHGDVYTCMGCRSFLTPDRSGNGWDKVARAGNYEPGKPKYYGRFNQGVVTINLVDVALSSGRDMTKFWEVFEDRLELCHRALRCRHERLKGTLSDAAPILWQYGALARLPKGEPIDKLLYGGYSTISLGYAGLYECVKYMTGKSHTDDEAKPFALSVMQKMNDKCLQWKTAENIDYSLYGTPLESTTYKFAKCLQKRFGLVPGITDKSYITNSYHVHVTEPIDAFTKLRFEAEFQQLSPGGAISYVEVPNMQNNIDAVLEVMQFIYDNIMYAELNTKSDYCQVCGYDGEIEIKEDDGKLIWVCPQCGNTDQNKMNVARRTCGYIGTQFWNQGRTQEIKDRVLHL

SEQ ID NO: 975 - protein, 755 aa, unidentified
  REGION 1..755: note = Description of Unknown:uncultivated organism sequence
  REGION 1..755: note = Category: MG60 effectors
  REGION 1..755: note = Description: MG60-188 effector
MHELIEKREPKEEKPMKIIKRNGAEVVFDIDKIIMAVTKANDAVDEKVRMTPLQIERISQSVQIACEEMGRSPSVEEIQDLVEKAIMAHGAFEVAKEYITYRYTRSLLRQSNTTDDRILSLIECNNEEVKQENANKNPTINAVQRDYMAGEVSKDITSRILLPKEVVDAHEAGIIHFHDADYYAQHMHNCDLVNLEDMLQNGTVISGTLIEKPHSFSTACNIATQIIAQVASNQYGGQSISLTHLAPFVQVSREKIRKTVEREMAAFGVAPAEETISKVVEDRLREEVRRGVQTIQYQVVTLMTTNGQAPFITVFMYLNEAKSEQEKKDLAMIIEETLRQRYEGVKNEKGVWITPAFPKLIYVLEEDNVREGTPYWYLTRLAAQCTAKRMVPDYISEKKMREYKLSKGETPGHGDVYTCMGCRSFLTPDRSGNGWDNVARAGNYEPGKPKYYGRFNQGVVTINLVDVALSSGRDMTKFWEVFEDRLELCHRALRCRHERLKGTLSDAAPILWQYGALARLPKGEPIDKLLYGGYSTISLGYAGLYECVKYMTGKSHTDDEAKPFALSVMQKMNDKCLQWKTAENIDYSLYGTPLESTTYKFAKCLQKRFGLVPGITDKSYITNSYHVHVTEPIDAFTKLRFEAEFQQLSPGGAISYVEVPNMQSNIDAVLEVMQFIYDNIMYAELNTKSDYCQVCGYDGEIEIKEDDGKLVWVCPQCGNTDQNKMNVARRTCGYIGTQFWNQGRTQEIKDRVLHL

SEQ ID NO: 976 - protein, 773 aa, unidentified
  REGION 1..773: note = Description of Unknown:uncultivated organism sequence
  REGION 1..773: note = Category: MG60 effectors
  REGION 1..773: note = Description: MG60-189 effector
MSAAYGITIFSVRRVDFACQSPTTGHRKGLTSMKIIKRNGSEAVFDIMKIITAVTKANNVVKEDEQLTPMQIRRIAESVENSCLGMNRALSVEEIQDLVEHQIMAHGAYEVAKQYITYRYTRSLVRKSNTTDEKILSLIESNNEEVKQENSNKNPTVNAVQRDYMAGEVSKDLTARMLLPKEIVDAHEAGIIHFHDADYFAQHMHNCDLVNLEDMLQNGTVISGTLIEKPHSFSTACNISTQIIAQIASNQYGGQSISLTHLAPFVDISRQKIRKTVLEEIRTLGAAPDEAAISKVVEDRLREEIRRGVQTIQYQVVTLMTTNGQAPFITVFMYLGEARNEQEKHDLAIIIEETLKQRIEGVKNEKGVWITPAFPKLIYVLEEDNIHEGTKYWELTKLAARCTAKRMVPDYISEKKMRELKLSKGETPGHGDVYTCMGCRSFLTPDRSGNGWNNIANAGNYEPGKPKYYGRFNQGVVTINLVDVALSSGGAVDKFWRIFDERLELCYEALMCRHNRLKGTLSDAAPILWQYGALARLGKGEPIDKLLYGGYSTISLGYAGLYECVKYMTGKSHTDPAATPFALEVMQHMNDKCAEWKQKENIDFSLYGTPLESTTYKFAKCLQKRFGLVEGITDKNYITNSYHIHVSEHVNAFDKLAFESQFQALSPGGAISYVEVPNMQSNIDAVLQVMQFIYENIMYAELNTKSDYCQICGFDGEIEIKEDKDGKLVWTCPQCGNTDQSKMNVARRTCGYIGTQYWNQGRTQEIRDRVLHL

SEQ ID NO: 977 - protein, 896 aa, unidentified
  REGION 1..896: note = Description of Unknown:uncultivated organism sequence
  REGION 1..896: note = Category: MG60 effectors
  REGION 1..896: note = Description: MG60-191 effector
MAKTSTFAEATKRNVLEFARYKDFDRSLVQLGRRGGKYQKAADRIDSVLGKASRGESNPFHGLKVTKHGENRVDKCVKYDLGDGIRLITIQDSGVVLFCFAGTHTECDEWLDRNRGSTLIRDSKGQIKLNPLNIVKEGFAGFREPLKPITGKLYELIKPDYYFDKLVDSLPRSVVREIEGLEAWASDEDLLAIAERIDDQEVSDAFLDVFALLKKDEIEKAVERIRLFMGESQPIAMLTKEEIAALAESDQIRKISPNDPNYPEVLRHFARHGSYMDWMLYLHPDQQDIVDRTFSGPAKLVGVSGSGKTCVIVKRAIRLARDNPDEKVLVLTLNRQLARLIEDMVEAAAVEEIASRVLVLPLFRLCQELLHRFEPKNDRLYDDITWKSHEHIDEIWREFYRCELNNNDAAVLLPLHDSLISRGIDAEEYIREEFDWIRSAFPPDRRTDYLHAERVGRSYPLDKRFRAIILEGLEAWELKMKHIGVTDYLGLSTALNRHLDKLHEEYRFVLIDESQDFGTIEFRLVRRLTMEGQDSLFLCGDAAQQVQTKHGSLRDAGINIPSARSIRLTKNYRNSREILSAAYEVLVNNLSEEMLDSPDFDVLDPEHGNFSSSAPLILEADSLEEEIAYAREFVEDVVENKGEQKCCIALCGYSLYQIQEFGKRIGVPVLDGNIVVGKEDLYLSDLEHTKGFEFDAMLILNCKHGVIPNPGVPEKEQYRDLARFYVAMTRAKNHLVLSFSSTQSPYLVGVDEYFLSERWENYIDRERLRIVGVPLTIDEIRADHEQIEHVPDLLDMSGTEFLYTRHAIGLSSLLIDKLRRLIAGSKTRGAGGKQTPIGWRSIRAAAHDIEVYPGSRQVFGAEGLRQFRELVEKISEIDETSEQSPACPNWRPTKKR

SEQ ID NO: 978 - protein, 1025 aa, unidentified
  REGION 1..1025: note = Description of Unknown:uncultivated organism sequence
  REGION 1..1025: note = Category: MG60 effectors
  REGION 1..1025: note = Description: MG60-192 effector
MEKFKNIFEVRKALRFELKASKITRENLEKENIYKNPVNILYKNKLEKWLNYSRTVFENDLKYFLDNSKNIILNLEKIKNLLDNTRFSEIFVEKKIFELIDKDFYIKFAKNKLSWWRSSSLQEIKKNLDWKWINLIKNYYLEIFENIENLIISIENLSEKESSFSKNEIKKFLRKISLEFIRIYNFLEKFDIKNKDFNKNLKEYIKKVINFKTFFEEIKSYYFISENQSSWILVRRFWFNEKSLKRRQPKEIKEELEENLKSFNEKLEIKEKLEEERQKLIQDFDLKLKTEKFEELLHPEKWSEIRKKKEKTKEEQEKLDDIDNQFKELKKLRNKDEEISKKTQELNRYKKDLWNLKVKINNLEKELENNLALTHYAKLLTNEINWEKLYYLVLIPIENKFILDEYISDEWNLEILEYNTLTFSALKKLALSYDWTMGIYWDKKEEINKKSNLKRWIVDLYIDLENWERQEEFYKIKRYVINLIKTYKNIFGNIYFDFKRLYDTKSLDEFKIEFDKQWYNLKWKNIDLEIIKKLEKEWKLEFYQIYNKDFYKNPDFFDIPYSIKEQKEERQRRRKSQNVKWNNNLFTIYWENFINDIANWNEEVRLNSDCWYFVKLKKEDKENHRYDRNKIIWNFGLIFNPGKKLTKKYDEKENIKKFNEIYKKEIKKVKNKSFIWIDRWEKELLTFCLIDENWNCIKNKNWEYIIWDFNLINNKWDFIPKDKCKYIDISWKEYKDLLGNFLPDFTHPENIISWKKSFQFDDEKNLYYFKLNHNARLYLLEWENKRYKIVNKEWKEIFLKDENWNNVIDYYLLFQSEVYKRHILKKTWNIKLEDVQELRWWYISNIIKQLNNWIVKYNWIIILENLDKTQIDEKWNIYKTNKEKVLEKTLWATIYQEIETLLNRKYNYFIFKDQDIWWLQLTPKVNNISDIKNLEKSKKNVNLWNIVFIDEYLTSKECPICKNQLFRDKKKWDNVYHNEKYPWNNWCSFDTRTNTYWFDFIKSWDDLAAYNIAKKGKEYIENLSN

SEQ ID NO: 979 - protein, 755 aa, unidentified
  REGION 1..755: note = Description of Unknown:uncultivated organism sequence
  REGION 1..755: note = Category: MG60 effectors
  REGION 1..755: note = Description: MG60-193 effector
MHELIEKREPKEEKPMKIIKRNGAEVVFDIDKIIMAVTKANDAVDEKVRMTPLQIERISQSVQIACEEMGRSPSVEEIQDLVEKAIMAHGAFEVAKEYITYRYTRSLLRQSNTTDDRILSLIECNNEEVKQENANKNPTINAVQRDYMAGEVSKDITSRILLPKEVVDAHEAGIIHFHDADYYAQHMHNCDLVNLEDMLQNGTVISGTLIEKPHSFSTACNIATQIIAQVASNQYGGQSISLTHLAPFVQVSREKIRKTVEREMAAFGVAPAEETISKVVEDRLREEVRRGVQPIQYQVVTLMTTNGQAPFITVFMYLNEAKSEQEKKDLAMIIEETLRQRYEGVKNEKGVWIAPAFPKLIYVLEEDNVREGTPYWYLTRLAAQCTAKRMVPDYISEKKMREYKLSKGETPGHGDVYTCMGCRSFLTPDRSGNGWDNVARAGNYEPGKPKYYGRFNQGVVTINLVDVALSSGRDMTKFWEIFEDRLELCHRALRCRHERLKGTLSDAAPILWQYGALARLPKGEPIDKLLYGGYSTISLGYAGLYECVKYMTGKSHTDDEAKPFALSVMQKMNDKCLQWKTAENIDYSLYGTPLESTTYKFAKCLQKRFGLIPGITDKSYITNSYHVHVTEPIDAFTKLRFEAEFQQLSPGGAISYVEVPNMQNNIDAVLEVMQFIYDNIMYAELNTKSDYCQVCGYDGEIEIKEDDGKLVWVCPQCGNTDQNKMNVARRTCGYIGTQFWNQGRTQEIKDRVLHL

SEQ ID NO: 980 - protein, 768 aa, unidentified
  REGION 1..768: note = Description of Unknown:uncultivated organism sequence
  REGION 1..768: note = Category: MG60 effectors
  REGION 1..768: note = Description: MG60-194 effector
MFCSCKKKLCVVIYIYDATKTYDCAKKLIVYKSIIKGAEVMKIIKRNGAEETFDRQKIKDAIAKANNETDGTPELTDRQIDYISLVIEDHCNEMNRALSVEEIQELVETHIILQGAPETAKRYIRYRFTRNLARASNTTDNQILSLIECNNEEVKQENSNKNPTVNSVQRDYMAGEVSKDLTKRILLPEDIVKAHEEGLIHFHDADYFAQHMHNCDLVNLEDMLQNGTVISGTMIEKPHSFSTACNIATQIIAQVASNQYGGQSISLAHLAPFVQISREKITRQVRAEMEEFGIDADDEQVKSLVEKRVRDEIKRGVQTIQYQVVTLLTTNGQAPFVTVFMYLNEAKNEQEKKDLAIIIEEVLKQRIKGTKNEVGVWVTPAFPKLIYVLEEDNITEDSRFWYLTKLAAECTAKRMVPDYISEKIMLELKIDKNGNGNCYTCMGCRSFLTPYVDENGKPKYYGRFNQGVVTINLVDVACTAARDGNKSEEKFWQVLDERLELCHRALQCRHERLEGTLSDAAPILWQYGALARLKKGEPIDKLLHGGYSTLSLGYAGLWECVYEITGKKLTEKEGEEFGLRVMQRLNDACAEWKAAENIDYSIYGTPLESTTYKFAKCLQNRFGIIKGVTDRNYITNSYHIHVTEKIDAFSKLELESKFQKLSPGGAISYVEVPNMQQNIPAVLEVMKFIYNNIMYAELNTKSDYCQVCGYDGEIQIVEEDGKLVWRCPNCGNEDQSKMNVARRTCGYIGSQFWNQGRTQEIKERVLHL

SEQ ID NO: 981 - protein, 755 aa, unidentified
  REGION 1..755: note = Description of Unknown:uncultivated organism sequence
  REGION 1..755: note = Category: MG60 effectors
  REGION 1..755: note = Description: MG60-195 effector
MHELIEKREPKEEKPMKIIKRNGAEVVFDIDKIIMAVTKANDAVDEKVRMTPLQIERISQSVQIACEEMGRSPSVEEIQDLVEKAIMAHGAFEVAKEYITYRYTRSLLRQSNTTDDRILSLIECNNEEVKQENANKNPTINAVQRDYMAGEVSKDITSRILLPKEVVDAHEAGIIHFHDADYYAQHMHNCDLVNLEDMLQNGTVISGTLIEKPHSFSTACNIATQIIAQVASNQYGGQSISLTHLAPFVQVSREKIRKTVEREMAAFGVAPAEETISKVVEDRLREEVRRGVQPIQYQVVTLMTTNGQAPFITVFMYLNEAKSEQEKKDLAMIIEETLRQRYEGVKNEKGVWIAPAFPKLIYVLEEDNVREGTPYWYLTRLAAQCTAKRMVPDYISEKKMREYKLSKGETPGRGDVYPCMGCRSFLTPDRSGNGWDNVARAGNYEPGKPKYYGRFNQGVVTINLVDVALSSGRDMTKFWEIFEDRLELCHRALRCRHERLKGTLSDAAPILWQYGALARLKKGEKIDKLLYGGYSTISLGYAGLYECVKYMTGKSHTDDEAKPFALSVMQKMNDKCLQWKTAENIDYSLYGTPLESTTYKFAKCLQKRFGLIPGITDKSYITNSYHVHVTEPIDAFTKLRFEAEFQQLSPGGAISYVEVPNMQNNIDAVLEVMQFIYDNIMYAELNTKSDYCQVCGYDGEIEIKEDDGKLVWVCPQCGNTDQNKMNVARRTCGYIGTQFWNQGRTQEIKDRVLHL

SEQ ID NO: 982 - protein, 817 aa, unidentified
  REGION 1..817: note = Description of Unknown:uncultivated organism sequence
  REGION 1..817: note = Category: MG60 effectors
  REGION 1..817: note = Description: MG60-196 effector
MAETLICTQCGSHKLKKLSDTQYVCDSCGTTTDLDLFNNEIGLKLNLAMTTRQTAKFDEAKSLYEQVKSILRPDQCAPEVYFGLFACEYKVLFELDNRTGNRVPIFYSSSESNVFDNKNLKKALEQARDVSFSKFEEYNELAMKVEAARMSYQKLSKLVTPFDIFICFKKTDLDGISDTRDYSTAMSLYSKLVDKFPKYHIFFSEKTLAEIPLTEYEPNIYYALHTSKILMVVSSKRDYLESQWVKNEWTRFLAINKANAIIPIYLKGTNVNIFPSEILKNNAYEEGDYDRIFTSIDSIMNSERYVKERDAEKKRKKDEIFEEVQKRLSKSFNAPNSNLSNMFKRMINDLSDGVFENAQKICDSIFNVDAEHPLAWLYSYLIDKKLTSLEQLKDQYESNWTEDRAIKKAIEFSKIDGYQDERNKIEDELYKWISYMVTEAIDLTHRKKYDDARSKLVKVATHVEEFGRDHRFDYFYHNFLLEMNCTNTNDLVSLQGIEKNAYFSKALKYANENQHIQLDEIIKVAKDNASKYQEQIIKNNTQLEASFAKLDLAVKSKFDEGNKLIELCHENEKEAKIKIKNFEDEAKKSKEQVILQKAEIIEKKAELAKYYSSRSEKMSRFLCNIRAIILGTVTYSILFIYAPGTVILSFTFIIPLLIIAILFNFINISIHKRQRDGRTIKGFVIFGIISGMILLNIPLLIGYSRNRYYKKIDSKTRKLDNDIYSKDQQLKTIEDKKQIDIKSEKEFIDRRMQYAKKVTEIMDTITSRSNQLKKDYPIFSLDKGITLKVKLEKDMNMFKESMVKLDEQIYDISHIAF

SEQ ID NO: 983 - protein, 755 aa, unidentified
  REGION 1..755: note = Description of Unknown:uncultivated organism sequence
  REGION 1..755: note = Category: MG60 effectors
  REGION 1..755: note = Description: MG60-197 effector
MHELIEKREPKEEKPMKIIKRNGAEVVFDIDKIIMAVTKANDAVDEKVRMTPLQIERISQSVQIACEEMGRSPSVEEIQDLVEKAIMAHGAFEVAKEYITYRYTRSLLRQSNTTDDRILSLIECNNEEVKQENANKNPTINAVQRDYMAGEVSKDITSRILLPKEVVDAHEAGIIHFHDADYYAQHMHNCDLVNLEDMLQNGTVISGTLIEKPHSFSTACNIATQIIAQVASNQYGGQSISLTHLAPFVQVSREKIRKTVEREMAAFGVAPAEETISKVVEDRLREEVRRGVQTIQYQVVTLMTTNGQAPFITVFMYLNEAKSEQEKKDLAMIIEETLRQRYEGVKNEKGVWITPAFPKLIYVLEEDNVREGTPYWYLTRLAAQCTAKRMVPDYISEKKMREYKLSKGETPGHGDVYTCMGCRSFLTPDRSGNGWDNVARAGNYEPGKPKYYGRFNQGVVTINLVDVALSSGRDVTKFWEVFEDRLELCHRALRCRHERLKGTLSDAAPILWQYGALARLPKGEPIDKLLYGGYSTISLGYAGLYECVKYMTGKSHTDDEAKPFALSVMQKMNDKCLQWKTAENIDYSLYGTPLESTTYKFAKCLQKRFGLVPGITDKSYITNSYHVHVTEPIDAFTKLRFEAEFQQLSPGGAISYVEVPNMQNNIDAVLEVMQFIYDNIMYAELNTKSDYCQVCGYDGEIEIKEDDGKLIWVCPQCGNTDQNKMNVARRTCGYIGTQFWNQGRTQEIKDRVLHL

SEQ ID NO: 984 - protein, 755 aa, unidentified
  REGION 1..755: note = Description of Unknown:uncultivated organism sequence
  REGION 1..755: note = Category: MG60 effectors
  REGION 1..755: note = Description: MG60-198 effector
MHELIEKREPKEEKPMKIIKRNGAEVVFDIDKIIMAVTKANDAVDEKVRMTPLQIERISQSVQIACEEMGRSPSVEEIQDLVEKAIMAHGAFEVAKEYITYRYTRSLLRQSNTTDDRILSLIECNNEEVKQENANKNPTINAVQRDYMAGEVSKDITSRILLPKEVVDAHEAGIIHFHDADYYAQHMHNCDLVNLEDMLQNGTVISGTLIEKPHSFSTACNIAAQIIAQVASNQYGGQSISLTHLAPFVQVSREKIRKTVEREMAVFGVSPAEETISKVVEDRLREEVRRGVQTIQYQVVTLMTTNGQAPFITVFMYLNEAKNEQEKKDLAMIIEETLRQRYEGVKNEKGVWITPAFPKLIYVLEEDNVREGTPYWYLTRLAAQCTAKRMVPDYISEKKMREYKLSKGETPGHGDVYTCMGCRSFLTPDRSGNGWDNVARAGNYEPGKPKYYGRFNQGVVTINLVDVALSSGRDMTKFWEVFEDRLELCHRALRCRHERLKGTLSDAAPILWQYGALARLPKGEPIDKLLYGGYSTISLGYAGLYECVKYMTGKSHTDDEAKPFALSVMQKMNDKCLQWKTAENIDYSLYGTPLESTTYKFAKCLQKRFGLIPGITDKSYITNSYHVHVTEPIDAFTKLRFEAEFQQLSPGGAISYVEVPNMQNNIDAVLEVMQFIYDNIMYAELNTKSDYCQVCGYDGEIEIKEDDGKLIWVCPQCGNTDQNKMNVARRTCGYIGTQFWNQGRTQEIKDRVLHL

SEQ ID NO: 985 - protein, 832 aa, unidentified
  REGION 1..832: note = Description of Unknown:uncultivated organism sequence
  REGION 1..832: note = Category: MG60 effectors
  REGION 1..832: note = Description: MG60-199 effector
MSLSFFATCPKGLENLLLKELVSLGATEVKETVAGVSFKGDFALGMRVCMWTRLASRVLLEISEFYAGTDTDLYLGALAVDYEKYFEVSNTIAVSFKGTSEAIRNTQYGALKIKDAVCDYFLKRNGIRPNVDKDNPDILITCHLDRKDNAHLLFDLSGNALHMRDFNRHTGMAPLKENLACAMLLRSGYNGSNLVDPMCGSGTLLLEAAAMATDTAPGICRDHYGFLQLKLCDRSAYTSLVEEMHKRSREGMLKFKQSGYKLFGFDADERIIDIALENAKKSGFADIIQFQVQSVETLVNPFDDLNDETQNKNAPSFFVITNPPYGQRMGNFNELISLYTKLGAVFKEQFRGAVCAVISSSEDLLSCLRLHADKIYKLYNGELLCQLRIFSIRQGEEGSESLSKDNLATDFANRLRKNLLKMNKWAKTLGLEAYRVYDADVPEYAAAIDYYKGYYVISTYKAQNKVSEKIEKRHELDMLGATIEVTGVSGSKVILKSREVKKGNSQYERLREDNSALIEIREGPFAFKVNLYDYLDTGLFLDGRLIRQYLYEHASNCSVLNLFAYTCSASVAAALGGASLITSVDMSKTYLEWGYENFLLNQIEAHSHEFIQADVLAFVSKDPEHKYDLIYVDPPTFSNSKRMQNTFDVRRDHLQLLGNLTRFLRDGAEVVFCTNLRSFRIDERLDEFGYSVTDLSSKTLPFDFKRNEHIHHCYSLIYHEKERRCEPVAFVSSNVNPKWSKVLYGIRKTNEQEITPKNKSVNGRPSRASTMVRFNASGMTEIHTDGNRDTSAFRHNNNRNFKSSKLRPAALRPKSSAKPRVFGPEGVKEGVQ

SEQ ID NO: 986 - protein, 1202 aa, unidentified
  REGION 1..1202: note = Description of Unknown:uncultivated organism sequence
  REGION 1..1202: note = Category: MG60 effectors
  REGION 1..1202: note = Description: MG60-200 effector
MFDDLKNLYEVRKTVRFELKPYRKTREVLKWNDSYDNLDAFIKHIKEDFQKDFNWNEFCKWQYQYFLDESRILFDFISHHICIHISDDDWNIKTTTSIQFNFKWLKGIFKNIPALKKCLDFKSLMKKILEIEEEYSECFRFFEMEKERKNEKQSDISEYLRKIAFLNRNTLTIFQFLWNNQERTTDEHILKRYQAMLSDLWETFEKLNNTIIASHQNETTGACFGKFTFNKYALFRREAEDLKEKYKQHKQKVEKYVDRMIQDEDFTEDNGRNITIDTWTIHKLVLKKENSGLQSILKTFNFHRDLDEVISELDEINGNLLNQYIQEFQDEYKKDTSIIDVEFHVFKTKEWREMKIYDKTGKPPKLKELFDRDYNATIKVQPWQTLEGYEYLYLIWKENTTWEEKKKQKLANKFLRILFKQEFINSDFNTIKKFRDALSRQRGKIRQDVRTSGREFIQEAMIRYYGNILEKDWYYFLALTRKEDIPDNSIENITMEKYIRNMAEKWDFSIFLYSQLSFRSLEKLCLMEDGDLIIHSELTEQWNKYKNQKKDIEWGCRHHKTSFDKYCEECNLVKEGKQKQFLERFRDHIVDAIEKLRNDSKYKGEDWSIFIPEIEKLSSIEKIVHFIDEKFYKLKKKYINANKVFELAEQWKVLLFQLYNKDFSIYDENFVSHEERLEENEHWEATKMQSSTKRASNKQPNLFTLYWKEIFQLSDTSLWQEGGIFFRKADTEKIEKRFRNNKFFWAFDVRFNKWKVIAKTKLCEKKEKFQQSTIDAINIITKRNVVNNQKIKENIVFVGIDRGKKEHLSIGFYDNNLNHLWIIGNTNFVKKIGVNQINFSICFRSKITYFDDQTELNIYKQIATNEYYFDEYWKVEEGHHLELLGLRDYHVKRIFTQDINGNYFVWLKNGWRFILNKWKYWYKIVDKDNNELVLHDTLDGKEIIDYYLLFESERYKRILDINSELQYSTNMKNLKKWYIAIVKDFFKQKIQEFSEKWKEIVFALENQSTNKGTITKDYKGASIISEIEEELLNSFVYLKYKAKSLLNGIQLGITIKKDELNTLSKSGKKTNAEYGHYWHFLFVNPDFTSEACPVCNKDINLFDIDRWNDKEENKNNQKSLSKLYWHWKWKLWESNMHHCDNPGNCPNIESHISTQNTSKCDYHMKDNRKWFDFLTSWDDLATYNIAKKAKEYLEFLSEQSSR

SEQ ID NO: 987 - protein, 755 aa, unidentified
  REGION 1..755: note = Description of Unknown:uncultivated organism sequence
  REGION 1..755: note = Category: MG60 effectors
  REGION 1..755: note = Description: MG60-201 effector
MHELIEKREPKEEKPMKIIKRNGAEVVFDIDKIIMAVTKANDAVDEKVRMTPLQIERISQSVQIACEEMGRSPSVEEIQDLVEKAIMAHGAFEVAKEYITYRYTRSLLRQSNTTDDRILSLIECNNEEVKQENANKNPTINAVQRDYMAGEVSKDITSRILLPKEVVDAHEAGIIHFHDADYYAQHMHNCDLVNLEDMLQNGTVISGTLIEKPHSFSTACNIATQIIAQVASNQYGGQSISLTHLAPFVQVSREKIRKTVEREMAAFGVAPAEETISKVVEDRLREEVRRGVQTIQYQVVTLMTTNGQAPFITVFMYLNEAKSEQEKKDLAMIIEETLRQRYEGVKNEKGVWITPAFPKLIYVLEEDNVREGTPYWYLTRLAAQCTAKRMVPDYISEKKMREYKLSKGETPGHGDVYTCMGCRSFLTPDRSGNGWDNVAGAGNYEPGKPKYYGRFNQGVVTINLVDVALSSGRDMTKFWEVFEDRLELCHRALRCRHERLKGTLSDAAPILWQYGALARLPKGEPIDKLLYGGYSTISLGYAGLYECVKYMTGKSHTDDEAKPFALSVMQKMNDKCLQWKTAENIDYSLYGTPLESTTYKFAKCLQKRFGLIPGITDKSYITNSYHVHVTEPIDAFTKLRFEAEFQQLSPGGAISYVEVPNMQNNIDAVLEVMQFIYDNIMYAELNTKSDYCQVCGYDGEIEIKEDDGKLIWVCPQCGNTDQNKMNVARRTCGYIGTQFWNQGRTQEIKDRVLHL

SEQ ID NO: 988 - protein, 755 aa, unidentified
  REGION 1..755: note = Description of Unknown:uncultivated organism sequence
  REGION 1..755: note = Category: MG60 effectors
  REGION 1..755: note = Description: MG60-202 effector
MHELIEKREPKEEKPMKIIKRNGAEVVFDIDKIIMAVTKANDAVDEKVRMTPLQIERISQSVQIACEEMGRSPSVEEIQDLVEKAIMAHGAFEVAKEYITYRYTRSLLRQSNTTDDRILSLIECNNEEVKQENANKNPTINAVQRDYMAGEVSKDITSRILLPKEVVDAHEAGIIHFHDADYYAQHMHNCDLVNLEDMLQNGTVISGTLIEKPHSFSTACNIATQIIAQVASNQYGGQSISLTHLAPFVQVSREKIRKTVEREMAAFGVAPAEETISKVVEDRLREEVRRGVQTIQYQVVTLMTTNGQAPFITVFMYLNEAKSEQEKKDLAMIIEETLRQRYEGVKNEKGVWITPAFPKLIYVLEEDNVREGTPYWYLTRLAAQCTAKRMVPDYISEKKMREYKLSKGETPGHGDVYTCMGCRSFLTPDRSGNGWDNVARAGNYEPGKPKYYGRFNQGVVTINLVDVALSSGRDMTKFWEVFEDRLELCHRALRCRHERLKGTLSDAAPILWQYGALARLPKGEPIDKLLYGGYSTISLGYAGLYECVKYMTGKSHTDDEAKPFALSVMQKMNDKCLQWKTAENIDYSLYGTPLESTTYKFAKCLQKRFGLVPGITDKSYITNSYHVHVTEPIDAFTKLRFEAEFQQLSPGGAISYVEVPNMQNNIDAVLEVMQFIYDNIMYAELNTKSDYCQVCGYDGEIEIKEDDGKLVWVCPQCGNTDQNKMNVARRTCGYIGTQFWNQGRTQEIKDRVLHL

SEQ ID NO: 989 - protein, 761 aa, unidentified
  REGION 1..761: note = Description of Unknown:uncultivated organism sequence
  REGION 1..761: note = Category: MG60 effectors
  REGION 1..761: note = Description: MG60-203 effector
MHKAALPFGAVMFALYSSVSYFSEGCFSVMKIIKRNGSEAAFDISKIIVAIGKANATVDESIRMTPVQIQRIAESVVLSCERLGRSPSVEEVQDMVEKQIMAHGAFEVAKNYITYRYTRTLVRQSNTTDDKILSLIECNNEEAKQENSNKNPVVNSTQRDYMAGEVSRDITNRILLPKEIVEAHNEGVIHFHDTDYFAQHMHNCDLVNLEDMLQNGTVITGTLIERPHSFSTACNIATQIIAQVASNQYGGQSISLAHLAPFVDVSRKKIRAQVEAEMAELGVERDEAKLSSIVEKRLREEIRRGVQTIQYQVVTLLTTNGQAPFVTVSMYLGEAKNEQEKKDLAMVIEETLLQRYQGVKNEKGVWVTPAFPKLIYTLDEDNIYPDSPYYYLTELAAKCTARRMVPDYISAKKMRELKGDVYTCMGCRSFLTPDRFTDAGVGNIANALNYEPGKHKYYGRFNQGVVTINLPDVALSSGGNVEKFWQIFEDRLELCHRALQYRHNRLKGTLSDAAPILWQYGACARLKKGEPIDKLLYDGYSTISLGYAGLYECVKFMTGRSHTDPTATPFALQIMQKMNDKCKQWKEAENIDYSLYGTPLESTTYKFAKCLQKRFGIIPGVTDKGYITNSYHVHVTEKIDAFTKLGFEAQFQHLSPGGAISYVEVPDMQNNIEAVLQVMRFIYDNIIYAELNTKSDYCQKCGWDGEITIKEQDGKLVWTCPQCGNQDQDTMNVARRTCGYIGTQFWNQGRTQEIKDRVLHL

SEQ ID NO: 990 - protein, 768 aa, unidentified
  REGION 1..768: note = Description of Unknown:uncultivated organism sequence
  REGION 1..768: note = Category: MG60 effectors
  REGION 1..768: note = Description: MG60-204 effector
MFCSCKKNLCVVIYIYDATKTYDCAKKLIVYKSIIKGAEVMKIIKRNGAEETFDRQKIKDAIAKANNETDGTPELTDRQIDYISLVIEDHCNEMNRALSVEEIQELVETHIILQGAPETAKRYIRYRFTRNLARASNTTDNQILSLIECNNEEVKQENSNKNPTVNSVQRDYMAGEVSKDLTKRILLPEDIVKAHEEGLIHFHDADYFAQHMHNCDLVNLEDMLQNGTVISGTMIEKPHSFSTACNIATQIIAQVASNQYGGQSISLAHLASFVQISREKITRQVRAEMEEFGIAADDEQVKSLVEKRVRDEIKRGVQTIQYQVVTLLTTNGQAPFVTVFMYLNEAKNEQEKKDLAIIIEEVLKQRIKGTKNEVGVWVTPAFPKLIYVLEEDNITEDSRFWYLTKLAAECTAKRMVPDYISEKIMLKLKIDKNGNGNCYTCMGCRSFLTPYVDENGKPKYYGRFNQGVVTINLVDVACTAARDGNKSEEKFWQVLDERLELCHRALQCRHERLEGTLSDAAPILWQYGALARLKKGEPIDKLLHGGYSTLSLGYAGLWECVYEITGKKLTEKEGEEFGLRVMQRLNDACAEWKAAENIDYSIYGTPLESTTYKFAKCLQNRFGIIKGVTDRNYITNSYHIHVTEKIDAFSKLELESKFQKLSPGGAISYVEVPNMQQNIPAVLEVMKFIYNNIMYAELNTKSDYCQVCGYDGEIQIVEEDGKLVWRCPNCGNEDQSKMNVARRTCGYIGSQFWNQGRTQEIKERVLHL

SEQ ID NO: 991 - protein, 755 aa, unidentified
  REGION 1..755: note = Description of Unknown:uncultivated organism sequence
  REGION 1..755: note = Category: MG60 effectors
  REGION 1..755: note = Description: MG60-205 effector
MHELIEKREPKEEKPMKIIKRNGAEVVFDIDKIIMAVTKANDAVDEKVRMTPLQIERISQSVQIACEEMGRSPSVEEIQDLVEKAIMAHGAFEVAKEYITYRYTRSLLRQSNTTDDRILSLIECNNEEVKQENANKNPTINAVQRDYMAGEVSKDITSRILLPKEVVDAHEAGIIHFHDADYYAQHMHNCDLVNLEDMLQNGTVISGTLIEKPHSFSTACNIATQIIAQVASNQYGGQSISLTHLAPFVQVSREKIRKTVEREMAAFGVAPAEETISKVVEDRLREEVRRGVQTIQYQVVTLMTTNGQAPFITVFMYLNEAKSEQEKKDLAMIIEETLRQRYEGVKNEKGVWITPAFPKLIYVLEEDNVRDGTPYWYLTRLAAQCTAKRMVPDYISEKKMREYKLSKGETPGHGDVYTCMGCRSFLTPDRSGNGWDNVARAGNYEPGKPKYYGRFNQGVVTINLVDVALSSGRDMTKFWEVFEDRLELCHRALRCRHERLKGTLSDAAPILWQYGALARLPKGEPIDKLLYGGYSTISLGYAGLYECVKYMTGKSHTDDEAKPFALSVMQKMNDKCLQWKTAENIDYSLYGTPLESTTYKFAKCLQKRFGLIPGITDKSYITNSYHVHVTEPIDAFTKLRFEAEFQQLSPGGAISYVEVPNMQNNIDAVLEVMQFIYDNIMYAELNTKSDYCQVCGYDGEIEIKEDDGKLIWVCPQCGNTDQNKMNVARRTCGYIGTQFWNQGRTQEIKDRVLHL

SEQ ID NO: 992 - protein, 761 aa, unidentified
  REGION 1..761: note = Description of Unknown:uncultivated organism sequence
  REGION 1..761: note = Category: MG60 effectors
  REGION 1..761: note = Description: MG60-206 effector
MHKAALPFGAVMFALYSSVSYFSEGCFSVMKIIKRNGSEAAFDISKIIVAIGKANATVDESTRMTPVQIQRIAESVVLSCEKLGRSPSVEEVQDMVEKQIMAHGAFEVAKNYITYRYTRTLVRQSNTTDDKILSLIECNNEEAKQENSNKNPVVNSTQRDYMAGEVSRDITNRILLPKEIVEAHNEGVIHFHDTDYFAQHMHNCDLVNLEDMLQNGTVITGTLIERPHSFSTACNIATQIIAQVASNQYGGQSISLAHLAPFVDVSRKKIRAQVEAEMAELGVERDEAKLSSIVEKRLREEIRRGVQTIQYQVVTLLTTNGQAPFVTVSMYLGEAKNEQEKKDLALVIEETLLQRYQGVKNEKGVWVTPAFPKLIYTLDEDNIYPDSPYYYLTELAAKCTARRMVPDYISAKKMRELKGDVYTCMGCRSFLTPDRFTDAGVGNIANALNYEPGKHKYYGRFNQGVVTINLPDVALSSGGNVEKFWQIFEDRLELCHRALQYRHNRLKGTLSDAAPILWQYGACARLKKGEPIDKLLYDGYSTISLGYAGLYECVKFMTGRSHTDPTATPFALQIMQKMNDKCKQWKEAENIDYSLYGTPLESTTYKFAKCLQKRFGIIPGVTDKGYITNSYHVHVTEKIDAFTKLGFEAQFQHLSPGGAISYVEVPDMQNNIEAVLQVMRFIYDNIIYAELNTKSDYCQKCGWDGEIIIKEQDGKLVWTCPQCGNQDQDTMNVARRTCGYIGTQFWNQGRTQEIKDRVLHL

SEQ ID NO: 993 - protein, 768 aa, unidentified
  REGION 1..768: note = Description of Unknown:uncultivated organism sequence
  REGION 1..768: note = Category: MG60 effectors
  REGION 1..768: note = Description: MG60-207 effector
MFCSCKKNLCVVIYIYNATKTYDCAKKLIVYKSIIKGAEVMKIIKRNGAEETFDRQKIKDAIAKANNETDGTPELTDRQIDYISLVIEDHCNEMNRALSVEEIQELVETHIILQGAPETAKRYIRYRFTRNLARASNTTDNQILSLIECNNEEVKQENSNKNPTVNSVQRDYMAGEVSKDLTKRILLPEDIVKAHEEGLIHFHDADYFAQHMHNCDLVNLEDMLQNGTVISGTMIEKPHSFSTACNIATQIIAQVASNQYGGQSISLAHLAPFVQISREKITRQVRAEMEEFGIAADDEQVKSLVEKRVRDEIKRGVQTIQYQVVTLLTTNGQAPFVTVFMYLNEAKNEQEKKDLAIIIEEVLKQRIKGTKNEVGVWVTPAFPKLIYVLEEDNITEDSRFWYLTKLAAECTAKRMVPDYISEKIMLKLKIDKNGNGNCYTCMGCRSFLTPYVDENGKPKYYGRFNQGVVTINLVDVACTAARDGSKSEEKFWQVLDERLELCHRALQCRHERLEGTLSDAAPILWQYGALARLKKGEPIDKLLHGGYSTLSLGYAGLWECVYEITGKKLTEKEGEEFGLRVMQRLNDACAEWKAAENIDYSIYGTPLESTTYKFAKCLQNRFGIIKGVTDRNYITNSYHIHVTEKIDAFSKLELESKFQKLSPGGAISYVEVPNMQQNIPAVLEVMKFIYNNIMYAELNTKSDYCQVCGYDGEIQIVEEDGKLVWRCPNCGNEDQSKMNVARRTCGYIGSQFWNQGRTQEIKERVLHL

SEQ ID NO: 994 - protein, 755 aa, unidentified
  REGION 1..755: note = Description of Unknown:uncultivated organism sequence
  REGION 1..755: note = Category: MG60 effectors
  REGION 1..755: note = Description: MG60-208 effector
MHELIEKREPKEEKPMKIIKRNGAEVVFDIDKIIMAVTKANDAVDEKVRMTPLQIERISQSVQIACEEMGRSPSVEEIQDLVEKAIMAHGAFEVAKEYITYRYTRSLLRQSNTTDDRILSLIECNNEEVKQENANKNPTINAVQRDYMAGEVSKDITSRILLPKEVVDAHEAGIIHFHDADYYAQHMHNCDLVNLEDMLQNGTVISGTLIEKPHSFSTACNIATQIIAQVASNQYGGQSISLTHLAPFVQVSREKIRKTVEREMAAFGVAPAEETISKVVEDRLREEVRRGVQTIQYQVVTLMTTNGQAPFITVFMYLNEAKSEQEKKDLAMIIEETLRQRYEGVKNEKGVWITPAFPKLIYVLEEDNVREGTPYWYLTRLAAQCTAKRMVPDYISEKKMREYKLSKGETPGHGDVYTCMGCRSFLTPDRSGNGWDNVARAGNYEPGKPKYYGRFNQGVVTINLVDVALSSGRDVTKFWEVFEDRLELCHRALRCRHERLKGTLSDAAPILWQYGALARLPKGEPIDKLLYGGYSTISLGYAGLYECVKYMTGKSHTDDEAKPFALSVMQKMNDKCLQWKTAENIDYSLYGTPLESTTYKFAKCLQKRFGLIPGITDKSYITNSYHVHVTEPIDAFTKLRFEAEFQQLSPGGAISYVEVPNMQNNIDAVLEVMQFIYDNIMYAELNTKSDYCQVCGYDGEIEIKEDDGKLIWVCPQCGNTDQNKMNVARRTCGYIGTQFWNQGRTQEIKDRVLHL

SEQ ID NO: 995 - protein, 939 aa, unidentified
  REGION 1..939: note = Description of Unknown:uncultivated organism sequence
  REGION 1..939: note = Category: MG60 effectors
  REGION 1..939: note = Description: MG60-209 effector
MFNFTPKIGEKEISIVKALTTNEIEDLRNRIASYDPFQLFEVNPHNDKEIICPICGNGNGENHTGVKPSNENNHWIFHCFKCERFNGDLLSVIASENNLSTKGEDFFKVLTIGARIINFNFNLNHTTFSSNKKTKKDVPKAELDLIHTDILETQKNLRDLIEEQGGKWRGLTLETLEHFHCGYILNWIPPKIRLKYAQGQRDKLPVTSRRVILPTQNHYNAVMIDSDRNTENKSYWKMHAGHKEPFGLDFIPADADLIIIVEGEVDAMSIYQATDTNIYVFSTGGAGEKKFISELEEKFQGRKLPHIIILFDSDESGRNGANNLRENLIQRGFLVVVKFIDESDIKIDSNDILQEQGDAALKLRLDNLISAAQIEFAEIEKEMAESEAKRKSDPLYLDEETRAKLFGGGITDFDNAERLVLLFGDKFRYFKDLDRWVFYTNDFWTIAPTGKSSALFHFGRKTAEFIEFNATADADKKIAENFVKKFENHRYLSPICSMVKGLEEIYITQEDLDKHQMLLNCANGVVDLETGKLYKHDPSLYFTKKSPVVYNPECNSIDFEKFMQDVLPNEETRRAVLRYLGYCLCGDIREEKALFIVGDGRNGKGTLAKVLMAILDDYATPFKIDALLQRRFDKDGDAATPEFAKLEGRRLAIANEIPQGKNLDVAHFKDLTGGDQISIRRLHQEATTIKNPTHHFILCGQHYPEIKDANDLGLRERIIAVRFPQSFTGENCDPNLKKKLLTPENLSGALNILVQECINWQREGLIISDDMKAEKQEYLDANNFIQDFISEYCVFDADKKILRKELLSVLKENYRSEIAGLSDQALTDMLKKIEGVEYKNNIGKKHLSYFYGIGLSDEKQNSLEFAAVNKNDKTFNLQEHSNNLSDSEAEKLVLKMESEGYSNEEIIEELIKGGIDSSFAHEHLNHLKPENIPDHCIPF

SEQ ID NO: 996 - protein, 755 aa, unidentified
  REGION 1..755: note = Description of Unknown:uncultivated organism sequence
  REGION 1..755: note = Category: MG60 effectors
  REGION 1..755: note = Description: MG60-210 effector
MHELIEKREPKEEKPMKIIKRNGAEVVFDIDKIIMAVTKANDAVDEKVRMTPLQIERISQSVQIACEEMGRSPSVEEIQDLVEKAIMAHGAFEVAKEYITYRYTRSLLRQSNTTDDRILSLIECNNEEVKQENANKNPTINAVQRDYMAGEVSKDITSRILLPKEVVDAHEAGIIHFHDADYYAQHMHNCDLVNLEDMLQNGTVISGTLIEKPHSFSTACNIATQIIAQVASNQYGGQSISLTHLAPFVQVSREKIRKTVEREMAAFGVAPADETISKVVEDRLREEVRRGVQTIQYQVVTLMTTNGQAPFITVFMYLNEAKSEQEKKDLAMIIEETLRQRYEGVKNEKGVWITPAFPKLIYVLEEDNVREGTPYWYLTRLAAQCTAKRMVPDYISEKKMREYKLSKGETPGHGDVYTCMGCRSFLTPDRSGNGWDNVARAGNYEPGKPKYYGRFNQGVVTINLVDVALSSGRDMTKFWEVFEDRLELCHRALRCRHERLKGTLSDAAPILWQYGALARLPKGEPIDKLLYGGYSTISLGYAGLYECVKYMTGKSHTDDEAKPFALSVMQKMNDKCLQWKTAENIDYSLYGTPLESTTYKFAKCLQKRFGLVPGITDKSYITNSYHVHVTEPIDAFTKLRFEAEFQQLSPGGAISYVEVPNMQNNIDAVLEVMQFIYDNIMYAELNTKSDYCQVCGYDGEIEIKEDDGKLVWVCPQCGNTDQNKMNVARRTCGYIGTQFWNQGRTQEIKDRVLHL

SEQ ID NO: 997 - protein, 783 aa, unidentified
  REGION 1..783: note = Description of Unknown:uncultivated organism sequence
  REGION 1..783: note = Category: MG60 effectors
  REGION 1..783: note = Description: MG60-211 effector
MMRVVKRDGKIVDFDESRIKIAIGKANNEVDESQRATEEEIEKIVEYVKKVKKDRILVEDIQDIIENKLMEYKRFELAKAYITYRYSRALVRKANTTDQTVKELVEGNSEYWNNENSNKNARVVTTQRDYLAGITSTDITRRLLLPPEIVKAHDEGIIHFHDADYFAQNALTNCCLINLNDMLQNGTVINGVMIEKPHRFVTACTIATQIILGVSSSQYGGCTVTLTHLAPFVRDSYNRSLKKYQDRNLPEEECKKFAMQDTKKEIADGVQTFNYQVNSMTNTNGQAPFLSVNMYLGETDEYKDELAMIIEEFLRQRMLGFKNEKGVYITPAFPKLLYVLEEDNIHKDSKYWYLTELAAKCTAKRMVPDYISEKMMKKLKINQYGEGDCYPCMGCRSFLTPDRVKGNVAKAKDYVEGKGKYYGRFNQGVVTINLPDVALSSKKDEKEFWKIFDERLELCHEALQLRHKRLSGITSDVAPLLWQYGAYARLNKGEKLDKLLHGGYSTLSLGYAGLYECVKYMTGDSHTDGGKGEKFALEVMQHMNDKCAEWKKAEDSDYSLYGTPIESTTYKFAKCLKKRFGTVEGVTDRNYITNSYHVPVFEEIDAFSKLKLESEFQRLSPGGAISYVETPNLQNNIEVVEQIIEFIYNNIMYAELNTKSDYCQKCGYTGEILIDDNLEWYCPNCGNRDHRTLNVARRTCGYIGTNFWNKGRTQEIKERVLHIDNKDFDAEKCTKCDEDVNVVSKCCNDSNESTESDKNVEKHEKKTRAKVSAKEKAMASVHA

SEQ ID NO: 998 - protein, 762 aa, unidentified
  REGION 1..762: note = Description of Unknown:uncultivated organism sequence
  REGION 1..762: note = Category: MG60 effectors
  REGION 1..762: note = Description: MG60-212 effector
MRVVKRDGKIVDFDESRIKIAIGKANNEVDESQRATEEEIEKIVEYVKKVKKDRILVEDIQDIIENKLMEYKRFELAKAYITYRYSRALVRKANTTDQTVKELVEGNSEYWNNENSNKNAKVVTTQRDYLAGITSTDITRRLLLPPEIVKAHDEGIIHFHDADYFAQNALTNCCLINLNDMLQNGTVINGVMIEKPHRFLTACTIATQIILGVSSSQYGGCTVTLTHLAPFVRDSYNRILKKYQDRNLPEEECKKFAMQDTKKEIADGVQTFNYQVNSMTNTNGQAPFLSVNMYLGETDEYKDELAMIIEEFLKQRMLGFKNEKGVYITPAFPKLLYVLEEDNIHKDSKYWYLTELAAKCTAKRMVPDYISEKMMKKLKINQYGEGDCYPCMGCRSFLTPDRVKGNVAKAKDYVEGKGKYYGRFNQGVVTINLPDVALSSKKDEKEFWKIFDERLELCHEALQLRHKRLSGITSDVAPLLWQYGAYARLDKGEKLDKLLHGGYSTLSLGYAGLYECVKYMTGDSHTDGGKGEKFALEVMQHMNDKCAEWKKAEDIDYSLYGTPIESTTYKFAKCLKKRFGTVEGITDRNYITNSYHVPVFEEIDAFSKLKLESEFQRLSPGGAISYVETPNLQNNIEVVEQIIEFIYNNIMYAELNTKSDYCQKCGYTGEILIDDNLEWYCPNCGNRDHRTLNVARRTCGYIGTNFWNKGRTQEIKERVLHIDNKDFDAEKCTKCDENVEKHEKKTRAKVSAKEKAIASVHA

SEQ ID NO: 999 - protein, 763 aa, unidentified
  REGION 1..763: note = Description of Unknown:uncultivated organism sequence
  REGION 1..763: note = Category: MG60 effectors
  REGION 1..763: note = Description: MG60-213 effector
MYIQPIITVSDTTHKFNFVKLFFQKNKNSLRDVWRGNGMKIIKRNGEEVVFDLKKIITAISKANNEVPPSEQLAGSTINSIAENIEKQCAAENHEMNVEAIQDLVEKAIMKAGAFDIAKKYITYRYQHQLMRRANSTDSQILSLLECNNEEVKQENSNKNSTVVSVQRDYMAGEVSKDITKRFLLDEDIVKAHDEGLIHFHDADYFAQHMHNCDLVNLEDMLQNGTVISGTKIDTPHSFSTACNIATQIIAQVASSQYGGQSISLAHLAPFVEVSRKKFQRETMRVEEQTGVKFTDEQFKKIVEMRIRDEITRGVQTIQYQVVTLMTTNGQSPFITVFMYLNEAKNEQEKADLAMIIEEMLKQRYQGVKNEKGFWVTPAFPKLIYVLEPDNIEPGSKYYSLTELAAKCTARRLVPDYISEKKMLELKVDANGKGNCYPCMGCRSFLTPYLDEHGKPKYYGRFNQGVVTINLVDVACSSNGDYKSFWEIFDERLELCHKALMRRHQRLLGTPSDVAPILWQHGALARLEKGETIDKLLFGGYSTISLGYAGLCECVRYMTGKPHTDPSATPFAIEIMKHLNEKCAEWKAESNIAFSLYGTPLESTTYKFAKCLKKRFGEIPGVTDKNYITNSYHVHVTEQMDAFTKLSFESQFQELSPGGAVSYVEVPNMENNIPAVMTLLKHIYENIMYAELNTKSDCCQKCGYTGEIQIVTDSDNKLVWQCPNCGNKDQATMNVARRTCGYIGTQYWNQGRTQEIKERVLHL

SEQ ID NO: 1000 - protein, 756 aa, unidentified
  REGION 1..756: note = Description of Unknown:uncultivated organism sequence
  REGION 1..756: note = Category: MG60 effectors
  REGION 1..756: note = Description: MG60-214 effector
MQQSIFDVCVIIGLWFKKKRRSEVFTMKVIKRDGHIVDYSPDKIEEAVSKANLEVSEEDRVSDIQIRNIIKYIEGLHKKRMLVEDIQDVIEKRLMTLGKYELAKEYITYRYTRELVRRSNTTDKSIKELIDGESEYWNTENSNKNAKVVTTQRDYLAGITSTDITRRFLLPEDIVTAHDQGIIHFHDADYFAQNALHNCDLINLDDMLQNGTNINGVMIEKPHRFLTAMTIATQLITAVSSSQYGGCTITLTHLAPFVRSSKEFYLKKYKNRKLTKAQVEKFATEDLKKEITDGVQTFQYQINSMTTTNGQAPFLSVCMYLGETEEYKDELAMIIEEVLKQRMEGMKNEKGVYITPAFPKLLYVLEEENINPKGKYYYLTELAARCTAKRMVPDYISEKVMKENKINSLGNGECFPCMGCRSFLTPDRMFNVGNISKALNYVENKGKYYGRFNQGVVTINLPDVALTSGKDMELFWKVFDDRLELCHRALQIRHKRLSKVTSDVAPILWQHGALARLEKGESIHELLHHGYSTISLGYAGLYECVKYMTGHSHTDNGKGHEFALEVMQHMNDKCNEWKEAEDIDYSLYGTPIESTTYKFAKCLRDRFGKIKGITDRDYITNSYHVPVFEEIDAFTKLKLESEFQRLSPGGAISYIETPNLENNIDVVMEVINFIYENIMYAELNTKSDYCQKCGYNGEILLDDDLEWYCPECGNRDHDTLNVARRTCGYIGTNFWNKGRTQEIKERVVHIDNKDDE

SEQ ID NO: 1001 - protein, 753 aa, unidentified
  REGION 1..753: note = Description of Unknown:uncultivated organism sequence
  REGION 1..753: note = Category: MG60 effectors
  REGION 1..753: note = Description: MG60-215 effector
MLEIVKRDCSKTNFDKQKIFNAIMKAMKSGSGIVKSEIAEKIANEIENEVKSMEEIDIYQIEAMVFQKLIENNQILTAKAYESYRSVREFQRNTTNSTDDAILELLAGQSEYWNEENSNKNAMLITTQRDYMAGIESEDISKRMLLTPEIVHAHENGIIHFHDIDYFAMKAMYNCCLINLEDMLQNGTVISNVLIEKPHSFSTACNVATQIIAQVASSQFGGQTISLSHLAPFIDVSRQKIKKQVEKELINANLTSVEYHNLVDSIVAKRLKEEIKKGVQTIQYQVVTLMTTNGQAPFLSVFMYLNEVKDKQTKHDLAMLIEEVLLQRIQGVKNEKGVWVTPAFPKLLYVLEEDNIHKNSPYYYLTELAAKCTVKRMVPDYISEKKMKECKIDKNGKGQCFPCMGCRSFLSPYLDKNSQPKYYGRFNQGVVTINLADVALSALKEYEESKLNLHNTSVESIFWKILDERLELCHRTLRLRHERLKGTVSDVAPILWQHGAIARLNKGEKIDKLLYNDYSTISLGYAALYECVKAITKHTLTDNGIGEKFGLQVMQRLTDKCNQWKEEENIGYSVYGTPLESTTYKFAKCLRKRFGVIEGITDRDYVTNSYHIPVFENINAFDKLLIESKFQKLSAGGAISYVEVPNLTDNIEIVIQIIQYIYEHIMYAELNTKSDYCHVCGYDKEIEIVTDANTGKLIWKCPQCGNTDQRKMSVTRRTCGYLGSNFWNQGRTQEIKERVLHIDDMDLNESENV

SEQ ID NO: 1002 - protein, 768 aa, unidentified
  REGION 1..768: note = Description of Unknown:uncultivated organism sequence
  REGION 1..768: note = Category: MG60 effectors
  REGION 1..768: note = Description: MG60-216 effector
MFCSCKKNLCVVIYIYDATKTYDCAKKLIVYKSIIKGAEVMKIIKRNGAEETFDRQKIKDAIAKANNETDGTPELTDRQIDYISLVIEDHCNEMNRALSVEEIQELVETHIILQGAPETAKRYIRYRFTRNLARASNTTDNQILSLIECNHEEVKQENSNKNPTVNSVQRDYMAGEVSKDLTKRILLPEDIVKAHEEGLIHFHDADYFAQHMHNCDLVNLEDMLQNGTVISGTMIEKPHSFSTACNIATQIIAQVASNQYGGQSISLAHLAPFVQISREKITRQVRAEMEEFGIDADDEQVKSLVEKRVRDEIKRGVQTIQYQVVTLLTTNGQAPFVTVFMYLNEAKNEQEKKDLAIIIEEVLKQRIKGTKNEVGVWVTPAFPKLIYVLEEDNITEDSRFWYLTKLAAECTAKRMVPDYISEKIMLKLKIDKNGNGNCYTCMGCRSFLTPYVDENGKPKYYGRFNQGVVTINLVDVACTAARDGNKSEEKFWQVLDERLELCHRALQCRHERLEGTLSDAAPILWQYGALARLKKGEPIDKLLHGGYSTLSLGYAGLWECVYEITGKKLTEKEGEEFGLRVMQRLNDACAEWKAAENIDYSIYGTPLESTTYKFAKCLQNRFGIIKGVTDRNYITNSYHIHVTEKIDAFSKLELESKFQKLSPGGAISYVEVPNMQQNIPAVLEVMKFIYNNIMYAELNTKSDYCQVCGYDGEIQIVEEDGKLVWRCPNCGNEDQSKMNVARRTCGYIGSQFWNQGRTQEIKERVLHL

SEQ ID NO: 1003 - protein, 769 aa, unidentified
  REGION 1..769: note = Description of Unknown:uncultivated organism sequence
  REGION 1..769: note = Category: MG60 effectors
  REGION 1..769: note = Description: MG60-218 effector
MKVIKRDGTIVEYDREKIRIAIEKANKEVSRKEKATDSEIEEIMSYIEDLKKGRILVEDIQDIIEEKLMEIKRYELAKKYITYRYTRALVRKANTTDQSIKELIEGESEYWNNENANKNARVVTTQRDYLAGITSTDITRRFLLPEDVVKAHDEGIIHFHDADYFAQNALTNCELINLEDMLQNGTIMNGVMIEKPHRFITACTIATQIILAVTSSTYGGATVSLAHLAPFVRSSYEKYYKKYKDNGLSKEQCEKFAKEDTKKEVADGVQTFNYQVNSMTNTNGQAPFLSVCMYLGETDEYKEELAMIIEEFLNQRILGFKNEKGVYITPAFPKLLYVLEEDNIHENSKYWYLTELAAKCTAKRMVPDYISEKIMKQMKVDANGDGQCYPCMGCRSFLTPYIDPVTKKPKYYGRFNQGVVTINLVDVALSSGKDLKKFWKIYDERLELCHKALQARHERLAKATSDIAPILWQHGAFARLPKGASIHPLLHGGYSTISLGYAGLYECVKYMTGKSHTDNGDGKDFAIEVMKKMNEKCAEWKDAEDIDYSVYGTPIESTTYKFAKCLQKRFGKIKGITDKNYITNSYHVPVFEEIDAFSKLKLESEFQRLSPGGAISYVETPNLQNNLEVVLQIMKFIYDNIMYAELNTKSDYCQKCGYTGEILIDDNLEWYCPNCGNRDHNTLNVARRTCGYIGSNFWNKGRTQEIKERVLHIDNKDDDCDCDECNCDHANTDTNKEEKSEEKQMNFIDYDVEEEITKSKKRMKQPAMV

SEQ ID NO: 1004 - protein, 755 aa, unidentified
  REGION 1..755: note = Description of Unknown:uncultivated organism sequence
  REGION 1..755: note = Category: MG60 effectors
  REGION 1..755: note = Description: MG60-219 effector
MHELIEKREPKEEKPMKIIKRNGAEVVFDIDKIIMAVTKANDAVDEKVRMTPLQIERISQSVQIACEEMGRSPSVEEIQDLVEKAIMAHGAFEVAKEYITYRYTRSLLRQSNTTDDRILSLIECNNEEVKQENANKNPTINAVQRDYMAGEVSKDITSRILLPKEVVDAHEAGIIHFHDADYYAQHMHNCDLVNLEDMLQNGTVISGTLIEKPHSFSTACNIATQIIAQVASNQYGGQSISLTHLAPFVQVSREKIRKTVEREMAAFGVVPAEETISKVVEDRLREEVRRGVQTIQYQVVTLMTTNGQAPFITVFMYLNEAKSEQEKKDLAMIIEETLRQRYEGVKNEKGVWITPAFPKLIYVLEEDNVREGTPYWYLTRLAAQCTAKRMVPDYISEKKMREYKLSKGETPGHGDVYTCMGCRSFLTPDRSGNGWDNVARAGNYEPGKPKYYGRFNQGVVTINLVDVALSSGRDMTKFWEVFEDRLELCHRALRCRHERLKGTLSDAAPILWQYGALARLPKGEPIDKLLYGGYSTISLGYAGLYECVKYMTGKSHTDDEAKPFALSVMQKMNDKCLQWKTAENIDYSLYGTPLESTTYKFAKCLQKRFGLIPGITDKSYITNSYHVHVTEPIDAFTKLRFEAEFQQLSPGGAISYVEVPNMQNNIDAVLEVMQFIYDNIMYAELNTKSDYCQVCGYDGEIEIKEDDGKLIWVCPQCGNTDQNKMNVARRTCGYIGTQFWNQGRTQEIKDRVLHL

SEQ ID NO: 1005 - protein, 1226 aa, unidentified
  REGION 1..1226: note = Description of Unknown:uncultivated organism sequence
  REGION 1..1226: note = Category: MG60 effectors
  REGION 1..1226: note = Description: MG60-220 effector
MKVIKRNGSEVLYNQQKIKDAVSKANAEVSRVERLSQAQITAIANNVTKIIEQSSHAVSIEDIQNYVEKEIMAMRGYEVAQKYITYRYKRALARQSNTTDERILSIIGLENEEVKQENANKNPTINSTQRDYMAGEVSKDLTTRILLPQDIVDAHNNGLIHFHDADYYAQKMHNCFTGDTKFMTHKGAKRFDSFKDGESVFVRDMHNEIRKATVHIYGEQRVQKVTFKMLGKNKKKTVKCTPNHRWILEDKKVTTALKVGDVLFSNSYSHYEKWKVEKIEFKGIEKVYCVEEPITHSFTLEDGMVTGNCDLINLEDMLQNGTVISGTMIEKPHSFHTACNITTQVIAQVASSQFGGQSFSLAHLVPFVDISRKKIKKEILEENLINKIVESDEIINKKVEFRLKEEIKRGIQTIQYQILTLMTTNGQAPFVTMFLWLDEVEEGQARDDMAMLVEEVLNQRIQGVKNEKGVYITPAFPKVIYLLDEDNIHEDSKYYYLTELAAKCTAKRMVPDYISGKVMRELKEGDIYPCMGCVDGAEVVTYKYLDNVYVESFERMWNRLSNYFKVELQPNKKDFVMKTPGVKIYDHQSGYVDNYGIIKNHTNRWLQISFSNGRVLTCTPDHPFETTDKRIIMAKDLTPNDMINIDTLSNYSSNNLISMKENRAWLYGFALCDSTYYDNFTASIAENSENEIKEFFTNMLLSEYKLETKCIYRNRGEKGKYIDLRAVSNNDNSLMNLKLDFIKAFEGKAKKDRHIPNEVFSWQNSAKLAFLAGMIDADGYLNSSMRLTKIQLGSTNKELAIQQALLAQTCGMPSRIYLNHYKSNCRDMIRYRVEFIPSIDLLKYIKCEKKYSLKDSTIARKNSSISDNDFVTITSVDELEKAGFSYDVTTESEHFTVSGLYSHNCRSFLTVDRTKENLGNAKNYNPNKHKYYGRFNQGVVTINLVDVACSSYGDMNKFWEILDERLELCHRALKERHKRLLGTPSDVAPILWQHGALARLEKGEKIDKLLYDGYSTISLGYAGLYEMCMRMTEKSHTDPEAKPFALAVMQKLNDKCNEWKEKENIDYSLYGTPMESTTFKFARCLQRRFGIIKDVTDHDYITNSYHVNVRENIDAFTKLSFESEFQKLSPGGAISYVEVPNMQDNIPAVLAVLKHIYNNIMYAELNTKSDYCQVCGYEGEIQIVRDKHKKLIWKCPNCGNTDHNKMNTARRTCGYIGTNDFNQGVT

SEQ ID NO: 1006 - protein, 752 aa, unidentified
  REGION 1..752: note = Description of Unknown:uncultivated organism sequence
  REGION 1..752: note = Category: MG60 effectors
  REGION 1..752: note = Description: MG60-221 effector
MIFLLIFIKNTISCGHQQKQTQNIVSKVTSYFFYKLSSLIPMAIKKVIKRNGSEAVYDPEKIRVAIQKANHEVPEDDQASDFLISEIIRSLELAKKWTVPIEEIQDFIEMQLIKMNKAELAKKYIIYRYQRALVRKANTTDDSILTLIHNDNKEVGQENSNKDASIASTQRDLIAWEVSKDLTRRMLLPDDIREAHDEGVLHFHDMDYFIQPIFNCCLVNIKDMFENGTVMNGKLVETPKSFQVACTVMTQIIASVASSQYGGQSVNIKHLGKYLYATKQKYLKKYKESCPELSDEEIQKIVDIRVKDELASWVQTIQYQINTLMTTNGQSPFVTLFLELDEKDEYIQETAEIIEEIFKQRLQGIKNEVWVYVTPAFPKLVYVLDECNILKGGKYDYLTKLAVKCSAKRMYPDYISAKKMREIECGNVFAPMGCRSFLAPWKDENWEYKFEGRFNQWVVTINLPQIWILANHSEEKYFKLLDERLELCRKALMCRHERLKGTVSDISPIHWQYWAIARLKKGEKIDKYLYGWYSTISLGYIGLYESSILITGEPHTTEKWQAFALKVMRTLKAAVTKWKEESGIGFALYGTPAESLCYRFAKIDKKKFGEIKDVTDKWYYTNSYHVDVREHIDALSKLAFEAQFQSISTWGAISYIEMPNMQKNLPALESLVQFMYDNIMYAEFNTKSDYCHCCGFDGEIIVNEDNEWECPQCHNKNQRKMNVTRRTCWYLGENFWNAGKTKEISKRVLHVS

SEQ ID NO: 1007 - protein, 783 aa, unidentified
  REGION 1..783: note = Description of Unknown:uncultivated organism sequence
  REGION 1..783: note = Category: MG60 effectors
  REGION 1..783: note = Description: MG60-222 effector
MMRVVKRDGKIVDFDESRIKIAIGKANNEVDESQRATEEEIEKIVEYVKKVKKDRILVEDIQDIIENKLMEYKRFELAKAYITYRYSRALVRKANTTDQTVKELVEGNSEYWNNENSNKNARVVTTQRDYLAGITSTDITRRLLLPPEIVKAHDEGIIHFHDADYFAQNALTNCCLINLNDMLQNGTVINGVMIEKPHRFVTACTIATQIILGVSSSQYGGCTVTLTHLAPFVRDSYNRSLKKYQDRNLPEEECKKFAMQDTKKEIADGVQTFNYQVNSMTNTNGQAPFLSVNMYLGETDEYKDELAMIIEEFLRQRMLGFKNEKGVYITPAFPKLLYVLEEDNIHKDSKYWYLTELAAKCTAKRMVPDYISEKMMKKLKINQYGEGDCYPCMGCRSFLTPDRVKGNVAKAKDYVEGKGKYYGRFNQGVVTINLPDVALSSKKDEKEFWKIFDERLELCHEALQLRHKRLSGITSDVAPLLWQYGAYARLNKGEKLDKLLHGGYSTLSLGYAGLYECVKYMTGDSHTDGGKGEKFALEVMQHMNDKCAEWKKAEDIDYSLYGTPIESTTYKFAKCLKKRFGTVEGVTDRNYITNSYHVPVFEEIDAFSKLKLESEFQRLSPGGAISYVETPNLQNNIEVVEQIIEFIYNNIMYAELNTKSDCCQKCGYTGEILIDDNLEWYCPNCGNRDHRTLNVARRTCGYIGTNFWNKGRTQEIKERVLHIDNKDFDAEKCTKCDEDVNVVSKCCNDSNESTESDKNVEKHEKKTRAKVSAKEKAMASVHA

SEQ ID NO: 1008 - protein, 1125 aa, unidentified
  REGION 1..1125: note = Description of Unknown:uncultivated organism sequence
  REGION 1..1125: note = Category: MG60 effectors
  REGION 1..1125: note = Description: MG60-223 effector
MLEIVKRDCSKTNFDKQKIFNAIMKAMKSGSGIVKSEIAEKIANEIENEVKSMEEIDIYQIEAMVFQKLIENNQILTAKAYESYRSVREFQRNTTNSTDDAILELLAGQSEYWNEENSNKNAMLITTQRDYMAGIESEDISKRMLLTPEIVHAHENGIIHFHDIDYFAMKAMYNCCLINLEDMLQNGTVISNVLIEKPHSFSTACNVATQIIAQVASSQFGGQTISLSHLAPFIDVSRQKIKKQVEKELINANLTSVEYHNLVDSIVAKRLKEEIKKGVQTIQYQVVTLMTTNGQAPFLSVFMYLNEVKDKQTKHDLAMLIEEVLLQRIQGVKNEKGVWVTPAFPKLLYVLEEDNIHKNSPYYYLTELAAKCTVKRMVPDYISEKKMKECKIDKNGKGQCFPCMGCVDGKEVVTYKYNNDVYTESFERMWDRLSKYFEISKQPNLVDFVMKTHGVKIYDQKAGFVDNYGIIKNHNSEWLRITFSNGRTIMCTPDHPFETTDGRVISAKNLTENDFIEIDKTSSFKTPSIYTMKENRAWLYGFALCDSTYYDGFTASIASVNETEIETNFVNIINDEYGLNTNSINRERGKKGTYKDLRVVSNGDNEYIKLRIELIKAFEGKAKANRHIPNEVFSWTQNAKLAFIAGMIDADGYLNTTAKKAIVQIGSINKELAIQQALLVQTCGMFAKIYHNHYNANHKDKIRYRVEFTPTEKLLSFIKCNKKTDLFNSILKNTKKSIADTNICAITNVEHIHKEGFSYDVTTSSEHFTVSGIYSHNCRSFLSPYLDKNSQPKYYGRFNQGVVTINLADVALSALKEYEESKLNLHNTSVESIFWKILDERLELCHRTLRLRHERLKGTVSDVAPILWQHGAIARLNKGEKIDKLLYNDYSTISLGYAALYECVKAITKHTLTDNGIGEKFGLQVMQRLTDKCNQWKEEENIGYSVYGTPLESTTYKFAKCLRKRFGVIEGITDRDYVTNSYHIPVFENINAFDKLLIESKFQKLSAGGAISYVEVPNLTDNIEIVIQIIQYIYEHIMYAELNTKSDYCHVCGYDKEIEIVTDTNTGKLIWKCPQCGNTDQRKMSVTRRTCGYLGSNFWNQGRTQEIKERVLHIDDMDLNESENV

SEQ ID NO: 1009 - protein, 921 aa, unidentified
  REGION 1..921: note = Description of Unknown:uncultivated organism sequence
  REGION 1..921: note = Category: MG60 effectors
  REGION 1..921: note = Description: MG60-224 effector
MKIVKRNGTEVEFDIKKIINAITKANKTVEEKDKLSIEEIKNISDCVMVRVSQLPVDTNVEVIQDIVEEELDKHNASYTLKRNYMLYRYQHNELRKSNTIDKTILSLIKCENEDIKQENSNKNPVIISTQRDYMAGEVSKDLMRRYFIDPDLMKAHDEGLIHIHDMDYILQNCHNCDLINLEDMLNNGTVISGTAIDKPHSFSTACNIATQIIAQVASSQYGGQSITLSHLAPFVDVSRKAILKELKEEFSSIDDDKLKEVCHRRLLKEINKGVQIIQYQVVTLMTTNGQAPFITVFMYLNECKDEQTKNDLALIIEEVLKQRIIGVKNEKGVYITPAFPKLIYVLQEDNIEKGSKYYYLTELAAKCTAKRMVPDYISEKIMKEMKEGQVYPSMGAVVPESKVYWKIDGKAYYGPIEKMYHSMIDRYDDLEEECQFGQEGNPNKDIDLKDYNIEIYDNGAGKYVKCLMMNMNLASQFRMYKIRTYNPIDDTDINLVVTHDHPMMKLKSGFDPNLVTIDWNDPKDIDNKCEEIQAEYLKTGDYVFFAKEQRGIRTVEIVDQTIPKPVQILKVPIINNYDFVYDVTTESEHFMVNNLWSHNCRSFLRPWKDENGKYKFYGRFNQGVCTINLIDVACSSGKNIEKFWKIFDERLDMCRRVLMIKHNRLLGTVSDVAPILWQNGALARLNKGEKIDKLLYGGYSTISLGYAGLYECVYYMTGKSHTDPSVKDFALSIMQHMNDMCAKWKKETNIGFSVYGTPLESVTYKFAKCLKKRFGEIPEVTDHNYITNSYHCNVREHINAFDKLTMESEFQRLSPGGAISYVEVPNMQNNIPAILQLLKHIYNTIMYAEINTKSDYCHECGYTGEIVIEENEDHKLIWKCPNCGNTDQTKMNVARRTCGYIGTNFWNQGRTQEIKDRVLHL

SEQ ID NO: 1010 - protein, 1019 aa, unidentified
  REGION 1..1019: note = Description of Unknown:uncultivated organism sequence
  REGION 1..1019: note = Category: MG60 effectors
  REGION 1..1019: note = Description: MG60-225 effector
MKIIKRNGEEAIFDYHKIEIAISKANLEAPMKEQLSAETIHNIALNIEKQCQKENHEMNVEDIQDIVEKEIMKAGAFDIAKKYITYRYQHELMRKANSTDSQIMSLLECNNEEVKQENSNKNSTVVSVQRDYMAGEVSKDITKRFLLDEDIVQAHNEGIIHFHDSDYFAQHMHNCLAKETRFITDKGVRSFADFSDGERVTVLTKDGNWKGATVKKYGTQKLYRFTFYNSKKEHTQQVLATENHRWYLADGTVTTALKEGDKLVSAPVLYHQDEDYHSFNENEKLLWCKGFALGDSTVEYLAADTQNNSTRIRLCGEKDSQWLERFSIAGCKVREQVFENGDKSAVVYDYHKEIPAFKNVGEIRAFLNGLYCADGKMAVNNPHSRTYRIQSSNKTVIDFLREYAPVAGLYITAENDLTGENGRPYTILFSFNPDFSFAYTVLSKEFAREDEVWCLEVDDEHNFVLANGIVTGNCDLVNLEDMLQNGTVISGTKIDTPHSFSTACNIATQIIAQVASSQYGGQSISLTHLAPFVDVSRKKIAREMHRMEEETGVYYTEAQFNHIVHERLKDEITRGVQTIQYQVVTLMTTNGQSPFVTVFMYLNEAKDAQTKADLALIIEEVLKQRYQGVKNEAGYWVTPAFPKLIYVLEEDNINEGAPYFYLTELAAKCTARRMVPDYISEKKMKSLKEGNCYPCMGCRSFLTVYRDENGKPKFYGRFNQGVVTINLVDVACSSGGDYDKFWQILDERLKLCYRALMARHRRLLGTPSDVAPILWQNGALARLKKGEVIDKLLYNGYSTISLGYAGLCECVRYMTGKSHTDSEATPFALRVMKTLNEACDKWREKTNIAFSIYGTPMESTTYKFAKCLKRRFGEIEGVTDKNYITNSYHIHVTEKVDAFTKLTFESQFQELSPGGAVSYVEVPNMEGNIPAVIALLKHIYEKIMYAELNTKSDCCQKCGYTGEIRIVTDSENKLVWQCPQCGNTDQSTMNVARRTCGYIGTQFWNQGRTQEIKERVLHL

SEQ ID NO: 1011 - protein, 1020 aa, unidentified
  REGION 1..1020: note = Description of Unknown:uncultivated organism sequence
  REGION 1..1020: note = Category: MG60 effectors
  REGION 1..1020: note = Description: MG60-226 effector
MVVIKRNGERVDFDPRKIEVAILKAFAEVRSESDDDIRECAKRIAHEIESTGKDLSVEEIQDMVEKKLMATKYKNVAKAYVEYRYKHKLIREFNTTDKTIKELLCGESDYWNNENSNKNARVVTTQRDYIAGITSTDIARRLLLPADVVEADDEGIIHFHDKDYFAQLSLHNCFDVTTRFITSNGVKAFSDFNDCDEATVLTHTGEWKRARVRKYGKQDLYRIVLKRGHGKEHIVYATANHRWFLQDGSVTTNLHVGDSLMKTPVIANVNLDDADVFEKQLWCKGFAFGDGQYCKAWDGTKIRLCGHKNKYARIFRAAGYTCTSPGNFENGDQEAHIPRYNKNEIPEMTPAETRYFVYGLLCADGDHPTSKGNTKANEFKGIQVTGEEKNFQVYNLLNIAGYYVSGYTDITGKTNYGERSDVTRRYAIQANQSHCNWKVQAIEYAKTDYVWCLNVEDCHSFVLEGGIVTGNCELVNLEDMLQHGTVLNGVMIRKPHRLLTATTIATQIITAVTSSSYGGCTINLSHLAPFVRDSYNAYVKKYRDRGVDEQTTKEWAELDTKKEIADSVQTFNYQCNSMTNTNGQAPFLSVFMYLNDAPEYQKETAMLIEEFLNQRLLGFQNETGHYVTPAFPKLLYVLDENNITEDSEYWYLTELAAKCTAKRMVPDYMSAKIMRRDKIDKNGNGNVYGCMGCRSFLTPYVDKDGKPKYWGRFNQGVVTINLPDIALSSGGDMEKFWKIFDERMALCHKALRCRHERLALATSDVAPILWQNGALARLPKGSPIHPLLHDGYSTLSLGYAGLYECVKYMTGESHSHGKGKEFGLRVMQTLNDFCKKWKEEESIDYSLYGTPIESTTYKFSKCLKKRFGIIEGITDKDYITNSYHISVREKIDPFEKLAIEAEYQKLSPGGAISYVECADLTQNPTAVLEVMRFIYDNIMYAELNTKSDYCQVCGYDGEIQIIDENGKLSWRCPNCGNEDQTKMNVARRTCGYIGTQFWNQGRTQEIKERYVHIDNHEVGE

SEQ ID NO: 1012 - protein, 1093 aa, unidentified
  REGION 1..1093: note = Description of Unknown:uncultivated organism sequence
  REGION 1..1093: note = Category: MG60 effectors
  REGION 1..1093: note = Description: MG60-227 effector
MMNQEKSIESNIIREDERVILKKGAYEDGEFTETLPADLTDIDDWAFLDARFGGRETIEIPPCVKRIGGAAFAGCDLKYLVIPPSVESIGKDGEEGVFSGSQLENVTLSAQIEELPVWAFCECGKLRRVELPKHLRKIGMSAFYYCYSMEEIRFPEMLERIEEGAFSSCHSLQKIDLPKYLREIGDEAFEHCSSLEEIHLSESLERIGNEAFYSCSSLKEIHLPESLKHIGERAFFRCEQLRRVVFPDHEVLLGKGIFEYCSSELEICNVHVGDRSHCVEGWAYHDMPIKDVTISADVKEIENGAFSLCSRLEAVSFEEPSQLEKIGFSAFCGCKNLNHIQLPDSIRILDDSSFSECESIEQIDLPRGLLRLGNKVFARCKRLKQIIIPQGVQEIGHEMFSLCGSLERVQLPDSVAVISDRMFAYCTSLPEIDLPGNVIEIGNEAFHGCAKLNICIPRSVTKIGFRAFAATALKEVVIPTGVKEIASQTFENCEMLRKVTLPEGLEKIGTRAFASCSALEEIEIPDSVTHIDALAFQNCTALRSIVLSEHTKVEQGPEINSYDVPIDEYRSGVMWTQTEDEDVAAYQELLRRVVSIRPKAWNEEREENKEEKIAFNQEQKRAVEAIQGPVMIISCAGAGKTTVLLERARQMVRMGIAPEKILITTFSRAAAYDMRERFERNADICGVKFSTIHGLCRIILTSAYFYEADVVLSDEEKIRFFMECHSKKNEQDGFVGFYMDISGRISRYIIGHYEQSLPEIENKPELSKLEQDDTFLHLYHAYQAFKKARKKLDYDDLLVETHKCLASNEAIRNHWQGMLDYIMIDEYQDTSRLQAEIFFLLAGKKRNICVVGDDDQSIYAFRGTQKQVFDLFMKKYPDAQKRFLGMNYRSREYIIRAADCLIRHNRNRLEKNLEADRKEPGNILLKKASGRENQAYIVVECIKRLLQSGSNPSDIAILYRIRNESSMVVRLLEEAGIAYDKKESVEEMIQRIVAGGEKHDLQPHEDGHGVVLSTFHAAKGLEWKYVFIISANQGITPLKRLTESVDIEEERRLFYVAVTRAKDTLAILYIENNMASEDNSMQKPSMFLSEMGL

SEQ ID NO: 1013 - protein, 1267 aa, unidentified
  REGION 1..1267: note = Description of Unknown:uncultivated organism sequence
  REGION 1..1267: note = Category: MG60 effectors
  REGION 1..1267: note = Description: MG60-228 effector
MNEQISHLTSYIEALKKISSEAEIRGNFLNLLRKTLIKEDNFEWRTVEQSVHQKGLFVGRIDLSVGRVVFEFKRSLKDKKKRREGIQQLKTYLSSDEFKDAPFGILTDGKTFEVYKLENGELYPVDNFSLPDFEHLPDLSEEEVKALKKFLYKLDAYLLGNLKVPLTSSTIVRFFGYNSQVFAKVYSALREAYERVKDLKEVSLKFNQWKRYMELVYGKNLQDELFFRHTYLSVLIKILSGKLLEVPYDSIWELLSGEVFERFGIKNYVDKDFFGWIFEEEIKNDLDELFEEIDRLLEFKFEMGNLSEELEEDLLKELYQNIVTRGEREILGEYYTPDWLVERILGEVLKDKDIRTLKVLDPACGSGSFLFFAIKRKREENVPLREILSSVIGLDINPLAVLIARSNYLLALGKEFLKNRHEEIFLPVYTADALRVYVSKHTDLYGSKISVELNGFKVEIPIPPKSSDREQDLKITDLYIERIVEWAKEQVPKKEERFVEDFWRWLERNYPEEEKIISPYFAGYSRSFERQILELVRKKGDDIWTFVLKNIYKPLFLKEKFDLIVGNPPWLVYNSMHRGLQKFFEEFLKAYRIKYGGHLKTHLELATAFLVLTAGFYLKPEGEIAFVMPHSLLNGDQNSWFRKSYHSLMAQERNFPTLSLDILKIFDLKEVSPLFNVPSVVIFAKKKNEGFKKEIPATVFKGKLPKRNARFGEAQKYLTEIDKTLYFVETGKVNYWVYDPQRLGVSPYKNHFREGATIVPRSFWFVEIEKSPYGFSEKSIPIRSKKLGDEKVEFELRGNVPKRFFFKTLLSKRLYPFGFTEFDLVVLPLKITSKEEEELKELKEEIDTVYRWLREYKATGKDYEDLFAKTVNLASSITEFVQNPEYTEKSKKELLDYLLRFKELLTDEATYFCSNPDLPSYYWWESENADFSKPYEVLKHVKSATKPEKFYKLLDYYDFRNKVSIGECPNCGEILDRKPEKVFKCPNCGFEVNLSSAGDILKKWVNLSREVPKPFKDWLLEAQELWEKHRGEKADKDNIIDWLNYRNKLTNQPVEGGYLVLYTTSGSNLAALWIKNSPKFVIDTKTFFGLFETLEEAIYVSTLLNSPLISHKVKEYQSKGLFGARDFHKVIFNLPIPPYDPADPLHQKLVIFGKKARKKAMHPVIRNWLKGVHPNRIRTLGRWVVENELKEIDKLVAQLLELDVNLSFPKKDFRFFKTEKEAKKWIKENKERIDNEKVYPAKVLAVKYEIPFSKIAEFEVGVEFESV

SEQ ID NO: 1014 - protein, 755 aa, unidentified
  REGION 1..755: note = Description of Unknown:uncultivated organism sequence
  REGION 1..755: note = Category: MG60 effectors
  REGION 1..755: note = Description: MG60-229 effector
MHELIEKREPKEEKPMKIIKRNGAEVVFDIDKIIMAVTKANDAVDEKVRMTPLQIERISQSVQIACEEMGRSPSVEEIQDLVEKAIMAHGAFEVAKEYITYRYTRSLLRQSNTTDDRILSLIECNNEEVKQENANKNPTINAVQRDYMAGEVSKDITSRILLPKEVVDAHEAGIIHFHDADYYAQHMHNCDLVNLEDMLQNGTVISGTLIEKPHSFSTACNIATQIIAQVASNQYGGQSISLTHLAPFVQVSREKIRKTVEREMAAFGVAPAEETISKVVEDRLREEVRRGVQTIQYQVVTLMTTNGQAPFITVFMYLNEAKSEQEKKDLAMIIEETLRQRYEGVKNEKGVWITPAFPKLIYVLEEDNVREGTPYWYLTRLAAQCTAKRMVPDYISEKKMREYKLSKGETPGHGDVYTCMGCRSFLTPDRSGNGWDNVARAGNYEPGKPKYYGRFNQGVVTINLVDVALSSGRDMTKFWEVFEDRLELCHRALRCRHERLKGTLSDAAPILWQYGALARLPKGEPIDKLLYGGYSTISLGYAGLYECVKYMTGKSHTDDEAKPFALSVMQKMNDKCLQWKTAENIDYSLYGTPLESTTYKFAKCLQKRFGLIPGITDKSYITNSYHVHVTEPIDAFTKLRFEAEFQQLSPGGAISYVEVPNMQQNLDAVLEVMKFIYDHIMYAELNTKSDYCQVCGYDGEIEIKEDDGKLIWVCPQCGNTDQNKMNVARRTCGYIGTQFWNQGRTQEIKDRVLHL

SEQ ID NO: 1015 - protein, 756 aa, unidentified
  REGION 1..756: note = Description of Unknown:uncultivated organism sequence
  REGION 1..756: note = Category: MG60 effectors
  REGION 1..756: note = Description: MG60-230 effector
MQQSIFDVCVIIGLWFKKKRRSEVFTMKVIKRDGHIVDYSPDKIEEAVSKANLEVSEEDRVSDIQIRNIIKYIEGLHKKRMLVEDIQDVIEKRLMTLGKYELAKEYITYRYTRELVRRSNTTDKSIKELIDGESEYWNTENSNKNAKVVTTQRDYLAGITSTDITRRFLLPEDIVTAHDQGVIHFHDADYFAQNALHNCDLINLDDMLQNGTNINGVMIEKPHRFLTAMTIATQLITAVSSSQYGGCTITLTHLAPFVRSSKEFYLKKYKDRKLTKAQVEKFAAEDLKKEITDGVQTFQYQINSMTTTNGQAPFLSVCMYLGETEEYKDELAMIIEEVLKQRMEGMKNEKGVYITPAFPKLLYVLEEENINPKGKYYYLTELAARCTAKRMVPDYISEKVMKENKINSLGNGECFPCMGCRSFLTPDRMFNVGNISKALNYVENKGKYYGRFNQGVVTINLPDVALTSGKDMELFWKVFDDRLELCHRALQIRHKRLSKVTSDVAPILWQHGALARLEKGESIHELLHHGYSTISLGYAGLYECVKYMTGHSHTDNGKGHEFALEVMQHMNDKCNEWKEAEDIDYSLYGTPIESTTYKFAKCLRDRFGKIKGITDRDYITNSYHVPVFEEIDAFTKLKLESEFQRLSPGGAISYIETPNLENNIDVVMEVINFIYENIMYAELNTKSDYCQKCGYNGEILLDDDLEWYCPECGNRDHDTLNVARRTCGYIGTNFWNKGRTQEIKERVVHIDNKDDE

SEQ ID NO: 1016 - protein, 768 aa, unidentified
  REGION 1..768: note = Description of Unknown:uncultivated organism sequence
  REGION 1..768: note = Category: MG60 effectors
  REGION 1..768: note = Description: MG60-231 effector
MFCSCKKNLRVVIYIYDATKTYDCAKKLIVYKSIIKGAEVMKIIKRNGAEETFDRQKIKDAIAKANNETDGTPELTDRQIDYISLVIEDHCNEMNRALSVEEIQELVETHIILQGAPETAKRYIRYRFTRNLARASNTTDNQILSLIECNNEEVKQENSNKNPTVNSVQRDYMAGEVSKDLTKRILLPEDIVKAHEEGLIHFHDADYFAQHMHNCDLVNLEDMLQNGTVISGTMIEKPHSFSTACNIATQIIAQVASNQYGGQSISLAHLAPFVQISREKITRQVRAEMEEFGIDADDEQVKSLVEKRVRDEIKRGVQTIQYQVVTLLTTNGQAPFVTVFMYLNEAKNEQEKKDLAIIIEEVLKQRIKGTKNEVGVWVTPAFPKLIYVLEEDNITEDSRFWYLTKLAAECTAKRMVPDYISEKIMLKLKIDKNGNGNCYTCMGCRSFLTPYIDENGKPKYYGRFNQGVVTINLVDVACTAARDGNKSEEKFWQVLDERLELCHRALQCRHERLEGTLSDAAPILWQYGALARLKKGEPIDKLLHGGYSTLSLGYAGLWECVYEITGKKLTEKEGEEFGLRVMQRLNDACAEWKAAENIDYSIYGTPLESTTYKFAKCLQNRFGIIKGVTDRNYITNSYHIHVTEKIDAFSKLELESKFQKLSPGGAISYVEVPNMQQNIPAVLEVMKFIYNNIMYAELNTKSDYCQVCGYDGEIQIVEEDGKLVWRCPNCGNEDQSKMNVARRTCGYIGSQFWNQGRTQEIKERVLHL

SEQ ID NO: 1017 - protein, 768 aa, unidentified
  REGION 1..768: note = Description of Unknown:uncultivated organism sequence
  REGION 1..768: note = Category: MG60 effectors
  REGION 1..768: note = Description: MG60-232 effector
MFCSCKKNLCVVIYIYNATKTYGCAKKLIVYKSIIKGAEVMKIIKRNGAEETFDRQKIKDAIAKANNETDGTPELTDRQIDYISLVIEDHCNEMNRALSVEEIQELVETHIILQGAPETAKRYIRYRFTRNLARASNTTDNQILSLIECNNEEVKQENSNKNPTVNSVQRDYMAGEVSKDLTKRILLPEDIVKAHEEGLIHFHDADYFAQHMHNCDLVNLEDMLQNGTVISGTMIEKPHSFSTACNIATQIIAQVASNQYGGQSISLAHLAPFVQISREKITRQVRAEMEEFGIDADDEQVKSLVEKRVRDEIKRGVQTIQYQVVTLLTTNGQAPFVTVFMYLNEAKNEQEKKDLAIIIEEVLKQRIKGTKNEVGVWVTPAFPKLIYVLEEDNITEDSRFWYLTKLAAECTAKRMVPDYISEKIMLKLKIDKNGNGNCYTCMGCRSFLTPYVDENGKPKYYGRFNQGVVTINLVDVACTAARDGSKSEEKFWQVLDERLELCHRALQCRHERLEGTLSDAAPILWQYGALARLKKGEPIDKLLHGGYSTLSLGYAGLWECVYEITGKKLTEKEGEEFGLRVMQRLNDACAEWKAAENIDYSIYGTPLESTTYKFAKCLQNRFGIIKGVTDRNYITNSYHIHVTEKIDAFSKLELESKFQKLSPGGAISYVEVPNMQQNIPAVLEVMKFIYNNIMYAELNTKSDYCQVCGYDGEIQIVEEDGKLVWRCPNCGNEDQSKMNVARRTCGYIGSQFWNQGRTQEIKERVLHL

SEQ ID NO: 1018 - protein, 757 aa, unidentified
  REGION 1..757: note = Description of Unknown:uncultivated organism sequence
  REGION 1..757: note = Category: MG60 effectors
  REGION 1..757: note = Description: MG60-233 effector
MKVVKRDGTIVDFDEERIRTAISKANNEVEKDEVATEKEIEEIVDYVKHLKKKRILVEDIQDLIENKLMEFKRFSLAREYITYRYNRALIRKANTTDQSIKELIDGTSEYWNSENSNKNAKIVTTQRDYLAGITSTDITRRLLLTPEIVKAHDEGIIHFHDADYFAQNALNNCCLINLNDMLQNGTVINGMMIEKPHRFITACTIATQIILGVSSSQYGGCTVTLTHLAPFVRDSYNRHLKRYEDRNLPHKKAKEYAMQDTKKEIADGVQTFNYQVNSMTNTNGQAPFLSVNMYLGETEEYKEELAMIIEEFLNQRILGFKNEKGVYITPAFPKLLYVLEEDNIHKDSKYWYLTELAAKCTAKRMVPDYISEKMMKQLKINQYGEGDCYPCMGCRSFLTPDRVKGNLSKAKDYVEGKGKYYGRFNQGVVTINLPDVALSSKQNMDEFWKIFDERLELCHKALQLRYKRLSMITSDAAPLLWQHGAFARLGKGEKILPLLHNGYSTLSLGYAGLYECVKYMTGKSHTDGNEGENFGLEVMQHMNDKCAEWKAAEDIDYSLYGSPIESTTYKFAKCLKNRFGTVKGITDRNYITNSYHVPVFEEIDAFSKLKLESKFQRLSPGGAISYVETPNLQNNIEAVEEIIEFIYNNIMYAEINTKSDYCQKCGFDGEILTDENLEWYCPNCGNRDHDTLNVARRTCGYIGTNFWNKGRTQEIKERVLHVDNKDYEAPHAHCEHENCECEEKVKEDVKVGVQIQF

SEQ ID NO: 1019 - protein, 804 aa, unidentified
  REGION 1..804: note = Description of Unknown:uncultivated organism sequence
  REGION 1..804: note = Category: MG60 effectors
  REGION 1..804: note = Description: MG60-234 effector
MNQGSPLVSIIVRTKDRPHLLKEALESIEVQTYRPLEVVLVNDGGCALPKEVYEALLKDIPLQWIDLEENQGRARAGNKGIEAARGDYIGFLDDDDRFLPHHVELLVACLEGWDYKVCYSDAEICQRVFDPSQKVYEIKDCRPFASRDFDLLDLLLENFIPLPCILFTRRCLLEAGGFDPTFELYEDWDLLLRIGNLHPFYHVPEVTVRYIQWSQKLQIAQGEYHQGLQQISYGRIIEKHRQLLTPEMAKAILRVFKDLERTQARLNQVTDECKMLEKALREEREKEKHLTGRIRQLSERIESLTHEQRKLQESHQEVLKEKRSLEHQLALIRGSRAWRFIQRYGRLRNALRSSLKPFKGKRIEHLQKGLRVVKTEGVKGLQRRVSQYVTLPSVKRGIYPYVPVDGKEVSLGRIAEDLPLSVTVIIPTRNAGPEFGRTLKKIRNQEGLKDLEILVIDSGSHDKTLDMAREAGARVLEISPEEFHHAGTRNLAAQHARGDVLVFTVQDATPAGDDWLYRLVQPIQQGKADAVSARQIPRTDADLFARWATWGYFEYLGYAEDTVRQGVDARRMDIHQRRRLFHLDSVCLAIPKGLFERYPFQRAYAEDLDLGKRLFERGHALLAQVSNAVIHSHNRPADYFFLREYVNVKSLQAILGQCPEPRPLKEILSTLAWAYDQFCAEVGPWMEAMGKEHKPPSEAMGQLMARLREAFKRGERRVSPGERDPLLYRWLNEDGECQAHVLKVLEGRFLGVLGSLREYLSSHSDWGFPLPEVAVALHKCFAVAAGGAVAEMGGELPSKLIKGI

SEQ ID NO: 1020 - protein, 763 aa, unidentified
  REGION 1..763: note = Description of Unknown:uncultivated organism sequence
  REGION 1..763: note = Category: MG60 effectors
  REGION 1..763: note = Description: MG60-235 effector
MMRVVKRDGKIVDFDESRIKMAIGKANNEVDESQRATEEEIEKIVEYVKKIKKDRILVEDIQDIIENKLMEYKRFELAKAYITYRYSRALVRKANTTDQTVKELVEGNSEYWNNENSNKNARVVTTQRDYLAGITSTDITRRLLLPPEIVKAHDEGIIHFHDADYFAQNALTNCCLINLNDMLQNGTVINGVMIEKPHRFVTACTIATQIILGVSSSQYGGCTVTLTHLAPFVRDSYNRSLKKYQDRNLPEEECKKFAMQDTKKEIADGVQTFNYQVNSMTNTNGQAPFLSVNMYLGETDEYKDELAMIIEEFLKQRMLGFKNEKGVYITPAFPKLLYVLEEDNIHKDSKYWYLTELAAKCTAKRMVPDYISEKMMKKLKINQYGEGDCYPCMGCRSFLTPDRVKGNVAKAKDYVEGKGKYYGRFNQGVVTINLPDVALSSKKDEKEFWKIFDERLELCHEALQLRHKRLSGITSDVAPLLWQYGAYARLNKGEKLDKLLHGGYSTLSLGYAGLYECVKYMTGDSHTDGGKGEKFALEVMQHMNDKCAEWKKAEDIDYSLYGTPIESTTYKFAKCLKKRFGTVEGITDRNYITNSYHVPVFEEIDAFSKLKLESEFQRLSPGGAISYVETPNLQNNIEVVEQIIEFIYNNIMYAELNTKSDYCQKCGYTGEILIDDNLEWYCPNCGNRDHRTLNVARRTCGYIGTNFWNKGRTQEIKERVLHIDNKDFDAEKCTKCDENVEKPEKKTRAKVSAKEKAMASVHA

SEQ ID NO: 1021 - protein, 781 aa, unidentified
  REGION 1..781: note = Description of Unknown:uncultivated organism sequence
  REGION 1..781: note = Category: MG60 effectors
  REGION 1..781: note = Description: MG60-236 effector
MIISGTRYCVFALHKQQYLVWFVKYRKINANYVEIIEVPYRGVFNMENRDQMSEIHVKTNVIKRNGQEVSFDISKIINAIGKANKEVESIHQMNEFQIRAVADMIAKRIASFPHAVNVEDIQDMVEKGIMEMRGYEVAQKYVRYRYKREISRKSNTTDDGILSLIDLSNEEVKQENSNKNPVINSTQRDYMAGEVSKDLTKRLLLPEDIVKAHEEGIIHFHDADYFAQREHNCDLINLEDMLQNGTVISQTLIEKPHSFFTACNVTTQIVAQVASNQYGGQSFTLAHLAPFVDVSRKKITKEVMEERKETGESMDPGIIEKIVERRLKEEIKSGIQTIQYQLITLMTCNGQAPFVTMFMYLDEVPDGQTRKDLAMIIEEVLRQRMQGVKNEKGVWITPAFPKLIYVLDEDNIHDDSPYYYLTKLAAECTAKRMVPDYISAKIMKQMKNGDVYPCMGCRSFLTPDTEGLGPKGQHKYYGRFNQGVVTINLVDVACSSGGDMDKFWKILEDRLELCHRALRCRHERLLGTVSDVAPILWQYGALARLKKGETIDKLLFNNYSTISLGYAGLYEMCVRMLGVSHTTEEGRKFALAVMQKLNDKCAEWRKKENISYSVYGTPMESTTYKFAKCLQKRFGIIPGVTDKNYITNSYHVHVTEKIDAFHKLKFESEFQKLSPGGAISYIEVPNMQTNIPAVLTVMKYIYENIMYAELNTKSDYCMVCGYDGEIKIVEDENGKLVWECPNCGNRDQHKMSVARRTCGYIGTQFWNQGRTQEIKDRVLHL

SEQ ID NO: 1022 - protein, 772 aa, unidentified
  REGION 1..772: note = Description of Unknown:uncultivated organism sequence
  REGION 1..772: note = Category: MG60 effectors
  REGION 1..772: note = Description: MG60-237 effector
MLQGSFLLYMESRILNELKDIPEQKLVVGPIVQQLIQGGWKFEQLIFGKNEWKIPKTPSEASKREKGHSFDYFPVDIAVFDTPENCGDYRHILFIIECKQPTVEVGLQQLETYLSLEPHAKLGIWANNPESASEALYVYKNAKGLSLPQKGTIKQLPSISSSLSPNSEALCFDNMVIPSKDILYHAFSDLLDKVVAQDGNVTRREEQLDQLCNLVLLKLDSDKQGKIDTTSEVYFRPFATDSATASFIKEKFASFIDVYPDIFVSKSDQELRFDDTTIHEVVERLCRFNLIDISADTVSIAFQVLRSAALKQEEGQYFTPKQVIQAAIKLMDVSLSDIIIDPACGTGGFLIQSLIEMKDRYPNQEKEISRWAQLHIYGIDKDAIGIKLTKAIMQILNDGSAHCVRGDSVLTHTWKNKYQHLLSNQFKNGRFTKIFTNPPFGTNLKIKYSEAKKSGLSLLEYVETGKDIELGLLMFNRCYDLLKEGGRLCIVLPETYFFSPSYKYVRDWAFTRMKPICVANVPMDAFQGFCRAKTNLYIFEKLPSDFSGYTGSEEVLFLNPSTCGIYKNGSDRFVVDAQGKRTDVIDNKLLDCSIQVANGDLSNAFSVPLQKVIASDVLVPQYYDLSLQSPFETLTDKLNVQSISIGDLIDSGIISLFNGHGSPSNDLRNGCIPYVKVSDIRNLRINVNPTNLIPLELATKFWKSDHSNLKEWDLISPSRASSNIGEFAILLPGEENIVLTKEVFIIRVNPNSLGIDAFYLLWALSLMQTRKQ

SEQ ID NO: 1023 - protein, 769 aa, unidentified
  REGION 1..769: note = Description of Unknown:uncultivated organism sequence
  REGION 1..769: note = Category: MG60 effectors
  REGION 1..769: note = Description: MG60-238 effector
MKVIKRDGTIVEYDREKIRIAIEKANKEVSRKEKATDSEIEEIMSYIEDLKKGRILVEDIQDIIEEKLMEIKRYELAKKYITYRYTRALVRKANTTDQSIKELIEGESEYWNNENANKNARVVTTQRDYLAGITSTDITRRFLLPEDVVKAHDEGIIHFHDADYFAQNALTNCELINLEDMLQNGTIMNGVMIEKPHRFITACTIATQIILAVTSSTYGGATVSLAHLAPFVRSSYEKYYKKYKDNGLSKEQCEKFAKEDTKKEVADGVQTFNYQVNSMTNTNGQAPFLSVCMYLGETDEYKEELAMIIEEFLNQRILGFKNEKGVYITPAFPKLLYVLEEDNIHENSKYWYLTELAAKCTAKRMVPDYISEKKMKELKVDKNGDGQCYPCMGCRSFLTPYIDPVTNKPKYYGRFNQGVVTINLVDVALSSGKDLKKFWKIYDERLELCHKALQARHERLAKATSDIAPILWQHGAFARLPKGASIHPLLHGGYSTISLGYAGLYECVKYMTGKSHTDNGDGKDFAIEVMKKLNEKCQEWKEAEDIDYSVYGTPIESTTYKFAKCLQKRFGKIKGITDKNYITNSYHVPVFEEIDAFSKLKLESEFQRLSPGGAISYVETPNLQNNLEVVLQIMKFIYDNIMYAELNTKSDYCQKCGYTGEILIDDNLEWYCPNCGNRDHNTLNVARRTCGYIGSNFWNKGRTQEIKERVLHIDNKDDDCDCDECNCDHANTDTSKEEKSEEKQMNFMDYDVEEEITKSKKRMKQPAMV

SEQ ID NO: 1024 - protein, 768 aa, unidentified
  REGION 1..768: note = Description of Unknown:uncultivated organism sequence
  REGION 1..768: note = Category: MG60 effectors
  REGION 1..768: note = Description: MG60-239 effector
MFCSCKKNLCVVIYIYNATKTYDCAKKLIVYKSIIKGAEVMKIIKRNGAEETFDRQKIKDAIAKANNETDGTPELTDRQIDYISLVIEDHCNEMNRALSVEEIQELVETHIILQGAPETAKRYIRYRFTRNLARASNTTDNQILSLIECNNEEVKQENSNKNPTVNSVQRDYMAGEVSKDLTKRILLPEDIVKAHEEGLIHFHDADYFAQHMHNCDLVNLEDMLQNGTVISGTMIEKPHSFSTACNIATQIIAQVASNQYGGQSISLAHLAPFVQISREKITRQVRAEMEEFGIDADDEQVKSLVEKRVRDEIKRGVQTIQYQVVTLLTTNGQAPFVTVFMYLNEAKNEQEKKDLAIIIEEVLKQRIKGTKNEVGVWVTPAFPKLIYVLEEDNITEDSRFWCLTKLAAECTAKRMVPDYISEKIMLKLKIDKNGNGNCYTCMGCRSFLTPYVDENGKPKYYGRFNQGVVTINLVDVACTAARDGSKSEEKFWQVLDERLELCHRALQCRHERLEGTLSDAAPILWQYGALARLKKGEPIDKLLHGGYSTLSLGYAGLWECVYEITGKKLTEKEGEEFGLRVMQRLNDACAEWKAAENIDYSIYGTPLESTTYKFAKCLQNRFGIIKGVTDRNYITNSYHIHVTEKIDAFSKLELESKFQKLSPGGAISYVEVPNMQQNIPAVLEVMKFIYNNIMYAELNTKSDYCQVCGYDGEIQIVEEDGKLVWRCPNCGNEDQSKMNVARRTCGYIGSQFWNQGRTQEIKERVLHL

SEQ ID NO: 1025 - protein, 768 aa, unidentified
  REGION 1..768: note = Description of Unknown:uncultivated organism sequence
  REGION 1..768: note = Category: MG60 effectors
  REGION 1..768: note = Description: MG60-240 effector
MFCSCKKKLCVVIYIYNATKTYDCAKKLIVYKSIIKGAEVMKIIKRNGAEETFDRQKIKDAIAKANNETDGTPELTDRQIDYISLVIEDHCNEMNRALSVEEIQELVETHIILQGAPETAKRYIRYRFTRNLARASNTTDNQILSLIECNNEEVKQENSNKNPTVNSVQRDYMAGEVSKDLTKRILLPEDIVKAHEEGLIHFHDADYFAQHMHNCDLVNLEDMLQNGTVISGTMIEKPHSFSTACNIATQIIAQVASNQYGGQSISLAHLAPFVQISREKITRQVRAEMEEFGIDADDEQVKSLVEKRVRDEIKRGVQTIQYQVVTLLTTNGQAPFVTVFMYLNEAKNEQEKKDLAIIIEEVLKQRIKGTKNEVGVWVTPAFPKLIYVLEEDNITEDSRFWYLTKLAAECTAKRMVPDYISEKIMLKLKVDKNGNGNCYTCMGCRSFLTPYVDENGKPKYYGRFNQGVVTINLVDVACTAARDGNKSEEKFWQVLDERLELCHRALQCRHERLEGTLSDAAPILWQYGALARLKKGEPIDKLLHGGYSTLSLGYAGLWECVYEITGKKLTEKEGEEFGLRVMQRLNDACAEWKAAENIDYSIYGTPLESTTYKFAKCLQNRFGIIKGVTDRNYITNSYHIHVTEKIDAFSKLELESKFQKLSPGGAISYVEVPNMQQNIPAVLEVMKFIYNNIMYAELNTKSDYCQVCGYDGEIQIVEEDGKLVWRCPNCGNEDQSKMNVARRTCGYIGSQFWNQGRTQEIKERVLHL

SEQ ID NO: 1026 - protein, 778 aa, unidentified
  REGION 1..778: note = Description of Unknown:uncultivated organism sequence
  REGION 1..778: note = Category: MG60 effectors
  REGION 1..778: note = Description: MG60-241 effector
MLHCLKKCAAGNGWDRSERIENSEQHRETGKAQGENTMKIIKRNGAEETFRIEKIIVAITKANNAAEEAERLTPLQIDRIAQAVEIRCEEMNRSLSVEEIQDLVEDQIMAHGAFEVAKRYITYRYTRSLVRQSNTTDDRILSLIECNNEEVKQENANKNPTINAVQRDYMAGEVSKDITRRILLPRDIVEAHEAGIIHFHDADYYAQHMHNCDLVNLEDMLQNGTVISGTLIEKPHSFSTACNIATQIIAQIASNQYGGQSISLTHLAPFVDVSRRKIRESVVREIRELGAEAAEERISKIVEERLREEIKRGVQTIQYQVVTLMTTNGQAPFITVFMYLGEARNPQEKHDLAIIIEETLRQRYQGVKNEKGVWITPAFPKLIYVLEEDNIHEDSKYFYLTRLAAECTARRMVPDYISEKKMRELKLSKGETPGNGDVYTCMGCRSFLTPDSSGNGWDNVANAGNYEPGKPKYYGRFNQGVVTLNLVDVALSSGKEMDKFWKIFDERLDLCYRALMCRHERLKGTLSDAAPILWQYGALARLPKGEPIDKLLYNGYSTISLGYAGLYECVKYMTGKSHTDPSATPFALDVMRYLNAACAKWRAETHIDFSLYGTPLESTTYKFAKCLQKRFGIVPGVTDKSYITNSYHIHVTEKINAFDKLAFESQFQALSPGGAISYVEVPDMQNNIDAVLEVMKFIYDNIMYAELNTKSDYCQVCGYDGEIEVLEDTDGKLVWTCPNCGNTDQSKMNVARRTCGYIGTQFWNQGRTQEIKERVLHL

SEQ ID NO: 1027 - protein, 763 aa, unidentified
  REGION 1..763: note = Description of Unknown:uncultivated organism sequence
  REGION 1..763: note = Category: MG60 effectors
  REGION 1..763: note = Description: MG60-242 effector
MYIQPIITVSDTTHKFNFVKLFFQKNKNSLRDVRRGNGMKIIKRNGEEVVFDLKKIITAISKANNEVPPSEQLAGSTINSIAENIEKQCAAENHEMNVEAIQDLVEKAIMKAGAFDIAKKYITYRYQHQLMRRANSTDSQILSLLECNNEEVKQENSNKNSTVVSVQRDYMAGEVSKDITKRFLLDEDIVKAHDEGLIHFHDADYFAQHMHNCDLVNLEDMLQNGTVISGTKIDTPHSFSTACNIATQIIAQVASSQYGGQSISLAHLAPFVEVSRKKFQRETMRVEEQTGVKFTDEQFKKIVEMRIRDEITRGVQTIQYQVVTLMTTNGQSPFITVFMYLNEAKNEQEKADLAMIIEEMLKQRYQGVKNEKGFWVTPAFPKLIYVLEPDNIEPGSKYYSLTELAAKCTARRLVPDYISEKKMLELKVDANGKGNCYPCMGCRSFLTPYLDEHGKPKYYGRFNQGVVTINLVDVACSSNGDYKSFWEIFDERLELCHKALMRRHQRLLGTPSDVAPILWQHGALARLEKGEKIDKLLFGGYSTISLGYAGLCECVRYMTGKPHTDPSATPFAIEIMKHLNEKCAEWKAASNIAFSLYGTPLESTTYKFAKCLKKRFGEIPGVTDKNYITNSYHVHVTEQMDAFTKLSFESQFQELSPGGAVSYVEVPNMENNIPAVMTLLKHIYENIMYAELNTKSDCCQKCGYTGEIQIVTDSDNKLVWQCPNCGNKDQATMNVARRTCGYIGTQYWNQGRTQEIKERVLHL

SEQ ID NO: 1028 - protein, 768 aa, unidentified
  REGION 1..768: note = Description of Unknown:uncultivated organism sequence
  REGION 1..768: note = Category: MG60 effectors
  REGION 1..768: note = Description: MG60-243 effector
MFCSCKKNLCVVIYIYNATKTYDCAKKLIVYKSIIKGAEVMKIIKRNGAEETFDRQKIKDAIAKANNETDGTPELTDRQIDYISLVIEDHCNEMNRALSVEEIQELVETHIILQGAPETAKRYIRYRFTRNLARASNTTDNQILSLIECNNEEVKQENSNKNPTVNSVQRDYMAGEVSKDLTKRILLPEDIVKAHEEGLIHFHDADYFAQHMHNCDLVNLEDMLQNGTVISGTMIEKPHSFSTACNIATQIIAQVASNQYGGQSISLAHLAPFVQISREKITRQVRAEMEEFGIDADDEQVKSLVEKRVRDEIKRGVQTIQYQVVTLLTTNGQAPFVTVFMYLNEAKNEQEKKDLAIIIEEVLKQRIKGTKNEVGVWVTPAFPKLIYVLEEDNITEDSRFWYLTKLAAECTAKRMVPDYISEKIMLKLKIDKNGNGNCYTCMGCRSFLTPYVDENGKPKYYGRFNQGVVTINLVDVACTAARDGSKSEEKFWQVLDERLELCHRALQCRHERLEGTLSDAAPILWQYGALARLKKGEPIDKLLHGGYSTLSLGYAGLWECVYEITGKKLTEKEGEEFGLRVMQRLNDACAEWKAAENIDYSIYGTPLESTTYKFAKCLQNRFGIIKGVTDRNYITNSYHIHVTEKIDAFRKLELESKFQKLSPGGAISYVEVPNMQQNIPAVLEVMKFIYNNIMYAELNTKSDYCQVCGYDGEIQIVEEDGKLVWRCPNCGNEDQSKMNVARRTCGYIGSQFWNQGRTQEIKERVLHL

SEQ ID NO: 1029 - protein, 768 aa, unidentified
  REGION 1..768: note = Description of Unknown:uncultivated organism sequence
  REGION 1..768: note = Category: MG60 effectors
  REGION 1..768: note = Description: MG60-244 effector
MFCSCKKKLCVVIYIYNATKTYDCAKKLIVYKSIIKGAEVMKIIKRNGAEETFDRQKIKDAIAKANNETDGTPELTDRQIDYISLVIEDHCNEMNRALSVEEIQELVETHIILQGAPETAKRYIRYRFTRNLARASNTTDNQILSLIECNNEEVKQENSNKNPTVNSVQRDYMAGEVSKDLTKRILLPEDIVKAHEEGLIHFHDADYFAQHMHNCDLVNLEDMLQNGTVISGTMIEKPHSFSTACNIATQIIAQVASNQYGGQSISLAHLAPFVQISREKITRQVRAEMEEFGIAADDEQVKSLVEKRVRDEIKRGVQTIQYQVVTLLTTNGQAPFVTVFMYLNEAKNEQEKKDLAIIIEEVLKQRIKGTKNEVGVWVTPAFPKLIYVLEEDNITEDSRFWYLTKLAAECTAKRMVPDYISEKIMLKLKVDKNGNGNCYTCMGCRSFLTPYVDENGKPKYYGRFNQGVVTINLVDVACTAARDGSKSEEKFWQVLDERLELCHRALQCRHERLEGTLSDAAPILWQYGALARLKKGEPIDKLLHGGYSTLSLGYAGLWECVYEITGKKLTEKEGEEFGLRVMQRLNDACTEWKAAENIDYSIYGTPLESTTYKFAKCLQNRFGIIKGVTDRNYITNSYHIHVTEKIDAFSKLELESKFQKLSPGGAISYVEVPNMQQNIPAVLEVMKFIYNNIMYAELNTKSDYCQVCGYDGEIQIVEEDGKLVWRCPNCGNEDQSKMNVARRTCGYIGSQFWNQGRTQEIKERVLHL

SEQ ID NO: 1030 - protein, 927 aa, unidentified
  REGION 1..927: note = Description of Unknown:uncultivated organism sequence
  REGION 1..927: note = Category: MG60 effectors
  REGION 1..927: note = Description: MG60-245 effector
MTKELSGVRVIELKTDLRKDQFWDRYERCFKTYHALYNEVPCWGLDWVEQKTQNQTSRELGCERVDLTAQRKALYERTDRTISYEQFSNCLKALWLGLLNCQQGNHMYTKLFEGAIQTDQMTAEDWAVLTEYVADPKSHNSQFLFRVSNTLKHIGFFSRPPFTATLFAPERKAITKDVMSDLKGWIEMKRMTEESYAAEEVQIQQMKAEVPVRIRQSLLRFFDTCIGLNLIGHFDERVHHYLRDCIIPALQQRTIPTEHFYLKSNRKDVGQKHIDFSLDIKFYELLAEMPELWNTLETSEDDLIPKPLILKHLHLLEAIMSHRAHRKTAAYAFVGEADYHRFYYLLGGNYTKHLISATGSELPDRVIWDNDKDVLMRNGRKVERLYVKVGDRKENFNFEVYTIAMNTKGLRGHRSTLKPTSYLQDLQIWSNPEGESTYLNFVRKGTERSAICKEPVLVYRNGAFFLRLSMSVEGMRASEEHIALQYYLSAAATGSDLSKDTEKTVERFNLIQGKTYKVMSVDLGIRSPFAWAVTESTITGVANPSQILNSGEMEIADDPDYTELFYAYKNLGHLIGQVKSSSKGKGLKADSHLVDMIHTVQRFFADYKVAGQRRSQIFEQFSKDPDPLYQMDQMMKRYENNLESVKKDFSFLINILFKYVTLQFGALRNRRRSYLSQNQMADQKFDQDFKWLNILEQRKRVTRSLSYLGTDNSRIPICLEQQKLDYNGCKDNFLKQLASKIVRIAHQNDCCLIVLEDLEGYGKTLNQRDENFLTAFWSPKRVKDAIINAAQWYGIGVVTVSEAQTSQVHHESGRIGYRKGRDLFFLTPDGQIESVPSDINAAKNIGHRFFSRHTDLHQVYLKGSDEGAKRMKGCLLYQFGSLEAARTHLTGTGPTWYLDGVEWIDKTERNLRRDLLKQRVEIEKMPF

SEQ ID NO: 1031 - protein, 768 aa, unidentified
  REGION 1..768: note = Description of Unknown:uncultivated organism sequence
  REGION 1..768: note = Category: MG60 effectors
  REGION 1..768: note = Description: MG60-246 effector
MFCSCKKNLRVVIYIYNATKTYDCAKKLIVYKSIIKGAEVMKIIKRNGAEETFDRQKIKDAIAKANNETDGTPELTDRQIDYISLVIEDHCNEMNRALSVEEIQELVETHIILQGAPETAKRYIRYRFTRNLARASNTTDNQILSLIECNNEEVKQENSNKNPTVNSVQRDYMAGEVSKDLTKRILLPEDIVKAHEEGLIHFHDADYFAQHMHNCDLVNLEDMLQNGTVISGTMIEKPHSFSTACNIATQIIAQVASNQYGGQSISLAHLAPFVQISREKITRQVRAEMEEFGIDADDEQVKSLVEKRVRDEIKRGVQTIQYQVVTLLTTNGQAPFVTVFMYLNEAKNEQEKKDLAIIIEEVLKQRIKGTKNEVGVWVTPAFPKLIYVLEEDNITEDSRFWYLTKLAAECTAKRMVPDYISEKIMLKLKIDKNGNGNCYTCMGCRSFLTPYVDENGKPKYYGRFNQGVVTINLVDVACTAARDGSKNEEKFWQALDERLELCHRALQCRHERLEGTLSDAAPILWQYGALARLKKGEPIDKLLHGGYSTLSLGYAGLWECVYEITGKKLTEKEGEEFGLRVMQRLNDACAEWKAAENIDYSIYGTPLESTTYKFAKCLQNRFGIIKGVTDRNYITNSYHIHVTEKIDAFSKLELESKFQKLSPGGAISYVEVPNMQQNIPAVLEVMKFIYNNIMYAELNTKSDYCQVCGYDGEIQIVEEDGKLVWRCPNCGNEDQSKMNVARRTCGYIGSQFWNQGRTQEIKERVLHL

SEQ ID NO: 1032 - protein, 768 aa, unidentified
  REGION 1..768: note = Description of Unknown:uncultivated organism sequence
  REGION 1..768: note = Category: MG60 effectors
  REGION 1..768: note = Description: MG60-247 effector
MFCSCKKNLRVVIYIYNATKTYDCAKKLIVYKSIIKGAEVMKIIKRNGAEETFDRQKIKDAISKANNETDGTPELTDRQIDYISLVIEDHCNEMNRALSVEEIQELVETHIILQGAPETAKRYIRYRFTRNLARASNTTDNQILSLIECNNEEVKQENSNKNPTVNSVQRDYMAGEVSKDLTKRILLPEDIVKAHEEGLIHFHDADYFAQHMHNCDLVNLEDMLQNGTVISGTMIEKPHSFSTACNIATQIIAQVASNQYGGQSISLAHLAPFVQISREKITRQVRAEMEEFGIAADDEQVKSLVEKRVRDEIKRGVQTIQYQVVTLLTTNGQAPFVTVFMYLNEAKNEQEKKDLAIIIEEVLKQRIKGTKNEVGVWVTPAFPKLIYVLEEDNITEDSRFWYLTKLAAECTAKRMVPDYISEKIMLKLKVDKNGNGNCYTCMGCRSFLTPYVDENGKPKYYGRFNQGVVTINLVDVACTAARDGNKSEEKFWQVLDERLELCHRALQCRHERLEGTLSDAAPILWQYGALARLKKGEPIDKLLHGGYSTLSLGYAGLWECVYEITGKKLTEKEGEEFGLRVMQRLNDACAEWKAAENIDYSIYGTPLESTTYKFAKCLQNRFGIIKGVTDRNYITNSYHIHVTEKIDAFSKLELESKFQKLSPGGAISYVEVPNMQQNIPAVLEVMKFIYNNIMYAELNTKSDYCQVCGYDGEIQIVEEDGKLVWRCPNCGNEDQSKMNVARRTCGYIGSQFWNQGRTQEIKERVLHL

SEQ ID NO: 1033 - protein, 768 aa, unidentified
  REGION 1..768: note = Description of Unknown:uncultivated organism sequence
  REGION 1..768: note = Category: MG60 effectors
  REGION 1..768: note = Description: MG60-248 effector
MFCSCKKNLRVVIYIYNATKTYDCAKKLIVYKSIIKGAEVMKIIKRNGAEETFDRQKIKDAIAKANNETDGTPELTDRQIDYISLVIEDHCNEMNRALSVEEIQELVETHIILQGAPETAKRYIRYRFTRNLARASNTTDNQILSLIECNNEEVKQENSNKNPTVNSVQRDYMAGEVSKDLTKRILLPEDIVKAHEEGLIHFHDADYFAQHMHNCDLVNLEDMLQNGTVISGTMIEKPHSFSTACNIATQIIAQVASNQYGGQSISLAHLAPFVQISREKITRQVRAEMEEFGIDADDEQVKSLVEKRVRDEIKRGVQTIQYQVVTLLTTNGQAPFVTVFMHLNEAKNEQEKKDLAIIIEEVLKQRIKGTKNEVGVWVTPAFPKLIYVLEEDNITEDSRFWYLTKLAAECTAKRMVPDYISEKIMLKLKIDKNGNGNCYTCMGCRSFLTPYVDENGKPKYYGRFNQGVVTINLVDVACTAARDGNKSEEKFWQVLDERLELCHRALQCRHERLEGTLSDAAPILWQYGALARLKKGEPIDKLLHGGYSTLSLGYAGLWECVYEITGKKLTEKEGEEFGLRVMQRLNDACAEWKAAENIDYSIYGTPLESTTYKFAKCLQNRFGIIKGVTDRNYITNSYHIHVTEKIDAFSKLELESKFQKLSPGGAISYVEVPNMQQNIPAVLEVMKFIYNNIMYAELNTKSDYCQVCGYDGEIQIVEEDGKLVWRCPNCGNEDQSKMNVARRTCGYIGSQFWNQGRTQEIKERVLHL

SEQ ID NO: 1034 - protein, 755 aa, unidentified
  REGION 1..755: note = Description of Unknown:uncultivated organism sequence
  REGION 1..755: note = Category: MG60 effectors
  REGION 1..755: note = Description: MG60-249 effector
MYELIEKREPKEEKPMKIIKRNGAEVVFDIDKIIMAVTKANDAVDEKVRMTPLQIERISQSVQIACEEMGRSPSVEEIQDLVEKAIMAHGAFEVAKEYITYRYTRSLLRQSNTTDDRILSLIECNNEEVKQENANKNPTINAVQRDYMAGEVSKDITSRILLPKEVVDAHEAGIIHFHDADYYAQHMHNCDLVNLEDMLQNGTVISGTLIEKPHSFSTACNIATQIIAQVAPNQYGGQSISLTHLAPFVQVSREKIRKTVEREMAAFGVAPAEETISKVVEDRLREEVRRGVQTIQYQVVTLMTTNGQAPFITVFMYLNEAKSEQEKKDLAMIIEETLRQRYEGVKNEKGVWITPAFPKLIYVLEEDNVREGTPYWYLTRLAAQCTAKRMVPDYISEKKMREYKLSKGETPGHGDVYTCMGCRSFLTPDRSGNGWDNVARAGNYEPGKPKYYGRFNQGVVTINLVDVALSSGRDMTKFWEVFEDRLELCHRALRCRHERLKGTLSDAAPILWQYGALARLPKGEPIDKLLYGGYSTISLGYAGLYECVKYMTGKSHTDDEAKPFALSVMQKMNDKCLQWKTAENIDYSLYGTPLESTTYKFAKCLQKRFGLVPGITDKSYITNSYHVHVTEPIDAFTKLRFEAEFQQLSPGGAISYVEVPNMQNNIDAVLEVMQFIYDNIMYAELNTKSDYCQVCGYDGEIEIKEDDGKLIWVCPQCGNTDQNKMNVARRTCGYIGTQFWNQGRTQEIKDRVLHL

SEQ ID NO: 1035 - protein, 909 aa, unidentified
  REGION 1..909: note = Description of Unknown:uncultivated organism sequence
  REGION 1..909: note = Category: MG60 effectors
  REGION 1..909: note = Description: MG60-250 effector
MNKVILTDAVPDIEKYWDYEANEGKKPSDFGASSSEKVWTKCPICGTSVRRNVRFTWEKDANGVGHVIHCRTCGKRNNNNSLVVLFPDIKKYWTYEKNEHDPEYYSISSGKKVYTRCPSCGEERYIAICDLIVNRNDRYELTQCIDCSLTLNPRRNVIGSIAKNYPDIDKYWDDKNVSKPDEIALNSQEIIFIHCPTCDKLIKRRALNSFRRDDQTGIYTLLDCHKCAAQKAGKIRGLNQSGALIDECPEIKEWWDAENNTIELKNITRGTHYKAQLKCPACHSSFTRQIHSFVSTKRDGRLLPVACPECGYSSKGDPNDNILRLCPEVDKWWDYEANSPYRPEQFTKGSQFQAHFICPDCGMHLYAGIHSLLKSDENGELHIRHKGNCLKYRSIESDNNLVKQYPQIKEWWDYEENGKALPEKFTIYSGKRMHFICPTCGAKSYRRITDAFAIEANSGEPILFNCPYCRNKKALSGKNSLLDTDPELAKEWSNSNNLKASEVLPTSSSRAKWVCPTCHGEYSAIIRDRKVDDNACPYCRNDKLLPGYNSLQDKKPELAKEWSTRNTLKADTVLFTSSSRVKWVCPTCHKEYSAIIRDRKLGDDSCPYCRQRRLLREHTSLWAVNPALAKEWSTKNPKKADEVLSSSCNSVLWICPTCHGEYSAIIRDRKVGDDACPYCKNDKVLPGFNSLQYKNPELAEEWSANNELKANEVLPTSSSRVKWVCPTCRGEYYAAIRDRKVGDDACPYCKNDKVLPGFNSLQYKNPELAEEWSANNELKANEVLPTSSSRVKWVCPTCRGEYYAAIRDRKVGDDACPYCKNDKVLPGYNSLKVRQPELVEREWCYPENILIGVYPDQILESYPGQAWWKCPTCKRKYLMSVKDRLMKQKRGHVACPQCRGRRRVRSFWV

SEQ ID NO: 1036 - protein, 768 aa, unidentified
  REGION 1..768: note = Description of Unknown:uncultivated organism sequence
  REGION 1..768: note = Category: MG60 effectors
  REGION 1..768: note = Description: MG60-251 effector
MFCSCKKNLRVVIYIYNATKTYDCAKKLIVYKSIIKGAEVMKIIKRNGAEETFDRQKIKDAIAKANNETDGTPELTDRQIDYISLVIEDHCNEMNRALSVEEIQELVETHIILQGAPETAKRYIRYRFTRNLARASNTTDNQILSLIECNNEEVKQENSNKNPTVNSVQRDYMAGEVSKDLTKRILLPEDIVKAHEEGLIHFHDADYFAQHMHNCDLVNLEDMLQNGTVISGTMIEKPHSFSTACNIATQIIAQVASNQYGGQSISLAHLAPFVQISREKITRQVRAEMEEFGIAADDEQVKSLVEKRVRDEIKRGVQTIQYQVVTLLTTNGQAPFVTVFMYLNEAKNEQEKKDLAIIIEEVLKQRIKGTKNEVGVWVTPAFPKLIYVLEEDNITEDSRFWYLTKLAAECTAKRMVPDYISEKIMLKLKIDKNGNGNCYTCMGCRSFLTPYVDENGKPKYYGRFNQGVVTINLVDVACTAARDGSKSEEKFWQVLDERLELCHRALQCRHERLEGTLSDAAPILWQYGALARLKKGEPIDKLLHGGYSTLSLGYAGLWECVYEITGKKLTEKEGEEFGLRVMQRLNDACAEWKAAENIDYSIYGTPLESTTYKFAKCLQNRFGIIKGVTDRNYITNSYHIHVTEKIDAFSKLELESKFQKLSPGGAISYVEVPNMQQNIPAVLEVMKFIYNNIMYAELNTKSDYCQVCGYDGEIQIVEEDGKLVWRCPNCGNEDQSKMNVARRTCGYIGSQFWNQGRTQEIKERVLHL

SEQ ID NO: 1037 - protein, 1240 aa, unidentified
  REGION 1..1240: note = Description of Unknown:uncultivated organism sequence
  REGION 1..1240: note = Category: MG60 effectors
  REGION 1..1240: note = Description: MG60-252 effector
MLKNQILKLTELTNKKELDKESDINSFLNKLPTIQKMFIVQNLLTELISIKNPFLETKNKMIEKIENNCYKYYKYTIQIKQIYDYCALKKPENSINYVLLKGKEAEIVLHEFEESRKNFITNFFFELRNNNILMMKIIKEIDINYYEQLGYFLTQFLYHNTTNTNFSQDELNLMLYLVMEDTVNNKFPDELTFEFLFNLNTEKEKMFLYYFVKNLTKKVEIRNYLTNIFHDLILNLESKNQKLSMNTTTLIREVLNLNNQNNQNNNDIVSDEKDDEYSRKTTMNAHDLLKNFKSLFNNADILNPEKKNTLRQTMISTKKKIEKVETKDDDLNLKKFKSEFDNCTINVETLRIKTFFEETNYTKNELYQSLNDLCNKNENRTSLENNFMEYLLCLKMESLKNETKKYTELYSNQMIYESFMESKKDNIKTEDEGNNIDEKYINNFMTITEFIQNLFEKILQSIDSLPYTIKCLLFFLDKLISKKYEQFKISTYQSSIIKLKFFFDGFILPILQNPFYNGCISDGVISDTTVENLKIISVIVEKFTSSNLFKIVNENIDPYYIIFNKFIVEHMQDFLKIHIAIDESIKNRFEPPKVLMELFESKDLNERNINYDFFKYNENESIQYQSVCFSYFDLMMFINTTEKENIKSYLESNGDIKSDYQLLLKYKIKNFEEGCKNNLSGKKKEFFYITNLKYKESFLKKIKSLTEEKEEFLDNYYKNQKSNSNMSENILLLKQCLIEVMIYLNKINKEDISSFIKRKNKLVLHHNSQINKYLLNKKYIGYKNIFEEKNNLSNINHIIKQKNFFSKLCLSQDAMEDGDFLEDIFPRIITKLKIELGHLIDYAKYERIIFCITFLQINIRNLPQIYRSNNFSKLFVEIINDVQNMIKGLQDNILNQYLFKIRGGDKLNLILSKYSQEIKSMEKYYTINYLFNKLTPHIPSKNKDEINKEKTIKQAKNTPSKKISSLSKSQIFFQPQNLIDLIPKKSILNFINEFHNYPASLKGIDDDVFSIEKKDEIPKLLHNYFNEIINLLQEEKMVKKYNQDDLVSICYDFENYILLKMHDKLLPDFPSKCDEFIYKKCLRLDFITPENMNADKKMINEDLLLTVTEYINKIDIKYTPIDKINMFGKAFQILQDSMSFSSGKSDVGTDDVLPLLHYVMIKAKPKMIYTNYVFCKYYINQNLLKKQTGFLLAQIGMFVKIICNMKFSNLKGVTEEQFGVDEEMPEDLKDIENKFEKLNP

SEQ ID NO: 1038 - protein, 1310 aa, unidentified
  REGION 1..1310: note = Description of Unknown:uncultivated organism sequence
  REGION 1..1310: note = Category: MG60 effectors
  REGION 1..1310: note = Description: MG60-253 effector
  MOD_RES 998..1001: note = Any amino acid
MSNFESYLNQFRVQKGEACNYTGMTINRGSFYIPEENRTTFLSKYYDHVFKQGGSSDLIERHSDLCCVLYDLDMKIDKESEERGYTREIINSFIEISTRIMKKYFDLPVSAYQCFVLEKDKPTVKKECKKDGVHLMFPYIVTEPSIQHLIRDEIVIEAKHLFEECLNTIEDIVDISVLDKNGWMLLGSSKIDGLPYNLTGIWSYENIEDVGNTFPNRVETSEYYTPSLDLVTLLSIRRFTLADITNFKSDMQDFLESWIDDFNTIQEEKNNIHTRRFHGNINKDMKVNMKTVQSLVSILSTDRAKNYEEWIELGFCLHTISDELLQTWIEFSERVDDYRETASADCSARWGKMRETGLGLGTLHMWAKADNYKAYLEIIQNDLEYFIVKTVNSALSNKDDAKDKAKKEVNISDVIFNVVLALKQKYYHYFICSSYEKKHWYEFEDIRWVEGDADVGLKRKIREDLYDDYVAVSTKYRKLSERFQNDHPNKEKYELISAEVFKVAQKLRDATFRKRLLEEASEQLYWSRDRSKQLSSSKFEEILDVNEKLIGMKNGVYDLEKQCFREARCEDYVSLSADIEYQEYFWNDEIIQDINTFISQVLTNKDVRDYVLQTFAMCLDGQIYNEHFHIYTGCHAKGSEILMHDGTIANVENVKVGDMLMGPDSKPREVHELVNGHSQMYEIIPSKGEPFVVNEDHIMVLKATTINNVVKCKNEKRFKLSWHERDIFGFPVSKCKNFPYNGRLKYKKNVIYYKTEDDARNAIEIYRNDLIMNNLNYIKNGDVIEIPLKEYIKRMKKINGAKNYFLFKEGVDFPAKDVKIDPYMLGYWLGDGTSKAFAITTMDDIVIDYFDQKTVVDENMDKKVYHKKNNKAKTIYYSSKERKPGKNRLLNAMKEYNIYNNKHIPSVYKFNNRQTRLELLAGLIDSDGHYNVKSKHYEITLKIEKLIDDTVYLARSLGFAVTKRTVKKTCTNNGKTGMYFNVLICGNNLNEIPVLIEXXXXFKVNKLKNDQYYGFKLNQDHLYLAGDFFVHHNCGSNGKSKILELFELSFGQYCSKLSIAALTQKRVSSSAATPEIARLRGRRFVVLQEPGENEILNVGLMKEMTGGDKIVARSLNKDPIEFKPQFNMILTCNQRPKIPSDDQGSWRRIRVVEFTSKFTANPDPNDPNQFMIDTDLTSKLKKWGKPFFWILTQYYKEFKKNGYKEPAEVTAATNEYQKEQDAYSEFVTDCLKLDKTSYADVKEVYTVFQEYVRYNNDQKPSKKAFEKYMNTRFGKFGRHRDSKCWKGFKIDEAALNENYGISENPEDELL

SEQ ID NO: 1039 - protein, 806 aa, unidentified
  REGION 1..806: note = Description of Unknown:uncultivated organism sequence
  REGION 1..806: note = Category: MG60 effectors
  REGION 1..806: note = Description: MG60-254 effector
MTSSSDLKKHAKFFRSLQEPFDPGPFKENLNVLEPRVDIEDTKSKACSVLTSPRKKVKPQVNLQEETSVMPESPATPKRKIWIPSVSSSELDTLIMNASEILDRALISKERGFCQFWTQRVGEISEKLSSLTETDYAGSDLKLLNESYRRAGGKSWFSITTSCPPNRNSSKIFSQLLQSSVPDCTVCEVTHSKTKLGVWQRREQVNLTGKKYKTLKVRLFPNKDQEDMLIGDSSRLRWYENAYNDIFPLDDYMKLIDKAKEDGEERPPLINWKTFQSKLKDYEYLEEQIGNMVDETHKTSMPVVYKQLKLKKGCKNILEDIALKEEINRKENERKKLEKEDKKKRENDGQEKIELTMSKEDKKVYRKKLKEDRKIATKNKRLRAKEEVENKKKAKLEEIQAKKQEREDQKKIAQTMPKDERKLYEAKLAEDRKIAAEEEAKNKKPRNTNEYPYPSWMENTFGKIISSKTNERIIRGAVANFTQNLNSAVSNYFNGNIKSFELRYRTAKDKHEFINFTDEHLPVWYKDVHGSYSYRFPIGHANKRRTSITWNDLMKTHKGSVIIIQDKQTKCWYGCLPVERDWYPPFDHRSENQGPMKKGEAIGLDPGMRKFLAGFTTTGETIYFGDRAFKIIGDLYSKISWIDSELAQYRAKMLDLSLEQKENLCKEKQAYWNRVKNLVTEMHWKCIRFLVLNYEYIFLEDFSTKGCIKKKPKGQDLSPLVKRILGQYSFYKFKQRLAYSCDKYGRKLILVHPARTTKDCPYCGNEQNVERSETYDCPKCNRILDRDQHSALNVLVKGMSILESRN

SEQ ID NO: 1040 - protein, 773 aa, unidentified
  REGION 1..773: note = Description of Unknown:uncultivated organism sequence
  REGION 1..773: note = Category: MG60 effectors
  REGION 1..773: note = Description: MG60-255 effector
MKIIKRNGSEAVFDIMKIISAVTRANNVVEEADRLTPMQIRRIAESVENSCLSMNRALSVEEIQDLVENQIMAHGAFEVAKNYITYRYTRTLVRKSNTTDEKILSLIESNNEEVKQENSNKNPTVNAVQRDYMAGEVSKDLTARVLLPQDIVDAHNEGIIHFHDADYFAQHMHNCDLVNLEDMLQNGTVISGTLIEKPHSFSTACNIATQIIAQIASNQYGGQSISLTHLAPFVDISRQKIRRSVLEEIKSFGVQPSEEAITNVVETRLRRKIRESVVREIRELGAEAAEERISKIVEERLREEIKRGVQTIQYQVVTLMTTNGQAPFITVFMYLGEARNEQERKDLAIIIEETLRQRIEGVKNEKGVWITPAFPKLIYVLEEDNITEDSPYWELTKLAARCTAKRMVPDYISEKKMRELKLSKGETPGHGDVYTCMGCRSFLTPDRSGTGWNNVANAGNYEPGKPKYYGRFNQGVVTINLVDIALSSGGGLDKFWKIFDDRLDLCYRALMCRHNRLKGTLSDAAPILWQYGALARLKKGEPIDKLLYGGYSTISLGYAGLYECVKYMTGKSHTDPAATPFALDIMHHLNDACAKWKAETDIDFSLYGTPLESTTYKFAKCLQKRFGIVPGITDKNYITNSYHIHVTEHINAFDKLAFESQFQALSPGGAISYVEVPNMQQNLDAVLEVMKFIYDHIMYAELNTKSDYCQVCGYDGEIEIKEDEDGKLIWTCPQCGNTDQSKMNVARRTCGYIGTQYWNQGRTQEIRDRVLHL

SEQ ID NO: 1041 - protein, 768 aa, unidentified
  REGION 1..768: note = Description of Unknown:uncultivated organism sequence
  REGION 1..768: note = Category: MG60 effectors
  REGION 1..768: note = Description: MG60-256 effector
MFCSCKKNLCVVIYIYDATKTYDCAKKLIVYKSIIKGAEVMKIIKRNGAEETFDRQKIKDAIAKANNETDGTPELTDRQIDYISLVIEDHCNEMNRALSVEEIQELVETHIILQGAPETAKRYIRYRFTRNLARASNTTDNQILSLIECNNEEVKQENSNKNPTVNSVQRDYMAGEVSKDLTKRILLPEDIVKAHEEGLIHFHDADYFAQHMHNCDLVNLEDMLQNGTVISGTMIEKPHSFSTACNIATQIIAQVASNQYGGQSISLAHLAPFVQISREKITRQVRAEMEEFGIAADDEQVKSLVEKRVRDEIKRGVQTIQYQVVTLLTTNGQAPFVTVFMYLNEAKNEQEKKDLAIIIEEVLKQRIKGTKNEVGVWVTPAFPKLIYVLEEDNITEDSRFWYLTKLAAECTAKRMVPDYISEKIMLKLKIDKNGNGNCYTCMGCRSFLTPYVDENGKPKYYGRFNQGVVTINLVDVACTAARDGNKSEEKFWQVLDERLELCHRALQCRHERLEGTLSDAAPILWQYGALARLKKGEPIDKLLHGGYSTLSLGYAGLWECVYEIKGKKLTEKEGEEFGLRVMQRLNDACAEWKAAENIDYSIYGTPLESTTYKFAKCLQNRFGIIKGVTDRNYITNSYHIHVTEKIDAFSKLELESKFQKLSPGGAISYVEVPNMQQNIPAVLEVMKFIYNNIMYAELNTKSDYCQVCGYDGEIQIVEEDGKLVWRCPNCGNEDQSKMNVARRTCGYIGSQFWNQGRTQEIKERVLHL

SEQ ID NO: 1042 - protein, 755 aa, unidentified
  REGION 1..755: note = Description of Unknown:uncultivated organism sequence
  REGION 1..755: note = Category: MG60 effectors
  REGION 1..755: note = Description: MG60-257 effector
MHELIEKREPKEEKPMKIIKRNGAEVVFDIDKIIMAVTKANDAVDEKVRMTPLQIERISQSVQIACEEMGRSPSVEEIQDLVEKAIMAHGAFEVAKEYITYRYTRSLLRQSNTTDDRILSLIECNNEEVKQENANKNPTINAVQRDYMAGEVSKDITSRILLPKEVVDAHEAGIIHFHDADYYAQHMHNCDLVNLEDMLQNGTVISGTLIEKPHSFSTACNIATQIIAQVASNQYGGQSISLTHLAPFVQVSREKIRKTVEREMAAFGVAPAEETISKVVEDRLREEVRRGVQTIQYQVVTLMTTNGQAPFITVFMYLNEAKNEQEKKDLAMIIEETLRQRYEGVKNEKGVWITPAFPKLIYVLEEDNVREGTPYWYLTRLAAQCTAKRMVPDYISEKKMREYKLSKGETPGHGDVYTCMGCRSFLTPDRSGNGWDNVARAGNYEPGKPKYYGRFNQGVVTINLVDVALSSGRDMTKFWEVFEDRLELCHRALRCRHERLKGTLSDAAPILWQYGALARLPKGEPIDKLLYGGYSTISLGYAGLYECVKYMTGKSHTDDEAKPFALSVMQKMNDKCLQWKTAENIDYSLYGTPLESTTYKFAKCLQKRFGLVPGITDKSYITNSYHVHVTEPIDAFTKLRFEAEFQQLSPGGAISYVEVPNMQNNIDAVLEVMQFIYDNIMYAELNTKSDYCQVCGYDGEIEIKEDDGKLIWVCPQCGNTDQNKMNVARRTCGYIGTQFWNQGRTQEIKDRVLHL

SEQ ID NO: 1043 - protein, 800 aa, unidentified
  REGION 1..800: note = Description of Unknown:uncultivated organism sequence
  REGION 1..800: note = Category: MG60 effectors
  REGION 1..800: note = Description: MG60-258 effector
MSLHFVLLRCIITQDVVLGIDNERYIKGLEHSGGSLMTRVFFAPYRLLLNCGEGTRKRLIRRSRKDMKIIKRSGTEVEFDISKIVAAVAKANKEVVEKDRLTREQINEIAKKVTLTCSGMNRTASVEEIQDMVENEIMEAQAFAVARKYITYRYTRALVRKANSTDEQILSLIECNNEEVKQENSNKNPVVNSVQRDYMAGEVSKDIAKRILLPEDVVKAHEEGIIHFHDSDYFAQHMHNCCLVNLEDMLQNGTVISETMIDKPKSFSTACNIATQSIAQIASSQYGGQSITLSHLAPFVDVSRKKYLKMVQEEFEEAGLALDHNQIAKIAELRVREEIKRGVQMIQYQVITLMTTNGQAPFVTVFMYLNEVPEGQTRDDLALVIEEMLRQRILGVKNEKGVYITPAFPKLIYVLEEDNITEDSKYWYLTKMAATCTAKRMVPDYISEKIMKKLKGGDVYACMGCRSFLTPDRFTEAGVGNIANAGNYDPNKHKYWGRFNQGVVTINLVDVACSSEGDMDKFWNIMDERLELCHKALMCRHERLLGTPSDVAPILWQYGALARLKRGEKIDRLLFDGYSTISLGYAGLCECTRYMTGLSHTNPEATPFAMEVMQHLNDACAKWKAESNIDFSIYGTPLESTTYKFAKCLQKRFGVIEGVTDKNYITNSYHVHVTEKIDAFSKLSFEAKFQELSPGGAVSYVEVPNMQNNIDAVLAVMKHIYDNIMYAELNTKSDYCQKCGYDGEIQIAENTDGKLVWKCPNCGNTDEETMNVARRTCGYIGTQFWNQGRTQEIQERVLHL

SEQ ID NO: 1044 - protein, 760 aa, unidentified
  REGION 1..760: note = Description of Unknown:uncultivated organism sequence
  REGION 1..760: note = Category: MG60 effectors
  REGION 1..760: note = Description: MG60-259 effector
MKIIKRSGTEVVFDIDKIVNAIRAANLEVEESSRLTDRQVVYAAQNVAEACENAGHTVSVEEIQDLVEDEIMRLDCYEVARHYIIYRYVQSLKRQKNTTDDKILSLIECNNEEVKQENSNKNPTVNSVQRDYMAGEISKDLTQRVLLPQEIVDAHNEGLIHFHDSDYFAQHMHNCDLVNLEDMLQNGTVISGTLIEKPHSFSTACNIATQIIAQVASSQYGGQSISLTHLAPFVEVSRQKIRGEVARELEELGVSASPEKVREVVEDRLRDEIRRGVQTIQYQVVTLMTTNGQAPFVTVFMYLNEARTPQEKHDLAMIVEETLRQRYEGVKNEAGVWITPAFPKLIYVLEDDNVHENSPYFYLTQLAAKCTAKRMVPDYISEKKMRELKLSKGETAGNGDCYTCMGCRSFLTPDRSGNGDCYTCMGCRSFLTPDRSGNGFNNVANALNYDPNKPKYYGRFNQGVVTINLPDVALSSHQDMDKFWKIFDERLELCHRALLCRHERLMGTLSDAAPILWQYGALARLKKGETIDKLLVGGYSTISLGYAGLYECVKYMTGHSHTEKEGTPFAMAVMQRMNDKCAEWKAESDIDFSLYGTPLESTTYKFAKCLQRRFGIIPGVTDKGYITNSYHVHVSEEIDAFDKLKFEGMFQQLSPGGAISYVEVPNMQDNLKAVIRVMQYIYDNIMYAELNTKSDYCQVCGYDGEIKIVEDDGKLVWECPNCGNRDQEKMNVARRTCGYIGTQFWNQGRTEEIRDRVLHL

SEQ ID NO: 1045 - protein, 768 aa, unidentified
  REGION 1..768: note = Description of Unknown:uncultivated organism sequence
  REGION 1..768: note = Category: MG60 effectors
  REGION 1..768: note = Description: MG60-260 effector
MFCSCKKNLCVVIYIYNATKTYDCVKKLIVYKSIIKGAEVMKIIKRNGAEETFDRQKIKDAISKANNETDGTPELTDRQIDYISLVIEDHCNEMNRALSVEEIQELVETHIILQGAPETAKRYIRYRFTRNLARASNTTDNQILSLIECNNEEVKQENSNKNPTVNSVQRDYMAGEVSKDLTKRILLPEDIVKAHEEGLIHFHDADYFAQHMHNCDLVNLEDMLQNGTVISGTMIEKPHSFSTACNIATQIIAQVASNQYGGQSISLAHLAPFVQISREKITRQVRAEMEEFGIAADDEQVKSLVEKRVRDEIKRGVQTIQYQVVTLLTTNGQAPFVTVFMYLNEAKNEQEKKDLAIIIEEVLKQRIKGTKNEVGVWVTPAFPKLIYVLEEDNITEDSRFWYLTKLAAECTAKRMVPDYISEKIMLKLKIDKNGNGNCYTCMGCRSFLTPYVDENGKPKYYGRFNQGVVTINLVDVACTAARDGSKSEEKFWQVLDERLELCHRALQCRHERLEGTLSDAAPILWQYGALARLKKGEPIDKLLHGGYSTLSLGYAGLWECVYEITGKKLTEKEGEEFGLRVMQRLNDACAEWKAAENIDYSIYGTPLESTTYKFAKCLQNRFGIIKGVTDRNYITNSYHIHVTEKIDAFSKLELESKFQKLSPGGAISYVEVPNMQQNIPAVLEVMKFIYNNIMYAELNTKSDYCQVCGYDGEIQIVEEDGKLVWRCPNCGNEDQSKMNVARRTCGYIGSQFWNQGRTQEIKERVLHL

SEQ ID NO: 1046 - protein, 768 aa, unidentified
  REGION 1..768: note = Description of Unknown:uncultivated organism sequence
  REGION 1..768: note = Category: MG60 effectors
  REGION 1..768: note = Description: MG60-261 effector
MFCSCKKNLCVVIYIYDATKTYDCAKKLIVYKSIIKGAEVMKIIKRNGAEETFDRQKIKDAIAKANNETDGTPELTDRQIDYISLVIEDHCNEMNRALSVEEIQELVETHIILQGAPETAKRYIRYRFTRNLARASNTTDNQILSLIECNNEEVKQENSNKNPTVNSVQRDYMAGEVSKDLTKRILLPEDIVKAHEEGLIHFHDADYFAQHMHNCDLVNLEDMLQNGTVISGTMIEKPHSFSTACNIATQIIAQVASNQYGGQSISLAHLAPFVQISREKITRQVRAEMEEFGIAADDEQVKSLVEKRVRDEIKRGVQTIQYQVVTLLTTNGQAPFVTVFMYLNEAKNEQEKKDLAIIIEEVLKQRIKGTKNEVGVWVTPAFPKLIYVLEEDNITEDSRFWYLTKLAAECTAKRMVPDYISEKIMLELKIDKNGNGNCYTCMGCRSFLTPYVDENGKPKYYGRFNQGVVTINLVDVACTAARDGNKSEEKFWQVLDERLELCHRALQCRHERLEGTLSDAAPILWQYGALARLKKGEPIYKLLHGGYSTLSLGYAGLWECVYEITGKKLTEKEGEEFGLRVMQRLNDACAEWKAAENIDYSIYGTPLESTTYKFAKCLQNRFGIIKGVTDRNYITNSYHIHVTEKIDAFSKLELESKFQKLSPGGAISYVEVPNMQQNIPAVLEVMKFIYNNIMYAELNTKSDYCQVCGYDGEIQIVEEDGKLVWRCPNCGNEDQSKMNVARRTCGYIGSQFWNQGRTQEIKERVLHL

SEQ ID NO: 1047 - protein, 756 aa, unidentified
  REGION 1..756: note = Description of Unknown:uncultivated organism sequence
  REGION 1..756: note = Category: MG60 effectors
  REGION 1..756: note = Description: MG60-262 effector
MHELIEKREPKEEKPMKIIKRNGAEVVFDIDKIIMAVTKANDAVDEKVRMTPLQIERISQSVQIACEEMGRSPSVEEIQDLVEKAIMAHGAFEVAKEYITYRYTRSLLRQSNTTDDRILSLIECNNEEVKQENANKNPTINAVQRDYMAGEVSKDITSRILLPKEVVDAHEAGIIHFHDADYYAQHMHNCDLVNLEDMLQNGTVISGTLIEKPHSFSTACNIATQIIAQVASNQYGGQSISLTHLAPFVQVSREKIRKTVEREMAAFGVAPAEETISKVVEDRLREEVRRGVQTIQYQVVTLMTTNGQAPFITVFMYLNEAKSEQEKKDLAMIIEETLRQRYEGVKNEKGVWITPAFPKLIYVLEEDNVREGTPYWYLTRLAAQCTAKRMVPDYISEKKMREYKLSKGETPGHGDVYTCMGCRSFLTPDRSGNGWDNVARAGNYEPGKPKYYGRFNQGVVTINLVDVALSSGRDMTKFWEVFEDRLELCHRALRCRHERLKGTLSDAAPILWQYGALARLPKGEPIDKLLYGGYSTISLGYAGLYECVKYMTGKSHTDDEAKPFALSVMQKMNDKCLQWKTAENIDYSLYGTPLESTTYKFAKCLQKRFGLIPGITDKSYITNSYHVHVTEPIDAFTKLRFEAEFQQLSPGGAISYVEVPNMQNNIDAVLEVMQFIYDNIMYAELNTKSDYCQVCGYDGEISIREDEDGKLVWVCPQCGNTDQSKMNVARRTCGYIGTQFWNQGRTQEIKDRVLHL

SEQ ID NO: 1048 - protein, 1076 aa, unidentified
  REGION 1..1076: note = Description of Unknown:uncultivated organism sequence
  REGION 1..1076: note = Category: MG60 effectors
  REGION 1..1076: note = Description: MG60-263 effector
MEKMQKLYEVRKSLRFELKPSKITFEKIKKEWIFNNNIFESQIFSQKFNEINFQAEEKENNYLFSINENKLNELVKRCDVKIENIKNIKEFIEDNPNELWRVWIDNEKIKIIDKDLKYILEEKSSWKKVFWNPEKKDKKTWNKWAQSNFTVKWKKWLFLTFDDIDAYFEEIRSTKNKKPKAWDFTNMFIDKISFLLKQYEVRKYQLWLNTKWNIEENEKKLFQTKRERISRIRSFLWMFLKLESVISVLNFNYKDNFSEFPVELKEIIISFNEDEDVNDIISEIELIFSESNLYLHKNIERKFSLNIRAINPNPENTKDNKIKTENEIFKDIEVLEEKISKLKNLKAQIKWERKDKKNSWDTNWKEHKKNKWDDVLKKLNPKWEESLFSKLTELRRDLEEVHLTHFAVLLEKEGLFYLALENKRVNNSKNWEIKKINNLELWKFFTKSNSWESKFLNYNVITFQWLRRLCLEESSSMKTENFLNKNNGKWTKWSNQQKKSININWRDEEYFDDLKDYLKFILKNNTDKIGVNFTENDFKEWKDIKWDENLENLEKIINKQWYKANWENFNFENLKKLEEEWNIELFQIYNKDFLIDKDFVTSNSDKEKFERIEYTKEQLKKEWKKFIPKYKDEYKKHKRNLFTIYWQDLFNDEENNQIRIKQEWKFYIRLAWEEEGERKISDNFSIKNKKRYSENKIFADFNLLLNPNTSNISKRCKQNKEFQKKYIKDFNLDIKGLNPKYYIGLDQWVNSLVSYCVMDENENIVTDKNWKPEIWDLSLVISNWENQGQFVEVEDTIIVWWDKWVWSEDKWILEQEEPNKRILKIDGNIKVFDYAEAIYSESYKRRKEIEKYCNNEIDFDEVSNLKKGYSSFVLHKIEQLAKKYSPAIISLEYLQDQKNKSRFVNKNWEWKKIDKQSENPKIYRFWTSTIECIEDALLKKFQFWYGKTENWKKQLVPFFSNKEELYKKGLQLWNIIFIDEKDTSVLCPSCKELLTRCKNPYHEEEWKRWGLYTDEDTKNIYWQFRKVFDILKHNPYNVCNWNSSEKNEKFSFIKSWDDLATYNIAKKWLEYIKNLK

SEQ ID NO: 1049 - protein, 1043 aa, unidentified
  REGION 1..1043: note = Description of Unknown:uncultivated organism sequence
  REGION 1..1043: note = Category: MG60 effectors
  REGION 1..1043: note = Description: MG60-264 effector
MIINNKRKEYKNKQMQINTSYDKDENISDNKKKTENIKVINGMGLNLDIKNKYQNGILSDEKSINLLGKNNNNSNSNCPIKIIKLNNINNFEVDGVSNNFDNQNGNKSNITHDSKYDSRRNFYIRNNSMKNINSKMVNSNFHNNVENVIFSNNNNIMLIDKNLSFNSERLDSRNAIKINKLKDDYIDYLQKEFEDKSKNNVQLDTSNKELLKKCNELILNNRLLNESLTDKNNKLTKISEENQYMKNEYNKSMANFRKMQEKTKVYEDQINLLKSNNTNNEKIIKELRQQIEQANSNLKKVKSEYEEKLKKTEEKYKNEIEENKKNMETLYNNKILGDDKNINNEKKIKSLMDEISYLKEKNQELIKDLETKEKTIELMYNDNAKLMNEANLKQGKLDQSYRQINDLKIILKHKESIINTFKMNIGENDRISLNKSNSCSFMKLDTSDVISENLTKLLNDNEENRMKLEVLNNRLKSIDEIRKKYHNLVKDNKAIPLTNNYSFNSRNSVNFTKEKLNTSFYSNCKNTNNKNNSQGEIDLKDNIENYNINKELNQSVRRSFLSSLSLNILNNSGIKNEENNNKNEKVIKKYIIDTSKDKDKDKDKDIKANILEGDKDKKPVISERFKSVEKKSIPFRGRNFYKRDENKNKRLLRQTTFENEENQKILHKRELEEESKDSRGSDEDSDKIKITTYVPKNFTFSGDEVIYEQNTEQIVNTTEGENNGSCYLYGIDRNDLFHIFDINNKIWLESKKIFDLNLDEKSSSFKTDYQYEGTLLYNTLRGVYILTGENTDTLYFFNSKSSSISKICKFNSSHNNGSMMFDNNENCLYVFGGKNITSCEYYSFYDRKVCKLPNLNIDRANSSFIISNNKIFAFFGFSYENDDYVRTIEYIDYNKKDKWIELNNITLLKNDISFDVESVSTMYYKQNASKILIYSGIQGEDEDFITEYYLIYDVRSNTMDKINKWNIKQYKNIGKKWKDYEITGNDPKGFHFAKNSRFILLPDNCIPEGYNENDIIEVLIDYKNNVHFIVQEKNKIDVYRGEM

SEQ ID NO: 1050 - protein, 768 aa, unidentified
  REGION 1..768: note = Description of Unknown:uncultivated organism sequence
  REGION 1..768: note = Category: MG60 effectors
  REGION 1..768: note = Description: MG60-265 effector
MFCSCKKNLRVVIYIYNATKTYDCAKKLIVYKSIIKGAEVMKIIKRNGAEETFDRQKIKDAISKANNETDGTPELTDRQIDYISLVIEDHCNEMNRALSVEEIQELVETHIILQGAPETAKRYIRYRFTRNLARASNTTDNQILSLIECNNEEVKQENSNKNPTVNSVQRDYMAGEVSKDLTKRILLPEDIVKAHEEGLIHFHDADYFAQHMHNCDLVNLEDMLQNGTVISGTMIEKPHSFSTACNIATQIIAQVASNQYGGQSISLAHLAPFVQISREKITRQVRAEMEEFGIAADDEQVKSLVEKRVRDEIKRGVQTIQYQVVTLLTTNGQAPFVTVFMYLNEAKNEQEKKDLAIIIEEVLKQRIKGTKNEVGVWVTPAFPKLIYVLEEDNITEDSRFWYLTKLAAECTAKRMVPDYISEKIMLKLKIDKNGNGNCYTCMGCRSFLTPYVDENGKPKYYGRFNQGVVTINLVDVACTAARDGSKSEEKFWQVLDERLELCHRALQCRHERLEGTLSDAAPILWQYGALARLKKGEPIDKLLHGGYSTLSLGYAGLWECVYEITGKKLTEKEGEEFGLRVMQRLNDACAEWKAAENIDYSIYGTPLESTTYKFAKCLQNRFGIIKGVTDRNYITNSYHIHVTEKIDAFSKLELESKFQKLSPGGAISYVEVPNMQQNIPAVLEVMKFIYNNIMYAELNTKSDYCQVCGYDGEIQIVEEDGKLVWRCPNCGNEDQSKMNVARRTCGYIGSQFWNQGRTQEIKERVLHL

SEQ ID NO: 1051 - protein, 755 aa, unidentified
  REGION 1..755: note = Description of Unknown:uncultivated organism sequence
  REGION 1..755: note = Category: MG60 effectors
  REGION 1..755: note = Description: MG60-266 effector
MHELIEKREPKEEKPMKIIKRNGAEVVFDIDKIIMAVTKANDAVDEKVRMTPLQIERISQSVQIACEEMGRSPSVEEIQDLVEKAIMAHGAFEVAKEYITYRYTRSLLRQSNTTDDRILSLIECNNEEVKQENANKNPTINAVQRDYMAGEVSKDITSRILLPKEVVDAHEAGIIHFHDADYYAQHMHNCDLVNLEDMLQNGTVISGTLIEKPHSFSTACNIATQIIAQVASNQYGGQSISLTHLAPFVQVSREKIRKTVEREMAAFGVAPAEETISKVVEDRLREEVRRGVQTIQYQVVTLMTTNGQAPFITVFMYLNEAKSEQEKKDLAMIIEETLRQRYEGVKNEKGVWITPAFPKLIYVLEEDNVREGTPYWYLTRLAAQCTAKRMVPDYISEKKMREYKLSKGETPGHGDVYTCMGCRSFLTPDRSGNGWDNVARAGNYEPGKPKYYGRFNQGVVTINLVDVALSSGRDMTKFWEVFEDRLELCHRALRCRHERLKGTLSDAAPILWQYGALARLPKGEPINKLLYGGYSTISLGYAGLYECVKYMTGKSHTDDEAKPFALSVMQKMNDKCLQWKTAENIDYSLYGTPLESTTYKFAKCLQKRFGLIPGITDKSYITNSYHVHVTEPIDAFTKLRFEAEFQQLSPGGAISYVEVPNMQNNIDAVLEVMQFIYDNIMYAELNTKSDYCQVCGYDGEIEIKEDDGKLVWVCPQCGNTDQNKMNVARRTCGYIGTQFWNQGRTQEIKDRVLHL

SEQ ID NO: 1052 - protein, 760 aa, unidentified
  REGION 1..760: note = Description of Unknown:uncultivated organism sequence
  REGION 1..760: note = Category: MG60 effectors
  REGION 1..760: note = Description: MG60-267 effector
MEEMEMNVKMNVIKRNGKEVPFDITKIVNAIGKANNEVDHVHQMNDYQIRAVADNIAHKIAGYSHAANVEDIQDMVETGIMEMRGYEVAQKYVRYRYKREISRKSNTTDDGILSLIDLSNEEVKQENSNKNPVINSTQRDYMAGEVSKDLTKRLLLPEEIVKAHEAGIIHFHDADYYAQREHNCDLINLEDMLQNGTVISQTMIEKPHSFFTACNVTTQIVAQVASNQYGGQSFTLAHLAPFVDISRQKIKKEVIAERKETGESMDESIIEKIVERRLKEEIKSGIQTIQYQLITLMTCNGQAPFVTMFMYLDEVPDGRTRKDLAMIIEEVLRQRMQGVKNEKGIWITPAFPKLIYVLDEDNIHDDSPYYYLTRLAAECTAKRMVPDYISAKIMKNLKHGDVYPCMGCRSFLTPDTEGLGENGKHKYYGRFNQGVVTINLVDVACSSGGDMDKFWEILEDRLELCHRALRCRHERLLGTVSDVAPILWQYGAIARLKKGETIDKLLFNNYSTISLGYAGLYEMCVRMLGVSHTTDEGRKFALAVMQKLNDKCSEWRAAENISYSVYGTPMESTTYKFAKCLQKRFGIIPGVTDKNYITNSYHVHVSEHIDAFHKLKFESDFQRLSPGGAISYIEVPNMQTNIPAVLTVMKYIYENIMYAELNTKSDYCMACGYDGEIRIIEDETGKLIWECPNCGNRDQHKMSVARRTCGYIGTQFWNQGRTQEIKGSPPFVSMQKLRIPRKLRNPYAQVEVVISSPRYG

SEQ ID NO: 1053 - protein, 768 aa, unidentified
  REGION 1..768: note = Description of Unknown:uncultivated organism sequence
  REGION 1..768: note = Category: MG60 effectors
  REGION 1..768: note = Description: MG60-268 effector
MFCSCKKNLSVVIYIYDATKTYDCAKKLIVYKSIIKGAEVMKIIKRNGAEETFDRQKIKDAIAKANNETDGTPELTDRQIDYISLVIEDHCNEMNRALSVEEIQELVETHIILQGAPETAKRYIRYRFTRNLARASNTTDNQILSLIECNNEEVKQENSNKNPTVNSVQRDYMAGEVSKDLTKRILLPEDIVKAHEEGLIHFHDADYFAQHMHNCDLVNLEDMLQNGTVISGTMIEKPHSFSTACNIATQIIAQVASNQYGGQSISLAHLAPFVQISREKITRQVRAEMEEFGIDADDEQVKSLVEKRVRDEIKRGVQTIQYQVVTLLTTNGQAPFVTVFMYLNEAKNEQEKKDLAIIIEEVLKQRIKGTKNEVGVWVTPAFPKLIYVLEEDNITEDSRFWYLTKLAAECTAKRMVPDYISEKIMLKLKIDKNGNGNCYTCMGCRSFLTPYVDENGKPKYYGRFNQGVVTINLVDVACTAARDGNKSEEKFWQVLDERLELCHRALQCRHERLEGTLSDAAPILWQYGALARLKKGEPIDKLLHGGYSTLSLGYAGLWECVYEITGKKLTEKEGEEFGLRVMQRLNDACAEWKAAENIDYSIYGTPLESTTYKFAKCLQNRFGIIKGVTDRNYITNSYHIHVTEKIDAFSKLELESKFQKLSPGGDISYVEVPNMQQNIPAVLEVMKFIYNNIMYAELNTKSDYCQVCGYDGEIQIVEEDGKLVWRCPNCGNEDQSKMNVARRTCGYIGSQFWNQGRTQEIKERVLHL

SEQ ID NO: 1054 - protein, 941 aa, unidentified
  REGION 1..941: note = Description of Unknown:uncultivated organism sequence
  REGION 1..941: note = Category: MG60 effectors
  REGION 1..941: note = Description: MG60-269 effector
MDFLSLSSEYQSYVDYIDNSLIIMKYFITFYQSLQNSFKIFSKNTRESLNTLFSNLIQFDNRSTFSKKFFEFYRLFEKYLTKLDLLSEKILTQIVEPTLDIQKHFKLKTDIEIKNLFEIIKSTINQKKKLEIIKQNYFDYSKAAEAQEKSLVEVMDDENQQNINYQNNILTKLRMESAEECEKYRNMVNETNKLYNDNNKKYFPIISSLKDCEEQRLYFIYSNFQKFISILTEQKNSLNFVVSNYENEDVFKVKIDDDMIMYQEKFSYTFKQNERFKKEDFILYDIYRRNIESIINSSNKLIKQNNIPVPNIDINFVSNENNIPIKLEQNDDISFQSLFNSNSYNINRKIFVAFENKLKTDGNFARNVIDKMLDDIFTKVLYKKYENKNQFDKLTDVLIDISMNSSIQNELFDVNYGILFIAEKTFYYDRITNSKYYLCKALSEKYQNFRNKVYWKRMLNYKKNSLIESLVEKEAMKKIKKDKIPTQQSSTFSFLWRSNSVDNNCINLISNNEKKRLTEKVKKLELFDILRDFLIHFGNFNLDLTISNDIIIEIASEDNIYSEQISFFVTFMNSNMYCVKNKKLKKYKKKENKKDIIVNKKILTSNNTKLRHILISLNSSIKYLQLKDYINLNLLNKTFYPISQKIIYKKFFLKQEQILEQEKHFKMWFNILHYDPNEIPYEKLLQDALDYNSPIIDLIQADVIRTFFDEDQENYRKKLQNILIAISYTYPKISYVQGMNYIVSFFLKITNNEKKSYDLMSCLLGKTDYGKSLLNEFEMIKKCFYVFERLIFIYLPELSYVLKKNNVSSSYYISPWFITLFTNSLSGNNTKIILRIIDMLILEGYNCIIRIGLVLLKHYQENLIKMKFEELLHFLINELKEKYEFFHNNNYEKFIELYNDMKIPKGLINNIENEYEIEKKVLKIREKDERIEKEKENEITI

SEQ ID NO: 1055 - protein, 1180 aa, unidentified
  REGION 1..1180: note = Description of Unknown:uncultivated organism sequence
  REGION 1..1180: note = Category: MG60 effectors
  REGION 1..1180: note = Description: MG60-270 effector
MAKIIQTLFIYISTREKEVEIMVIIKRNGKESLFEKSKIRNAIRKANAEAEAENQLSEGQIYLIADEIEEIAEKRSRALNVEEIQDLVEDKIMNCGKYEVARKYIKYRYNRELNRRSNTTDEKILSLIECENEEAKQENANKNPTIASVQRDYMAGEVSKDLTKRILLPQEIVDAHEKGIIHFHDADYYSQHIHNCDLINLEDMLQNGTVISGTLIEKPHSFSTACNIATQIIAQVASSQYGGQSITLSHLAPFVDVSRQKIMQKTKKAFDEAEMTYTEDQLKAVVENKVKEEIEKGVQIIQYQVVTLMTTNGQAPFITVFMYLNEVKDEQTKHDLAMIIEEVLKQRIQGVKNEKGVWITPAFPKLIYALEEDNIKEGSKYWYLTELAAKCTAKRMVPDYISEKKMLELKGDAYPCMGCVDGKETVKVKGVFSENPNEETLEIKLPIEKLWKEMSKKYQVKLQPNGKDYFIETPDLLIYDQKKGFVKNYGIIKNHNSDWLIITFSNGAKIKCTEDHPFETEDGRIIKAKDLTDADVIAHETDKLCYPKNIERIPAGVSDGFSYDVTTESEHFTVSGIYSHNCRSFLTPDRFTDNGAGNIANAKNYKPNEHKYYGRFNQGVVTINLPDAALSAKGDMNEFWKILDERLELCHKALKCRHERLLGTPTSIAPILWQYGALARLGKDEKIDKLLFGGYSTISLGYAGLWECVYGLIKKKITEPEGKELGLKIMQTLNDYCSKWKVDENIDYSLYGTPLESTTYKFAKCLQDRFGVVEGVSDKNYITNSYHIKVTEKVNAFEKLKFESEFQALSPGGAISYIEVPDMKDNIAAVLEVIKFIYDNIMYAELNTKSDYCQECGYDGEIQIVQEGNKLVWRCPNCGNEDQSKLNIARRTCGKQSSEIATIKNDRTSGKPRLYNNFEDYKAGNPEPSSQSNKNSKNSNYKVCDICGRHEKHIIGYYGKKLCNKHYNQIKKYGHVLENSPRTIYDKNEIKVEGEIAYIELYDKLYNVVALAMIDAEDINKVKYSKWRLNCNGYVISTNKFDGKTTFLHRRILNNTNQFVDHINGNVLDNRKQNLRLVTKSQNQMNVNYKGVSKTKNDKHYAHIKIKGKAINLGVYVDEEDALYARYFAEKLLFKEYRFPKEEPFVLTNRKNEIENYVRNRLEKYKDVITNDAENTKNAA

SEQ ID NO: 1056 - protein, 1239 aa, unidentified
  REGION 1..1239: note = Description of Unknown:uncultivated organism sequence
  REGION 1..1239: note = Category: MG60 effectors
  REGION 1..1239: note = Description: MG60-271 effector
MLKNQILKLTELTNKKELDKESDINSFLNKLPTIQKMFIVQNLLTELISIKNPFLETKNKMIEKIENNCYKYYKYTIQIKQIYDYCALKKPENSINYVLLKGKEAEIVLHEFEESRKNFITNFFFELRNNNILMMKIIKEIDINYYEQLGYFLTQFLYHNTTNTNFSQDELNLMLYLVMEDTVNNKFPDELTFEFLFNLNTEKEKMFLYYFVKNLTKKVEIRNYLTNIFHDLILNLESKNQKLSMNTTTLIREVLNLNNQNNQNNNDIVSDEKDDEYSRKTTMNAHDLLKNFKSLFNNADILNPEKKNTLRQTMISTKKKIEKVETKDDDLNLKKFKSEFDNCTINVETLRIKTFFEETNYTKNELYQRLNDLCNKNENRTSLENNFMEYLLCLKMESLKNETKKYTELYSNQMIYESFMESKKDNIKTEDEGNNIDEKYINNFMTITEFIQNLFEKILQSIDSLPYTIKCLLFFLDKLISKKYDIKLSSYQSSIIKLKFFFDGFILPILQNPFYNGCISDGVISDTTVENLKIISVIVEKFTSNNLFKIVNENIDPYYIIFNKFIVEHMQDFLKIHIAIDESIKNRFEPPKVLMELFESKDLNERNINYDFFKYNENESIQYQSVCFSYFDLMMFINTTEKENIKSYLESNGDIKSDYQLLLKYKIKNFEEGCKNNLSGGKKEFFYITNLKYKESFLKKIKSLTEEKEEFLDNYYKNQKSNSDMNENILLLKQCLIEVMIYLNKINKEDISSFIKRKNKLVLHHNSQINKYLLNKKYIGYKNIFEEKNNLSNINHIIKQKNFFSKLCLSQDAMEDGDFLEDIFPRIITKLKIELGHLIDYAKYERIIFCITFLQINIRNLPQIYRSNNFSKLFVEIINDVQNMIKGLQDNILNQYLFKIRGGDKLNLILSKYSQEIKSMEKYYTINYLFNKLTPHIPSKNKDEINKEKTIKQVKNTPSKKISSLSKSQIYFQPQNLIDLIPKKSILNFINEFHNYPASLKGIDDDVFSIEKKDEIPKLLHNYFNEIINLLQEEKMVKKYNQDDLVSICYDFENYILLKMHDKLLPDFPSKCDEFLYKKCLRLDFITPENMNADKKMINEDLLLTVTEYINKIDIKYTPIDKINMFGKAFQILQDSMSFSSGKSDVGTDDVLPLLHYVMIKAKPKMIYTNYVFCKYYINQNLLKKQTGFLLAQIGMFVKIICNMKFSNLKGVTEEQFGVDEEMPEDLKDIENKFEKLNP

SEQ ID NO: 1057 - protein, 755 aa, unidentified
  REGION 1..755: note = Description of Unknown:uncultivated organism sequence
  REGION 1..755: note = Category: MG60 effectors
  REGION 1..755: note = Description: MG60-272 effector
MHELIEKREPKEEKPMKIIKRNGAEVVFDIDKIIMAVTKANDAVDEKVRMTPLQIERISQSVQIACEEMGRSPSVEEIQDLVEKAIMAHGAFEVAKEYITYRYTRSLLRQSNTTDDRILSLIECNNEEVKQENANKNPTINAVQRDYMAGEVSKDITSRILLPKEVVDAHEAGIIHFHDADYYAQHMHNCDLVNLEDMLQNGTVISGTLIEKPHSFSTACNIATQIIAQVASNQYGGQSISLTHLAPFVQVSREKIRKTVEREMAAFGVAPADETISKVVEDRLREEVRRGVQTIQYQVVTLMTTNGQAPFITVFMYLNEAKSEQEKKDLAMIIEETLRQRYEGVKNEKGVWITPAFPKLIYVLEEDNVREGTPYWYLTRLAAQCTAKRMVPDYISEKKMREYKLSKGETPGHGDVYTCMGCRSFLTPDRSGNGWDNVARAGNYEPGKPKYYGRFNQGVVTINLVDVALSSGRDMTKFWEVFEDRLELCHRALRCRHERLKGTLSDAAPILWQYGALARLPKGEPIDKLLYGGYSTISLGYAGLYECVKYMTGKSHTDDEAKPFALSVMQKMNDKCLQWKTAENIDYSLYGTPLESTTYKFAKCLQKRFGLIPGITDKSYITNSYHVHVTEPIDAFTKLRFEAEFQQLSPGGAISYVEVPNMQNNIDAVLEVMQFIYDNIMYAELNTKSDYCQVCGYDGEIEIKEDDGKLIWVCPQCGNTDQNKMNVARRTCGYIGTQFWNQGRTQEIKDRVLHL

SEQ ID NO: 1058 - protein, 924 aa, unidentified
  REGION 1..924: note = Description of Unknown:uncultivated organism sequence
  REGION 1..924: note = Category: MG60 effectors
  REGION 1..924: note = Description: MG60-273 effector
MNLILYVNIVFIFYLTYSEELNKINFNKISFEYKYKANKRYLLNNKNQKLNNIVNIYNPYEKIAYISNTKNENGDLFITTNSENKNDNTRLVYGLKKDFTNYFRDNEGSYRIVMTNLESDNIYPSITSLTINKEEYLISFSHDGVFESLDYNKGHAYGRYSYTAIGYTSNVNKNTFIKLKYYNNSNYVLNSHIAKDGKSNFFFLIKINFRNGNLTKNRPDPVNETRVEKGFIGALATCFEIKEYIECLYTNSERYYKASIFDVLNFGNLYSKIIDENIVSEPQLFSKCIYFKDSIGAFIYYLSQNIQPILTFLKLTTPSPLSDDFNLDNYLGPITLNSNSKFDLGYGYASNDLIKLNDNNIIFTSVSNNYENIIIILIKLLKEDKNILINYYNIELNNEYNIKIYKDITTFTINNLFGIGMTNYNYSLSSSKTYSNYFIIGINSSNNISISEEIDIFDEDNIYGFKIKEININIDNNIFGYYFSGIQIINILNENLTDDNLGFYLYSNNSDKKIELNESVLYDDIINFKVIEDLGVKKDLYSIAFLPIISEANSTDYISIPDSIELFPENYANLEYFYQPDIFYGKKAFISFGVKNCYKTCQTCSYYGNHINHHCESCSTKYPYNTFNNCYNLTFKETNILTNEIISTQVNIIDTQNISSEIQEISRETSKNHDKDCDIKALFKKQCLYDEKYSKTNKDLIKDIKQSFKEHSLDDILEDLIKINEDFIIEKENVLYQITTSYNQNNKIYYNLSSIKLGKCEQILKANNNLTENESLIIFKVEYYIEGYIIPLIDYEVYNPRTKNKINLNLCQSEKIDIIHHITIDENELFKYDPESDYYNDICYAYTTTDETDIILKDRREEFLKNNLTLCENNCQFKGYDPKFHIVNCKCDIKTDLQCIFDSNFDIKRLTYNFLDIKNIINIL

SEQ ID NO: 1059 - protein, 920 aa, unidentified
  REGION 1..920: note = Description of Unknown:uncultivated organism sequence
  REGION 1..920: note = Category: MG60 effectors
  REGION 1..920: note = Description: MG60-274 effector
MASKFHWNASYSIYDKYFQCGKFIDLDKFDCPCETFGYNAFEKPPLTTEEKQLMHRFTFDAEQKHFTDMQIFAWQTKQRFWELYEELKFPFPENATITDNLIYPEKFDYQMERELQKRFCALKCYYNPRECYHNENHIGKLDKLMKKDFHQQFNPRFEKQFERNSVPKLKWKSKTSYPKEGLNELVDNDLGIWSKLFYDENGIAINFSLFTKENCEYGENVKYLGRPYCHFETKKFLDVIIALIEVTKDSFDNAQLEANKVYSESIECKGPIRRPILNQMPWGPVSFNEENPPCKGYMCNFVKRGNNFWNLEQYKIHKLHCCRYFSKHHYWMFTHSDKFVCNSGKIGQLYGPAMTRDACIVYPCNQTYCNQTCTCKFCTRRGECSSDLHKKHLARPTFKGNNLVMEDLSLECLVQKSSQCQEHWVTHPDKFKRKEDIEVEKNLYFHNGKLVKTPRDIAVQIIKFSGIKKSCDNCKEDVEDHFKEHMFPHLQCKLCLFMLRDATFWKMICYICNKNMVNFSAEQIKRHKRYHEKGFFGCQFCKYKTQKKFNMTRHLEEVHNHYKSSDEDISDCDESEGVSAGDNELSIHDSESGTEWDSNSDNEYGDDSDTDEYDDSLFKQDLFDPFVVKVKRKTRLFPEKEYVCTEAQCDKKFFYERNLHRHINSEHGENNEYSCGQCKKIFNRKDTLARHQFEVHGNLGDGTYRFPGTTSINNNFSCEQCGVKFKRKPYLKRHINEVHQLQDRQYDCEKCGKKFTRQEKMKRHIHDVHELQDGQYVCEECGKKFKRQQDMKRHIHEVHELQDGQYVCEECGKKFKRQQDMKRHMHEVHELHDRQYVCEECGQKFERQENMKTHIHEVHEKEDPQYPCEKCDKKFKRKYHLNRHIHDKHDSSGWEYICDLCGKSFKSKSNLKEHLHTHKM

SEQ ID NO: 1060 - protein, 768 aa, unidentified
  REGION 1..768: note = Description of Unknown:uncultivated organism sequence
  REGION 1..768: note = Category: MG60 effectors
  REGION 1..768: note = Description: MG60-275 effector
MFCSCKKNLCVVIYIYDATKTYDCAKKLIVYKSIIKGAEVMKIIKRNGAEETFDRQKIKDAIAKANNETDGTPELTDRQIDYISLVIEDHCNEMNRALSVEEIQELVETHIILQGAPETAKRYIRYRFTRNLARASNTTDNQILSLIECNNEEVKQENSNKNPTVNSVQRDYMAGEVSKDLTKRILLPEDIVKAHEEGLIHFHDADYFAQHMHNCDLVNLEDMLQNGTVISGTMIEKPHSFSTACNIATQIIAQVASNQYGGQSISLAHLAPFVQISREKITRQVRAEMEEFGIDADDEQVKSLVEKRVRDEIKRGVQTIQYQVVTLLTTNGQAPFVTVFMYLNEAKNEQEKKDLAIIIEEVLKQRIKGTKNEVGVWVTPAFPKLIYVLEEDNITEDSRFWYLTKLAAECTAKRMVPDYISEKIMLKLKIDKNGNGNCYTCMGCRSFLTPYVDENGKPKYYGRFNQGVVTINLVDVACTAARDGNKSEEKFWQVLDERLELCHRALQCRHERLEGTLSDAAPILWQYGALARLKKGEPIDKLLHGGYSTLSLGYAGLWECVYEIKGKKLTEKEGEEFGLRVMQRLNDACAEWKAAENIDYSIYGTPLESTTYKFAKCLQNRFGIIKGVTDRNYITNSYHIHVTEKIDAFSKLELESKFQKLSPGGAISYVEVPNMQQNIPAVLEVMKFIYNNIIYAELNTKSDYCQVCGYDGEIQIVEEDGKLVWRCPNCGNEDQSKMNVARRTCGYIGSQFWNQGRTQEIKERVLHL

SEQ ID NO: 1061 - protein, 755 aa, unidentified
  REGION 1..755: note = Description of Unknown:uncultivated organism sequence
  REGION 1..755: note = Category: MG60 effectors
  REGION 1..755: note = Description: MG60-276 effector
MHELIEKREPKEEKPMKIIKRNGAEVVFDIDKIIMAVTKANDAVDEKVRMTPLQIERISQSVQIACEEMGRSPSVEEIQDLVEKAIMAHGAFEVAKEYITYRYTRSLLRQSNTTDDRILSLIECNNEEVKQENANKNPTINAVQRDYMAGEVSKDITSRILLPKEVVDAHEAGIIHFHDADYYAQHMHNCDLVNLEDMLQNGTVISGTLIEKPHSFSTACNIATQIIAQVASNQYGGQSISLTHLAPFVQVSREKIRKTVEREMAAFGVAPAEETISKVVEDRLREEVRRGVQTIQYQVVTLMTTNGQAPFITVFMYLNEAKSEQEKKDLAMIIEETLRQRYEGVKNEKGVWITPAFPKLIYVLEEDNVREGTPYWYLTRLAAQCTAKRMVPDYISEKKMREYKLSKGETPGNGDVYTCMGCRSFLTPDRSGNGWDNVARAGNYEPGKPKYYGRFNQGVVTINLVDVALSSGRDMTKFWEVFEDRLELCHRALRCRHERLKGTLSDAAPILWQYGALARLPKGEPIDKLLYGGYSTISLGYAGLYECVKYMTGKSHTDDEAKPFALSVMQKMNDKCLQWKTAENIDYSLYGTPLESTTYKFAKCLQKRFGLIPGITDKSYITNSYHVHVTEPIDAFTKLRFEAEFQQLSPGGAISYVEVPNMQNNIDAVLEVMQFIYDNIMYAELNTKSDYCQVCGYDGEIEIKEDDGKLIWVCPQCGNTDQNKMNVARRTCGYIGTQFWNQGRTQEIKDRVLHL

SEQ ID NO: 1062 - protein, 755 aa, unidentified
  REGION 1..755: note = Description of Unknown:uncultivated organism sequence
  REGION 1..755: note = Category: MG60 effectors
  REGION 1..755: note = Description: MG60-277 effector
MHELIEKREPKEEKPMKIIKRNGAEVVFDIDKIIMAVTKANDAVDEKVRMTPLQIERISQSVQIACEEMGRSPSVEEIQDLVEKAIMAHGAFEVAKEYITYRYTRSLLRQSNTTDDRILSLIECNNEEVKQENANKNPTINAVQRDYMAGEVSKDITSRILLPKEVVDAHEAGIIHFHDADYYAQHMHNCDLVNLEDMLQNGTVISGTLIEKPHSFSTACNIATQIIAQVASNQYGGQSISLTHLAPFVQVSREKIRKTVEREMAAFGVAPAEETISKVVEDRLREEVRRGVQTIQYQVVTLMTTNGQAPFITVFMYLNEAKSEQEKKDLAMIIEETLRQRYEGVKNEKGVWITPAFPKLIYVLEEDNVREGTPYWYLTRLAAQCTAKRMVPDYISEKKMREYKLSKGETPGHGDVYTCMGCRSFLTPDRSGNGWDNVARAGNYEPGKPKYYGRFNQGVVTINLVDVALSSGRDMTKFWEVFEDRLELCHRALRCRHERLKGTLSDAAPILWQYGALARLKKGEPIDKLLYGGYSTISLGYAGLYECVKYMTGKSHTDDEAKPFALSVMQKMNDKCLQWKTAENIDYSLYGTPLESTTYKFAKCLQKRFGLVPGITDKSYITNSYHVHVTEPIDAFTKLRFEAEFQQLSPGGAISYVEVPNMQNNIDAVLEVMQFIYDNIMYAELNTKSDYCQVCGYDGEIEIKEDDGKLIWVCPQCGNTDQNKMNVARRTCGYIGTQFWNQGRTQEIKDRVLHL

SEQ ID NO: 1063 - protein, 812 aa, unidentified
  REGION 1..812: note = Description of Unknown:uncultivated organism sequence
  REGION 1..812: note = Category: MG60 effectors
  REGION 1..812: note = Description: MG60-278 effector
MDDIGEKLMAENAESDKEELGLICPKCGKKIIDDGTAYRCEAGDFKCGKEILGTEISRDELQKAIAGQSDELGFRSSKTGKTFLARLVLSEAKDSLDFRFSDRNGEDSGLKCPKCGGKIVDDGKAYKCESGDFKCWKIIRGHEITREELQKIFAGQGDKLEFTSKKTGKPFTSRLVLNEDKDGIDFEFAVRKKDDTGLKCPKCHGKIIDAGPIYRCEVGDFKCDKEILGTEITRDELQKVIDEGSSDELDFTDQDTGKPYTARLKLSSDKKSVEVPKPEDTGEKCPNCRNKIMETDKAYWCESCNFTCDKEILGTRISHDDLHKIVEEGNSDELDFTDHDSGKSYKAHLNLSSDKQTVDVPKPEDTGEKCPNCRNKIMETDKAYWCESCNFTCDKEILGTRISHDQLHKIVEEGRSDELDFADHDSGKSYKARLNLSEDNKTVVVPKPKDTGIKCPKCTMKIMETDRAYWCESEACDFTCDKEILDTKITRDELKKVVLNGKSGKLDFTDKDTKKPYKGRLVLNKKKNGLHVDKLDYMKVIFAVISFVVATISFIGIFLPDLFNMNKGSITRFETTLSDKKSAQKLEEFLDANVGKIVELTIHYKQNLVYGLVPWAKYSEDSYYGVKYDPAKDGSWWWDSASAAHDVTFSHFGDNNRFYVKSFLYDKNLFEVEYRDFGGIGYCDAITRYAYQLMIPYVKNDKLAFEWQRDREKSKDYVALPSPYWVLKGTFVVNVKKGEELTDNITTLYDEFQQRKLRSDYGKDYVVPEIAKILAVDPACGERTGNGDYSFSGKSFELEPLTQQQLLQMAYN

SEQ ID NO: 1064 - protein, 728 aa, unidentified
  REGION 1..728: note = Description of Unknown:uncultivated organism sequence
  REGION 1..728: note = Category: MG60 effectors
  REGION 1..728: note = Description: MG60-279 effector
MDAVHTNVIKRNGEEVNFDLDKIVNAINAANKEVDRLHQLNDYQVQAIADNIAKQIEIMTHAIHVEDIQDMVETGIMEMRGYEVAQKYVRYRYKRELARKSNTTDNGILALIDHMNEEVNQENSNKNPVINSTQRDYMAGEVSKDLTKRMLLPKEIVEAHEQGIIHFHDSDYFAQREHNCDLVNLEDMLQNGTVISETMIEKPHSFFTACNVTTQIVAQVASNQYGGQSFTLSHIAPFVDVSRKKIREQVIEERKMCGEALDEEVISKITESRLRAEVKSGIQTIQYQLITLMTCNGQAPFVTMFMYLDEVPEGQTRDDLAMIIEEVLQQRIQGVKNEKGIWITPAFPKLIYVLDKDNITEDSKYWYLTELAAKCTAKRMVPDYISAKVMRELKNGDVYPCMGCRSFPTSEDSQRNPDGTRKYYGRFNQGVVTINLVDVACSAEGHIDRFWEILESRLELCHRALRCRHERLLGTVSDVAPILWQHGALARLKKGETIDKLLFNGYSTISLGYAGLCEMCVRMTGKTHTSPEGKKLALEVMQKLNDKCKEWKEAENISYSVYGTPMESTTYKFAKCLQKRFGIIKGVTDKNYITNSYHIHVTEPVNAFDKLKFESEFQKLSPGGAISYVEVPNLQDNVEAVISVMKFIYDNILYAELNTKSDYCEICGYDGEIKIVTDENGKLIWECPNCGNRDQNNLFVARRTCGYIGTQFWNQGRTQEIKDRVLHL

SEQ ID NO: 1065 - protein, 728 aa, unidentified
  REGION 1..728: note = Description of Unknown:uncultivated organism sequence
  REGION 1..728: note = Category: MG60 effectors
  REGION 1..728: note = Description: MG60-280 effector
MDAVHTNVIKRNGEEVCFNLDKIVNAITAANKEVDRLHQLNDYQVQAIADNIAKQIEIMTHAIHVEDIQDMVETGIMEMRGYEVAQKYVRYRYKRELARKSNTTDNGILALIDHLNEEVNQENSNKNPVINSTQRDYMAGEVSKDLTKRMLLPEEIVEAHEQGIIHFHDSDYFAQREHNCDLVNLEDMLQNGTVISETMIEKPHSFFTACNVTTQIVAQVASNQYGGQSFTLSHIAPFVDVSRKKIREQVIEERKMCGEALDEEVISKITESRLRAEVKSGIQTIQYQLITLMTCNGQAPFVTMFMYLDEVPEGQTRDDLAMIIEEVLQQRIQGVKNEKGIWITPAFPKLIYVLDKDNITEDSKYWYLTELAAKCTAKRMVPDYISAKVMRELKNGDVYPCMGCRSFPTSEDSQRNPDGTRKYYGRFNQGVVTINLVDVACSAEGHMDRFWEILESRLELCHRALRCRHERLLGTVSDVAPILWQHGALARLKKGETIDKLLFNGYSTISLGYAGLCEMCVRMTGKTHTSPEGKKLALEVMQKLNDKCKEWKEAENISYSVYGTPMESTTYKFAKCLQKRFGIIKGVTDKNYITNSYHIHVTEPVNAFDKLKFESEFQKLSPGGAISYVEVPNLQDNVEAVISVMKFIYDNILYAELNTKSDYCEICGYDGEIKIVTDENGKLVWECPNCGNRDQNNLFVARRTCGYIGTQFWNQGRTQEIKDRVLHL

SEQ ID NO: 1066 - protein, 728 aa, unidentified
  REGION 1..728: note = Description of Unknown:uncultivated organism sequence
  REGION 1..728: note = Category: MG60 effectors
  REGION 1..728: note = Description: MG60-281 effector
MDAVHTNVIKRNGEEVNFDLDKIVNAINAANKEVDRLHQLNDYQVQAIADNIAKQIEIMTHAIHVEDIQDMVETGIMEMRGYEVAQKYVRYRYKRELARKSNTTDNGILALIDHMNEEVNQENSNKNPVINSTQRDYMAGEVSKDLTKRMLLPKEIVEAHEQGIIHFHDSDYFAQREHNCDLVNLEDMLQNGTVISETMIEKPHSFFTACNVTTQIVAQVASNQYGGQSFTLSHIAPFVDVSRKKIREQVIEERKMCGEALDEEVISKITESRLRAEVKSGIQTIQYQLITLMTCNGQAPFVTMFMYLDEVPEGQTRDDLAMIIEEVLQQRIQGVKNEKGIWITPAFPKLIYVLDKDNITEDSKYWYLTELAAKCTAKRMVPDYISAKVMRELKNGDVYPCMGCRSFPTSEDSQRNPDGTRKYYGRFNQGVVTINLVDVACSAEGHMDRFWEILESRLELCHRALRCRHERLLGTVSDVAPILWQHGALARLKKGETIDKLLFNGYSTISLGYAGLCEMCVRMTGKTHTSPEGKKLALEVMQKLNDKCKEWKEAENISYSVYGTPMESTTYKFAKCLQKRFGIIKGVTDKNYITNSYHIHVTEPVNAFDKLKFESEFQKLSPGGAISYVEVPNLQDNVEAVISVMKFIYDNILYAELNTKSDYCEICGYDGEIKIVTDENGKLIWECPNCGNRDQNNLFVARRTCGYIGTQFWNQGRTQEIKDRVLHL

SEQ ID NO: 1067 - protein, 728 aa, unidentified
  REGION 1..728: note = Description of Unknown:uncultivated organism sequence
  REGION 1..728: note = Category: MG60 effectors
  REGION 1..728: note = Description: MG60-282 effector
MDAVHTNVIKRNGEEVCFNLDKIVNAITAANKEVDRLHQLNDYQVQAIADNIAKQIEIMTHAIHVEDIQDMVETGIMEMRGYEVAQKYVRYRYKRELARKSNTTDNGILALIDHLNEEVNQENSNKNPVINSTQRDYMAGEVSKDLTKRMLLPEEIVEAHEQGIIHFHDSDYFAQREHNCDLVNLEDMLQNGTVISETMIEKPHSFFTACNVTTQIVAQVASNQYGGQSFTLSHIAPFVDVSRKKIREQVIEERKMCGEALDEEVISKITESRLRAEVKSGIQTIQYQLITLMTCNGQAPFVTMFMYLDEVPEGQTRDDLAMIIEEVLQQRIQGVKNEKGIWITPAFPKLIYVLDKDNITEDSKYWYLTELAAKCTAKRMVPDYISAKVMRELKNGDVYPCMGCRSFPTSEDSQRNPDGTRKYYGRFNQGVVTINLVDVACSAEGHIDRFWEILESRLELCHRALRCRHERLLGTVSDVAPILWQHGALARLKKGETIDKLLFNGYSTISLGYAGLCEMCVRMTGKTHTSPEGKKLALEVMQKLNDKCKEWKEAENISYSVYGTPMESTTYKFAKCLQKRFGIIKGVTDKNYITNSYHIHVTEPVNAFDKLKFESEFQKLSPGGAISYVEVPNLQDNVEAVISVMKFIYDNILYAELNTKSDYCEICGYDGEIKIVTDENGKLVWECPNCGNRDQNNLFVARRTCGYIGTQFWNQGRTQEIKDRVLHL

SEQ ID NO: 1068 - protein, 725 aa, unidentified
  REGION 1..725: note = Description of Unknown:uncultivated organism sequence
  REGION 1..725: note = Category: MG60 effectors
  REGION 1..725: note = Description: MG60-283 effector
MKVIKRSGVETKFDVNKIILAISKANQSTEPEHRISDEEIRRISENIAAQCKKLRKSMNVEEIQDLVENELMSEGTHELAKNYITYRYSRALVRKANTTDAQIMSLIECNNEEVKQENSNKNPTVNSVQRDYMAGEVSKDITKRFLLPEDVVEAHEEGIIHFHDADYFAQHMHNCDLVNLEDMLQNGTVISGTLIEKPKSFSTACNIATQIIAQVASSQYGGQSISLSHLAPFVQVSRDRITKEVQEESRLTGLELSEEQIGIIVERRLRDEIKKGVQTIQYQVVTLMTTNGQAPFVTVFMYLNEVKDPKVREDLALIIEECLNQRYEGVKNEQGVWITPAFPKLIYVLEEDNIREDSKYWYLTKLAAKVTAKRMVPDYISEKKMLEYKIDKNGNGNCYPCMGCRSFLTPYVDENGKPKYYGRFNQGVVTINLVDIACSSNRDHDKFWKIFDDRMNLCHRALQARHNRLKGTLSDVAPILWQYGAIARLKKGEKIDKLLYGGYSTISLGYAGLWETVYYMTGKKMTEPEGTEFGLKIMEKLNEYTGKWKKAENIDYSLYGTPLESTTYKFARCLKKRFGIIEGVTDKNYITNSYHIHVTEPINAFEKLIFESRFQKLSPGGAISYVEVPNMQNNIEAVLEVIKCIYENIMYAELNTKSDYCQCCGYDGEILIVKDEDGKLVWECPRCGNRDQSKLNVARRTCGYIGTQFWNQGRTEEIKERVLHL

SEQ ID NO: 1069 - protein, 768 aa, unidentified
  REGION 1..768: note = Description of Unknown:uncultivated organism sequence
  REGION 1..768: note = Category: MG60 effectors
  REGION 1..768: note = Description: MG60-284 effector
MKIRSTNCIQRAKPGKVNKMNNIIKRSGKEVEFDKKKIENAIKKANAATETAAQMSEAEIVVVMDRILANLDLVPHAISVEEVQDEVEAQIAKIGAFKVAKNYITYRYTHELRREANTTDDKILSLLDLTNEEVKQENSNKNPVVNSVQRDYMAGETSKDLTRRILLPEDISKAHDDGLIHFHDTDYFAQKMFNCQLVDLEGMFNYGHRHGQEITTALSGHGISAPKSFSTAANIATQVIAQVASNQYGGQTITLTDFVGGRHADAINFVDVSRQKWIKKIAEENAAVGTEMTDEQIKKVAEIRLIDEIKSGIQLIQYQLITLQTTNGQAPFITVFMYLNEVYCDDAQKKEDLALLIKLMLEQRIKGVQDQKGNWITPAFPKLIYVLEDDNIEEGSKYYDLTVLAAKCTAKRMVPDYLSEKVMRQLKGDVYPPMGCRSFLTPDKEGMGDNGEHKYYGRFNQGVITINLVDIACSSKKNEDKFWEIFEDRMENLVHKGLRIRHERLLGTPSDVSPIHWQDGAVSRLQSGETIDKLLYNNYSTISVGYAGLAETVYYMKGLSHTSKEGREFGLKVMQFLNDKCAKWRAEENISYSVYGTPLESTTYKFAKCLQKRFGMIDNVTDKNYITNSYHVRVTEEINAFDKLTKEAAFQELSPGGAISYVEIPNLQNNIDAVLAIMKHIYNTIMYAELNSKSDLCECCGYDGEIQIVEDDNKKLIWKCPNCGNTDQTKMHVARRTCGYIGTQYWNQGRTQEIKERVMHVSNPEINL

SEQ ID NO: 1070 - protein, 720 aa, unidentified
  REGION 1..720: note = Description of Unknown:uncultivated organism sequence
  REGION 1..720: note = Category: MG60 effectors
  REGION 1..720: note = Description: MG60-285 effector
MKIIKRNGEEAVFDSRKIELAISKANLEAPMAEQMSAETIHNIAINIEKQCMSENHEMNVEDIQDIVEKEIMKAGAFDIAKKYITYRYQHELMRKANSTDKQIMSLLECQNEEVKQENSNKNSTVVSVQRDYMAGEVSKDITKRFLLDEDIVQAHNEGIIHFHDSDYFAQHMHNCDLVNLEDMLQNGTVISGTRIDTPHSFSTACNIATQIIAQVASSQYGGQSISLAHLAPFVDVSRKKISREMHRMEEETGVYYNEEQFNHIVKARLREEITRGVQTIQYQVVTLMTTNGQSPFVTVFMYLNEAKDEQTKADLALIIEEVLKQRYQGVKNEAGYWVTPAFPKLIYVLEEDNITEESKYFYLTELAAKCTARRMVPDYISEKKMKALKEGNCYPCMGCRSFLSVYHDENGKPKFYGRFNQGVVTLNLVDVACSSGGDYNKFWQILDERLKLCYRALMARHKRLLGTPSDVAPILWQNGALARLKKGEVIDKLLFGGYSTISLGYAGLCECVRYMTGKSHTDPEATPFALKVMKTLNDACEKWKERTNIGFSLYGTPMESTTYKFAKCLKRRFGEIEGVTDKNYITNSYHVHVTEPVDAFTKLTFESQFQELSPGGAVSYVEVPNMEGNIPAVIALLKHIYEKIMYAELNTKSDCCQKCGYTGEIRIVTDSDNKLVWQCPQCGNTDQSTMNVARRTCGYIGTQFWNQGRTQEIKERVLHL

SEQ ID NO: 1071 - protein, 723 aa, unidentified
  REGION 1..723: note = Description of Unknown:uncultivated organism sequence
  REGION 1..723: note = Category: MG60 effectors
  REGION 1..723: note = Description: MG60-286 effector
MRIIKRNGSEEDFNIEKIINAVKKANGSGEHKFLTDEQIEDVADYVEYKCNKIRRAVSVEEIQDMVEDQLMAKGAFELARRYVRYRYNRSLVRKANTTDNRILSLIECNNEEVKQENSNKNPTVNSVQRDYMAGEVSRDLTRRMLLPADIVEADKEGIIHFHDSDYFAQHMHNCDLVNLEDMLQNGTVISDTLIERPHSFSTACNIATQIIAQVASNQYGGQSISLAHLAPFVQVSREKIRRETLAEIEELGVHPTEEKINDIVEQRLRKEVNRGVQTIQYQVVTLLTTNGQAPFVTVFMYLNEAKNEQEKHDLAMIIEETLKQRHKGVKNEKGVWITPAFPKLIYVLEEDNITEDSKYWYLTELAAKCTAKRMVPDYISEKVMLQSKIDKNGEGHCFTCMGCRSFLTPYVDENGKPKYYGRFNQGVVTVNLIDIGLSAGKDLDKFWKIFDERMELCHRALQCRHERLTGTLSDAAPILWQYGALARLKKGEKIDKLLHGGYSTLSLGYAGLWECVYSLIGKKLTEKEGKELGLKIMQKLNDYCAKWKKEENIDYSIYGTPLESTTYKFAKCLQKRFGIIKGVTDKNYITNSYHVHVTENIDAFSKLKLESEFQALSPGGAISYVEVPNMQDNIPAVLQVIKFIYDNIMYAELNTKSDYCQVCGYDGEIKIVHDDGKLVWECPNCGNRDQDKMNVARRTCGYIGTQFWNQGRTQEIEERVLHL

SEQ ID NO: 1072 - protein, 755 aa, unidentified
  REGION 1..755: note = Description of Unknown:uncultivated organism sequence
  REGION 1..755: note = Category: MG60 effectors
  REGION 1..755: note = Description: MG60-287 effector
MSKYPETLIGDWLKDSGNWFLDEEMECVGRMSRALYPYKSMFSPIRVNGITLKNRLVMAPMGNISQAEETGRPNQSMIAYFEERAKGGVGLITSGLIPVSFGIDHTLTEPGGLTYFPKILGSRTFFSGWRDIAHNTHSAGAHFFIQLTAGLGRVGNPQCLVNQHKFPVSASLNPNYYLPAVPCLRISGRKLKKIVKNFGQAAADAKTATIDGVYLHGHEGYLLEQMSNTAFNRRKWGRYADWQAFGLDIVREIRKRTGPDYPIMYRINLSLALNATYGKRMQTVKTLKKFSNERTIEQTLDYMKNLVQAGVDMFDVDLGCYDNWWLPHPPTTMKPGVFLEVAKLVKDHFAENSIVSNKGLPVPIVAVGKLGYPDLAEKAIADEMCDMVMLGRPLLADPMWPRKAYAGQVQEIRPCIGCQEACINEFVEGGHPSCAVNPRTSHESTLPEKPLPAPIKKKVAVVGAGPAGFECAMAALDRGHEVHLIDKQEGVGGMVRLAAIPAFKRDVTNYLEWMERTVDQRVKDNPDFQLMLNTEATLYMLEDGKYDAIVCATGSREKTPGVEGLEKAVFARALLLDTSLLDGKEKIVVVGGGTVGCEVALMLAAEYGRKVTVLEMLPTLMSHVSTANRTHLIHELEKHSVTLINCAKLEKIEDNSVAVYVNESPTVPDPYNTWNPVLPENVPNPLAKPIKSEYKMRSIDADLVVLAVGHEQDNTLHRLIKDAYITPELHLLGDAAHTGMIMHAVRAGYRTGLSI

SEQ ID NO: 1073 - protein, 642 aa, unidentified
  REGION 1..642: note = Description of Unknown:uncultivated organism sequence
  REGION 1..642: note = Category: MG60 effectors
  REGION 1..642: note = Description: MG60-288 effector
MKVIKRDGRVVDFNREKIAIAIEKANQEVTEKERADKQDIKDIIKYIESLDKKRILVEDVQDIIEEQLMDKKKFKLAKKYMIYRYNRALVRKKNTTDESILGLIKNQNMEMLEDGTRKNAVLASSQRDYIAGEVSKDLTKRLLLPEKIVKAHEEGVLYFHDMDYFLQPIFNSSVISIGDMLDNGTVINGKLIESPKSFRVACTVLAQILATVASTQYGGQSVDISHLGKYVRKSYEKFKEEFEQDLGGKLSEEILDKKIKEEVTSGVQTLQYQINTLMTTNGRSPLVSLFMYLREDDEYIKENALIIEEILKQRIEGMKDSEGKYINPEFPKLIYVIDENNCLNGEKYDYLTQLALECANKTQEPSFISAKKMRENYSGNVFSPMGFRSFLTPWKDENGTYKFEGRFNQGIVSINLPQIAIVADGDEDKFFSLLDERLELCHEALLCRHYALLGTVSDTSPIHWIYGAIAHLKSGEKIDKYLKDGYSTISLGYVGVYEATMMMKEVSNTEPNGKEFAIKIVKHLKETVEKWKKASGLGFCLYGETSQKVCKTFERIDKERFGVIKNVTDKEKYTSSYHASEDEKIDYKEKLAFESVFQKLSLGGVVSQIPSEYIGELSDKEEFIKFVYDNVQYLEFTKELKK

SEQ ID NO: 1074 - protein, 728 aa, unidentified
  REGION 1..728: note = Description of Unknown:uncultivated organism sequence
  REGION 1..728: note = Category: MG60 effectors
  REGION 1..728: note = Description: MG60-289 effector
MDAVHTNVIKRNGEEVNFDLDKIVNAINAANKEVDRLHQLNDYQVQAIADNIAKQIEIMTHAIHVEDIQDMVETGIMEMRGYEVAQKYVRYRYKRELARKSNTTDNGILALIDHMNEEVNQENSNKNPVINSTQRDYMAGEVSKDLTKRMLLPKEIVEAHEQGIIHFHDSDYFAQREHNCDLVNLEDMLQNGTVISETMIEKPHSFFTACNVTTQIVAQVASNQYGGQSFTLSHIAPFVDVSRKKIREQVIEERKMCGEALDEEVISKITESRLHAEVKSGIQTIQYQLITLMTCNGQAPFVTMFMYLDEVPEGQTRDDLAMIIEEVLQQRIQGVKNEKGIWITPAFPKLIYVLDKDNITEDSKYWYLTELAAKCTAKRMVPDYISAKVMRELKNGDVYPCMGCRSFPTSEDSQRNPDGTRKYYGRFNQGVVTINLVDVACSAEGHMDRFWEILESRLELCHRALRCRHERLLGTVSDVAPILWQHGALARLKKGETIDKLLFNGYSTISLGYAGLCEMCVRMTGKTHTSPEGKKLALEVMQKLNDKCKEWKEAENISYSVYGTPMESTTYKFAKCLQKRFGIIKGVTDKNYITNSYHIHVTEPVNAFDKLKFESEFQKLSPGGAISYVEVPNLQDNVEAVISVMKFIYDNILYAELNTKSDYCEICGYDGEIKIVTDENGKLIWECPNCGNRDQNNLFVARRTCGYIGTQFWNQGRTQEIKDRVLHL

SEQ ID NO: 1075 - protein, 765 aa, unidentified
  REGION 1..765: note = Description of Unknown:uncultivated organism sequence
  REGION 1..765: note = Category: MG60 effectors
  REGION 1..765: note = Description: MG60-290 effector
MSEKHHSHCLDAMEINDLQCIVRVRSILYRNIKEGVIMDAVHTNVIKRNGEEVNFDLDKIVNAINAANKEVDRLHQLNDYQVQAIADNIAKQIEIMTHAIHVEDIQDMVETGIMEMRGYEVAQKYVRYRYKRELARKSNTTDNGILALIDHMNEEVNQENSNKNPVINSTQRDYMAGEVSKDLTKRMLLPKEIVEAHEQGIIHFHDSDYFAQREHNCDLVNLEDMLQNGTVISETMIEKPHSFFTACNVTTQIVAQVASNQYGGQSFTLSHIAPFVDVSRKKIREQVIEERKMCGEALDEEVISKITESRLRAEVKSGIQTIQYQLITLMTCNGQAPFVTMFMYLDEVPEGQTRDDLAMIIEEVLQQRIQGVKNEKGIWITPAFPKLIYVLDKDNITEDSKYWYLTELAAKCTAKRMVPDYISAKVMRELKNGDVYPCMGCRSFPTSEDSQRNPDGTRKYYGRFNQGVVTINLVDVACSAEGHMDRFWEILESRLELCHRALRCRHERLLGTVSDVAPILWQHGALARLKKGETIDKLLFNGYSTISLGYAGLCEMCVRMTGKTHTSPEGKKLALEVMQKLNDKCKEWKEAENISYSVYGTPMESTTYKFAKCLQKRFGIIKGVTDKNYITNSYHIHVTEPVNAFDKLKFESEFQKLSPGGAISYVEVPNLQDNVEAVISVMKFIYDNILYAELNTKSDYCEICGYDGEIKIVTDENGKLVWECPNCGNRDQNNLFVARRTCGYIGTQFWNQGRTQEIKDRVLHL

SEQ ID NO: 1076 - protein, 733 aa, unidentified
  REGION 1..733: note = Description of Unknown:uncultivated organism sequence
  REGION 1..733: note = Category: MG60 effectors
  REGION 1..733: note = Description: MG60-291 effector
MKIIKRNGKEVDFDVTKIQNAIRKESKATIDECLSEEEIKEISDYLTFKIGKLHYSPNVEEIQHMVQKQIMAAGKFNIATNYIEYRYKHDLMRKANSTDDVILSIIDRDNEEIKQENSNKNPTVNSVQRDYMAGEISKDLTSRIILPEDVLQAHKEGIIHVHDMDYFVQHMHNCDLVNLEDMLQNGTVISETMIEKPHSFSTACNITTQIIAQVASNQYGGQSISLAHLAPFVDISRKKIRKQLIEEEAATGIKLDEKQLDSVIELRLKEEIKRGIQMIQYQVVTLETTNGQTPFITESMYLNEAKNEQEKHDLAMLIEETLKQRIQGVKNENGVWITPAFPKLIYILEEDNINEDAPYYYLTELAAKCTAKRMVPDYVSEKIMLELKGDVYPPMGCRSFLTPDRFTDEGVGNISNANNYESDKHKYYGRFNQGVVTINLVDVALSSKGNINDFWKIFDERLNLCKKALICRHKRLLGTTSDAAPILWQHGALARLKKGEKIDKLLFNGYSTISLGYAGLYECTYYMTGKSHTDDNGGKPFAIAVMEYLNDKCNEWKKETNIDFSLYGTPLESTTYKFAKCLQKRFGKIENVTDHNYITNSYHVCVRENIDAFTKLKFESEFQKLSPGGCISYVEVPNMLNNIPAVLQVIKYIYDNIMYAELNTKSDYCQCCGYDGEIQIVENEDGKLIWHCPKCGNEDQEKMNVARRTCGYIGTQFWNQGRTQEIKDRVLHL

SEQ ID NO: 1077 - protein, 765 aa, unidentified
  REGION 1..765: note = Description of Unknown:uncultivated organism sequence
  REGION 1..765: note = Category: MG60 effectors
  REGION 1..765: note = Description: MG60-292 effector
MSEKHHSHCLDAMEINDLQCIMRVRSILYRNIKEGVIMDAVHTNVIKRNGEEVNFDLDKIVNAINAANKEVDRLHQLNDYQVQAIADNIAKQIEIMTHAIHVEDIQDMVETGIMEMRGYEVAQKYVRYRYKRELARKSNTTDNGILALIDHMNEEVNQENSNKNPVINSTQRDYMAGEVSKDLTKRMLLPKEIVEAHEQGIIHFHDSDYFAQREHNCDLVNLEDMLQNGTVISETMIEKPHSFFTACNVTTQIVAQVASNQYGGQSFTLSHIAPFVDVSRKKIREQVIEERKMCGEALDEEVISKITESRLRAEVKSGIQTIQYQLITLMTCNGQAPFVTMFMYLDEVPEGQTRDDLAMIIEEVLQQRIQGVKNEKGIWITPAFPKLIYVLDKDNITEDSKYWYLTELAAKCTAKRMVPDYISAKVMRELKNGDVYPCMGCRSFPTSEDSQRNPDGTRKYYGRFNQGVVTINLVDVACSAEGHMDRFWEILESRLELCHRALRCRHERLLGTVSDVAPILWQHGALARLKKGETIDKLLFNGYSTISLGYAGLCEMCVRMTGKTHTSPEGKKLALEVMQKLNDKCKEWKEAENISYSVYGTPMESTTYKFAKCLQKRFGIIKGVTDKNYITNSYHIHVTEPVNAFDKLKFESEFQKLSPGGAISYVEVPNLQDNVEAVISVMKFIYDNILYAELNTKSDYCEICGYDGEIKIVTDENGKLIWECPNCGNRDQNNLFVARRTCGYIGTQFWNQGRTQEIKDRVLHL

SEQ ID NO: 1078 - protein, 733 aa, unidentified
  REGION 1..733: note = Description of Unknown:uncultivated organism sequence
  REGION 1..733: note = Category: MG60 effectors
  REGION 1..733: note = Description: MG60-293 effector
MKILKRNKVEVEFDSSKIVNAITKANNSVLEAERLGSECINKIASEVVSDCEALDRVVSVEEVQDMVEKKIMEAGAYQVAKNYITYRYTRQLQRQKNTTDDAILSLVAHKNEEAKEENANKNPIIASTQRDYVAGEVSKDLTMRVLLNDPEIAEAHENGIIHFHDADYFLQTIHNCDIWNLDDMLQNGTVISGVMIDKPKSFATACNIATQIVAQVASSQYGGQTFSLAHLAPFVDVSRQKWAKKIRKDMEEAGVSYTDAQFDQLVENRVREEIQNGVQTIQYQLVTLMTTNGQTPFVSVFMYLDEVPEGRTRDDLAMIIEEVLVQRKKGLKNKVGHWVVTAFPKLLYVLDEDNIYPDSKYYYLTKLAAECTAKTMVPDYISAKKMREFKGDVYACMGCRSFLTPDRFTDAGVGNIAKAKNYVPGQHKYYGRFNQGVVTINLVDVACSSYKDMDKFWQILNDRLELCHRALQKRHKRLKGTLSDVAPILWQYGALARLEPGEVIDPLLYDGYSTISLGYAGVYEMTRYMTGESHTEPNGQAFALKVMNALNDACAKWKKEENIDYSLYGTPMESTTYKFAKCLQKRFGIIPEVTDHSYITNSYHICVREPIDAFEKLSKEAEFQRLSPGGAISYVEVPNMQNNIPAVLAVMTHIYNTIMYAELNTKADYCQVCGYEGEIDLVNQEGKWIWKCPQCGCTDHSKMNIARRVCGYISTNDMNNGRKHEIAERVLHL

SEQ ID NO: 1079 - protein, 722 aa, unidentified
  REGION 1..722: note = Description of Unknown:uncultivated organism sequence
  REGION 1..722: note = Category: MG60 effectors
  REGION 1..722: note = Description: MG60-294 effector
MQVIKRNGTEVPFDETKIVNAITAANNGAGGRLTASQISEITDFVSFKCQKLHRSVSVETIQDMVEQQLMASGEYNVAKHYITYRYKRAEIRRGNTTDAKILSLVDCNNEEAKQENSNKNPTVNSVQRDYIAGEVSRDITERTLLPEDVVQAHKSGIIHFHDTDYYAQRMHNCDLVNLEDMLQNGTVISGTLIEKPHSFSTACNIATQIIAQVASNQYGGQSISLAHLAPFVQVSREKIRRELREEMEISDTQISPEAFNTIVETRVRREVNKGIQTIQYQVVTLLTTNGQAPFLTVFMYLNEAKDEQEKKDLAIIIEETLKQRIEGVKNEKGHWITPAFPKLIYVLEEDNITKDSKYWYLTELAAKCTAKRMVPDYISEKIMKQLKEGNCFPVMGCRSNLSPWKDENGNYKFYGRFNQGVVTINLVDVALSSHGNMEEFWRIFDERLALCYKALMCRHNRLKGTLSDAAPILWQYGAIARLKKGEKIDKLLYGGYSTISLGYAGLAECVRYMTGKSHTDPTATPFALAVMKHMNAACDEWKRETNIGFGIYGTPLESTTYKFAKCLQERFGIIEGVTDKNYITNSYHIPVTEQINAFDKLKFEAQFQALSTGGAISYVEVPNLEHNIDAVMKIITFIYDNIMYAELNTKSDYCQVCGYDKEIQIVTDENTGKLVWECPNCGNRDQNKMNVARRTCGYIGSQFWNQGRTQEIKDRVMHLSLE

SEQ ID NO: 1080 - protein, 728 aa, unidentified
  REGION 1..728: note = Description of Unknown:uncultivated organism sequence
  REGION 1..728: note = Category: MG60 effectors
  REGION 1..728: note = Description: MG60-295 effector
MDAVHTNVIKRNGEEVNFDLDKIVNAINAANKEVDRLHQLNDYQVQAIADNIAKQIEIMTHAIHVEDIQDMVETGIMEMRGYEVAQKYVRYRYKRELARKSNTTDNGILALIDHMNEEVNQENSNKNPVINSTQRDYMAGEVSKDLTKRMLLPEEIVEAHEQGIIHFHDSDYFAQREHNCDLVNLEDMLQNGTVISETMIEKPHSFFTACNVTTQIVAQVASNQYGGQSFTLSHIAPFVDVSRKKIREQVIEERKMCGEALDEEVISKITESRLRAEVKSGIQTIQYQLITLMTCNGQAPFVTMFMYLDEVPEGQTRDDLAMIIEEVLQQRIQGVKNEKGIWITPAFPKLIYVLDKDNITEDSKYWYLTELAAKCTAKRMVPDYISAKVMRELKNGDVYPCMGCRSFPTSEDSQRNPDGTRKYYGRFNQGVVTINLVDVACSAEGHIDRFWEILESRLELCHRALRCRHERLLGTVSDVAPILWQHGALARLKKGETIDKLLFNGYSTISLGYAGLCEMCVRMTGKTHTSPEGKKLALEVMQKLNDKCKEWKEAENISYSVYGTPMESTTYKFAKCLQKRFGIIKGVTDKNYITNSYHIHVTEPVNAFDKLKFESEFQKLSPGGAISYVEVPNLQDNVEAVISVMKFIYDNILYAELNTKSDYCEICGYDGEIKIVTDENGKLIWECPNCGNRDQNNLFVARRTCGYIGTQFWNQGRTQEIKDRVLHL

SEQ ID NO: 1081 - protein, 719 aa, unidentified
  REGION 1..719: note = Description of Unknown:uncultivated organism sequence
  REGION 1..719: note = Category: MG60 effectors
  REGION 1..719: note = Description: MG60-296 effector
MKIIKRNGSEETFDIQKIVVAVTKADKDNGERTLTDSQIEDIAEYVEFKCNKLNRAVSVEEIQDMVENQIMATGAFELARKYVRYRYKRSLVRKANTTDNRILSLIEYNNEDVKQENSNKNPAVNSVQRDYMAGEVSRDLTTRMLLPHDIVEADREGIIHFHDSDYYAQHMHNCDLVNLEDMLQNGTVISGTMIEKPHSFSTACNIATQIIAQVASNQYGGQSISLAHLAPFVDVSREKIRKEVISEQELVGMEYPEDVLNEIVERRLKKEITKGVQTIEYQVITLMTTNGQAPFLTVFMYLNEAKNEREKKDLAMIIEETLRQRYQGVKNEAGVWVTPAFPKLIYVLEEDNIEEGSEYYYLTELAAKCTAKRLVPDYISEKKMKELKEGNCFPVMGCRSCLSPWKDENGNYKFYGRFNQGVVTINLVDVALSSGGDMDKFWKIFDDRLELCYRALMCRHNRLKGTLSDAAPILWQFGALARLKKGEPIDKLLYGGYSTISLGYAGLYECVKYMTGKSHTDPDATPFALDVMKHMNDACNQWKEETNVAFSIYGSPIESTTYKFAKCLQKRFGIVPGITDKSYITNSYHVFVREEIDAFSKLKFESQFQALSSGGAISYVEVPDMKDNIAAVLQVIRFIYDNIMYAELNTKSDYCQECGYDGEIQIITDEEGKLVWECPHCGNRNQDTLNVARRTCGYIGTQFWNQGRTQEIKERVLHL

SEQ ID NO: 1082 - protein, 708 aa, unidentified
  REGION 1..708: note = Description of Unknown:uncultivated organism sequence
  REGION 1..708: note = Category: MG60 effectors
  REGION 1..708: note = Description: MG60-297 effector
MKVVKRDGRVVDFDRSKIVTAIQKANAEVRPKERANKEEVKSVIEYIESLDKKRILVEDIQDIIEEQLMAIGKYELAKKYIVYRYTRALVRKSNTTDESILKLIKNENKELAEENSNKNTMLASTQRDYIAGEVSRDLTRRILLPEKISKANDEGILHFHDADYFIQPIFNCCLINIGDMLDNGTVMNGKMIESPKSFQVACTVLTQIIAAVASNQYGGQSVDLIHLGKYLRRSYNKYRKAIEEKYKNKIPEHIIEDIVQERLRAELKSGVQTIQYQINTLMTTNGQSPFVTLFLHLEKDDPYIKENAMIIEEVIRQRYEGIKNEAGVYVTPAFPKLVYVIDDFNNLTGGEYDYLTELAVKCSAKRMYPDYISAKKMRENYEGNVFSPMGCRSFLSPWKDENGNYKFEGRFNQGVVSINLPQIAIIADGDEEKFWKLLDERLELCKEALMCRHNALVGTSSDISPIHWQYGAIARLKKGEKIDKLLYGGYSTMSLGYIGIYEMTKLMTGVSHTDPKGHEFAIKVMNHLRETTDRWKKETNIGFALYGTPAESLCYKFARIDKEKFGTIKDVTDKGYYTNSYHVDVREKIDAFDKLKFESEFQKISSGGAISYIEIPNMQNNLEALRSVVKFIYDNIQYAEFNTKSDYCHVCGYDGEIKINDDNEWECPNCGNKDHNKMTVVRRTCGYLGENFWNAGKTKEIKQRVLHL

SEQ ID NO: 1083 - protein, 724 aa, unidentified
  REGION 1..724: note = Description of Unknown:uncultivated organism sequence
  REGION 1..724: note = Category: MG60 effectors
  REGION 1..724: note = Description: MG60-298 effector
MNVIKRSGEEVVFDASKIENAIKKANKATTHNQMSDELIRSVTQSVIDKCENLKRSPNVEEIQDMVEGELMEHRCFAVAHNYITYRYERALVRKANSTDKQIMSLLERNNEEVKQENSNKNPLVNSVQRDYMAGEVSKDITKRFLLPQDVMEAHEQGIIHFHDSDYFAQHMHNCCLVNLEDMLQNGTVISETMIEKPHSFSTACNVATQIIAQVASSQYGGQSITLSHLAPFVQVSREKARREVKEELESLNLDSSEDTVNKMAEMRVRKEIEKGVQMIQYQVITLMTTNGQAPFVTVFMYLNEVPEGQTRDDLAIIIEEMLKQRIKGVKNEKGIWITPAFPKLIYVLEENNIEEGSKYWYLTELAAKCTAKRMVPDYISEKKMLELKVDVNGEGHCYPCMGCRSFLTTYLDENGKPKYYGRFNQGVVTLNLVDVACSSKQDEEAFWRIMDERLALCKKALMCRHERLLGTPSDVAPILWQNGALARLKKGEPIDKLLFGGYSTISLGYAGLCECVYYMTGHPHTEEPGTSFGLKVMQYLNDACAKWKAEENIDFSLYGTPMESTTFKFSKHLQERFGIIPHVTDKNYITNSYHVHVTEEIDAFTKLSFESQFQKLSPGGAISYVEVPNMENNIDAVLAIMKHIYNHIMYAELNTKSDYCQVCGYTGEIKIVEDENHKLVWECPNCGNRDQEKMNVARRTCGYIGTQFWNQGRTQEIKERVLHL

SEQ ID NO: 1084 - protein, 727 aa, unidentified
  REGION 1..727: note = Description of Unknown:uncultivated organism sequence
  REGION 1..727: note = Category: MG60 effectors
  REGION 1..727: note = Description: MG60-299 effector
MRKKPSMIIKRDGSKVLFDPKKIELAITKALISEGVASIFTGTAQAIAKSFESENETPTIKEIEEYVFKSLCEAGLPLVAKAYEGYRSIREFQRSDQFTDESILSIVAGGTDEDLRDENSNKNVATASTQRDMIAGEASKDIAMRHMLPPHVVQAHKDGLIHFHDLDYAVQRIFNCCLVDLRGPFKDGTVINKKMIETPRSFRTACTVATQIVQQVACGQYGGQTISLAHLAPYVRVSYEKIKNQVREELFGDDVPLASPTKLCGNREVEHIAKKRLRKEIEDGLQTIQYQVNTFSTSNGQAPFLSIFMYLNEDPEYIEETAMLIEEMIKQRYIGMKNEAGVYVTPAFPKLLYVLDENNVPKDSKYRYLTDLAVKCVARRMMPDFISAKKMKENYEDVFPCMGCRSFLSQYRDKDGKLKWYNRFNQGVVTLNLADAGLSADGNIDAFWKILDERLELVHDGLMCKHKSLLGTKAEKSPIHWQHGVIARLKKDDVIDPYLKDGYSTLSLGYIGLHECVLALIGESHTTERGEELAVRIMRRLRKACDDWRAESGLGFSLYGSPSESTTYRLAQTTQKRFGVVKGITDRDYLTNSYHVDVTEKINAFDKLRFESQFQKISSGGCISYVEVPNLEQNLEVIDQLVSYMYETIQYAEINTKSDYCAKCGFRGEIKLNNNLDWECPQCHTVNRDDLTVCRRTCGYLGDNFWNKGRTEEIGARVLHVDNEDLS

SEQ ID NO: 1085 - protein, 719 aa, unidentified
  REGION 1..719: note = Description of Unknown:uncultivated organism sequence
  REGION 1..719: note = Category: MG60 effectors
  REGION 1..719: note = Description: MG60-300 effector
MKIIKRNGSEAAFDITKIIAAVTKANNADGQSRELTGEQIRAIAAEVEEKCGAMGRAPSVEEIQDMVENQIMGRNAFEVAKRYIRYRYTRSLARRANTTDNQILSLIECNNEEAKQENANKNPTVNSVQRDYMAGEVSKDITRRILLPQEIVEAHEQGIIHFHDSDYFAQHMHNCDLVNLEDMLQNGTVITGTLIEKPHSFSTACNIATQIVAQVASNQYGGQSISLAHLAPFVQVSREKIRGEVLAELEELGTTASEDKIAQIVERRLRAEVERGVQTIQYQVVTLMTTNGQAPFITVFMYLNEAKNEREKRDLAMIIEEVLLQRYEGVKNEKGVWVTPAFPKLIYVLQEDNVAPGAEYYYLTELAAKCTAKRMVPDYISEKKMKELKEGNCFPVMGCRSALSPWKDENGNYKFYGRFNQGVVTLNLVDVALSSGGDMDRFWKIFDERLDLCYRALMCRHNRLKGTLSDAAPILWQYGAIARLKKGEPIDKLLYGGYSTISLGYAGLCECVRYMTGKSHTDPSATPFALAVMKYMNTACERWKAETTIGFGIYGTPLESTTYKFAKCLQKRFGIVPGVTDKPYITNSYHVHVTEEIDAFAKLAFEAQFQALSTGGAISYVEVPNMQQNLEAVLQIIRYIYDNIMYAELNTKSDYCQACGFDGEIRIVEDDGKLVWECPNCGNRDQDTMNVARRTCGYIGTQYWNQGRTAEIKERVLHL

SEQ ID NO: 1086 - protein, 729 aa, unidentified
  REGION 1..729: note = Description of Unknown:uncultivated organism sequence
  REGION 1..729: note = Category: MG60 effectors
  REGION 1..729: note = Description: MG60-301 effector
METAVNTNVIKRNGEEVKFDLSKIENAIFAANKEVDKLHQLSDYQVYAIADNLAKHIEEMTHAVHVEDIQDMVETGIMEMRGYEVAQKYVRYRYKRELARKSNTTDNGILSLIEHMNEEVNQENSNKNPVINSTQRDYMAGEVSKDLTKRMLLPEDIVEAHEAGIIHFHDSDYFAQKEHNCDLVNLEDMLQNGTVISETMIEKPHSFFTACNVTTQIVAQVASNQYGGQSFTLSHIAPFVDVSRKKIRKQVIEERTELGEPLDDDIIDKITEKRLLLEVKSGIQTIQYQLITLMTCNGQAPFVTMFMYLDEVPEGQTRDDLALIIEEVLNQRIIGVKNEKGFYITPAFPKLIYVLDEDNITPGSKYWYLTELAAKCTAKRMVPDYISAKVMREMKNGDVYPCMGCRSFPTSEPNILNPDGTRKYYGRFNQGVVTINLVDVACSSDGDMDEFWKILEERLELCHRALRCRHERLLGTLSDVAPILWQHGALARLKKGEKIDKLLYNGYSTISLGYAGLCEMCVRMTGKTHTSPEGKDFALKVMQKLNDKCAEWKKAENISYSVYGTPMESTTYKFAKCLQKRFGIIKGVTDKNYITNSYHVHVTEHIDAFSKLKFESEFQKLSPGGAISYVEVPNLTNNIEAVISVMQFIYDNILYAELNTKSDFCEKCLYDGEMRIVTDDSGKLVWECPNCGNRDQNNLFVARRTCGYIGTQFWNQGRTQEIKDRVLHL

SEQ ID NO: 1087 - protein, 850 aa, unidentified
  REGION 1..850: note = Description of Unknown:uncultivated organism sequence
  REGION 1..850: note = Category: MG60 effectors
  REGION 1..850: note = Description: MG60-302 effector
MANNVTEIEEKSKSFLYHLVKYYKIFIDTCSLLSIRANKFWEHITPILKAQNASVIVPYRVYEEVEKYADNLELCKKKVPNDPNFNLTAKKAKKKILSLYEQGLVKIFGDKTDNFADNVFQTVFTKFRMKYNLLLITQDKDLASDIMKISESKSVMANNKILVRKINNYGYLSAVEKIKVDVNKNEPKKSVVNTVHNGSQKKKVQVSVAVPEDEIFAHTDTITVVTGSVNVSEYPKENCIVTAKRGGNSKTIHLLSKVSSGGEGIIYTTDIPNVVAKIYKPQKVDRAKFEKLKLMMTKNINCPGVCFPIALLYNTKGEFVGYLMNKAKGIELQKGIFIPRLLQKHFPNWKKKDTVQLCITILKKFKYLHDRNIILGDINPNNILVVSPTEVYFVDTDSYQIEGYPCPVGTINFTAPEIQGKRYDEFLRTLGNEQFAVATLLFMIMLPGKPPYALQGGESQSDNIINGDFAYASGERTNGKAPEGAWRYIWSHMPRYLKDDFYETFHKDGAQHSENSRFSDDDWIKKFEYYEKLLTEENSKFLANDSMSGELIPNRLKKVANVTYVRCKLCGREVDEERTEQGYCSDCLRKGETYNCSRCGNEMVYTNYQRLIRHSHKFDTCKACNDKLNSIYRRYPCRNPRCNNMVEITFRYKEKLEQNNKPLPTVCKDCRNEVYATRRCSICNRVFDITFSEKEYYDSKGYDFPKKCPNCRGVKIPVHRGSSYYNTPRTYNNSIPQPTQKKKSSFCFITTAVCKYFNKPDDCYELTLLRKFRDTWLVKQPGGNELVKEYYSVAPNIVTALDNYSEKDKVYIHIWNNYIKPCIKLIELGANDTCKDLYMNMVNELKEKFN

SEQ ID NO: 1088 - protein, 747 aa, unidentified
  REGION 1..747: note = Description of Unknown:uncultivated organism sequence
  REGION 1..747: note = Category: MG60 effectors
  REGION 1..747: note = Description: MG60-303 effector
MRIIKRSGKEVEYDGSKIIKAIQKANAEVATNERLSDTKIQAIEEDTRAILEELTHTANIEEIQDIVIHQIMKMQAYRLAQVYTEYRYKQALKRKNNSTDDGILALIERQNEELNQENSNKNPVIASTQRDYIAGEVSKDITDRLLLPTDVLEAHRKGIIHFHDRDYFLMHIYNCCLINLEDMLQNGTVITETMIEKPHSFATAANVATQIIAQVASNQYGGQTFNLAHLAPFVDISRQKHIKHYREDITDAITSVPILGKLLTPIMDKIVDPLAKFLGERALKREIRSGIQTIQYQLVTLMTTNGQTPFVSMFMYLKDAKNETERDDLAMLMEEVLRQRIAGIKNEQGVPITPAFPKILFVLDTLTMDPNSKYHYLKELAAECTAKRMVPDYISEKKMLEYKGDVYGCMGCRSFLTPDRFTDKGIGNIARAKNYQEGVHKYWGRFNQGVVTINLPYIACLSEKNMTKFWEILDQYLELCHKALRIRHERLMNTPADVAPILFRYGAIARLDKGEVINDLLFHGYSTISLGYAGLYEMCKYMTGKSHTDPDAKPFALSVMQRMNDACAKWKAEEDIDYSIYGTPIESTTYRFAQKLQEQFGIIPDVTDHNYITNSYHINVREEIDAFSKLKFESEFQALSPGGAISYVEVPDLQNNLKAVEAIQDCIYNEILYAEINTKSDYCQVCGYDGQIEIIEDDHKKLIWKCPNCGNTDQNKMNVARRTCGYIGTQFWNQGRTQEIKDRVLHI

SEQ ID NO: 1089 - protein, 634 aa, unidentified
  REGION 1..634: note = Description of Unknown:uncultivated organism sequence
  REGION 1..634: note = Category: MG60 effectors
  REGION 1..634: note = Description: MG60-304 effector
MKVIKRDGRVVDFNREKIAIAIEKANQEVTEKERADKQDIKDIIKYIESLDKKRILVEDVQDIIEEQLMDKKKFKLAKKYMIYRYNRALVRKKNTTDESILGLIKNQNVEMLEDGTRKNAVLASSQRDYIAGEVSKDLTKRLLLPEKIVKAHEEGVLYFHDMDYFLQPIFNSSVISIGDMLDNGTVINGKLIESPKSFRVACTVLAQILATVASTQYGGQSVDISHLGKYVRKSYEKFKEEFGGVPSKEILDKKIKEEVTSGVQTLQYQINTLMTTNGRSPLVSFFMYLREGDEYIKENALIIEEILKQRIEGMKDAEGEYINPEFPKLIYAIDENNCLNGEKHDYLTQLALECANKTQEPSFISAKKMRENYSGNVFSPMGFRSFLTPWKDENGTYKFEGRFNQGIVSINLPQIAIVADGDEDKFFSLLDERLELCHEALLCRHYALLGTVSDTSPIHWIYGAIAHLKSGEKIDKYLKDGYSTISLGYVGVYEATMMIKEVSNTEPDGKEFAIKIVKYLKETVEKWKKASGLGFCLYGETSQKVCKTFERIDKERFGVIKNVTDKEKYTSSYHASEDEKIDYKEKLAFESVFQKLSLGGVVSQIQSKYIGKLSDKEEFIKFVYDNVQYLEFTK

SEQ ID NO: 1090 - protein, 708 aa, unidentified
  REGION 1..708: note = Description of Unknown:uncultivated organism sequence
  REGION 1..708: note = Category: MG60 effectors
  REGION 1..708: note = Description: MG60-305 effector
MKVVKRDGRVVDFDRSKIVTAIQKANAEVRPKERANKEEVKSVIEYIESLDKKRILVEDIQDIIEEQLMAIGKYELAKKYIVYRYTRALVRKSNTTDESILKLIKNENKELAEENSNKNTMLASTQRDYIAGEVSRDLTRRILLPEKISKANDEGILHFHDADYFIQPIFNCCLINIGDMLDNGTVMNGKMIESPKSFQVACTVLTQIIAAVASNQYGGQSVDLIHLGKYLRRSYNKFKKAIEEKYKNKIPEHIIEDIVQERLRTELKSGVQTIQYQINTLMTTNGQSPFVTLFLHLEKDDPYIKENAMIIEEVIRQRYEGIKNEAGVYVTPAFPKLVYVIDDFNNLTGGEYDYLTELAVKCSAKRMYPDYISAKKMRENYEGNVFSPMGCRSFLSPWKDENGNYKFEGRFNQGVVSINLPQIAIIADGDEEKFWKLLDERLELCKEALMCRHNALVGTPSDISPIHWQYGAIARLKKGEKIDKLLYGGYSTMSLGYIGIYEMTKLMTGVSHTDPKGHEFAIKVMNHLRETTDRWKKETNIGFALYGTPAESLCYKFARIDKEKFGTIKDVTDKGYYTNSYHVDVREKIDAFDKLKFESEFQKISSGGAISYIEIPNMQNNLEALRSVVKFIYDNIQYAEFNTKSDYCHVCGYDGEIKINDDNEWECPNCGNKDHNKMTVVRRTCGYLGENFWNAGKTKEIKQRVLHL

SEQ ID NO: 1091 - protein, 716 aa, unidentified
  REGION 1..716: note = Description of Unknown:uncultivated organism sequence
  REGION 1..716: note = Category: MG60 effectors
  REGION 1..716: note = Description: MG60-306 effector
MLEVIKRNGERVPFNRDKITNAIEKAMNSSSGIYEEGQAAKIASEIEAYAASIQKDLTIYAIEDQVYYRLLKYNNPATARAYENYKTIQAFKRQTNTTDDDVFGLLNNTNLEVLDENSNKNGHVVSTQRDLIAGEVSKDIARRKLIPADIVQAHDSGAIHFHDMDYIIQPMFNCCLINLEDMLANGTVINGKKIDTPKSFQVACTVTTQIIAQVASGQYGGQSINGIDRILAPYVRKSFKKYMKAVVEEQREVYGIEPDMEKAEEIAWKRTKKEIKDGIQTIQYQINTLMTTNGQAPFVTLFMYFKPDYEYAKEAALIDEELLRQRIQGIKNEANVYVTPAFPKLIYVLDEHNVREGSPYFYLTKLAAECTAKRMYPDYISAKKMRESYEGNVFSPMGCRSFLSPWKDEQGNYKFDGRFNMGVVSLNLPQIGILADGDEEKFFQILDKRLELCKKALLLRVDLLKRITSDVSPIHWQYGAIARLKPGETIEKFIYGGYATLSLGYIGIYEATMLTKHCSHTTAEGRKFAMRIMDDLNAHIKKWRKETNIGFALYGTPAENLTNLFCKIDKARFGSIPDVTDKGYYTNSYHVDVREPINVFDKFSFEADFEDKSTGGCISYAEIPNMTHNIPAVLTMVQYIYDHIAYGEFNTKLDYCHECGFDGEIILNDDNEWECPRCHNKDRNKLTVIRRTCGYLGENFWNEGRTQEIKNRVLHI

SEQ ID NO: 1092 - protein, 740 aa, unidentified
  REGION 1..740: note = Description of Unknown:uncultivated organism sequence
  REGION 1..740: note = Category: MG60 effectors
  REGION 1..740: note = Description: MG60-307 effector
MKIIKRSGSEATFDISKIVNAIKGANGEVAPEERLTDDQIALAAHSVEWLCNRSGHTVSVEEIQDMVENQIMAQGRYTVARKYIIYRYLQTLKRQSNTTDDKILSLIECNNEEAKQENSNKNPTVNSVQRDYMAGEVSKDITMRLLLPADVVEAHNEGIIHFHDSDYFAQHMHNCDLVNLEDMLQNGTVISGTLIERPHSFSTACNIATQIIAQVASCQYGGQSISLTHLAPFVEVSRQKIRRQVLQEINALGLEANTDRIADVVETRLRDEIRRGVQTIQYQVVTLMTTNGQAPFVTVFMYLNEARNEQEKRDLAMIIEETLAQRYEGVKNEEGVWITPAFPKLIYVLEEDNITEDSPYFYLTKMAAKCTAKRMVPDYISEKKMRELKLSKGETEGNGDCYTCMGCRSFLTPDRTGNGYDNVANAGNYQPGKPKYYGRFNQGVVTISLPDVALSSHGDMAKFWEIFDERLELCYKALMCRHERLKGTLSDAAPILWQYGALARLKKGEPIDKLLYGGYSTISLGYAGLYECVKYMTGHSHTDAEGTPFAMEVMQHMNDKCNEWKAATNIDFSLYGTPLESTTYKFAKALQRRFGIIPGITDKGYITNSYHVHVTEQIDAFEKLKFESNFQRLSPGGAISYVEVPNMQDNLKAVIRVMQYIYDNIMYAELNTKSDYCQVCGYDGEIQIVEDDGKLVWECPKCGNRDQEKLNVARRTCGYIGTQFWNQGRTQEIRDRVLHL

SEQ ID NO: 1093 - protein, 719 aa, unidentified
  REGION 1..719: note = Description of Unknown:uncultivated organism sequence
  REGION 1..719: note = Category: MG60 effectors
  REGION 1..719: note = Description: MG60-308 effector
MKIIKRNGSEETFDIQKIVVAVTKADKDNGERTLTDSQIEDIAEYVEFKCNKLNRAVSVEEIQDMVENQIMATGAFELARKYVRYRYKRSLVRKANTTDNRILSLIEYNNEDVKQENSNKNPAVNSVQRDYMAGEVSRDLTTRMLLPHDIVEADREGIIHFHDSDYYAQHMHNCDLVNLDDMLQNGTVISGTMIEKPHSFSTACNIATQIIAQVASNQYGGQSISLAHLAPFVDVSREKIRKEVISEQELVGMEYPEDVLNEIVERRLKKEITKGVQTIEYQVITLMTTNGQAPFLTVFMYLNEAKNEREKKDLAMIIEETLRQRYQGVKNEAGVWVTPAFPKLIYVLEEDNIEEGSEYYYLTELAAKCTAKRLVPDYISEKKMKELKEGNCFPVMGCRSCLSPWKDENGNYKFYGRFNQGVVTINLVDVALSSGGDMDKFWKIFDDRLELCYRALMCRHNRLKGTLSDAAPILWQFGALARLKKGEPIDKLLYGGYSTISLGYAGLYECVKYMTGKSHTDPDATPFALDVMKHMNDACNQWKEETNVAFSIYGSPIESTTYKFAKCLQKRFGIVPGITDKSYITNSYHVFVGEEIDAFSKLKFESQFQALSSGGAISYVEVPDMKDNIAAVLQVIRFIYDNIMYAELNTKSDYCQECGYDGEIQIITDEEGKLVWECPHCGNRNQDTLNVARRTCGYIGTQFWNQGRTQEIKERVLHL

SEQ ID NO: 1094 - protein, 738 aa, unidentified
  REGION 1..738: note = Description of Unknown:uncultivated organism sequence
  REGION 1..738: note = Category: MG60 effectors
  REGION 1..738: note = Description: MG60-309 effector
MSPEVKTKVIKRNGKEVSFDISKITHAIEKANEEVDNLHQINIFQISAIADKIAKEVEESTHAVNVEDIQDLVETGIMEMRGYEVAQKYVRYRYKREMKRKSNTTDNGILALLDHINEEVKQENSNKNPVINSTQRDYMAGEVSKDLSRRVLLPEEIVQAHEQGIIHFHDTDYFAQREHNCDLINLEDMLQNGTVISETMIEKPHSFFTACNVTTQIVAQVASNQYGGQSFTLAHLAPFVDISRKKIRANVIAERKECGEVLDETIIDKVTERRLRDEVRSGIQTIQYQLITLMTCNGQAPFVTMFMYLDEVPEGKTRDDLATIIEEVLIQRMQGVKNEKGVWITPAFPKLIYVLDEDNITEDSKYWHLTELAAQCTAKRMVPDYISAKIMKELKKGEVYPCMGCRSFLTVEDSQLNADGSHKFYGRFNQGVVTINLVDVACSSNGDMDEFWRILDERLELCHRALRCRHERLKGTISDVAPILWQNGALARLKKGETIDKLLYDGYSTISLGYAGLYEMCMRMYGKSHTDPEAKPFALKVMQHLNDKCNEWKAAEHISYSIYGTPMESTTYKFSKCLQKRFGIIPGVTDKNYITNSYHVHVSEEIDAFSKLKFESEFQKLSPGGAISYVEVPNMQNNIPAVLAVMKFIYENIMYAELNTKSDYCECCGYDGEIKIIEEDSGKLVWECPNCGNRDQSKMSVARRTCGYIGTQFWNQGRTQEIKDRVLHLSNHTNPEYK

SEQ ID NO: 1095 - protein, 638 aa, unidentified
  REGION 1..638: note = Description of Unknown:uncultivated organism sequence
  REGION 1..638: note = Category: MG60 effectors
  REGION 1..638: note = Description: MG60-310 effector
MKVIKRDGRVVDFNREKIAIAIEKANQEVTEKERADKQDIKDIIKYIESLDKKRILVEDVQDIIEEQLMDKKKFKLAKKYMIYRYNRALVRKKNTTDESILGLIKNQNMEMLEDGTRKNAVLASSQRDYIAGEVSKDLTKRLLLPEKIVKAHEEGVLYFHDMDYFLQPIFNSSVISIGDMLDNGTVINGKLIESPKSFRVACTVLAQILATVASTQYGGQSVNISHLGKYVRKSYEKFKEEFGGVPSKEILDKKIKEEVTSGVQTLQYQINTLMTTNGRSPLVSLFMYLREDDEYIKENALIIEEILKQRIEGMKDAEGKYINPEFPKLIYVIDENNCLNGEKYDYLTHLALECANKTQEPSFISAKKMRENYSGNVFSPMGFRSFLTPWKDENGTYKFEGRFNQGIVSINLPQIAIVADGDEDKFFSLLDERLELCHEALLCRHYALLGTVSDTSPIHWIYGAIAHLKSGEKIDKYLKDGYSTISLGYVGVYEATMMMKEVSNTEPNGKEFAIKIVKYLKETVEKWKKASGLGFCLYGETSQKVCKTFERIDKERFGVIKNVTDKEKYTSSYHASEDEKIDYKEKLAFESVFQKLSLGGVVSQIPSEYIGELSDKEEFIKFVYDNVQYLEFTKELKK

SEQ ID NO: 1096 - protein, 746 aa, unidentified
  REGION 1..746: note = Description of Unknown:uncultivated organism sequence
  REGION 1..746: note = Category: MG60 effectors
  REGION 1..746: note = Description: MG60-311 effector
MIIIKKNPEAEKKAGAKYVIKRNGSEDLFDEDKIVNALFKANDSTIKNKITKKQIGEIADHIKRKVDETPHALNIEDIQDMVENELMQIRAFDVARSYITYRYKRALARQHNTTDDKILSLIEHNNEEVKQENSNKNPIVNSVQRDYMAGEVSKDLCKRVFLPGDIWEAHEDGLIHFHDADYFAQHMHNCCLVNLEDMLQNGTVISGTMIDKPKSFATACNIATQAIAQIASQQYGGQTMSIAHLAPFVEISRQKYMKKQRESMEKAGVKATETQLACIVEDMVDDEIKRGVQMIQYQLITLMTTNGQAPFVTIYMYLNECRDEKTKADMVKIIREMFRQRIQGVKNEQGVWVTPAFPKLIYVLEEDNIREGSRYWELTQLAAKCTAKRMVPDYISEKIMKKLKNGDVYSCMGCRSFLTVDRTKGNVANATNYKEGEHKYYGRFNQGVVTLNLVDVACTSAGDEDYFWEILDKRLELCHKALRIRHERLLGTPSDVAPILWQHGALARLKKGETIDKLLYGGYSTISLGYAGLCECTRYMKGVSHTDPKGTDFAMKIMQKLNDACAKWKEAENIDYSVYGTPLESTTYKFAKCLQKRFGIIPGVADKNYITNSYHVHVTEKINAFDKLKFEAPFQKLSPGGAISYVEVPNLQNNIEAVLSIMQYIYDNIMYAELNTKSDYCEACGYDGEIKIVEDEHGKLVWECPNCGNRDQSRMSVARRTCGYIGTQFWNQGRTQEIKERFVHLY

SEQ ID NO: 1097 - protein, 638 aa, unidentified
  REGION 1..638: note = Description of Unknown:uncultivated organism sequence
  REGION 1..638: note = Category: MG60 effectors
  REGION 1..638: note = Description: MG60-312 effector
MKVIKRDGRVVDFNREKIAIAIEKANQEVTEKERADKQDIKDIIKYIESLDKKRILVEDVQDIIEEQLMDKKKFKLAKKYMIYRYNRALVRKKNTTDESILGLIKNQNMEMLEDGTRKNAVLASSQRDYIAGEVSKDLTKRLLLPEKIVKAHGEGVLYFHDMDYFLQPIFNSSVINIGDMLDNGTVINGKLIESPKSFRVACTVLAQILATVASTQYGGQSVDISHLGKYVRKSYEKFKEEFGGVSSNEILDKKIKEEVTSGVQTLQYQINTLMTTNGRSPLVSLFMYLREGDEYIKENALIIEEILKQRIDGMKDAEGEYINPEFPKLIYVIDKDNCLNGGKYDYLTHLALDCANKTQEPSFISAKKMRENYSGNVFSPMGFRSFLTPWKDENGTYKFEGRFNQGIVSINLPQIAIVADGDEDKFFSLLDERLELCHEALLCRHYALLGTVSDTSPIHWIYGAIAHLKSGEKIDKYLKDGYSTISLGYVGVYEATMMIKEVSNTEPNGKEFAIKIVKHLKETVEKWKKASGLGFCLYGETSQKVCKTFERIDKERFGVIKNVTDKEKYTSSYHASEDEKIDYKEKLAFESVFQKLSLGGVVSQIPSEYIGELSDKEEFIKFVYDNVQYLEFTKELKK

SEQ ID NO: 1098 - protein, 745 aa, unidentified
  REGION 1..745: note = Description of Unknown:uncultivated organism sequence
  REGION 1..745: note = Category: MG60 effectors
  REGION 1..745: note = Description: MG60-313 effector
MIIIKKNPEAEKKAGAKYVIKRNGSEDLFDEDKIVNALFKANDSTIKNKITKKQIGEIADHIKRKVDETPHALNIEDIQDMVENELMQIRAFDVARSYITYRYKRALARQHNTTDDKILSLIEHNNEEVKQENSNKNPIVNSVQRDYMAGEVSKDLCKRVFLPGDIWEAHEDGLIHFHDADYFAQHMHNCCLVNLEDMLQNGTVISGTMIDKPKSFATACNIATQAIAQIASQQYGGQTMSIAHLAPFVEISRQKYMKKQRESMEKAGVKATEAQIASIVEDMVDEEIKRGVQMIQYQLITLMTTNGQAPFVTIYMYLNECRDEKTKADMVKIIREMFRQRIQGVKNEQGVWVTPAFPKLIYVLEEDNIREGSRYWDLTQLAAKCTAKRMVPDYISEKIMKQLKNGDVYSCMGCRSFLTVDRTNGNIANATNYKEGEHKYYGRFNQGVVTLNLVDVACTSAGDEDYFWEILDKRLELCHKALRIRHERLLGTPSDVAPILWQHGALARLKKGETIDKLLYGGYSTISLGYAGLCECTGYMKGVSHTDPDGTEFAMKVMQRLNDACAKWKEAENIDYSVYGTPLESTTYKFAKCLQKRFGIIPGVTDKNYITNSYHVHVTEKINAFDKLKFEAPFQKLSPGGAISYVEVPNLQNNIEAVLSIMQYIYDNIMYAELNTKSDYCEACGYDGEIKIVEDEHGKLVWECPNCGNRDQSRMSVARRTCGYIGTQFWNQGRTQEIKERFVHL

SEQ ID NO: 1099 - protein, 638 aa, unidentified
  REGION 1..638: note = Description of Unknown:uncultivated organism sequence
  REGION 1..638: note = Category: MG60 effectors
  REGION 1..638: note = Description: MG60-314 effector
MKVIKRDGRVVDFNREKIAIAIEKANQEVTEKERADKQDIKDIIKYIESLDKKRILVEDVQDIIEEQLMDKKKFKLAKKYMIYRYNRALVRKKNTTDESILGLIKNQNMEMLEDGIRKNAVLASSQRDYIAGEVSKDLTKRLLLPEKIVKAHGEGVLYFHDMDYFLQPIFNSSVINIGDMLDNGTVINGKLIESPKSFRVACTVLAQILATVASTQYGGQSVDISHLGKYVRKSYEKFKEEFGGVSSNEILDKKIKEEVTSGVQTLQYQINTLMTTNGRSPLVSLFMYLREGDEYIKENALIIEEILKQRIDGMKDAEGEYINPEFPKLIYVIDKDNCLNGGKYDYLTHLALDCANKTQEPSFISAKKMRENYSGNVFSPMGFRSFLTPWKDENGTYKFEGRFNQGIVSINLPQIAIVADGDEDKFFSLLDERLELCHEALLCRHYALLGTVSDTSPIHWIYGAIAHLKSGEKIDKYLKDGYSTISLGYVGVYEATMMIKEVSNTEPNGKEFAIKIVKHLKETVEKWKKASGLGFCLYGETSQKVCKTFERIDKERFGVIKNVTDKEKYTSSYHASEDEKIDYKEKLAFESVFQKLSLGGVVSQIPSEYIGELSDKEEFIKFVYDNVQYLEFTKELKK

SEQ ID NO: 1100 - protein, 745 aa, unidentified
  REGION 1..745: note = Description of Unknown:uncultivated organism sequence
  REGION 1..745: note = Category: MG60 effectors
  REGION 1..745: note = Description: MG60-315 effector
MIIIKKNPEAEKKAGAKYVIKRNGSEDLFDEDKIVNALFKANDSTIKNKITKKQIGEIADHIKRKVDETPHALNIEDIQDMVENELMQIRAFDVARSYITYRYKRALARQHNTTDDKILSLIEHNNEEVKQENSNKNPIVNSVQRDYMAGEVSKDLCKRVFLPGDIWEAHEDGLIHFHDADYFAQHMHNCCLVNLEDMLQNGTVISGTMIDKPKSFATACNIATQAIAQIASQQYGGQTMSIAHLAPFVEISRQKYMKKQRESMEKAGVKATETQLASIVEDMVDEEIKRGVQMIQYQLITLMTTNGQAPFVTIYMYLNECRDEKTKADMVKIIREMFLQRIQGVKNEQGVWVTPAFPKLIYVLEEDNIREGSRYWELTQLAAKCTAKRMVPDYISEKIMKQLKNGDVYSCMGCRSFLTVDRTNGNIANATNYKEGEHKYYGRFNQGVVTLNLVDVACTSAGDEDYFWEILDKRLELCHKALRIRHERLLGTPSDVAPILWQHGALARLKKGETIDKLLYGGYSTISLGYAGLCECTRYMKGVSHTDPDGTEFAMKVMQRLNDACAKWKEAENIDYSVYGTPLESTTYKFAKCLQKRFGIIPGVTDKNYITNSYHVHVTEKINAFDKLKFEAPFQKLSPGGAISYVEVPNLQNNIEAVLSIMQYIYDNIMYAELNTKSDYCEACGYDGEIKIVEDEHGKLVWECPNCGNRDQSRMSVARRTCGYIGTQFWNQGRTQEIKERFVHL

SEQ ID NO: 1101 - protein, 765 aa, unidentified
  REGION 1..765: note = Description of Unknown:uncultivated organism sequence
  REGION 1..765: note = Category: MG60 effectors
  REGION 1..765: note = Description: MG60-316 effector
MSEKHHSHCLDAMEINDLQCIMRVRSILYRNIKEGVIMDAVHTNVIKRNGEEVNFDLDKIVNAINAANKEVDRLHQLNDYQVQAIADNIAKQIEIMTHAIHVEDIQDMVETGIMEMRGYEVAQKYVRYRYKRELARKSNTTDNGILALIDHMNEEVNQENSNKNPVINSTQRDYMAGEVSKDLTKRMLLPKEIVEAHEQGIIHFHDSDYFAQREHNCDLVNLEDMLQNGTVISETMIEKPHSFFTACNVTTQIVAQVASNQYGGQSFTLSHIAPFVDVSRKKIREQVIEERKMCGEALDEEVISKITESRLRAEVKSGIQTIQYQLITLMTCNGQAPFVTMFMYLDEVPEGQTRDDLAMIIEEVLQQRIQGVKNEKGIWITPAFPKLIYVLDKDNITEDSKYWYLTELAAKCTAKRMVPDYISAKVMRELKNGDVYPCMGCRSFPTSEDSQRNPDGTRKYYGRFNQGVVTINLVDVACSAEGHMDRFWEILESRLELCHRALRCRHERLLGTVSDVAPILWQHGALARLKKGETIDKLLFNGYSTISLGYAGLCEMCVRMTGKTHTSLEGKKLALEVMQKLNDKCKEWKEAENISYSVYGTPMESTTYKFAKCLQKRFGIIKGVTDKNYITNSYHIHVTEPVNAFDKLKFESEFQKLSPGGAISYVEVPNLQDNVEAVISVMKFIYDNILYAELNTKSDYCEICGYDGEIKIVTDENGKLIWECPNCGNRDQNNLFVARRTCGYIGTQFWNQGRTQEIKDRVLHL

SEQ ID NO: 1102 - protein, 638 aa, unidentified
  REGION 1..638: note = Description of Unknown:uncultivated organism sequence
  REGION 1..638: note = Category: MG60 effectors
  REGION 1..638: note = Description: MG60-317 effector
MKVIKRDGRVVDFNREKIAIAIEKANQEVTEKERADKQDIKDIIKYIESLDKKRILVEDVQDIIEEQLMDKKKFKLAKKYMIYRYNRALVRKKNTTDESILGLIKNQNMEMLEDGTRKNAVLASSQRDYIAGEVSKDLTKRLLLPEKIVKAHGEGVLYFHDMDYFLQPIFNSSVINIGDMLDNGTVINGKLIESPKSFRVACTVLAQILATVASTQYGGQSVDISHLGKYVRKSYEKFKEEFGGVSSNEILDKKIKEEVTSGVQTLQYQINTLMTTNGRSPLVSLFMYLRKGDEYIKENALIIEEILKQRIEGMKDAEGKYINPEFPKLIYVIDENNCLNGEKYDYLTHLALECANKTQEPSFISAKKMRENYSGNVFSPMGFRSFLTPWKDENGTYKFEGRFNQGIVSINLPQIAIVADGDEDKFFSLLDERLELCHEALLCRHYALLGTVSDTSPIHWIYGAIAHLKSGEKIDKYLKDGYSTISLGYVGVYEATMMMKEVSNTELNGKEFAIKIVKYLKETVEKWKKASGLGFCLYGETSQKVCKTFERIDKERFGVIKNVTDKEKYTSSYHASEDEKIDYKEKLAFESVFQKLSLGGVVSQIPSEYIGELSDKEEFIKFVYDNVQYLEFTKELKK

SEQ ID NO: 1103 - protein, 720 aa, unidentified
  REGION 1..720: note = Description of Unknown:uncultivated organism sequence
  REGION 1..720: note = Category: MG60 effectors
  REGION 1..720: note = Description: MG60-318 effector
MKVIKRDGHMVDYSPEKIENAIIKANTEVDDDEQASSTQIKNIIKYIEKLGKKRILVEDIQDIIEMKLMSIGKYTLAKKYITYRYTRELVRRSNTTDLAIKELIDGESEYWNTENSNKNAKVVTTQRDYLAGITSTDITRRFLLPEDIVKAHDEGIIHFHDADYFAQNALHNCDLINLEDMLQNGTNINGVMIEKPHRFLTAMTIATQIITGVASSQYGGCTISLAHLAPFVRDSKKLYEAKYKRRKLSKEQIDQFVKEDLAKEVTDGVQTFQYQINSMTTTNGQAPFLSVCLYLGETEEYKEELAMLIEEVLKQRIQGMKNEKGVYITPAFPKLLYVLEEDNIKVGSKYYYLTELAAKCTAKRMVPDYISEKVMKETKIDKNGDGQCYPCMGCRSFLTPYLDSDGKPKYYGRFNQGVVTINLVDVALSSDKDMNKFWNIFEERLELAHRALQIRHKRLSKVTSDVAPILWQHGALARLKKGESIHDLLHNGYSTISLGFAGLYECVKYMTGKSHTDNAEGREFGLQVMQKMDDKCDEWKKEENIDYSVYGTPIESTTYKFAKCLKERFGVIKGITDRDYITNSYHVPVFEEIDAFTKLKLESEFQKLSPGGAISYIETPNLTNNIDVVLEIIKFIYDNIMYAELNTKSDYCQECGYDQEILLDENLEWYCPNCGNRNHDTLNVARRTCGYIGTNFWNKGRTQEIKDRVIHIDNKDLDEE

SEQ ID NO: 1104 - protein, 724 aa, unidentified
  REGION 1..724: note = Description of Unknown:uncultivated organism sequence
  REGION 1..724: note = Category: MG60 effectors
  REGION 1..724: note = Description: MG60-319 effector
MNVIKRSGEEVVFDASKIENAIKKANKATTHNQMSDELIRSVTQSVIDKCENLKRSPNVEEIQDMVEGELMEHRCFAVAHNYITYRYERALVRKANSTDKQIMSLLERNNEEVKQENSNKNPLVNSVQRDYMAGEVSKDITKRFLLPQDVMEAHEQGIIHFHDSDYFAQHMHNCCLVNLEDMLQNGTVISETMIEKPHSFSTACNVATQIIAQVASSQYGGQSITLSHLAPFVQVSREKARREVKEELESLNLDSSEDTVNKMAEMRVRKEIEKGVQMIQYQVITLMTTNGQAPFVTVFMYLNEVPEGQTRDDLAIIIEEMLKQRIKGVKNEKGIWITPAFPKLIYVLEENNIEEGSKYWYLTELAARCTAKRMVPDYISEKKMLELKVDANGEGHCYPCMGCRSFLTTYLDENGKPKYYGRFNQGVVTLNLVDVACSSKQNEEAFWRIMDERLALCKKALMCRHERLLGTPSDVAPILWQNGALARLKKGEPIDKLLFGGYSTISLGYAGLCECVYYMTGHPHTEEPGTSFGLKVMQYLNDACAKWKAEENIDFSLYGTPMESTTFKFSKHLQERFGIIPHVTDKNYITNSYHVHVTEEIDAFTKLSFESQFQKLSPGGAISYVEVPNMENNIDAVLAIMKHIYNHIMYAELNTKSDYCQVCGYTGEIKIVEDENHKLVWECPNCGNRDQEKMNVARRTCGYIGTQFWNQGRTQEIKERVLHL

SEQ ID NO: 1105 - protein, 634 aa, unidentified
  REGION 1..634: note = Description of Unknown:uncultivated organism sequence
  REGION 1..634: note = Category: MG60 effectors
  REGION 1..634: note = Description: MG60-320 effector
MKVIKRDGRVVDFNREKIAIAIEKANQEVTEKERADKQDIKDIIKYIESLDKKRILVEDVQDIIEEQLMDKKKFKLAKKYMIYRYNRALVRKKNTTDESILGLIKNQNMEMLEDGTRKNAVLASSQRDYIAGEVSKDLTKRLLLPEKIVKAHEEGVLYFHDMDYFLQPIFNSSVINIGDMLDNGTVVNGKLIESPKSFRVACTVLAQILATVASTQYGGQSVDISHLGKYVRKSYEKFKEEFGGMPSKEILDKKIKEEVTSGVQTLQYQINTLMTTNGRSPLVSLFMYLREGDEYIKENALIIEEILKQRIEGMKDAEGKYINPEFPKLIYVIDENNCLNGEKYDYLTQLALECANKTQEPSFISAKKMRENYSGNVFSPMGFRSFLTPWKDENGTYKFEGRFNQGIVSINLPQIAIVADGDEDKFFSLLDERLELCHEALLCRHYALLGTVSDTSPIHWIYGAIAHLKSGEKIDKYLKDGYSTISLGYVGVYEATMMMKEVSNTEPEGKEFAIKIVKHLKETVEKWKKASGLGFCLYGETSQKVCKTFERIDKERFGVIKNVTDKEKYTSSYHASEDEKIDYKEKLAFESVFQKLSLGGVVSQIPSEYIGKLSDKEEFIKFVYDNVQYLEFTK

SEQ ID NO: 1106 - protein, 740 aa, unidentified
  REGION 1..740: note = Description of Unknown:uncultivated organism sequence
  REGION 1..740: note = Category: MG60 effectors
  REGION 1..740: note = Description: MG60-321 effector
MKIIKRNGSEAVFDITKIIAAVTKANNVVPESQRLTNHQIIELADKVQASCLSRGHAMNVEEIQDIVEDAIMATGAYEVARKYITYRYVQNLKRTHNTTDDRILSLIECNNEEVKQENSNKNPTVNSVQRDYMAGEVSKDLTMRMLLPPEIVKAHEEGIIHFHDADYYAQHMHNCDLVNLDDMLQNGTVISGTLIEKPHSFSTACNIATQIIAQVASSQYGGQSISLTHLAPFVDVSRKKIRRDVEAEMKELGINPGEEKISEIVEARLREEIKRGVQTIQYQVVTLMTTNGQAPFITVFMYLGEAGDNQRLKSDLAIIIEEMLRQRYQGVKNEAGVWITPAFPKLIYVLEEDNIREGTPYFYLTKLAAKCTAKRLVPDYISEKKMKEYKLSKGETEGNGDVYTCMGCRSFLTPDRSGNGWDNIANAKNYDGKPKYYGRFNQGVVTINLVDVALSSGGDFDKFWKIFDERLELCHKALMCRHNRLKGTLSDAAPILWQYGALARLEKGEPIDKLLYGGYSTISLGYAGLYECCKYMTGKSHTDPAAKPFALHVMQHMNDACQTWKKQHNIDFSLYGTPLESTTYKFAKCLQKRFGIIPGITDRNYITNSYHVHVTEQIDAFTKLKFESEFQKLSPGGAISYVEVPNMQDNLEAVIKVMQFIYDNIMYAELNTKSDYCQVCGYDGEISIVEEDGKLIWECPKCHNRDQNKLNVARRTCGYIGTQFWNQGRTAEIKDRVLHL

SEQ ID NO: 1107 - protein, 728 aa, unidentified
  REGION 1..728: note = Description of Unknown:uncultivated organism sequence
  REGION 1..728: note = Category: MG60 effectors
  REGION 1..728: note = Description: MG60-322 effector
MDAVHTNVIKRNGEEVNFDLDKIVNAINAANKEVDRLHQLNDYQVQAIADNIAKQIEIMTHAIHVEDIQDMVETGIMEMRGYEVAQKYVRYRYKRELARKSNTTDNGILALIDHMNEEVNQENSNKNPVINSTQRDYMAGEVSKDLTKRMLLPEEIVEAHEQGIIHFHDSDYFAQREHNCDLVNLEDMLQNGTVISETMIEKPHSFFTACNVTTQIVAQVASNQYGGQSFTLSHIAPFVDVSRKKIREQVIEERKMCGEALDEEVISKITESRLRAEVKSGIQTIQYQLITLMTCNGQAPFVTMFMYLDEVPEGQTRDDLAMIIEEVLQQRIQGVKNEKGIWITPAFPKLIYVLDKDNITEDSKYWYLTELAAKCTAKRMVPDYISAKVMRELKNGDVYPCMGCRSFPTSEDSQRNPDGTRKYYGRFNQGVVTINLVDVACSAEGHMDRFWEILESRLELCHRALRCRHERLLGTVSDVAPILWQHGALARLKKGETIDKLLFNGYSTISLGYAGLCEMCVRMTGKTHTSPEGKKFALEVMQKLNDKCKEWKEAENISYSVYGTPMESTTYKFAKCLQKRFGIIKGVTDKNYITNSYHIHVTEPVNAFDKLKFESEFQKLSPGGAISYVEVPNLQDNVEAVISVMKFIYDNILYAELNTKSDYCEICGYDGEIKIVTDENGKLIWECPNCGNRDQNNLFVARRTCGYIGTQFWNQGRTQEIKDRVLHL

SEQ ID NO: 1108 - protein, 724 aa, unidentified
  REGION 1..724: note = Description of Unknown:uncultivated organism sequence
  REGION 1..724: note = Category: MG60 effectors
  REGION 1..724: note = Description: MG60-323 effector
MNVIKRSGEEVVFDASKIENAIKKANKATTHNQMSEELIRSVTQSVIDKCENLKRSPNVEEIQDMVEGELMEHRCFAVAHNYITYRYERALVRKANSTDKQIMSLLERNNEEVKQENSNKNPLVNSVQRDYMAGEVSKDITKRFLLPQDVMEAHEQGIIHFHDSDYFAQHMHNCCLVNLEDMLQNGTVISETMIEKPHSFSTACNVATQIIAQVASSQYGGQSITLSHLAPFVQVSREKARREVKEELESLNLDSSEDTVNKMAEMRVRKEIEKGVQMIQYQVITLMTTNGQAPFVTVFMYLNEVPEGQTRDDLAIIIEEMLKQRIKGVKNEKGIWITPAFPKLIYVLEENNIEEGSKYWYLTELAARCTAKRMVPDYISEKKMLELKVDVNGEGHCYPCMGCRSFLTTYLDENGKPKYYGRFNQGVVTLNLVDVACSSKQDEEAFWRIMDERLALCKKALMCRHERLLGTPSDVAPILWQNGALARLKKGEPIDKLLFGGYSTISLGYAGLCECVYYMTGHPHTEEPGTSFGLKVMQYLNDACAKWKAEENIDFSLYGTPMESTTFKFSKHLQERFGIIPHVTDKNYITNSYHVHVTEEIDAFTKLSFESQFQKLSPGGAISYVEVPNMENNIDAVLAIMKHIYNHIMYAELNTKSDYCQVCGYTGEIKIVEDENHKLVWECPNCGNRDQEKMNVARRTCGYIGTQFWNQGRTQEIKERVLHL

SEQ ID NO: 1109 - protein, 724 aa, unidentified
  REGION 1..724: note = Description of Unknown:uncultivated organism sequence
  REGION 1..724: note = Category: MG60 effectors
  REGION 1..724: note = Description: MG60-324 effector
MNVIKRSGEEVVFDASKIENAIKKANKATTHNQMSDELIRSVTQSVIDKCENLKRSPNVEEIQDMVEGELMEHRCFAVAHNYITYRYERALVRKANSTDKQIMSLLERNNEEVKQENSNKNPLVNSVQRDYMAGEVSKDITKRFLLPQDVMEAHEQGIIHFHDSDYFAQHMHNCCLVNLEDMLQNGTVISETMIEKPHSFSTACNVATQIIAQVASSQYGGQSITLSHLAPFVQVSREKARREVKEELESLNLDSSEDTVNKMAEMRVRKEIEKGVQMIQYQVITLMTTNGQAPFVTVFMYLNEVPEGQTRDDLAIIIEEMLKQRIKGVKNEKGIWITPAFPKLIYVLEENNIEEGSKYWYLTELAARCTAKRMVPDYISEKKMLELKVDANGEGHCYPCMGCRSFLTTYLDENGKPKYYGRFNQGVVTLNLVDVACSSKQDEEAFWKIMDERLALCKKALMCRHERLLGTPSDVAPILWQNGALARLKKGEPIDKLLFGGYSTISLGYAGLCECVYYMTGHPHTEEPGTSFGLKVMQYLNDACAKWKAEENIDFSLYGTPMESTTFKFSKHLQERFGIIPHVTDKNYITNSYHVHVTEEIDAFTKLSFESQFQKLSPGGAISYVEVPNMENNIDAVLAIMKHIYNHIMYAELNTKSDYCQVCGYTGEIKIVEDENHKLVWECPNCGNRDQEKMNVARRTCGYIGTQFWNQGRTQEIKERVLHL

SEQ ID NO: 1110 - protein, 716 aa, unidentified
  REGION 1..716: note = Description of Unknown:uncultivated organism sequence
  REGION 1..716: note = Category: MG60 effectors
  REGION 1..716: note = Description: MG60-325 effector
MLEVIKRNGQKVPFDRDKITIAIEKAMNSSSGVYEEGQAAKIAGEIEAYAASIHKDMTIYAIEDQVYYRLLKYNNPATARAYENYKAIQSFKRQTNTTDNDVFGLLNNTNLEVLNENSNKNGHVVSTQRDLIAGEVSKDIARRKLIPADIVQAHDSGAIHFHDMDYIIQPMFNCCLINLEDMLANGTVINGKKIDTPKSFQVACTVTTQIIAQVASGQYGGQSINGIDRILAPYVRKSFKKYMSAVVEEQREVYGIEPDMEKAEEIAWKRTKKEIKDGIQTIQYQINTLMTTNGQAPFVTLFMYFQPDYEYAKEAALIDEELLRQRIQGIKNDANVYVTPAFPKLIYVLDEHNVREGSPYFYLTKLAAECTAKRMYPDYISAKKMRESYEGNVFSPMGCRSFLSPWKDAQGNYKFDGRFNMGVVSLNLPQIGILADGDEEKFFQILDKRLELCKKALLLRVELLKKVTSDVSPIHWQYGAIARLQPGETIEKFIYGGYATLSLGYIGMYEATVLTKHCSHTTPEGRKFAMRIMDDLNAHIQQWKKETNIGFALYGTPAENLTNRFCKIDKARFGSIANVTDKDYYTNSYHVDVREPINVFDKFSFEADFEDKSTGGCISYAEIPNMSHNIPAVLTMIQYIYDHIAYGEFNTKLDYCHECGFDGEIILNDDNQWECPRCHNQDRNKLTVIRRTCGYLGENFWNEGRTQEITNRVLHI

SEQ ID NO: 1111 - protein, 1117 aa, unidentified
  REGION 1..1117: note = Description of Unknown:uncultivated organism sequence
  REGION 1..1117: note = Category: MG60 effectors
  REGION 1..1117: note = Description: MG60-326 effector
MKIIKRNGSEQEFNPSKIHVAMTKAFRSVEEGKTVSEETIANLTAKAMAKVQEIPHTPNVEEVQDIVENVLMDSGFHDVSRSYIKYRFTHAVRRNTTDAAILSLIEAENEEVKQENANKNPTVASVQRDYMAGEVSKDLTMRLLLPEEIAKAHNEGILHFHDADYYAQHMHNCCLINLDDMLQNGTVISGTMIEKPHRFSTACNIATQIIAQVASCQYGGQSISLTHLAKFVDVSRKAIRKEVETENKEAAINMTECQMNEVVERRLRKEIRAGIQTIQYQIITLMTTNGQAPFVTVFMYLDEAGNDETLKHDLAICIEEMLKQRYEGVKNEVGVWITPAFPKLIYVLDEDNIRPESPFFYLTKLAAKCTAKRMVPDYISAKKMREYKLSKGETEGHGDVYTCMGCVTGDEVVVYKYLGTMYTESFERMWRRLSAHFPVETQPGRTNDLYIDLHGVSIYDNKLSDFTECHRIIRNENSKILRLKFSNGRVLDCTPDHPFETENRGVVRADELASDDVIMADKKSAFVFSEDGVVPYNTDLAWALGLLLCDASYDGTIVLSLANEGEDDIAQKFSNVMKTTYGLNTNCVVQSRERKGVYKDILCVSDGKRTIQKVCDFLVGEFGGKKKMLRHIPSEVFTWDEDARFAFLAGMIDADGYINNSQRVPAVQIGSINKELAIQQALLAQSLGMPASIYMNHYKGEGRGDTIRYHVTFVPCSRLMEFIVCDKKKAHFNDEVRKNHSISETSYCKMAERMELSGEYATYDVTTASEHFMVSGLYSHNCRSFLTPDRSGNGWNNIANAKNYEPGEPKYYGRFNQGVVTINLPDVALSSGGDFEKFWQIFDERLELCHKALQYRHKRLEGTLSDTSPIHWQYGALARLQKGEPIDKLLHGGYSTISLGYAGLYECCKYMTGKSHTDPDAKPFALKVMQHMNDMCAKWKAEEDIDYSLYGTPLESTTYKFAKCLDRRFGKEWYKISGGKNYITNSYHVHVTEQIDAFTKLKFESEFQKLSPGGAISYVEVPNMQDNLAAVIKVMQFIYDNIMYAELNTKSDYCQVCGYDGEIQIVDDDGKLVWECPNCHNRDFSKMNVARRTCGYIGCQGFNAGRTAEIRDRVLHL

SEQ ID NO: 1112 - protein, 638 aa, unidentified
  REGION 1..638: note = Description of Unknown:uncultivated organism sequence
  REGION 1..638: note = Category: MG60 effectors
  REGION 1..638: note = Description: MG60-327 effector
MKVIKRDGRVVDFNREKIAIAIEKANQEVTEKERADKQDIKDIIKYIEALDKKRILVEDVQDIIEEQLMDKKKFKLAKKYMIYRYNRALVRKKNTTDESILGLIKNQNMEMLEDGTRKNAVLASSQRDYIAGEVSKDLTKRLLLPEKIVKAHEEGILYFHDMDYFLQPIFNSSVINIGDMLDNGTVINGKLIESPKSFRVACTVLAQILATVASTQYGGQSVDISHLGKYVRKSYEKFKEEFGDVPSKEILDKKIKEEVTSGVQTLQYQINTLMTTNGRSPLVSLFMYLREDDEYIKENALIIEEILNQRIEGMKDAEGKYINPEFPKLIYVIDENNCLNNGKYDYLTHLALDCANKTQEPSFISAKKMRENYSGNVFSPMGFRSFLTPWKDENGTYKFEGRFNQGIVSINLPQIAIVADGDEDKFFSLLDERLELCHEALLCRHYALLGTVSDTSPIHWIYGAIAHLKSGEKIDKYLKDGYSTISLGYVGVYEATIMMKEVSNTEPDGKEFAIKIVKHLKETVEKWKKTSGLGFCLYGETSQNVCKTFERIDKERFGVIKNVTDKEKYTSSYHSSENEKIDYKEKLAFESEFQKLSLGGVVSQIPRGYIGELSDKEEFIKFVYDNVQYLEFTEEFVK

SEQ ID NO: 1113 - protein, 724 aa, unidentified
  REGION 1..724: note = Description of Unknown:uncultivated organism sequence
  REGION 1..724: note = Category: MG60 effectors
  REGION 1..724: note = Description: MG60-328 effector
MNVIKRSGEEVVFDSIKIENAIKKANKATTHNQMSDELIHTVTQSVVDKCENLKRSPNVEEIQDMVEGELMEKRCFAVAHNYITYRYERALVRKANSTDKQIMSLLERNNEEVKQENSNKNPLVNSVQRDYMAGEVSKDITKRFLLPQDVMEAHEQGIIHFHDSDYFAQHMHNCCLVNLEDMLQNGTVISETMIEKPHSFSTACNVATQIIAQVASSQYGGQSITLSHLAPFVQVSREKARREVKEELESLNLDSSEDTVNKMAEMRVRKEIEKGVQMIQYQVITLMTTNGQAPFVTVFMYLNEVPEGQTRDDLAIIIEEMLKQRIKGVKNEKGIWITPAFPKLIYVLEENNIEEGSKYWYLTELAAKCTAKRMVPDYISEKKMLELKVDANGEGHCYPCMGCRSFLTTYLDENGKPKYYGRFNQGVVTLNLVDVACSSKQDEEAFWRIMDERLALCKKALMCRHERLLGTPSDVAPILWQNGALARLKKGEPIDKLLFGGYSTISLGYAGLCECVYYMTGHPHTEEPGTSFGLKVMQYLNDACAKWKAEENIDFSLYGTPMESTTFKFSKHLQERFGIIPHVTDKNYITNSYHVHVTEEIDAFTKLSFESQFQKLSPGGAISYVEVPNMENNIDAVLAIMKHIYNHIMYAELNTKSDYCQVCGYTGEIKIVEDENHKLVWECPNCGNRDQEKMNVARRTCGYIGTQFWNQGRTQEIKERVLHL

SEQ ID NO: 1114 - protein, 760 aa, unidentified
  REGION 1..760: note = Description of Unknown:uncultivated organism sequence
  REGION 1..760: note = Category: MG60 effectors
  REGION 1..760: note = Description: MG60-329 effector
MKVIKRDCSEVDFDKSKISTAILKAMKNGSGIVKQKIAEDIANEIEEDCKDKDEVSISDIESMVYDKLITKKQRLTAKAYEGYRSIREFQRENENTIDTEITELLSGESDYWNNENSNKNPRLNTTQRDYLAGIVSKDASRRYILPPEIVQAHDDGLIHVHDLDYLIQYMNNCCLINLEDMLQNGTVISETLIEKPHSFSTACTVATQIIAQVASSQYGGQSISLAHLAPFVDISRQKIRKEVIEEQEYLYRNIDEKEWVKPRKVLGKKLRKDQEKFYKNKDRLLKFIDATDIEDIVEKRLKKEIEKGIQTIQYQITTLMTTNGQAPFITLFMYLNEAHNQREKDDLAMLIEEELRQSYLGVKNEEGVYITPAFPKVIYVLQEDNIHEEDKYWYLTEMAAKCSMKRLTPDYISEKIMKEMKDGNCYPVMGCRSALTVWYDENGKPKFYGRFNSGVVTVSLPDIALSSGGDFNEFWRIFDERTELCHKALKIRHQRLRGTKSDVAPILWQHGAFARLKKGESIDKLLFGGYSTLSLGYAGLAECVKYMTGHYHCDEGIGEKFGLEVMQALNDKCSQWKIDENIDYSLYGTPLEATTEKFAKKLKERFGIIEGVTDRTYITNSYHIPVFIHIDAFGKLRIEAKFQRLSPGGSISYIECPNMENNIPAVLEVMKFIYNNNMYAELNTKSDYCQKCGWSKEIKLIDEGGKLIWECPNCGNRDVRTMDITRRTCGYKGTARNGWNQGRLGDIHDRVPHLDDIEEE

SEQ ID NO: 1115 - protein, 638 aa, unidentified
  REGION 1..638: note = Description of Unknown:uncultivated organism sequence
  REGION 1..638: note = Category: MG60 effectors
  REGION 1..638: note = Description: MG60-330 effector
MKVIKRDGRVVDFNREKIAIAIEKANQEVTEKERADKQDIKDIIKYIESLDKKRILVEDVQDIIEEQLMDKKKFKLAKKYMIYRYNRALVRKKNTTDESILGLIKNQNMEMLEDGTRKNAVLASSQRDYIAGEVSKDLTKRLLLPEKIVKAHGEGVLYFHDMDYFLQPIFNSSVINIGDMLDNGTVINGKLIESPKSFRVACTVLAQILATVASTQYGGQSVDISHLGKYVRKSYEKFKEEFGGVSSNEILDKKIKEEVTSGVQTLQYQINTLMTTNGRSPLVSLFMYLRKGDEYIKENALIIEEILKQRIEGMKDAEGKYINPEFPKLIYVIDENNCLNGEKYDYLTHLALECANKTQEPSFISAKKMRENYSGNVFSPMGFRSFLTPWKDENGTYKFEGRFNQGIVSINLPQIAIVADGDEDKFFSLLDERLELCHEALLCRHYALLGTVSDTSPIHWIYGAIAHLKSGEKIDKYLKDGYSTISLGYVGVYEATMMMKEVSNTELNGKEFAIKIVKSLKETVEKWKKASGLGFCLYGETSQKVCKTFERIDKERFGVIKNVTDKEKYTSSYHASEDEKIDYKEKLAFESVFQKLSLGGVVSQIPSEYIGELSDKEEFIKFVYDNVQYLEFTKELKK

SEQ ID NO: 1116 - protein, 634 aa, unidentified
  REGION 1..634: note = Description of Unknown:uncultivated organism sequence
  REGION 1..634: note = Category: MG60 effectors
  REGION 1..634: note = Description: MG60-331 effector
MKVIKRDGRVVDFNREKIAIAIEKANQEVTEKERADKQDIKDIIKYIESLDKKRILVEDVQDIIEEQLMDKKKFKLAKKYMIYRYNRALVRKKNTTDESILGLIKNQNMEMLEDGTRKNAVLASSQRDYIAGEVSKDLTKRLLLPEKIVKAHEEGVLYFHDMDYFLQPIFNSSVINIGDMLDNGTVINGKLIESPKSFRVACTVLAQILATVASTQYGGQSVDISHLGKYVRKSYEKFKEEFGGVPSKEILDKKIKEEVTSGVQTLQYQINTLMTTNGRSPLVSLFMYLREGDEYIKENALIIEEILKQRIEGMKDAKGKYINPEFPKLIYVIDENNCLNGEKYDYLTHLALECANKTQEPSFISAKKMRENYSGNVFSPMGFRSFLTPWKDENGTYKFEGRFNQGIVSINLPQIAIVADGDEDKFFSLLDERLELCHEALLCRHYALLGTVSDTSPIHWIYGAIAHLKSGEKIDKYLKDGYSTISLGYVGVYEATMMVKEVSNNEPEGKEFAIKIVKHLKETVEKWKKASGLGFCLYGETSQKVCKTFERIDKERFGVIKNVTDKEKYTSSYHASEDEKIDYKEKLAFESVFQKLSLGGVVSQIQSKYIGELNDKEEFIKFVYDNVQYLEFIK

SEQ ID NO: 1117 - protein, 724 aa, unidentified
  REGION 1..724: note = Description of Unknown:uncultivated organism sequence
  REGION 1..724: note = Category: MG60 effectors
  REGION 1..724: note = Description: MG60-332 effector
MNVIKRSGEEVVFDASKIENAIKKANKATTHNQMSDELIRSVTQSVINKCENLKRSPNVEEIQDMVEGELMEHRCFAVAHNYITYRYERALVRKANSTDKQIMSLLERNNEEVKQENSNKNPLVNSVQRDYMAGEVSKDITKRFLLPQDVMEAHEQGIIHFHDSDYFAQHMHNCCLVNLEDMLQNGTVISETMIEKPHSFSTACNVATQIIAQVASSQYGGQSITLSHLAPFVQVSREKARREVKEELESLNLDSSEDTVNKMAEMRVRKEIEKGVQMIQYQVITLMTTNGQAPFVTVFMYLNEVPEGQTRDDLAIIIEEMLKQRIKGVKNEKGIWITPAFPKLIYVLEENNIEEGSKYWYLTELAAKCTAKRMVPDYISEKKMLELKVDVNGEGHCYPCMGCRSFLTTYLDENGKPKYYGRFNQGVVTLNLVDVACSSKQDEEAFWRIMDERLALCKKALMCRHERLLGTPSDVAPILWQNGALARLKKGEPIDKLLFGGYSTISLGYAGLCECVYYMTGHPHTEEPGTSFGLKVMQYLNDACAKWKAEENIDFSLYGTPMESTTFKFSKHLQERFGIIPHVTDKNYITNSYHVHVTEEIDAFTKLSFESQFQKLSPGGAISYVEVPNMENNIDAVLAIMKHIYNHIMYAELNTKSDYCQVCGYTGEIKIVEDENHKLVWECPNCGNRDQEKMNVARRTCGYIGTQFWNQGRTQEIKERVLHL

SEQ ID NO: 1118 - protein, 780 aa, unidentified
  REGION 1..780: note = Description of Unknown:uncultivated organism sequence
  REGION 1..780: note = Category: MG60 effectors
  REGION 1..780: note = Description: MG60-333 effector
MENEVNNKVETEEEVLSSNVDVIKRNGKEVRFDQRKIQAAIRKANKDVDERYRISDIQIRTISYMIKLWVKELGHTPTVDEIQDKVVISLGHESPELQHAYDIYRYDRDLERNGNSTDREILSLVDRQNEIAMQENSNKNPIVESTQRDYIAGLVSRDISERILFDKDLVEAHREGKIHIHDTDYFLQTIHNCDLVNLEDMLQNGTVISGTLIRKPHSFRTACNIATQVIAQVASAQYGGQTITLSHLAPFVDVSRQAIRKAVIEEGKISGVDYTDEIIDKITHSRLKKEITDGIQTLNYQLVTLLTTNGQTPFVTIFMYIDEVPEGQTREDLVLIIEEVLRQRMDGTENEDGVKTTPAFPKLIYCLDEDNVKEGTKYWDTTVLAAQCTAKRMNPDYISAKIMREQKGDVYPCMGCRSFLTPDRTQKEFEVVKEDGTTEIVKPLGNIANAKNYDEANHKYYGRFNQGVCTISLPDVALSSGGDKEKFWKIFDERLEMCHRVLQTRHNRLMGTPSDVAPILWQYGALARLEKHETIDKLLFHGYSTISLGYAGLYECTKYMTGESHTDEKAGKPFALEVMKHMNDACAKWKKAEDIDYSLYGTPIESTTYKFAKALQTRFGIVEGITDHGYITNSYHVNVREKIDAFKKLEFEAEFQNLSPGGAVSYVEVPDMQSNIPAVLSIMQYIYEHIMYAELNTKSDYCMNCGYDGEIQIVKNENGKLIWKCPKCGNTDQSKMSVARRTCGYIGTQYWNQGRTEEIQDRVMHVSLENFKPCSCGCDS

SEQ ID NO: 1119 - protein, 873 aa, unidentified
  REGION 1..873: note = Description of Unknown:uncultivated organism sequence
  REGION 1..873: note = Category: MG60 effectors
  REGION 1..873: note = Description: MG60-334 effector
MPKFFATCPKGLEGLLNAELVQLGAESVKETVAGVSFSGDLNLAVRVCLWTRFATRVLLTIGSFHTDSDIELYNGAYSLHYEDYFSSDQTISVDFNGQNSFINNTLYGALRVKDALCDRFVKLTGSRPNVDRENPDVCINAHLDKKNNVTISLDLSGKALHRREYRTEAGIAPLKENLAAAIVARSGYVSGSVVDPMCGSGTLLIEAAMKAADIAPGLFRSSYGFEKLKDFDAVEFTHYKREAHARAEAGKQRLIDARVSFYGFDRDPAVLEKAVQNVERAGLSQLIKFTAGDLHELKNPVTSGSKGFVITNPPYGERLGNVAELLELYSSLGFCLKKEFAGWKATVISSSEDLLSCLRLRADKTYRLYNGALECQLRVYSIGEKLQVTDDGSENAGRITDSGKDAGFTLSTETLRVAEEFANRLKKNLKRLEKWAAREGIEAYRIYDADLPNYNAAIDLYGSYVVIQEYAAPNSVDAKIAHRRMLDLIQVVVGVTGIKGDHVILKVRERKKGESQYEKLNETKHTLLVREYMASFIVNLWDYLDTGLFLDHREVRRMITKMSAGKSFLNIFSYTGSATVAAAIGGARETTTVDMSRTYLAWAKDNMLANGFSGRNHQFIQADCLRWLDISPKTYDLIFADPPTFSNSKRMEATFDVQRDHVALIAKLTRLLNLGGTLIFSNNNRSFKLDSDAITAMGYKITDVSEKTVQEDFRRNKKIHCCFILEKVIDVPVPEDYSDASFGSVSGLKAKVEYLNGGVSGDRREGRGGRERPVRDGRDGAPGRERNGSFRKHDNDAFGKSRSYTFRNGERQEAPADGRSFRETDGSENRPVIPAVRRSRMPSRVIGGASAGGQTAPRGPRLSRNIGRKEDKE

SEQ ID NO: 1120 - protein, 719 aa, unidentified
  REGION 1..719: note = Description of Unknown:uncultivated organism sequence
  REGION 1..719: note = Category: MG60 effectors
  REGION 1..719: note = Description: MG60-335 effector
MKVVKRDGKKVEFDAIKIENAILKAMKCGSGIVDEKCAHDIAVEIEKWHEHSDDNISIYRIEGQVFEKLIEKGQILTAKAYEGYRKVREFQRETNTIDNEIYGIVNQTNKEAMEENSNKDATVLATQRDLIAGEFSRDYCRRLLLPPKIVQAHDDGIIHFHDMDYYIQKMHNCDLVNLKDMFAKGTVINDKLIETPKSLQTACTVATQIVQQVANGQYGGQTISLAHLSPFVRLSYEKHQHNVRHEGRLIGIEYTDEQVEKIATSRIKDEIKAGIQTIQYQINTFSTTNGQAPFLSVFMYLREEPEYIKETAMLIEETLRQRYVGMKNPVGAYVTPAFPKLLYVLDDNNVPQDSEYRYLTDLAVKCVSKRMMPDFISAKVMRENYEGQVFPCMGCRSFLSPWKDENGEYKWYGRFNQGVVTLNLADAGLSANHKLDVFWKILDERLELCKEALMLRHESLKGTLSDVSPIHWRYGALARLKSGETIDKLLENGYSTISLGYIGLYECVVSLIGDTHTSKDGNELATKIMQRLREACDSWKEETGLGFGLYGTPAESTTYTFARALKKRFGIVKGITDKDYLTNSYHVNVKEHIDAFDKLKVEAKFQKVSSGGAISYVEVTNMSENLDALSALIDYMYDTIQYAEINTKSDYCQECGFDGEILLDENREWYCPNCGNRNHKSLNVCRRTCGYLGDNFWNQGRTQEIAERFVHLDNHLLGE

SEQ ID NO: 1121 - protein, 716 aa, unidentified
  REGION 1..716: note = Description of Unknown:uncultivated organism sequence
  REGION 1..716: note = Category: MG60 effectors
  REGION 1..716: note = Description: MG60-336 effector
MLEVIKRNGERVPFNRDKITVAIEKAMNSSSGIYEEGQAAKIASEIEAYAASIQKDLTIYAIEDQVYYRLLKYNNPATARAYENYKTIQAFKRQTNTTDDDVFGLLNNTNLEVLDENSNKNGHVVSTQRDLIAGEVSKDIARRKLIPADIVQAHDSGAIHFHDMDYIIQPMFNCCLINLEDMLANGTVINGKKIDTPKSFQVACTVTTQIIAQVASGQYGGQSINGIDRILAPYVRKSFKKYMKAVVEEQREVYGIEPDMEKAEEIAWKRTKKEIKDGIQTIQYQINTLMTTNGQAPFVTLFMYFQPDYEYAREAALIDEELLRQRIQGIKNEANVYVTPAFPKLIYVLDEHNVREGSPYFYLTKLAAECTAKRMYPDYISAKKMRESYEGNVFSPMGCRSFLSPWKDEKGNYQFDGRFNMGVVSLNLPQIGILADGDEEKFFQILDKRLELCKKALLLRVDLLKRITSDVSPIHWQYGAIARLKPGETIEKFIYGGYATLSLGYIGIYEATVLTKHCSHTAPEGRKFAMRIMDDLNAHIKKWRKETNIGFALYGTPAENLTNLFCKIDKARFGSIPDVTDKGYYTNSYHVDVREPINVFDKFSFEADFEDKSTGGCISYAEIPNMTHNIPAVLTMVQYIYDHITYGEFNTKLDYCHECGFDGEIILNDDNEWECPRCHNKDRNKLTVIRRTCGYLGENFWNEGRTQEIKNRVLHI

SEQ ID NO: 1122 - protein, 638 aa, unidentified
  REGION 1..638: note = Description of Unknown:uncultivated organism sequence
  REGION 1..638: note = Category: MG60 effectors
  REGION 1..638: note = Description: MG60-337 effector
MKVIKRDGRVVDFNREKIAIAIEKANQEVTEKERADKQDIKDIIKYIESLDKKRILVEDVQDIIEEQLMDKKKFKLAKKYMIYRYNRALVRKKNTTDESILGLIKNQNMEMLEDGTRKNAVLASSQRDYIAGEVSKDLTKRLLLPEKIVKAHGEGVLYFHDMDYFLQPIFNSSVINIGDMLDNGTVINGKLIESPKSFRVACTVLAQILATVASTQYGGQSVDISHLGKYVRKSYEKFKEEFGGVSSNEILDKKIKEEVTSGVQTLQYQINTLMTTNGRSPLVSLFMYLREGDEYIKENALIIEEILKQRIDGMKDAEGEYINPEFPKLIYVIDKDNCLNGGKYDYLTHLALDCANKTQEPSFISAKKMRENYSGNVFSPMGFRSFLTPWKDENGTYKFEGRFNQGIVSINLPQIAIVADGDEDKFFSLLDERLELCHEALLCRHYALLGTVSDTSPIHWIYGAIAHLKSGEKIDKYLKDGYSTISLGYVGVYEATMMIKEVSNTEPNGKEFAIKIVKHLKETVEKWKKASGLGFCLYGETSQKVCKTFERIDKERFGVIKNVTDKEKYTSSYHASEDEKIDYKEKLAFESVFQKLSLGGVVSQIPSEYIGELSDKEEFIKFVYDNVQYLGFTKELKK

SEQ ID NO: 1123 - protein, 716 aa, unidentified
  REGION 1..716: note = Description of Unknown:uncultivated organism sequence
  REGION 1..716: note = Category: MG60 effectors
  REGION 1..716: note = Description: MG60-338 effector
MLEVIKRNGERVPFNRDKITNAIEKAMNSSSGIYEEGQAAKIASEIEAYAASIQKDLTIYAIEDQVYYRLLKYNNPATARAYENYKTIQAFKRQTNTTDDDVFGLLNNTNLEVLDENSNKNGHVVSTQRDLIAGEVSKDIARRKLIPADIVQAHDSGAIHFHDMDYIIQPMFNCCLINLEDMLANGTVINGKKIDTPKSFQVACTVTTQIIAQVASGQYGGQSINGIDRILAPYVRKSFKKYMKAVVEEQREVYGIEPDMEKAEEIAWKRTKKEIKDGIQTIQYQINTLMTTNGQAPFVTLFMYFKPDYEYAKEAALIDEELLRQRIQGIKNEANVYVTPAFPKLIYVLDEHNVREGNPYFYLTKLAAECTAKRMYPDYISAKKMRESYEGNVFSPMGCRSFLSPWKDEQGNYKFDGRFNMGVVSLNLPQIGILADGDEEKFFQILDKRLELCKKALLLRVDLLKRITSDVSPIHWQYGAIARLKPGETIEKFIYGGYATLSLGYIGIYEATMLTKHCSHTTAEGRKFAMRIMDDLNAHIKKWRKETNIGFALYGTPAENLTNLFCKIDKARFGSIPDVTDKGYYTNSYHVDVREPINVFDKFSFEADFEDKSTGGCISYAEIPNMTHNIPAVLTMVQYIYDHIAYGEFNTKLDYCHECGFDGEIILNDDNEWECPRCHNKDRNKLTVIRRTCGYLGENFWNEGRTQEIKNRVLHI

SEQ ID NO: 1124 - protein, 724 aa, unidentified
  REGION 1..724: note = Description of Unknown:uncultivated organism sequence
  REGION 1..724: note = Category: MG60 effectors
  REGION 1..724: note = Description: MG60-339 effector
MNVIKRSGEEVVFDASKIENAIKKANKATTHNQMSDELIRSVTQSVINKCENLKRSPNVEEIQDMVEGELMEHRCFAVAHNYITYRYERALVRKANSTDKQIMSLLERNNEEVKQENSNKNPLVNSVQRDYMAGEVSKDITKRFLLPQDVMEAHEQGIIHFHDSDYFAQHMHNCCLVNLEDMLQNGTVISETMIEKPHSFSTACNVATQIIAQVASSQYGGQSITLSHLAPFVQVSREKARREVKEELESLNLDSSEDTVNKMAEMRVRKEIEKGVQMIQYQVITLMTTNGQAPFVTVFMYLNEVPEGQTRDDLAIIIEEMLKQRIKGVKNEKGIWITPAFPKLIYVLEENNIEEGSKYWYLTELAAKCTAKRMVPDYISEKKMLELKVDANGEGHCYPCMGCRSFLTTYLDENGKPKYYGRFNQGVVTLNLVDVACSSKQDEEAFWRIMDERLALCKKALMCRHERLLGTPSDVAPILWQNGALARLKKGEPIDKLLFGGYSTISLGYAGLCECVYYMTGHPHTEEPGTSFGLKVMQYLNDACAKWKAEENIDFSLYGTPMESTTFKFSKHLQERFGIIPHVTDKNYITNSYHVHVTEEIDAFTKLSFESQFQKLSPGGAISYVEVPNMENNIDAVLAIMKHIYNHIMYAELNTKSDYCQVCGYTGEIKIVEDENHKLVWECPNCGNRDQEKMNVARRTCGYIGTQFWNQGRTQEIKERVLHL

SEQ ID NO: 1125 - protein, 724 aa, unidentified
  REGION 1..724: note = Description of Unknown:uncultivated organism sequence
  REGION 1..724: note = Category: MG60 effectors
  REGION 1..724: note = Description: MG60-340 effector
MNVIKRSGEEVVFDASKIENAIKKANKATTHNQMSDELIRSVTQSVIDKCENLKRSPNVEEIQDMVEGELMEHRCFAVAHNYITYRYERALVRKANSTDKQIMSLLERNNEEVKQENSNKNPLVNSVQRDYMAGEVSKDITKRFLLPQDVMEAHEQGIIHFHDSDYFAQHMHNCCLVNLEDMLQNGTVISETMIEKPHSFSTACNVATQIIAQVASSQYGGQSITLSHLAPFVQVSREKARREVKEELESLNLDSSEDTVNKMAEMRVRKEIEKGVQMIQYQVITLMTTNGQAPFVTVFMYLNEVPEGQTRDDLAIIIEEMLKQRIKGVKNEKGIWITPAFPKLIYVLEENNIEEGSKYWYLTELAARCTAKRMVPDYISEKKMLELKVDANGEGHCYPCMGCRSFLTTYLDENGKPKYYGRFNQGVVTLNLVDVACSSKQDEDAFWRIMDERLELCKKALMCRHERLLGTPSDVAPILWQNGALARLKKGEPIDKLLFGGYSTISLGYAGLCECVYYMTGHPHTEEPGTSFGLKVMQYLNDACAKWKAEENIDFSLYGTPMESTTFKFSKHLQERFGIIPHVTDKNYITNSYHVHVTEEIDAFTKLSFESQFQKLSPGGAISYVEVPNMENNIDAVLAIMKHIYNHIMYAELNTKSDYCQVCGYTGEIKIVEDENHKLVWECPNCGNRDQEKMNVARRTCGYIGTQFWNQGRTQEIKERVLHL

SEQ ID NO: 1126 - protein, 724 aa, unidentified
  REGION 1..724: note = Description of Unknown:uncultivated organism sequence
  REGION 1..724: note = Category: MG60 effectors
  REGION 1..724: note = Description: MG60-341 effector
MNVIKRSGEEVVFDSIKIENAIKKANKATTHNQMSDELIRSVTQSVIDKCENLKRSPNVEEIQDMVEGELMEHRCFAVAHNYITYRYERALVRKANSTDKQIMSLLERNNEEVKQENSNKNPLVNSVQRDYMAGEVSKDITKRFLLPQDVMEAHEQGIIHFHDSDYFAQHMHNCCLVNLEDMLQNGTVISETMIEKPHSFSTACNVATQIIAQVASSQYGGQSITLSHLAPFVQVSREKARREVKEELESLNLDSSEDTVNKMAEMRVRKEIEKGVQMIQYQVITLMTTNGQAPFVTVFMYLNEVPEGQTRDDLAIIIEEMLKQRIKGVKNEKGIWITPAFPKLIYVLEENNIEEGSKYWYLTELAAKCTAKRMVPDYISEKKMLELKVDANGEGHCYPCMGCRSFLTTYLDENGKPKYYGRFNQGVVTLNLVDVACSSKQDEEAFWRIMDERLALCKKALMCRHERLLGTPSDVAPILWQNGALARLKKGEPIDKLLFGGYSTISLGYAGLCECVYYMTGHPHTEEPGTSFGLKVMQYLNDACAKWKAEENIDFSLYGTPMESTTFKFSKHLQERFGIIPHVTDKNYITNSYHVHVTEEIDAFTKLSFESQFQKLSPGGAISYVEVPNMENNIDAVLAIMKHIYNHIMYAELNTKSDYCQVCGYTGEIKIVEDENHKLVWECPNCGNRDQEKMNVARRTCGYIGTQFWNQGRTQEIKERVLHL

SEQ ID NO: 1127 - protein, 735 aa, unidentified
  REGION 1..735: note = Description of Unknown:uncultivated organism sequence
  REGION 1..735: note = Category: MG60 effectors
  REGION 1..735: note = Description: MG60-342 effector
MKKPMLVLKRNGEEVTFDRQKIFNAISAANKEVAPIHQLNKYQIEAVTKNVTEKIEEMSHIVSVEEIQDMVEVAIMEMRGYEVAQKYVRYRHKRELARKSNTTDEGILALINLSNEEIKQENSNKNPTVNSTQRDYMAGEVSKDLTMRVLLPEDIVKAHKEGIIHFHDSDYFAQKMYNCCLVNLKDMFENETVISGTKIETPKSFYTGCNVATQIVAQVASNQYGGQTITLSDLAPFVDVSRKKITQKVKEELAESGLSATDKQISKIVHKRLKEEIKSGIQTIQYQLVTLMTTNGQTPFVSIFMYLDEVPEGQTRDDLALIIEEVLRQRIQGVKNEKGVWVTPAFPKLLYILDEDNIHEDSKYWYLTELAAKCTAKRMVPDYISAKIMKEIKNGEVYPCMGCRSFLTVEDGIRNPDGSHKFYGRFNQGVVTINLVDVACSSYGDMDKFWKILDERLELCHKALRYRHERLLHTKSDVAPILWQNGAIARLEKGETIDKLLFGGYSTISLGYAGLYEMCVRMTGHSHTDPEAKKFALSVMQRLNDKCKEWREAENIGYSVYGTPMESTTYKFAKCLQKRFGIIPGVTDKNYITNSYHVHVTEEIDAFSKLKFESEFQKLSPGGAISYVEVPDMQGNIPAVLSLIKYIYENIMYAELNSKSDYCEVCGYEGEIKIVETESGKLIWECPCCGNRDQNKMFVARRTCGYIGTQFWNQGRTQEIKDRVIHMSYHALNKN

SEQ ID NO: 1128 - protein, 706 aa, unidentified
  REGION 1..706: note = Description of Unknown:uncultivated organism sequence
  REGION 1..706: note = Category: MG60 effectors
  REGION 1..706: note = Description: MG60-343 effector
METNPQIELAFDFLQYTGTNVFLTGKAGTGKTTFLRELKRRSPKRMIVVAPTGVAAINAGGVTIHSFFQLPFGPYVPGNMEETPGGENRYTNKFSREKINIIRSLDLLVIDEISMVRADLLDAVSDVLCRYKDRSRPFGGVQLLMIGDLQQLAPVVKEEEWGVLKERYASPFFFCSRALQEVPYAGIELTQVYRQTDAFFLDLLNKVRDNRADQQTLQALNRRYIPGFRPDDTEGYITLTTHNYQAQQINREKLDELEGKAYSYEAEIVDEFPEYSFPTDQHLVLKKGAQVMFVKNDASPEKRYYNGKIGRITAISSDHILVRCGGEKEAITVAKEEWTNTKYSIDAETQEITETVEGVFRQYPLKTAWAITIHKSQGLTFERAIVDAGAAFTHGQVYVALSRCKTLEGLVLSSPLRTGALICDQVVRQFTESVERNQPGREQLADARKAYYLQLLKELFDYSGVLRRVQYMSRLMNEHLWRLYPELTERYRTVREFCHNELKDVGERFQAQLERLVSECGDPEQDGQVRERVAKGLAYFRENTERVAVLVRDTQPEVDNKEVRKSLNEALGRLQQEVEVKMATLEAAVGGFSVMGHLQAKAKAMIEKPKPKTRKVSDKVDVPDDILHPDLYQILRQWRKEEAASMNLPVYTVLHQKALLGIANTLPTNGRELLAIPGIGKKVAERYGAKLLEIVNDFRFATLGEA

SEQ ID NO: 1129 - protein, 724 aa, unidentified
  REGION 1..724: note = Description of Unknown:uncultivated organism sequence
  REGION 1..724: note = Category: MG60 effectors
  REGION 1..724: note = Description: MG60-344 effector
MNVIKRSGEEVVFDASKIENAIKKANKATTHNQMSDELIRSVTQSVIDKCENLKRSPNVEEIQDMVEGELMEHRCFAVAHNYITYRYERALVRKANSTDKQIMSLLERNNEEVKQENSNKNPLVNSVQRDYMAGEVSKDITKRFLLPQDVMEAHEQGIIHFHDSDYFAQHMHNCCLVNLEDMLQNGTVISETMIEKPHSFSTACNVATQIIAQVASSQYGGQSITLSHLAPFVQVSREKARREVKEELESLNLDSSEDTVNKMAEMRVRKEIEKGVQMIQYQVITLMTTNGQAPFVTVFMYLNEVPEGQTRDDLAIIIEEMLKQRIKGVKNEKGIWITPAFPKLIYVLEENNIEEGSKYWYLTELAAKCTAKRMVPDYISEKKMLELKVDVNGEGHCYPCMGCRSFLTTYLDENGKPKYYGRFNQGVVTLNLVDVACSSKQDEEAFWKIMDERLALCKKALMCRHERLLGTPSDVAPILWQNGALARLKKGEPIDKLLFGGYSTISLGYAGLCECVYYMTGHPHTEEPGTSFGLKVMQYLNDACAKWKAEENIDFSLYGTPMESTTFKFSKHLQERFGIIPHVTDKNYITNSYHVHVTEEIDAFTKLSFESQFQKLSPGGAISYVEVPNMENNIDAVLAIMKHIYNHIMYAELNTKSDYCQVCGYTGEIKIVEDENHKLVWECPNCGNRDQEKMNVARRTCGYIGTQFWNQGRTQEIKERVLHL

SEQ ID NO: 1130 - protein, 724 aa, unidentified
  REGION 1..724: note = Description of Unknown:uncultivated organism sequence
  REGION 1..724: note = Category: MG60 effectors
  REGION 1..724: note = Description: MG60-345 effector
MNVIKRSGEEVVFDASKIENAIKKANKATTHNQMSDELIRSVTQSVIDKCENLKRSPNVEEIQDMVEGELMEHRCFAVAHNYITYRYERALVRKANSTDKQIMSLLERNNEEVKQENSNKNPLVNSVQRDYMAGEVSKDITKRFLLPQDVMEAHEQGIIHFHDSDYFAQHMHNCCLVNLEDMLQNGTVISETMIEKPHSFSTACNVATQIIAQVASSQYGGQSITLSHLAPFVQVSREKARREVKEELESLNLDSSEDTVNKMAEMRVRKEIEKGVQMIQYQVITLMTTNGQAPFVTVFMYLNEVPEGQTRDDLAIIIEEMLKQRIKGVKNEKGIWITPAFPKLIYVLEENNIEEGSKYWYLTELAARCTAKRMVPDYISEKKMLELKVDANGEGHCYPCMGCRSFLTTYLDENGKPKYYGRFNQGVVTLNLVDVACSSKQDEEAFWRIMDERLALCKKALMCRHERLLGTPSDVAPILWQNGALARLKKGEPIDKLLFGGYSTISLGYAGLCECVYYMTGHPHTEEPGTSFGLKVMQYLNDACAKWKAEENIDFSLYGTPMESTTFKFSKHLQERFGIIPHVTDKNYITNSYHVHVTEEIDAFTKLSFESQFQKLSPGGAISYVEVPNMENNIDAVLAIMKHIYNHIMYAELNTKSDYCQVCGYTGEIKIVEDENHKLVWECPNCGNRDQEKMNVARRTCGYIGTQFWNQGRTQEIKERVLHL

SEQ ID NO: 1131 - protein, 716 aa, unidentified
  REGION 1..716: note = Description of Unknown:uncultivated organism sequence
  REGION 1..716: note = Category: MG60 effectors
  REGION 1..716: note = Description: MG60-346 effector
MLEVIKRNGERVPFNRDKITVAIEKAMNSSSGIYEEGQAAKIASEIEAYAASIQKDLTIYAIEDQVYYRLLKYNNPATARAYENYKTIQAFKRQTNTTDDDVFGLLNNTNLEVLDENSNKNGHVVSTQRDLIAGEVSKDIARRRLIPADIVQAHDSGAIHFHDMDYIIQPMFNCCLINLEDMLANGTVINGKKIDTPKSFQVACTVTTQIIAQVASGQYGGQSINGIDRILAPYVRKSFKKYMKAVVEEQREVYGIEPDMEKAEEIAWKRTKKEIKDGIQTIQYQINTLMTTNGQAPFVTLFMYFQPDYEYAREAALIDEELLRQRIQGIKNEANVYVTPAFPKLIYVLDEHNVREGSPYFYLTKLAAECTAKRMYPDYISAKKMRESYEGNVFSPMGCRSFLSPWKDEKGNYQFDGRFNMGVVSLNLPQIGILADGDEEKFFQILDKRLELCKKALLLRVDLLKRITSDVSPIHWQYGAIARLKPGETIEKFIYGGYATLSLGYIGIYEATVLTKHCSHTAPEGRKFAMRIMDDLNAHIKKWRKETNIGFALYGTPAENLTNLFCKIDKARFGSIPDVTDKGYYTNSYHVDVREPINVFDKFSFEADFEDKSTGGCISYAEIPNMTHNIPAVLTMVQYIYDHITYGEFNTKLDYCHECGFDGEIILNDDNEWECPRCHNKDRNKLTVIRRTCGYLGENFWNEGRTQEIKNRVLHI

SEQ ID NO: 1132 - protein, 708 aa, unidentified
  REGION 1..708: note = Description of Unknown:uncultivated organism sequence
  REGION 1..708: note = Category: MG60 effectors
  REGION 1..708: note = Description: MG60-347 effector
MKVIKRDGRVVDYNRDKIITAIEKANKEVKTKERVTKEEIKEITKYIEELDKKRILVEDIQDIIEEQLMDLKKFELAKKYMIYRYTRALVRKANTTDESILGLIKNQNKELLEENSNKNAVLASTQRDYIAGEVSKDLTKRILLPEKITKAHEDGVLHFHDMDYFLQPIFNCCLINIGDMLDNGTVMNGKLIESPKSFQVACTVMTQIIAAVASNQYGGQSVDISHLGKYVRKSYEKFRRTFENEFGNELSEDIIERLTQQRLKKEISAGVQTIQYQINTLMTTNGQSPFVTIFLNLKKDDPYIKENAMVIEEIIRQRYEGIKNEKGVYVTPAFPKLIYVLDEHNCLKGGEYDYLTKLAVKCSAKRLYPDYISAKKMRENYEGNVFSPMGCRSFLSPWKDENGNYKFEGRFNQGVVSINLPQIGIIADGDEEKFWKLLDERLEICKEALMCRHYSLLGTLSNTSPIHWRYGAIARMKPGEKIDELLKGGYSTLSLGYIGIYETTKLMKGVSHTTPEGHEFAIKVMKRLRDATAEWKKETGLGFALYGTPAESLCYRFARIDKEKFGEIKDVTDKGYYTNSYHVDVREKIDAFSKLKFESEFQELSLGGAISYVEIPNMRHNLKALEDLVKFIYDNIQYAEFNTKSDYCHVCGFDGEIIINDNLEWECPNCGNKDKNKMNVTRRTCGYLGENFWNEGKTKEIKARVLHL

SEQ ID NO: 1133 - protein, 716 aa, unidentified
  REGION 1..716: note = Description of Unknown:uncultivated organism sequence
  REGION 1..716: note = Category: MG60 effectors
  REGION 1..716: note = Description: MG60-348 effector
MLEVIKRNGERVPFNRDKITIAIEKAMNSSSGIYEEGQAAKIASEIEAYAASIQKDLTIYAIEDQVYYRLLKYNNPATARAYENYKTIQAFKRQTNTTDDDVFGLLNNTNLEVLDENSNKNGHVVSTQRDLIAGEVSKDIARRKLIPADIVQAHDSGAIHFHDMDYIIQPMFNCCLINLEDMLANGTVINGKKIDTPKSFQVACTVTTQIIAQVASGQYGGQSINGIDRILAPYVRKSFKKYMKAVVEEQREVYGIEPDMEKAEEIAWKRTKKEIKDGIQTIQYQINTLMTTNGQAPFVTLFMYFQPDYEYAREAALIDEELLRQRIQGIKNEANVYVTPAFPKLIYVLDEHNVREGSPYFYLTKLAAECTAKRMYPDYISAKKMRESYEGNVFSPMGCRSFLSPWKDEKGNYQFDGRFNMGVVSLNLPQIGILADGDEEKFFQILDKRLELCKKALLLRVDLLKRITSDVSPIHWQYGAIARLKPGETIEKFIYGGYATLSLGYIGIYEATVLTKHCSHTAPEGRKFAMRIMDDLNAHIKKWRKETNIGFALYGTPAENLTNLFCKIDKARFGSIPDVTDKGYYTNSYHVDVREPINVFDKFSFEADFEDKSTGGCISYAEIPNMTHNIPAVLTMVQYIYDHITYGEFNTKLDYCHECGFDGEIILNDDNEWECPRCHNKDRNKLTVIRRTCGYLGENFWNEGRTQEIKNRVLHI

SEQ ID NO: 1134 - protein, 724 aa, unidentified
  REGION 1..724: note = Description of Unknown:uncultivated organism sequence
  REGION 1..724: note = Category: MG60 effectors
  REGION 1..724: note = Description: MG60-349 effector
MNVIKRSGEEVVFDASKIENAIKKANKATTHNQMSDELIRSVTQSVINKCENLKRSPNVEEIQDMVEGELMEHRCFAVAHNYITYRYERALVRKANSTDKQIMSLLERNNEEVKQENSNKNPLVNSVQRDYMAGEVSKDITKRFLLPQDVMEAHEQGIIHFHDSDYFAQHMHNCCLVNLEDMLQNGTVISETMIEKPHSFSTACNVATQIIAQVASSQYGGQSITLSHLAPFVQVSREKARREVKEELESLNLDSSEDTVNKMAEMRVRKEIEKGVQMIQYQVITLMTTNGQAPFVTVFMYLNEVPEGQTRDDLAIIIEEMLKQRIKGVKNEKGIWITPAFPKLIYVLEENNIEEGSKYWYLTELAARCTAKRMVPDYISEKKMLELKVDANGEGHCYPCMGCRSFLTTYLDENGKPKYYGRFNQGVVTLNLVDVACSSKQDEEAFWRIMDERLALCKKALMCRHERLLGTPSDVAPILWQNGALARLKKGEPIDKLLFGGYSTISLGYAGLCECVYYMTGHPHTEEPGTSFGLKVMQYLNDACAKWKAEENIDFSLYGTPMESTTFKFSKHLQERFGIIPHVTDKNYITNSYHVHVTEEIDAFTKLSFESQFQKLSPGGAISYVEVPNMENNIDAVLAIMKHIYNHIMYAELNTKSDYCQVCGYTGEIKIVEDENHKLVWECPNCGNRDQEKMNVARRTCGYIGTQFWNQGRTQEIKERVLHL

SEQ ID NO: 1135 - protein, 724 aa, unidentified
  REGION 1..724: note = Description of Unknown:uncultivated organism sequence
  REGION 1..724: note = Category: MG60 effectors
  REGION 1..724: note = Description: MG60-350 effector
MNVIKRSGEEVVFDASKIENAIKKANKATTHNQMSDELIRSVTQSVINKCENLKRSPNVEEIQDMVEGELMEHRCFAVAHNYITYRYERALVRKANSTDKQIMSLLERNNEEVKQENSNKNPLVNSVQRDYMAGEVSKDITKRFLLPQDVMEAHEQGIIHFHDSDYFAQHMHNCCLVNLEDMLQNGTVISETMIEKPHSFSTACNVATQIIAQVASSQYGGQSITLSHLAPFVQVSREKARREVKEELESLNLDSSEDTVNKMAEMRVRKEIEKGVQMIQYQVITLMTTNGQAPFVTVFMYLNEVPEGQTRDDLAIIIEEMLKQRIKGVKNEKGIWITPAFPKLIYVLEENNIEEGSKYWYLTELAARCTAKRMVPDYISEKKMLELKVDANGEGHCYPCMGCRSFLTTYLDENGKPKYYGRFNQGVVTLNLVDVACSSKQDEEAFWKIMDERLALCKKALMCRHERLLGTPSDVAPILWQNGALARLKKGEPIDKLLFGGYSTISLGYAGLCECVYYMTGHPHTEEPGTSFGLKVMQYLNDACAKWKAEENIDFSLYGTPMESTTFKFSKHLQERFGIIPHVTDKNYITNSYHVHVTEEIDAFTKLSFESQFQKLSPGGAISYVEVPNMENNIDAVLAIMKHIYNHIMYAELNTKSDYCQVCGYTGEIKIVEDENHKLVWECPNCGNRDQEKMNVARRTCGYIGTQFWNQGRTQEIKERVLHL

SEQ ID NO: 1136 - protein, 745 aa, unidentified
  REGION 1..745: note = Description of Unknown:uncultivated organism sequence
  REGION 1..745: note = Category: MG60 effectors
  REGION 1..745: note = Description: MG60-351 effector
MAIVIKMNDKKNENAKYVIKRNGAEALFDEDKIVNALFKANDSTLKNKITKQQIVNIADHIKAYVEQTTYALNIEDIQDMVENELMQIKAFDVARSYITYRYKRALARQKNTTDDKILSLIEHNNEEVKQENSNKNPVVNSVQRDYMAGEVSKDLCKRIFLPSDIWEAHEDGIIHFHDADYFAQHMHNCCLVNLEDMLQNGTVISDTMIDRPKSFSTACNIATQAIAQIASQQYGGQTMSIAHLAPFVDVSRQKYMRKQMASMEKAGIKTTEAQLESVVEDMVDEEIKRGVQMIQYQLITLMTTNGQAPFVTIYMYLNECKDGRTKADMVKVIREMLKQRIQGVKNEKGVYVTPAFPKLIYVLEEDNIHEGDKYWELTKLAAKCTAKRMVPDYISEKIMKELKQGDVYSCMGCRSFLTVDRTKENIANAGNYKDGEHKYYGRFNQGVVTLNLVDVACTSARDEDYFWEILDKRLELCHKALRIRHERLLGTPSDVAPILWQHGALARLKKGETIDKLLYGGYSTISLGYAGLCECTRYMKGVSHTDPLGTEFATRVMQKLNDACAKWKAEENIDYSVYGTPLESTTYKFAKCLQKRFGIIPGVTDKNYITNSYHVHVTEKINAFDKLKFEAPFQKLSPGGAISYVEVPNLQDNIEAVLAIMQYIYENIMYAELNTKSDYCEVCGYDGEIRVVEDEHGKLVWECPNCGNRDQNKMSVARRTCGYIGTQFWNQGRTQEIKERYVHLQ

SEQ ID NO: 1137 - protein, 853 aa, unidentified
  REGION 1..853: note = Description of Unknown:uncultivated organism sequence
  REGION 1..853: note = Category: MG60 effectors
  REGION 1..853: note = Description: MG60-352 effector
MARSIEKIFEDNILLKYNLYNSIFTTLPFEKIEHVGTLLPLFSSYCSKGFEKKQSPKQIVQGFFENYLPDIKEEKQFDILFRFIQYVEREIVLFDAIEESAFPLLQSKKQNNSIKYIIEQALQEKKTEELKHFIENFRIRTVLTAHPTQFYPGKVLGIITDLSEAIKNNNFVLIKNLLLQLGKTPFIKHKKPSPLDEANHLIWYLENILYDAIPEIYNNIIEDLLEKESPNAIFEIGFWPGGDRDGNPFVTTEITLKVAEQLKLAILKKYHSDLKKLKRRLTFNGIFNKLESLEKNIQKIIINPKKKTELTQEKLLDRLHEIRTVLKEKHQSIFISDLDELIRKVRIFGFYFASLDIRQDSRIHTSAFNHITRIYPDVLTENYADFDEKQKLVYLGEINKKINISEFKDPMAISTLESMQAIKKIQKSNGKKGAHRYIISNTQSATNVMQVFCMLRMSGFNKKMPVDIVPLFETINDLQSAGKIMEILYKNPAYKKHLKSRKNEQIIMLGFSDGTKDGGYLAANWSIYRAKEDLSLMAQKYDIKVVFFDGRGGPPARGGGKTHSFYSSLGKNIENKAIEITVQGQTISSQYGSIELAKHNLEQLLSAGIKNKVFQGENNELSAENRKILEHLSDLAYRKYKNFKEHPKFIPYLEKMSTLKYYGKTKIGSRPTKRANSDKLIFSDLRAIPFVGAWSQLKQNVPGFFGVGSALLHYEQEGAFNKIENLYAESKFFKALIENVIVSLKKSFFQLTEYMKNDEEFGDFWKIIYDEYNNTQRLLLKLTKRKDLLEKSPETKASIETRHKIVLPLLTIQQYALQEIQITGKENKERIENLEKMIVRSLFGNINASRNAV

SEQ ID NO: 1138 - protein, 717 aa, unidentified
  REGION 1..717: note = Description of Unknown:uncultivated organism sequence
  REGION 1..717: note = Category: MG60 effectors
  REGION 1..717: note = Description: MG60-353 effector
MKVIKRDGHVVDYEPEKIEAAIQKANQEVDEADRVSDIQIRNIIKYIEGLKKKRMLVEDIQDVIEMRLMSLGKYVLAKAYITYRYTRELVRRSNTTDLTIKELIDGDSEYWNTENSNKNARVVTTQRDYLAGITSTDITRRFLLPEDVVNAHDSGIIHFHDADYFAQNALHNCDLINLDDMLQNGTSINGVMIEKPHRFLTAMTIATQLITAVSSSQYGGATITLTHLAPFVRASREYYEKRYSNRKLTKEQVKKFVEEDLHKEIVDGVQTFQYQINSMTTTNGQAPFLSVNMYLGETEEYKDELAMIIEEVLRQRIQGMKNEKGVWITPAFPKLLYVLEEDNINPKSKYYYLTKLATECTAKRMVPDYISEKVMKELKIDKNGNGQCYPCMGCRSFLTPYVDNDGKPKYYGRFNQGVVTLNLPDIALSSKKDMDEFWKIFDERLELSHKALRIRYKRLSKATSDVAPILWQHGALARLPKGASIKELLHNGYSTISLGYAGLYECVKYMTGKSHTDGAEGEEFGLKVMQHLNDACNKWKEEEKIDYSVYGTPIESTTYKFAKCLKERFGVIKGITDRNYITNSYHIPVFEEVDAFTKLAIESKFQKLSPGGAISYVEAPNLVKNLDAVLELITFIYNNIMYAEINTKSDYCHKCGYTGEILIDDNLEWYCPECGNRDHTKLNVARRTCGYIGTNFWNKGRTQEIKERVLHIDNKEA

SEQ ID NO: 1139 - protein, 706 aa, unidentified
  REGION 1..706: note = Description of Unknown:uncultivated organism sequence
  REGION 1..706: note = Category: MG60 effectors
  REGION 1..706: note = Description: MG60-354 effector
METNPQIELAFDFLQYTGTNVFLTGKAGTGKTTFLRELKRRSPKRMIVVAPTGVAAINAGGVTIHSFFQLPFGPYVPGNAEGGAENEKRYTNKFSREKINIIRSLDLLVIDEISMVRADLLDAVSDVLCRYKDRSRPFGGVQLLMIGDLQQLAPVVKDDEWSLLKERYASPFFFCSRALQEVPYVGIELTQVYRQTDAFFLDLLNKVRDNRADQATLQALNRRYIPGFRPDDTEGYITLTTHNYQAQQINREKLEELEEKAYSYEAEIVDEFPEYSFPTDRHLVLKKGAQVMFVKNDASPEKRYYNGKIGRVTAISSDHILVRCGEEREAITVAKEEWTNTKYTIDAETQEISETVEGVFRQYPLKTAWAITIHKSQGLTFERAIVDAGAAFTHGQVYVALSRCKTLEGLVLSSPLRTGALICDQVVRQFTEGIEQGQPGREQLADAKRAYYLQLLKELFDYNGVLRRMQYMSRILNEHLWRLYPELTERYRTEREFCHNELKDVGERFQMQLERLVNECREPEQDGQVRERVAKGLAYFRERTGRVFALVQDTQPEVDNKEVRKSLNEALGRLQQEVEVKMATLEAAAGGFSVMGYLQAKARAMIEKPKAKARKISDKVDVPEDILHPDLYQILRQWRKEEAASMNLPVYTVLHQKALLGIANILPTNGRELLSIPGIGKKVAERYGKKLLEMVNDYRFATLGDA

SEQ ID NO: 1140 - protein, 716 aa, unidentified
  REGION 1..716: note = Description of Unknown:uncultivated organism sequence
  REGION 1..716: note = Category: MG60 effectors
  REGION 1..716: note = Description: MG60-355 effector
MLEVIKRNGERVPFNRDKITVAIEKAMNSSSGIYEEGQAAKIAGEIEAYAASIQKDLTIYAIEDQVYYRLLKYNNPATARAYENYKTIQAFKRQTNTTDDDVFGLLNNTNLEVLDENSNKNGHVVSTQRDLIAGEVSKDIARRKLIPADIVQAHDSGAIHFHDMDYIIQPMFNCCLINLEDMLANGTVINGKKIDTPKSFQVACTVTTQIIAQVASGQYGGQSINGIDRILAPYVRKSFKKYMKAVVEEQREVYGIEPDMEKAEEIAWKRTKKEIKDGIQTIQYQINTLMTTNGQAPFVTLFMYFQPDYEYAREAALIDEELLRQRIQGIKNEANVYVTPAFPKLIYVLDEHNVREGSPYFYLTKLAAECTAKRMYPDYISAKKMRESYEGNVFSPMGCRSFLSPWKDEKGNYQFDGRFNMGVVSLNLPQIGILADGDEEKFFQILDKRLELCKKALLLRVDLLKRITSDVSPIHWQYGAIARLKPGETIEKFIYGGYATLSLGYIGIYEATVLTKHCSHTAPEGRKFAMRIMDDLNAHIKKWRKETNIGFALYGTPAENLTNLFCKIDKARFGSIPDVTDKGYYTNSYHVDVREPINVFDKFSFEADFEDKSTGGCISYAEIPNMTHNIPAVLTMVQYIYDHITYGEFNTKLDYCHECGFDGEIILNDDNEWECPRCHNKDRNKLTVIRRTCGYLGENFWNEGRTQEIKNRVLHI

SEQ ID NO: 1141 - protein, 716 aa, unidentified
  REGION 1..716: note = Description of Unknown:uncultivated organism sequence
  REGION 1..716: note = Category: MG60 effectors
  REGION 1..716: note = Description: MG60-356 effector
MLEVIKRNGERVPFNRDKITVAIEKAMNSSSGIYEEGQAAKIAGEIEAYAASIQKDLTIYAIEDQVYYRLLKYNNPATARAYENYKTIQAFKRQTNTTDDDVFGLLNNTNLEVLDENSNKNGHVVSTQRDLIAGEVSKDIARRKLIPADIVQAHDSGAIHFHDMDYIIQPMFNCCLINLEDMLANGTVINGKKIDTPKSFQVACTVTTQIIAQVASGQYGGQSINGIDRILAPYVRKSFKKYMKAVVEEQREIYGIEPDMEKAEEIAWKRTKKEIKDGIQTIQYQINTLMTTNGQAPFVTLFMYFQPDYEYAREAALIDEELLRQRIQGIKNEANVYVTPAFPKLIYVLDEHNVREGSPYFYLTKLAAECTAKRMYPDYISAKKMRESYEGNVFSPMGCRSFLSPWKDEKGNYQFDGRFNMGVVSLNLPQIGILADGDEEKFFQILDKRLELCKKALLLRVDLLKRITSDVSPIHWQYGAIARLKPGETIKKFIYGGYATLSLGYIGIYEATVLTKHCSHTAPEGRKFAMRIMDDLNAHIKKWRKETNIGFALYGTPAENLTNIFCKIDKARFGSIPDVTDKGYYTNSYHVDVREPINVFDKFSFEADFEDKSTGGCISYAEIPNMTHNIPAVLTMVQYIYDHITYGEFNTKLDYCHECGFDGEIILNDDNEWECPRCHNKDRNKLTVIRRTCGYLGENFWNEGRTQEIKNRVLHI

SEQ ID NO: 1142 - protein, 752 aa, unidentified
  REGION 1..752: note = Description of Unknown:uncultivated organism sequence
  REGION 1..752: note = Category: MG60 effectors
  REGION 1..752: note = Description: MG60-357 effector
MYIYDEILDGNMHTEEPNMCVMKRSGERVPFDRVKIAEAIERANREEGILSERLTDAQIDQITRGIEKDASNAGRDLSVEEIQDKVEDALMCSGRPKVARLYITYRYKHNEMRKMSNIDQKIAGVVERDNEEVKQENSNKNPTVLSVQRDYMAGEWSRYYTSRYLLPEEIVDAHKNGIIHFHDADYFAQHMHNCDLVNLEDMLQNGTCISGTHIDKPKSFSTACTVASQIVAQVASSQYGGQTITMSHLAPFVDISRKKITSRLAEELHETGIEVPAEKLSELVEKELLKEIESGCQTIQYQLITLQSTNGQAPFVTVFLYLGEVPEGQLRDDLAIVIEVMLKQRILGVKDKSGVYITPAFPKLIYVLQEDNIREGTPYFYLTELAAKCTAKRMVPDYISEKKALELKGDVYPCMGCRSFLTPDRFTDAGVGNIANDKSYVPGRHKYYGRFNQGVVTLNLVDIACSSGRDERKFWDIMNERLDLCHRALRIRHERLKGTPSDVAPILWQDGAIARLASGETIDRLLMNGYSTISLGYAGLAECVFYMKGTSHTSEEGKEFGLRVMQALNDACAKWKKAENIDYSVYGTPLESTTYKFAKCLQRRFGKIPGVTDKNYITNSYHIHVSEHIDAFSKLSKEAEFQQLSPGGAISYVEVPNMQNNIPAVIRVMQHIYDSILYAELNTKSDLCEVCGFDGEIQVKKDVTGKLVWECPNCGNRDQSKMHVARRTCGYIGTQYWNQGRTAEIADRVLHL

SEQ ID NO: 1143 - protein, 716 aa, unidentified
  REGION 1..716: note = Description of Unknown:uncultivated organism sequence
  REGION 1..716: note = Category: MG60 effectors
  REGION 1..716: note = Description: MG60-358 effector
MLEVIKRNGERVPFNRDKITIAIEKAMNSSSGIYEEGQAAKIAGEIEAYAASIQKDLTIYAIEDQVYYRLLKYNNPATARAYENYKTIQAFKRQTNTTDDDVFGLLNNTNLEVLDENSNKNGHVVSTQRDLIAGEVSKDIARRKLIPADIVQAHDSGAIHFHDMDYIIQPMFNCCLINLEDMLANGTVINGKKIDTPKSFQVACTVTTQIIAQVASGQYGGQSINGIDRILAPYVRKSFKKYMKAVVEEQREVYGIEPDMEKAEEIAWKRTKKEIKDGIQTIQYQINTLMTTNGQAPFVTLFMYFQPDYEYAREAALIDEELLRQRIQGIKNEANVYVTPAFPKLIYVLDEHNVREGSPYFYLTKLAAECTAKRMYPDYISAKKMRESYEGNVFSPMGCRSFLSPWKDKKGNYQFDGRFNMGVVSLNLPQIGILADGDEEKFFQILDKRLELCKKALLLRVDLLKRITSDVSPIHWQYGAIARLKPGETIEKFIYGGYATLSLGYIGIYEATVLTKHCSHTAPEGRKFAMRIMDDLNAHIKKWRKETNIGFALYGTPAENLTNLFCKIDKARFGSIPDVTDKGYYTNSYHVDVREPINVFDKFSFEADFEDKSTGGCISYAEIPNMTHNIPAVLTMVQYIYDHITYGEFNTKLDYCHECGFDGEIILNDDNEWECPRCHNKDRNKLTVIRRTCGYLGENFWNEGRTQEIKNRVLHI

SEQ ID NO: 1144 - protein, 656 aa, unidentified
  REGION 1..656: note = Description of Unknown:uncultivated organism sequence
  REGION 1..656: note = Category: MG60 effectors
  REGION 1..656: note = Description: MG60-359 effector
MKKEGLMKVIKRDGRAVDYDRSKIQIAIEKANQEVKESERVSKEDILGIISYIEELDKKRILVEDIQDIIEQKIMELKKYELAKKYIVYRYTRALVRKQNTTDETILGIIRNDNKEEGQEDNEITVSAQRDYIAGEVSKDLTKRLLLPEKVASADEEGVLYFHDSEYFVHPMINSSFVGIGDMLDNGTVMSNAKIESPKSFLVACTVATQIMAAIANNQYGGQAIDMQCFGKYLRKSYEKFKGEIENEFNGELEKESIENLVNKRLKTELKSGIQIMQYQFNTLKVIKGRMPQITLFLHLDKEDTYIKENAMIIEEILKQKQNGFKDENGQNITLEFPKLIYVIDEFNNLAGGEYDYLTKLALECSLKTKSPSYISAKIMRQYYNGNVFCPMDAGSFLLPWERENLINKETSTKSNNSIDFKEKSKFNQGIVSINLPQIAIIADGDEKKFWKLLEERLDICLDALKCRHYSLVGISSDMSPTHWQYGGIARLEKGEKIDKLLYNGYSTLTLGYVGIYEMAMKMTGQNHLEGNGREFAVKVLEYLNETTKKWKKETNIDFILCGITSKKVGKRFLKKDKEKFGTIKGITDKEYYTGSYLMDPKQNEETLTALSFEKEFQKMSPGGNASYLKVANLKMDELEEILKYSYENICYLRLI

SEQ ID NO: 1145 - protein, 706 aa, unidentified
  REGION 1..706: note = Description of Unknown:uncultivated organism sequence
  REGION 1..706: note = Category: MG60 effectors
  REGION 1..706: note = Description: MG60-360 effector
METNPQIELAFDFLQYTGTNVFLTGKAGTGKTTFLRELKRRSPKRMIVVAPTGVAAINAGGVTIHSFFQLPFGPYVPGNMEETPGGENRYTNKFSREKINIIRSLDLLVIDEISMVRADLLDAVSDVLCRYKDRSRPFGGVQLLMIGDLQQLAPVVKEEEWGLLKERYASPFFFCSRALQEVPYAGIELTQVYRQTDAFFLDLLNKVRDNRADQQTLQALNRRYIPGFRPDDTEGYITLTTHNYQAQQINREKLDELEGKAYSYEAEIVDEFPEYSFPTDQHLVLKKGAQVMFVKNDASPEKRYYNGKIGRITAISSDHILVRCGGEKEAITVAKEEWTNTKYSIDAETQEITETVEGVFRQYPLKTAWAITIHKSQGLTFERAIVDAGAAFTHGQVYVALSRCKTLEGLVLSSPLRTGALICDQVVRQFTESVERNQPGREQLADARKAYYLQLLKELFDYSGVLRRVQYMSRLMNEHLWRLYPELTERYRTVREFCHNELKDVGERFQAQLERLVSECGDPEQDGQVRGRVAKGLAYFRENTERVAVLVRDTQPEVDNKEVRKSLNEALGRLQQEVEVKMATLEAAVGGFSVMGHLQAKAKAMIEKPKPKTRKVSDKVDVPDDILHPDLYQILRQWRKEEAASMNLPVYTVLHQKALLGIANTLPTNGRELLAIPGIGKKVAERYGAKLLEIVNDFRFATLGEA

SEQ ID NO: 1146 - protein, 717 aa, unidentified
  REGION 1..717: note = Description of Unknown:uncultivated organism sequence
  REGION 1..717: note = Category: MG60 effectors
  REGION 1..717: note = Description: MG60-361 effector
MKVIKRDGHVVDYEPEKIEAAIQKANQEVDEADRVSDIQIRNIIKYIEGLKKKRMLVEDIQDVIEMRLMSLGKYVLAKAYITYRYTRELVRRSNTTDLTIKELIDGDSEYWNTENSNKNARVVTTQRDYLAGITSTDITRRFLLPEDVVNAHDSGIIHFHDADYFAQNALHNCDLINLNDMLQNGTSINGVMIEKPHRFLTAMTIATQLITAVSSSQYGGATITLTHLAPFVRASREYYEKRYSNRKLTKEQVKKFVEEDLHKEIVDGVQTFQYQINSMTTTNGQAPFLSVNMYLGETEEYKDELAMIIEEVLRQRIQGMKNEKGVWITPAFPKLLYVLEEDNINPKSKYYYLTKLAAECTAKRMVPDYISEKVMKELKIDKNGNGQCYPCMGCRSFLTPYVDNDGKPKYYGRFNQGVVTLNLPDIALSSKKDMDEFWKIFDERLELSHKALRIRYKRLSKATSDVAPILWQHGALARLPKGASIKELLHNGYSTISLGYAGLYECVKYMTGKSHTDGAEGEEFGLKVMQHLNDACNKWKEEEKIDYSVYGTPIESTTYKFAKCLKERFGVIKGITDRNYITNSYHIPVFEEVDAFTKLAIESKFQKLSPGGAISYVEAPNLVKNLDAVLEIITFIYNNIMYAEINTKSDYCHKCGYTGEILIDDNLEWYCPECGNRDHTKLNVARRTCGYIGTNFWNKGRTQEIKERVLHIDNKEA

SEQ ID NO: 1147 - protein, 724 aa, unidentified
  REGION 1..724: note = Description of Unknown:uncultivated organism sequence
  REGION 1..724: note = Category: MG60 effectors
  REGION 1..724: note = Description: MG60-362 effector
MNVIKRSGEEVVFDASKIENAIKKANKATTHNQMSDELIRSVTQSVIDKCENLKRSPNVEEIQDMVEGELMEHRCFAVAHNYITYRYERALVRKANSTDKQIMSLLERNNEEVKQENSNKNPLVNSVQRDYMAGEVSKDITKRFLLPQDVMEAHEQGIIHFHDSDYFAQHMHNCCLVNLEDMLQNGTVISETMIEKPHSFSTACNVATQIIAQVASSQYGGQSITLSHLAPFVQVSREKARREVKEELESLNLDSSEDTVNKMAEMRVRKEIEKGVQMIQYQVITLMTTNGQAPFVTVFMYLNEVPEGQTRDDLAIIIEEMLKQRIKGVKNEKGIWITPAFPKLIYVLEENNIEEGSKYWYLTELAARCTAKRMVPDYISEKKMLELKVDANGEGHCYPCMGCRSFLTTYLDENGKPKYYGRFNQGVVTLNLVDVACSSKQDEEAFWKIMDERLALCKKALMCRHERLLGTPSDVAPILWQNGALARLKKGEPIDKLLYGGYSTISLGYAGLCECVYYMTGHPHTEEPGTSFGLKVMQYLNDACAKWKAEENIDFSLYGTPMESTTFKFSKHLQERFGIIPHVTDKNYITNSYHVHVTEEIDAFTKLSFESQFQKLSPGGAISYVEVPNMENNIDAVLAIMKHIYNHIMYAELNTKSDYCQVCGYTGEIKIVEDENHKLVWECPNCGNRDQEKMNVARRTCGYIGTQFWNQGRTQEIKERVLHL

SEQ ID NO: 1148 - protein, 724 aa, unidentified
  REGION 1..724: note = Description of Unknown:uncultivated organism sequence
  REGION 1..724: note = Category: MG60 effectors
  REGION 1..724: note = Description: MG60-363 effector
MNVIKRSGEEVVFDSIKIENAIKKANKATTHNQMSDELIHTVTQSVVDKCENLKRSPNVEEIQDMVEGELMEKRCFAVAHNYITYRYERALVRKANSTDKQIMSLLERNNEEVKQENSNKNPLVNSVQRDYMAGEVSKDITKRFLLPQDVMEAHEQGIIHFHDSDYFAQHMHNCCLVNLDDMLQNGTVISETMIEKPHSFSTACNVATQIIAQVASSQYGGQSITLSHLAPFVQVSREKARREVKEELESLNLDSSEDTVNKMAEMRVRKEIEKGVQMIQYQVITLMTTNGQAPFVTVFMYLNEVPEGQTRDDLAIIIEEMLKQRIKGVKNEKGIWITPAFPKLIYVLEENNIEEGSKYWYLTELAAKCTAKRMVPDYISEKKMLELKVDANGEGHCYPCMGCRSFLTTYLDENGKPKYYGRFNQGVVTLNLVDVACSSKQDEEAFWKIMDERLALCKKALMCRHERLLGTPSDVAPILWQNGALARLKKGEPIDKLLFGGYSTISLGYAGLCECVYYMTGHPHTEEPGTSFGLKVMQYLNDACAKWKAEENIDFSLYGTPMESTTFKFSKHLQERFGIIPHVTDKNYITNSYHVHVTEEIDAFTKLSFESQFQKLSPGGAISYVEVPNMENNIDAVLAIMKHIYNHIMYAELNTKSDYCQVCGYTGEIKIVEDENHKLVWECPNCGNRDQEKMNVARRTCGYIGTQFWNQGRTQEIKERVLHL

SEQ ID NO: 1149 - protein, 752 aa, unidentified
  REGION 1..752: note = Description of Unknown:uncultivated organism sequence
  REGION 1..752: note = Category: MG60 effectors
  REGION 1..752: note = Description: MG60-364 effector
MYIYDEILDGNMHTEEPNMCVMKRSGERVPFDRVKIAEAIERANREEGILSERLTDAQIDQITRGIEKDASNAGRDLSVEEIQDKVEDALMCSGRPKVARLYITYRYKHNEMRKMSNIDQKIAGVVERDNEEVKQENSNKNPTVLSVQRDYMAGEWSRYYTSRYLLPEEIVDAHKSGIIHFHDADYFAQHMHNCDLVNLEDMLQNGTCISGTHIDKPKSFSTACTVASQIVAQVASSQYGGQTITMSHLAPFVDISRKKITSRLAEELHETGIEVPAEKLSELVEKELLKEIESGCQTIQYQLITLQSTNGQAPFVTVFLYLGEVPEGQLRDDLAIVIEVMLKQRILGVKDKSGVYITPAFPKLIYVLQEDNIREGTPYFYLTELAAKCTAKRMVPDYISEKKALELKGDVYPCMGCRSFLTPDRFTDAGVGNIANDKSYVPGRHKYYGRFNQGVVTLNLVDIACSSGRDERKFWDIMNERLDLCHRALRIRHERLKGTPSDVAPILWQDGAIARLASGETIDRLLMNGYSTISLGYAGLAECVFYMKGTSHTSKEGKEFGLRVMQALNDACAKWKKAENIDYSVYGTPLESTTYKFAKCLQRRFGKIPGVTDKNYITNSYHIHVSEHIDAFSKLSKEAEFQQLSPGGAISYVEVPNMQNNIPAVIRVMQHIYDSILYAELNTKSDLCEVCGFDGEIQVKKDVTGKLVWECPNCGNRDQSKMHVARRTCGYIGTQYWNQGRTAEIADRVLHL

SEQ ID NO: 1150 - protein, 760 aa, unidentified
  REGION 1..760: note = Description of Unknown:uncultivated organism sequence
  REGION 1..760: note = Category: MG60 effectors
  REGION 1..760: note = Description: MG60-365 effector
MKVIKRDCSEVDFDKSKISTAILKAMKNGSGIVKQKIAEDIANEIEEDCKDKDEVSISDIESMVYDKLITKKQRLTAKAYEGYRSIREFQRENENTIDTEITELLSGESDYWNNENSNKNPRLNTTQRDYLAGIVSKDASRRYILPPEIVQAHDDGLIHVHDLDYLIQYMNNCCLINLEDMLQNGTVISETLIEKPHSFSTACTVATQIIAQVASSQYGGQSISLAHLAPFVDISRQKIRKEVIEEQEYLYRNIDEKEWVKPRKVLGKKLRKDQEKFYKNKDRLLKFIDATDIEDIVEKRLKKEIEKGIQTIQYQITTLMTTNGQAPFITLFMYLNEAHNQREKDDLAMLIEEELRQSYLGVKNEEGVYITPAFPKVIYVLQEDNIHEEDKYWYLTEMAAKCSMKRLTPDYISEKIMKEMKDGNCYPVMGCRSALTVWHDENGKPKFYGRFNSGVVTVSLPDIALSSGGDFNEFWRIFDERTELCHKALKIRHQRLRGTKSDVAPILWQHGAFARLKKGESIDKLLFGGYSTLSLGYAGLAECVKYMTGHYHCDEGIGEKFGLEVMQALNDKCSQWKIDENIDYSLYGTPLEATTEKFAKKLKERFGIIEGVTDRTYITNSYHIPVFIHIDAFGKLRIEAKFQRLSPGGSISYIECPNMENNIPAVLEVMKFIYNNNMYAELNTKSDYCQKCGWSKEIKLIDEGGKLIWECPNCGNRDVRTMDITRRTCGYKGTARNGWNQGRLGDIHDRVPHLDDIEEE

SEQ ID NO: 1151 - protein, 733 aa, unidentified
  REGION 1..733: note = Description of Unknown:uncultivated organism sequence
  REGION 1..733: note = Category: MG60 effectors
  REGION 1..733: note = Description: MG60-366 effector
MNILKRNGSEVLFDKSKIVIAISKANEEVEPHERLPISRIEAIANDIEADCAHLGYEVSVEDVQDMVEKQILDSNAFTLAKTYMRYRQDHNIARGKQELYKRLLAIVEGDSEEATQENSNKNPVIASTQRDYMAGEVSRDITNTMLLPKDIVDAHNAGIIHFHDADYYAQHMHNCDLINLEDMLQNGTVISGTLIEKPHSFSTACNIATQIIAQVASNQYGGQSISLSHLAPFVDVSRQKIRDSVMKELELAGAAPTQETIAEIVEMRLKDEIKRGIQTIQYQVVTLMTTNGQAPFITVFMYLDEVSDPQTKADLAMIIEETLRQRYQGVKNETGAWVTPAFPKLIYVLDEDNIHEDSPYWYLTVMAAKCTARRMVPDYISAKKMRELKGDVYTCMGCRSFLTPDRFTDEGAGNIANAGNYDPTKHKYYGRFNQGVVTINLPDVGLSAHKDFDLFWKIFDERLELCHRALKLRHERLLGTPSDISPIHWQYGALARLKKGETIDKLLFNGYSTISLGYAGLYECTVAMTGKSHTDPAGKEFALAVMQHMNDKCNEWKAAENIDYSLYGTPIESTTYKFAKCLKKRFGIIPEVTDHNYITNSYHISVREKVDAFTKLAFESDFQKLSPGGAISYVEVPDMQNNIPAVLEVMKFIYDHIMYAELNTKSDYCQVCGWDGEIPIVEDENGKLIFKCPRCGNEDRSKLNIARRTCGYIGTNDWNQGRVQEIKERVLHL

SEQ ID NO: 1152 - protein, 717 aa, unidentified
  REGION 1..717: note = Description of Unknown:uncultivated organism sequence
  REGION 1..717: note = Category: MG60 effectors
  REGION 1..717: note = Description: MG60-367 effector
MKVIKRDGHMVDWCPEKIEDAIMKANKEVEEDEQASSVQIRNIIKYIEKLGKKRILVEDIQDIIEMKLMSQGKYELAKRYITYRYTRELVRRSNTTDQSIKELIDGESEYWNTENSNKNAKIVTTQRDYLAGITSTDITRRFLLPEDIVEAHDAGIIHFHDADYFAQNALHNCDLVNLEDMLQNGTSINGVMIEKPHRFLTAMTIATQIITAVSSSQYGGVTITLTHLAPFVRDSYKRYLDKYKKRKLSKEDCEKFAMEDTKKEIVDGVQTFQYQVNSMTTTNGQAPFLSVCMYLGETDEYKEELAWIIEEFLKQRIVGMKNEQGVYITPAFPKLLYVLEEDNIHKNSKYYYLTKLAAECTSKRMVPDYISEKIMKELKIDKNGNGNCYPCMGCRSFLTPYVDENGKPKYYGRFNQGVVTINLVDVALSSDKDMDVFWQIFEERLELCHRALQIRHKRLSKATSDVAPILWQHGALARLPKGASIHDLLHNGYSTISLGYAGLYECVKYMTGHSHTDNGKGKEFGLKVMEKMNEKCKEWKELENIDYSVYGTPIEATTYKFAKGLKERFGVVKGITDRDYITNSYHVPVFEEIDAFTKLKLESEFQKLSPGGAISYIETPNLSNNIDVVLEVMNFIYDNIMYAELNTKSDYCQECGYTGEILIDDNMEWYCPNCGNRDHSKLNVARRTCGYIGTNFWNKGRTQEIKERVIHIDNKEA

SEQ ID NO: 1153 - protein, 724 aa, unidentified
  REGION 1..724: note = Description of Unknown:uncultivated organism sequence
  REGION 1..724: note = Category: MG60 effectors
  REGION 1..724: note = Description: MG60-368 effector
MNVIKRSGEEVVFDASKIENAIKKANKATTHNQMSDELIHSVTQSVIDKCENLKRSPNVEEIQDMVEGELMEHRCFAVAHNYITYRYERALVRKANSTDKQIMSLLERNNEEVKQENSNKNPLVNSVQRDYMAGEVSKDITKRFLLPQDVMEAHEQGIIHFHDSDYFAQHMHNCCLVNLEDMLQNGTVISETMIEKPHSFSTACNVATQIIAQVASSQYGGQSITLSHLAPFVQVSREKARREVKEELESLNLDSSEDTVNKMAEMRVRKEIEKGVQMIQYQVITLMTTNGQAPFVTVFMYLNEVPEGQTRDDLAIIIEEMLKQRIKGVKNEKGIWITPAFPKLIYVLEENNIEEGSKYWYLTELAAKCTAKRMVPDYISEKKMLELKVDANGEGHCYPCMGCRSFLTTYLDENGKPKYYGRFNQGVVTLNLVDVACSSKQDEEAFWRIMDERLALCKKALMCRHERLLGTPSDVAPILWQNGALARLKKGEPIDKLLFGGYSTISLGYAGLCECVYYMTGHPHTEEPGTSFGLKVMQYLNDACAKWKAEENIDFSLYGTPMESTTFKFSKHLQERFGIIPHVTDKNYITNSYHVHVTEEIDAFTKLSFESQFQKLSPGGAISYVEVPNMENNIDAVLAIMKHIYNHIMYAELNTKSDYCQVCGYTGEIKIVEDENHKLVWECPNCGNRDQEKMNVARRTCGYIGTQFWNQGRTQEIKERVLHL

SEQ ID NO: 1154 - protein, 752 aa, unidentified
  REGION 1..752: note = Description of Unknown:uncultivated organism sequence
  REGION 1..752: note = Category: MG60 effectors
  REGION 1..752: note = Description: MG60-369 effector
MTYYDETLDGNLDMEEQKIYIMKRSGERVIFDKEKIIQAIRKANLEEGILAERLTEDQIVDIVNGIEKDARNASRDLSVEEIQDKVEDGLMGTGKHKVARLYITYRYKHNEMRKMSNIDQKISGVVERDNEEVKQENSNKNPTVLSVQRDYMAGEWSRYYTSRYLLPDDIVMAHKEGVIHFHDADYFAQHMHNCCLVNLGDMLDNGTCISGTHIDTPRSFSTACTVASQIVAQVASSQYGGQTITMSHLAKYVDISRQKITKRLRNEFEEAGINIPEDKLKDIVELEVRKEVESGCQTVQYQLITLQSTNGQAPFVTVFLYLNEVPEGQTRDDLAMIIEVMFKQRILGVKDREGHYITPAFPKLIYVLQENNITEGSKYFYLTKLAAECTAKRMVPDYISEKKSMELKGDCFPCMGCRSFLTPDRFTDTGVGNLANALNFDVTKHKYYGRFNQGVVTINLVDAACSSGGDEKKFWEIMEERLDLCHKALRIRHERLLGTPSDVAPILWQDGALARLKPGETIDKLLYDGYSTISLGYAGLAECVYYMKGVSHTSEEGEAFGLRVMQLLNDSCATWKQHENIDYSVYGTPLESTTYKFAKCLQRRFGKIPHVTDKNYITNSYHVHVTEKIDAFSKLTKEAEFQKLSPGGAVSYVEVPSMQNNIPAVITVLQHMYNTILYAELNTKLDMCDKCGFNGEIQIVKDDTGKLVWECPNCGNRDQNEMHVSRRTCGYIGTQYWNQGRTAEIADRVLHL

SEQ ID NO: 1155 - protein, 758 aa, unidentified
  REGION 1..758: note = Description of Unknown:uncultivated organism sequence
  REGION 1..758: note = Category: MG60 effectors
  REGION 1..758: note = Description: MG60-370 effector
MSGVLFILERGGNMIIIKKNPEAEKKAGAKYVIKRNGSEDLFDENKIVIALFKANDSTIRNKITKKQIGAIADHIKSKVDETPHALNIEDIQDMVENELMRIRAFDVARSYITYRYKRALARQHNTTDDKILSLIEHNNEEVKQENSNKNPIVNSVQRDYMAGEVSKDLCKRVFLPGDIWEAHEDGLIHFHDADYFAQHMHNCCLVNLEDMLQNGTVISGTMIDKPKSFATACNIATQAIAQIASQQYGGQTMSIAHLAPFVEISRQKYMKKQRESMEKAGVKATEAQIASIVEDMVDEEIKRGVQMIQYQLITLMTTNGQAPFVTIYMYLNECRDEKTKADMVKIIREMFRQRIQGVKNEQGVWVTPAFPKLIYVLEEDNIREGSRYWDLTQLAAKCTAKRMVPDYISEKIMKQLKNGDVYSCMGCRSFLTVDRTNGNIANATNYKEGEHKYYGRFNQGVVTLNLVDVACTSAGDEDYFWEILDKRLELCHKALRIRHERLLGTPSDVAPILWQHGALARLKKGETIDKLLYGGYSTISLGYAGLCECTGYMKGVSHTDPDGTEFAMKVMQRLNDACAKWKEAENIDYSVYGTPLESTTYKFAKCLQKRFGIIPGVTDKNYITNSYHVHVTEKINAFDKLKFEAPFQKLSPGGAISYVEVPNLQNNIEAVLSIMQYIYDNIMYAELNTKSDYCEACGYDGEIKIVEDEHGKLVWECPNCGNRDQSRMSVARRTCGYIGTQFWNQGRTQEIKERFVHL

SEQ ID NO: 1156 - protein, 758 aa, unidentified
  REGION 1..758: note = Description of Unknown:uncultivated organism sequence
  REGION 1..758: note = Category: MG60 effectors
  REGION 1..758: note = Description: MG60-371 effector
MSGVLFILERGGNMIIIKKNPEAEKKAGAKYVIKRNGSEDLFDENKIVIALFKANDSTIRNKITKKQIGAIADHIKSKVDETPHALNIEDIQDMVENELMRIGAFDVARSYITYRYKRALARQHNTTDDKILSLIEHNNEEVKQENSNKNPIVNSVQRDYMAGEVSKDLCKRVFLPGDIWEAHEDGLIHFHDADYFAQHMHNCCLVNLEDMLQNGTVISGTMIDKPKSFATACNIATQAIAQIASQQYGGQTMSIAHLAPFVEISRQKYMKKQRESMEKAGVKATEAQIASIVEDMVDEEIKRGVQMIQYQLITLMTTNGQAPFVTIYMYLNECRDEKTKADMVKIIREMFRQRIQGVKNEQGVWVTPAFPKLIYVLEEDNIREGSRYWDITQLAAKCTAKRMVPDYISEKIMKQLKNGDVYSCMGCRSFLTVDRTNGNIANATNYKEGEHKYYGRFNQGVVTLNLVDVACTSAGDEDYFWEILDKRLELCHKALRIRHERLLGTPSDVAPILWQHGALARLKKGETIDKLLYGGYSTISLGYAGLCECTRYMKGVSHTDPDGTEFAMKVMQRLNDACAKWKEAENIDYSVYGTPLESTTYKFAKCLQKRFGIIPGVTDKNYITNSYHVHVTEKINAFDKLKFEAPFQKLSPGGAISYVEVPNLQNNIEAVLSIMQYIYDNIMYAELNTKSDYCEACGYDGEIKIVEDEHGKLVWECPNCGNRDQSRMSVARRTCGYIGTQFWNQGRTQEIKERFVHL

SEQ ID NO: 1157 - protein, 732 aa, unidentified
  REGION 1..732: note = Description of Unknown:uncultivated organism sequence
  REGION 1..732: note = Category: MG60 effectors
  REGION 1..732: note = Description: MG60-372 effector
MNVIKRSGEEVSFDADKILLAIEKANQATQENRQISEDKITEITNRVIQKCNEIARSISVEEIQDLVENELMAEGAYTVAHNYITYRYERALVRKANTTDKKILSLLGRNNEEAMQENSNKNPTVNSTQRDYMAGEVSKDITRRFLLPKEIWDAHEKGIIHFHDSDYFAQPMYNCCLVNLEDMLQNGTVISGTHIDKPHSFATACNIATQIIAQVASNQYGGQTITLSHLAPFVDISRQKYRKSVKAEMEAAGVEISEDKINTIAEERVKREVTTGVQTIQYQIITLMTTNGQAPFVTVFMYLDEVAEGQTRDDLALIIEEMLKQRMQGVKNEKGVYITPAFPKLIYCLDEDNIYNDSKYYYLTKLAAECTAKRMVPDYISAKIMKELKGDVYPCMGCRSFLTPDRFTENGWENNEHAMNSSSKHKYYGRFNQGVVTINLVDVACSSKKDMNAFWKIFDERLDLCYKALMIRHDRLKGTPSDVAPILWQYGAIARLEKGETIDKLLFNGYSTISLGYGGLAECVRYMTGLSHTTPEGEKFGLAVMKHLNDACAKWKQQTNIDFSVYGTPMESTTYKFAKCLQERFGIIKGVTDKNYITNSYHIHVTEEINAFDKLTEESKFQELSPGGAISYVEVPNMQNNIQAVLQLMKHIYNTIMYAELNTKSDYCQVCGYTGEIQITEDENKKLIWKCPNCGNTDQNKMNVARRTCGYIGTQFWNQGRTQEIKERVLHL

SEQ ID NO: 1158 - protein, 822 aa, unidentified
  REGION 1..822: note = Description of Unknown:uncultivated organism sequence
  REGION 1..822: note = Category: MG60 effectors
  REGION 1..822: note = Description: MG60-373 effector
MKQKPVHNPELQLAYDFVQYTGQNIFLTGRAGTGKTTFLRDLKRQSPKRMIVVAPTGVAAINAGGVTIHSFFQLPFGPRVPGYTENEDNHLRFGRHKRNIIRSLDLLVIDEISMVRADLLDSIDERLRQFRRNNQPFGGVQLLLIGDMQQLPPVVKGDEWELLRKFYDTPYFFSSRALLKSNYVTITLQHVYRQRDEKFINILNKIRDKQVDEETLARLNERYQPDFNPGDDNYIILTTHNAKAKAINDKKLAALKGKKVRFTASVTGNFPEYMYPTELELELKPGAQVMFVKNDPDAEKRFFNGKIGNITEIREDGIVVRCPDDDEDIYVEPLEWQNVKYIIEEQNKEIKEKVEGTFTQIPLKLAWAITIHKSQGLTFDRAVIDSEAAFAHGQVYVALSRCRSLEGLVLSTKFSPYSLKQDKSIEGFNIQTNKRQAGPEELTVSKTAYQRQLLEDLIDFSEMQRHVNSFYFLLHDNRKSLQPEVEVPVKEMKEQVLKEITEISEKFKSQIGRLLEKKNDAEKHDELQERIRKGAVYFSDKLNDCILRKIKEFSVESDNAEVLKKVKKAEKRLLEEVWYKRACLDACRDGFIVKDYLKERAMASLEEMPKKRPSKTEKLPVSKDIANAGLYELLKEWRNVRAQELGMPYFMVLPLKTMRALSNQVPSNMDELKRVHGFGRKKIEQFGEELLELLNEYRHDHELKTEPLPEPVKKKEKKPKINTREVSLKLWLQHKDIAKVALERGLTRATVEGHLAHYVGLGELQVEEFVDEEKIRKITKVMTEHNNFTLAEIKAKLGDDVSYGELKMVRQHLLWLGKSKSI

SEQ ID NO: 1159 - protein, 732 aa, unidentified
  REGION 1..732: note = Description of Unknown:uncultivated organism sequence
  REGION 1..732: note = Category: MG60 effectors
  REGION 1..732: note = Description: MG60-374 effector
MNVIKRSGEEVSFDADKILLAIEKANQATQENRQISEDKITEITNRVIQKCNEIARSISVEEIQDLVENELMAEGAYTVAHNYITYRYERALVRKANTTDKKILSLLGRNNEEAMQENSNKNPTVNSTQRDYMAGEVSKDITRRFLLPKEIWDAHEKGIIHFHDSDYFAQPMYNCCLVNLEDMLQNGTVISGTHIDKPHSFATACNIATQIIAQVASNQYGGQTITLSHLAPFVDISRQKYRKSVKAEMEAAGVEISEDKINTIAEERVKREVTTGVQTIQYQIITLMTTNGQAPFVTVFMYLDEVAEGQTRDDLALIIEEMLKQRMQGVKNEKGVYITPAFPKLIYCLDEDNIYNDSKYYYLTKLAAECTAKRMVPDYISAKIMKELKGDVYPCMGCRSFLTPDRFTENGWENNEHAMNSSSKHKYYGRFNQGVVTINLVDVACSSKKDMNAFWKIFDERLDLCYKALMIRHDRLKGTPSDVAPILWQYGAIARLEKGETIDKLLFNGYSTISLGYGGLAECVRYMTGLSHTTPEGEKFGLAVMKHLNDACTKWKQQTNIDFSVYGTPMESTTYKFAKCLQERFGIIKGVTDKNYITNSYHIHVTEEINAFDKLTEESKFQELSPGGAISYVEVPNMQNNIQAVLQLMKHIYNTIMYAELNTKSDYCQVCGYTGEIQITEDENKKLIWKCPNCGNTDQNKMNVARRTCGYIGTQFWNQGRTQEIKERVLHL

SEQ ID NO: 1160 - protein, 716 aa, unidentified
  REGION 1..716: note = Description of Unknown:uncultivated organism sequence
  REGION 1..716: note = Category: MG60 effectors
  REGION 1..716: note = Description: MG60-375 effector
MLEVIKRNGERVPFNRDKITIAIEKAMNSSSGIYEEGQAAKIAGEIEAYAASIQKDLTIYAIEDQVYYRLLKYNNPATARAYENYKTIQAFKRQTNTTDDDVFGLLNNTNLEVLDENSNKNGHVVSTQRDLIAGEVSKDIARRKLIPADIVQAHDSGAIHFHDMDYIIQPMFNCCLINLEDMLANGTVINGKKIDTPKSFQVACTVTTQIIAQVASGQYGGQSINGIDRILAPYVRKSFKKYMKAVVEEQREVYGIEPDMEKAEEIAWKRTKKEIKDGIQTIQYQINTLMTTNGQAPFVTLFMYFQPDYEYAREAALIDEELLRQRIQGIKNEANVYVTPAFPKLIYVLDEHNVREGSPYFYLTKLAAECTAKRMYPDYISAKKMRESYQGNVFSPMGCRSFLSPWKDEKGNYQFDGRFNMGVVSINLPQIGILADGDEEKFFQILDKRLELCKKALLLRVDLLKRITSDVSPIHWQYGAIARLKPGETIEKFIYGGYATLSLGYIGIYEATVLTKHCSHTAPEGRKFAMRIMDDLNAHIQKWKKETNIGFALYGTPAENLTNLFCKIDKARFGSIPDVTDKGYYTNSYHVDVREPINVFDKFSFEADFEDKSTGGCISYAEIPNMTHNIPAVLTMVQYIYDHITYGEFNTKLDYCHECGFDGEIILNDDNEWECPRCHNKDRNKLTVIRRTCGYLGENFWNEGRTQEIKSRVLHI

SEQ ID NO: 1161 - protein, 706 aa, unidentified
  REGION 1..706: note = Description of Unknown:uncultivated organism sequence
  REGION 1..706: note = Category: MG60 effectors
  REGION 1..706: note = Description: MG60-376 effector
METNPQIELAFDFLQYTGTNVFLTGKAGTGKTTFLRELKRRSPKRMIVVAPTGVAAINAGGVTIHSFFQLPFGPYVPGNAEGGAENEKRYTNKFSREKINIIRSLDLLVIDEISMVRADLLDAVSDVLCRYKDRSRPFGGVQLLMIGDLQQLAPVVKDDEWVLLKERYASPFFFCSRALQEVPYVGIELTQVYRQTDAAFLDLLNKVRDNRADQATLQALNRRYIPGFRPDDTEGYITLTTHNYQAQQINREKLEELEEKAYSYEAEIVDEFPEYSFPTDRHLVLKKGAQVMFVKNDASPEKRYYNGKIGRVTAISSDHILVRCGEEREAIMVAKEEWTNTKYTIDAETQEISETVEGVFRQYPLKTAWAITIHKSQGLTFERAIVDAGAAFTHGQVYVALSRCKTLEGLVLSSPLRTGALICDQVVRQFTEGIEQGQPGREQLADAKRAYYLQLLKELFDYNGVLRRMQYMSRILNEHLWRLYPELTERYRTEREFCHNELKDVGERFQMQLERLVNECREPEQDGQVRERVAKGLAYFREHTGRVFALVQDTQPEVDNKEVRKSLNEALGRLQQEVEVKMATLEAAAGGFSVMGHLQAKARAMIEKPKVKARKISDKVDVPEDILHPDLYQILRQWRKEEAASMNLPVYTVLHQKALLGIANILPTNGRELLSIPGIGKKVAERYGKKLLEMVNDYRFATLGDA

SEQ ID NO: 1162 - protein, 1147 aa, unidentified
  REGION 1..1147: note = Description of Unknown:uncultivated organism sequence
  REGION 1..1147: note = Category: MG60 effectors
  REGION 1..1147: note = Description: MG60-377 effector
MKTFAYKQQKSVTFGLIGKEGNPFVKEKKNNFKIKYREQEINFNCDARDRIYGDNLWWLQRIFHYMQNILHMIFAKEPYHRFTFSYEFTLVERKKLQTRRIAEKALKDKIWRKYEKQFQKLLNNISLFDEILEEKEDNFSKISHIVRIIRYINWDTQKLEHCISNYTYFWDKIEKKSALEEFKNFIQKNWDFWELLEFYSKLDKEQFEEYKIALNPAILNTHSEVNQQNWTQELDSLKRSLEALERKNNFNKNIKRFFEEDLEAYINYILYQKNFFKQSKNVEYKNKTQRIYEKYSNLSSNARYQEELVIDFIEGNEIDLENPYKVAQEELDKYLQQQESINSLKNLKSNINFVQLKTFLYQLTWKRAEIKENNKKSEEKLDYQKLSEYIVIIKWEINSRLENANYRYGEFIKRDGIKAQTAQKLWQKYGEYMQKLNFDKELKWYTHFWFIVRKWKRFFIRTYKKEDILNKNQGFTLQDAENLLKEKRDVKWEYTAFLFQSLTLKWLLKLIFIKNAFNLDFKEEYKIYQIWKQKKYIKDRFQSTKLIDFLIKILTSNKWKELFPYVDNYFKKGNQYSKFQEFEKDLLKNSYKVKKYQCNFDESELIELDIVDRKFEHNDAVEPRLKRQNDIQILVEWFFSKQNFSFIRLLPEIKIFVRYQKLFNDMKKRVVSWIDSNWDRYEKEINEKERFYKTISKASFMLELNPCRIGGTPQKEKKEYQDYIIDLYEKREDFHIISIDIGENSFATLGVYDRDLMPKKIDVKWLPQQNENQNKDIIDITDLKIEKWEIVQTNTKNSEKYKSYKNMFENILRYQIYLKDILEQVGEIELKKENYNNIAQKIEESINRISELRFNTGNIIDEVKQDFPLLKNGLKQLLFSYIQNLHNGQDKTINITQYYHQIFEKLELQKVINFKDAFWANFVGVMKEILNRYPGIIVFESLHTGNNYDSYNDVIKKRLQNTTSEKSKEFRTFGTYIWMYIVQSLVNSFSKIIDIKNEKVNQLIYWEKNYETTIWKEKYSNNGILFFVDEKNTSSVCPICNWNFIQKIKKNWEVIEQENKNIKKLFGHWRWKEFETSMHHINDENNKNYQRWKWKSGNLEKGDLCDYGIWNKNYPEFEFIKSWDDLATYNIAKKAKEYLESLSKKED

SEQ ID NO: 1163 - protein, 463 aa, unidentified
  REGION 1..463: note = Description of Unknown:uncultivated organism sequence
  REGION 1..463: note = Category: MG60 effectors
  REGION 1..463: note = Description: MG60-378 effector
MVNLKNFKNLYEVRKTVRFELKPYKKTRELLKWKNNYQSLDSYIKHIKDWEFEDWFDWNDFCLWKYEDFLKESKKYYWFLFQINAEIQKWRNDTTKKNIHFDLKKSKGIFKNIPSLKKIQWFEWLKSKLLEIQDEYQNYFNFFDQLQHKQHKNEKKSDISIYLRKIAYLNRNLFTIFNFFDTYKTNQEILDKKKEIIDYDFEKLNNSIIASHENEISGACFWKFTFNKFALFRREASLLKEKLETNKQVLQKAVATMVADGEIINDNWTIVDINTNQIHSLTLQKKICYSLKFEEEIWTLQGRLEKFNFNRNLDEVISELDDINGQLLNQYIQNFVNGYKNDENILEVSFYTDHEGNEIFDKSKKYDSYENGQKKEKFYPSLLKLDLEQFVEAQKRNQIKIQPGQTLEWYQYINLLGKDELANEEKEQKKLLNKFLQILFKQEFINPDYNTIKKFRDTLAKYR

SEQ ID NO: 1164 - protein, 1232 aa, unidentified
  REGION 1..1232: note = Description of Unknown:uncultivated organism sequence
  REGION 1..1232: note = Category: MG61 effectors
  REGION 1..1232: note = Description: MG61-1 effector
MDYAKFTKQGKLIKGIKLELVPQGNTRDAISEYKIVEADQQLADMVKEVVMAGNEFYKDFIKQIVRHMDGADWQAYGEAVENKTADQKAYDEAVKSISASIKNAILDTAELYGGKKTLFAKDFITIVLRKYVETAENFPYNRERVLTCIDVLSDKNALFKTPYVKWEHIIFGESKGSIAERMLSNFDIFYDNRNKYAALKEATAITDFDDFFTDYASYTRYVGQGGIELYNSAIRGIYSESGAKISEGINEYINKLKMKHPELHVNMLKKLQKQILSNSEPLFKVATIQNAEELKGIMNKVKVAEESVLSSAKELLVHMETSDLHDLYISGQRLYFVCQKVAKDGEILEELIFNDECSRVEKLTEKKKEEIRGAIVKQDYNFAYIDSLLSEYAEKTVKMVINEELQKLIAAIVSSGASYDSITINPKWKAVPDKEVTVIREYLESFVELNKFIKCLQVRDSDVYPDFKTYATLNALADELGALNKAYNMVRNFVTKKVNDKDGKTRLCFGKGALLERGWNRKNQAVDWLGNIDHMLLTKDGKYYYAVPAPVKRKTKIYISDTKPSDEVYEYMEISKQSSFLKTFARLFTSLGLKNIGDADDITMDLGNGSMTVTKEFLVKYKDGECKKDVDFMHKSIDIAKEFLAKHYSYANFNFSELKKTEDYASFYEFANDVDKYTYAVKTKYIDAAIIDKAVEDKELLLFMLSSMDLYKPQESCKDITALYTRYFFSEENKKKADIWLNANPAIYYRKPLIKFEKTHPAGSILVRKTYEDKDGITHIVPDKVYMSLYNHYNKNTPLNEEAMQYVDLVEHHVAVQDYVKDARYTREMFTINLSFTLNGDAGDAAQTYTINNMVKEQIKAKMPRMLTVVRGYRNLLEYCVTDETGKVFESGNFNTIGGVNFKEKLEDLDKIRKIDAQNWKYEKTVVNIKESYLGMVTSSIVKKAVEYDAIINVEQLSDAFKDKRSCMDNQVFKKFEEKLVNKLACYYDKEKAPTEPGGYLNPLQLASPNCLSNTQNGILFYVSPAYTNEVCPKSNFINLLDFSAAKTLKAKREFLRKMSGICYDAEHEAFHFSFCYDDMPIKLPVKEKKELNDKTNQEFGKHIWTVYTNGVRTEYNKKERKLIELNGTEILGKECAKNNVMLTDHMDVDSMPNSVVNEMIHIFQKYSFGEVAQKDVYYVSPVSPQAGPICTPGELRLKSMSEKGYMILHNIVAGKEKFAVNKIEWLEEKLG

SEQ ID NO: 1165 - protein, 1253 aa, unidentified
  REGION 1..1253: note = Description of Unknown:uncultivated organism sequence
  REGION 1..1253: note = Category: MG61 effectors
  REGION 1..1253: note = Description: MG61-2 effector
MELNKFCRLNQSIKTCSLELVPIGRTRETIEKHNVIEEDSKRKENAVLAKEVSDSFIREFIADYKGDFDWSELVACFGKHEEYAGIKEKMEEKIAREFSDAFNGYISKFLKANGVGKADNKTKWSDASYIDVVLPLYASLHPDYDNPKYKEAIASICHCSSTIFKRYITAYEKIINGTKKGSFAERVMDNFQIICTNRLMCEIVFSKIKKADDFRLFLDAPESMNEYLSQKGIDQYNETIGDSFSEKGEILRYGLNHYINEWNQKNPDSRMPKLQKLKKQILSVAEPAFRIDVIDNEKELQETIKNIRAAEVRYSGKLKDILENLNYTNTYIHDGVLVKAAGRENLAKMITGEWNFFREQIREREERRIRDEYLQKKNRIKTKLTKKDEKQIEDTVSKGMYSLVDLNKMLGEEKANIESKLLDEYVKNRSEREKHYTVVANADFMSKESLPTSDEIKIIQNYLDKVIQMTHIIRCLDADAQNEKVDLVFLDDAAELEDDKTLIVTGYNLIRNFLTKKREKTAKEKAVQLCFGRPAHFEQKWNNKQAGKFGNVDAALLEENGKFYYIVPAAKNESKLNFPVTDEPQAGRCYNYLSTQKAIGFAKAFAKFTIKSPEAMSGYAKSEEPFEISVGNQKMTVSKKMYDSYEAKTFRDSEEEKIKLIDYAKEFLQKHGSYNTYDWSELRESKDYVNYGEFCSEVDSIAFRVVNRYISKDLVDDAVLRGDLYMFEITSQDMYKDKNRMKNIMALRFHAIMEGMKTGNKSIIINNAPQIRYRPQIIEAEDKHPAGSKLVNKKTTDGKTIPGDIYLELCDFYNGRKSSLSPEASLYNERVSVKVSDREHIKDKHYTAEKFLITLSYTMNKNVASNTSVYKLNEMIRNEIKENGCNIMSVIRGIDNLLYYAVIDENGNKIEAGDLNVVGDTDFNEMLSVVGTQRYIDQKNWKYEKKVAELKDTYLGQACRKIASIAVKNNAVIVIDKINENTKRKNAAFDNNVYRKFEDALVNTLSNYYDRSIKADEPGGISNPLQLCVNEDNNFQNGILFYTYDAFTKNICMDTGFINLLNTFNVKTVAAKLGFLKKMDGIYYDSDRQEFVFEFAWGKLGSVLKEEEAALYTGLDKSWKVRTHLTRYKRDRESGKYKEVDGTEILKKLIKEKHPDMIGEKINVDKLTSNEVQTVYEIFTLYVNGFIPRMDGESSEYMSPVSDWNSMSNIAYDEMTALQLARKGSLTIGRIKNGFEGKDINISRVDWLNEILR

SEQ ID NO: 1166 - protein, 846 aa, unidentified
  REGION 1..846: note = Description of Unknown:uncultivated organism sequence
  REGION 1..846: note = Category: MG61 effectors
  REGION 1..846: note = Description: MG61-3 effector
MDFTKFQKLNSIIKTCSFEMIPIGKTRETMEKHNVIEEDAERKSNAELTKEASDSFIREFIADYKEDMDWKDLYDAYGEDRARFTDIMNQKAEKLAKRFSDSFNEYINTFLKANGINDKKSKWSDSGYVDVVLPLYVSIHPDFSNDKYERAVASLLHCSNSLFKKYTTSYARIIAGTKKGSFADRSMENFQTACANSVMFDLISRNLSSVGSHDAFKEVFADAPLNMNEYLSQKGISRYNEFVGDSFDESGQVIRYGVNHYINEWNQTHPDERMPKMHKLKKQILSIVEPSFRIRTINDETELFGTFDNIRTAEQRYAGMLESILENMNTADIYDKSGILVTSAERDSLANAITGEWSYFRRQIKEEEENRIREEYLQKKNRVKTKLTQKDNKQIEDALNKSIYSVADLNKMLGSDFGTIEEKLLDEYIRNKSKKESAYAQLVKTDFYDKKTIPAGDDVQRIQQYLDKVLSLTHIVRGLCADSQDPRTDFVFSDDVSSLEDDRVQIISCYNLIRNFVTKKREKTAKEKQIQLCFGRPAHFEQVWNNKQEGKFGNVDAALLEYAGKYYYMVPAAKNEAKLNFPVTDEPQMGECYNYLATKKAIGFAKAFAKFYIKSPEAMEGFEKTEEPFEISVGNDTMIISRKVYEDYEAKTFRESEEAKNKLIDCAKEFLSKNLSYCIYDWSVLKEANDYVNYGEFCNEVDSIAFRVINRYVSKKLVDDAVERGNLYMFEISSLDMYKDSSRMKNIMALRFNQIMNGMFTGDKSIIINNAPQIRYRPVVIEKKDVHPVGSRLVNKNTTDGRTIPGDVYLELCAYYNGKKDSLSPEASLYNEKVSVKDSDRAHIKD

SEQ ID NO: 1167 - protein, 1259 aa, unidentified
  REGION 1..1259: note = Description of Unknown:uncultivated organism sequence
  REGION 1..1259: note = Category: MG61 effectors
  REGION 1..1259: note = Description: MG61-4 effector
MDFTKFQKLNSIIKTCSFEMIPIGKTRETMEKHNVIEEDAERKSNAELTKEVSDSFIREFIADYKEDMDWKDLYDAYGEDRARFTDIMNQKAEKLAKRFSDSFNEYINTFLKANGIKDKKSKWSDSGYVDVVLPLYVSIHPDFSNDKYERAVASLLHCSNSLFKKYTTSYARIIAGTKKGSFADRSMENFQTACANSVMFDLISINLSNVGSHDAFKEVFADAPLNMNEYLSQKGISRYNEFVGDSFDESGQVIRYGVNHYINEWNQTHPDERMPKMHKLKKQILSIVEPSFRIRTINDETELFGTFDNIRTAEQRYAGMLESILENMNTADIYDKSGILVTSAERDSLANAITGEWSYFRRQIKEEEENRIREEYLQKKNRVKTKLTQKDNKQIEDALNKSIYSVADLNKMLGSDFGTIEEKLLDEYIRNKSKKESAYAQLVKTDFYDKKTIPAGDDVQRIQQYLDKVLGLTHIVRGLCADSQDPRTDFVFSDDVSSLEDDRVQIISCYNLIRNFVTKKREKTAKEKQIQLCFGRPAHFEQVWNNKQEGKFGNVDAALLEYAGKYYYMVPAAKNEAKLNFPVTDEPQRGECYNYLATKKAIGFAKAFAKFYIKSPEAMEGFEKTEEPFEISVGNDTMIISRKVYEDYEAKTFRESEEAKNKLIDCAKEFLSKNLSYCIYDWSGLKETKDYVNYGEFCNEVDSIAFRVINRYVSKKLVDDAVERGNLYMFEISSLDMYKDSSRMKNIMALRFNQIMNGMFTGDKSIIINNAPQIRYRPVVIEKKDVHPVGSRLVNKNTTDGRTIPGDVYLELCAYYNGKKDSLSPEASLYNEKVSVKDSDRAHIKDKHYTEEKFLITFSYTANKNVASATSGYQLNEMVRKEIRENGCNIMAVIRGIDNLLYYAVVDENGNRIEAGDLNVVGDTDFYEKLTILGKQRYTDQKNWKHENKVADLKDTYLGQVCRKIASIAVKNNAVIVIDKINERTKRKNAAFDNNMYRKFENALVNSLTDYYDIGIRGDEPGSVKNPLQLTVKEDNGFQNGIIFYQFDTFTKNICMRTGFVNLLNTFEIKTVASKVAFLKKLSGIYYDNDINEFVFEFTWRNIGCILKDEELSLYDGMDKIWKVRTHFTRYMRNAEKNKYVEIDGTEVLKELIRKNHPDMIGGKIDVDRLTSEEVKKVFEIFTLYTNGYIPRMDDAESGYMSPACDWNNFGTIRYDEMTALQLAKKSSLMIGKVKSGKDWKDMNVSRVEWLNHVLKADW

SEQ ID NO: 1168 - protein, 1259 aa, unidentified
  REGION 1..1259: note = Description of Unknown:uncultivated organism sequence
  REGION 1..1259: note = Category: MG61 effectors
  REGION 1..1259: note = Description: MG61-5 effector
MDFTKFQKLNSIIKTCSFEMIPIGKTRETMEKHNVIEEDAERKSNAELTKEVSDSFIREFIADYKEDMDWKDLYDAYGEDRARFTDIMNQKAEKLAKRFSDSFNEYINTFLKANGIKDKKSKWSDSGYVDVVLPLYVSIHPDFSNDKYERAVASLLHCSNSLFKKYTTSYARIIAGTKKGSFADRSMENFQTACANSVMFDLISINLSNVGSHDAFKEVFADAPLNMNEYLSQKGISRYNEFVGDSFDESGQVIRYGVNHYINEWNQTHPDERMPKMHKLKKQILSIVEPSFRIRTINDETELFGTFDNIRTAEQRYAGMLESILENMNTADIYDKSGILVTSAERDSLANAITGEWSYFRRQIKEEEENRIREEYLQKKNRVKTKLTQKDNKQIEDALNKSIYSVADLNKMLGSDFGTIEEKLLDEYIRNKSKKESAYAQLVKTDFYDKKTIPAGDDVQRIQQYLDKVLGLTHIVRGLCADSQDPRTDFVFSDDVSSLEDDRVQIISCYNLIRNFVTKKREKTAKEKQIQLCFGRPAHFEQVWNNKQEGKFGNVDTALLEYAGKYYYMVPAAKNEAKLNFPVTDEPQRGECYNYLATKKAIGFAKAFAKFYIKSPEAMEGFEKTEEPFEISVGNDTMIISRKVYEDYEAKTFRESEEAKNKLIDCAKEFLSKNLSYCIYDWSGLKETKDYVNYGEFCNEVDSIAFRVINRYVSKKLVDDAVERGNLYMFEISSLDMYKDSSRMKNIMALRFNQIMNGMFTGDKSIIINNAPQIRYRPVVIEKKDVHPVGSRLVNKNTTDGRTIPGDVYLELCAYYNGKKDSLSPEASLYNEKVSVKDSDRAHIKDKHYTEEKFLITFSYTANKNVASATSGYQLNEMVRKEIRENGCNIMAVIRGIDNLLYYAVVDENGNRIEAGDLNVVGDTDFYEKLTILGKQRYTDQKNWKHENKVADLKDTYLGQVCRKIASIAVKNNAVIVIDKINERTKRKNAAFDNNMYRKFENALVNSLTDYYDIGIRGDEPGSVKNPLQLTVKEDNGFQNGIIFYQFDTFTKNICMRTGFVNLLNTFEIKTVASKVAFLKKLSGIYYDNDINEFVFEFTWRNIGCILKDEELSLYDGMDKIWKVRTHFTRYMRNAEKNKYVEIDGTEVLKELIRKNHPDMIGGKIDVDRLTSEEVKKVFEIFTLYTNGYIPRMDDAESGYMSPACDWNNFGTIRYDEMTALQLAKKSSLMIGKVKSGKDWKDMNVSRVEWLNHVLKADW

SEQ ID NO: 1169 - protein, 1259 aa, unidentified
  REGION 1..1259: note = Description of Unknown:uncultivated organism sequence
  REGION 1..1259: note = Category: MG61 effectors
  REGION 1..1259: note = Description: MG61-6 effector
MDFTKFQKLNSIIKTCSFEMIPIGKTRETMEKHNVIEEDAERKSNAELTKEVSDSFIREFIADYKEDMDWKDLYDAYGEDRARFTDIMNQKAEKLAKRFSDSFNEYINTFLKANGIKDKKSKWSDSGYVDVVLPLYVSIHPDFSSDKYERAVASLLHCSNSLFKKYTTSYARIIAGTKKGSFADRSMENFQTVCANSVMFDLISRNLSSVECHDTFKEVFADAPLNMNEYLSQKGISRYNEFVGDSFDESGQVIRYGVNHYINEWNQTHPDERMPKMHKLKKQILSIVEPSFRIRTINDETELFGTFDNIRTAEQRYAGMLESILENMNTADIYDKSGILVTSAERDSLANAITGEWSYFRRQIKEEEENRIREEYLQKKNRVKTKLTQKDNKQIEDALNKSIYSVADLNKMLGSDFGTIEEKLLDEYIRNKSKKESAYAQLVKTDFYDKKTIPAGDDVQRIQQYLDKVLSLTHIVRGLCADSQDPRTDFVFSDDVSSLEDDRVQIVTCYNLIRNFVTKKREKTAKEKQIQLCFGRPAHFEQVWNNKQEGKFGNVDAALLEYAGKYYYMVPAAKNEAKLNFPVTDEPQRGECYNYLATKKAIGFAKAFAKFYIKSPEAMEGFEKTEEPFEISVGNDTMIISRKVYEDYEAKTFRESEEAKNKLIDCAKEFLSKNLSYCIYDWSVLKEANDYVNYGEFCNEVDSIAFRVINRYVSKKLVDDAVERGNLYMFEISSLDMYKDSSRMKNIMALRFNQIMNGMFTGDKSIIINNAPQIRYRPVVIEKKDVHPVGSRLVNKNTTDGRTIPGDVYLELCAYYNGKKDSLSPEASLYNEKVSVKDSDRAHIKDKHYTEEKFLITFSYTANKNVASATSGYQLNEMVRKEIRENGCNIMAVIRGIDNLLYYAVVDENGNRIEAGDLNVVGDTDFYEKLTILGKQRYTDQKNWKHENKVADLKDTYLGQVCRKIASIAVKNNAVIVIDKINESTKRKNAAFDNNMYRKFENALVNSLTDYYDIGIRGDEPGSVKNPLQLTVKEDNGFQNGIIFYQFDTFTKNICMRTGFVNLLNTFEIKTVASKVAFLKKLSGIYYDNDINEFVFEFTWRNIGCILKDEELSLYDGMDKIWKVRTHFTRYMRNAEKNKYVEIDGTEVLKELIRKNHPDMIGGKIDVDRLTSEEVKKVFEIFTLYTNGYIPRMDDAESGYMSPACDWNNFGTIRYDEMTALQLAKKSSLMIGKVKSGKDWKDMNVSRVEWLNHVLKADW

SEQ ID NO: 1170 - protein, 1259 aa, unidentified
  REGION 1..1259: note = Description of Unknown:uncultivated organism sequence
  REGION 1..1259: note = Category: MG61 effectors
  REGION 1..1259: note = Description: MG61-7 effector
MDFTKFQKLNSIIKTCSFEMIPIGKTRETMEKHNVIEEDAERKSNAELTKEVSDSFIREFIADYKEDMDWKDLYDAYGEDRARFTDIMNQKAEKLAKRFSDSFNEYINTFLKANGIKDKKSKWSDSGYVDVVLPLYVSIHPDFSSDKYERAVASLLHCSNSLFKKYTTSYARIIAGTKKGSFADRSMENFQTVCANSVMFDLISRNLSSVECHDTFKEVFADAPLNMNEYLSQKGISRYNEFVGDSFDESGQVIRYGVNHYINEWNQTHPDERMPKMHKLKKQILSIVEPSFRIRTINDETELFGTFDNIRTAEQRYAGMLESILENMNTADIYDKSGILVTSAERDSLANAITGEWSYFRRQIKEEEENRIREEYLQKKNRVKTKLTQKDNKQIEDALNKSIYSVADLNKMLGSDFGTIEEKLLDEYIRNKSKKESAYAQLVKTDFYDKKTIPAGDDVQRIQQYLDKVLSLTHIVRGLCADSQDPRTDFVFSDDVSSLEDDRVQIVTCYNLIRNFVTKKREKTAKEKQIQLCFGRPAHFEQVWNNKQEGKFGNVDAALLEYAGKYYYMVPAAKNEAKLNFPVTDEPQRGECYNYLATKKAIGFAKAFAKFYIKSPEAMEGFEKTEEPFEISVGNDTMIISRKVYEDYEAKTFRESEEAKNKLIDCAKEFLSKNLSYCIYDWSVLKEANDYVNYGEFCNEVDSIAFRVINRYVSKKLVDDAVERGNLYMFEISSLDMYKDSSRMKNIMALRFNQIMNGMFTGDKSIIINNAPQIRYRPVVIEKKDVHPVGSRLVNKNTTDGRTIPGDVYLELCAYYNGKKDSLSPEASLYNEKVSVKDSDRAHIKDKHYTEEKFLITFSYTANKNVASATSGYQLNEMVRKEIRENGCNIMAVIRGIDNLLYYAVVDENGNRIEVGDLNVVGDTDFYEKLTILGKQRYTDQKNWKHENKVADLKDTYLGQVCRKIASIAVKNNAVIVIDKINESTKRKNAAFDNNMYRKFENALVNSLTDYYDIGIRGDEPGSVKNPLQLTVKEDNGFQNGIIFYQFDTFTKNICMRTGFVNLLNTFEIKTVASKVAFLKKLSGIYYDNDINEFVFEFTWRNIGCILKDEELSLYDGMDKIWKVRTHFTRYMRNAEKNKYVEIDGTEVLKELIRKNHPDMIGGKIDVDRLTSEEVKKVFEIFTLYTNGYIPRMDDAESGYMSPACDWNNFGTIRYDEMTALQLAKKSSLMIGKVKSGKDWKDMNVSRVEWLNHVLKADW

SEQ ID NO: 1171 - protein, 1259 aa, unidentified
  REGION 1..1259: note = Description of Unknown:uncultivated organism sequence
  REGION 1..1259: note = Category: MG61 effectors
  REGION 1..1259: note = Description: MG61-8 effector
MDFTKFQKLNSIIKTCSFEMIPIGKTRETMEKHNVIEEDAERKSNAELTKEVSDSFIREFIADYKEDMDWKDLYDAYGEDRARFTDIMNQKAEKLAKRFSDSFNEYINTFLKANGINDKKSKWSDSGYVDVVLPLYVSIHPDFSNDKYERAVASLLHCSNSLFKKYTTSYARIIAGTKKGSFADRSMENFQTACANSVMFDLISRNLSSVGSHDAFKEVFADAPLNMNEYLSQKGISRYNEFVGDSFDESGQVIRYGVNHYINEWNQTHPDERMPKIHKLKKQILSIVEPSFRIRTINDETELFGTFDNIRTAEQRYAGMLESILENMNTADIYDKSGILVTSAERDSLANAITGEWSYFRRQIKEEEENRIREEYLQKKNRVKTKLTQKDNKQIEDALNKSIYSVADLNKMLGSDFGTIEEKLLDEYIRNKSKKESAYAQLVKTDFYDKKTIPAGDDVQRIQQYLDKVLSLTHIVRGLCADSQDPRTDFVFSDDVSSLEDDRVQIISCYNLIRNFVTKKREKTAKEKQIQLCFGRPAHFEQVWNNKQEGKFGNVDAALLEYAGKYYYMVPAAKNEAKLNFPVTDEPQMGECYNYLATKKAIGFAKAFAKFYIKSPEAMEGFEKTEEPFEISVGNDTMIISRKVYEDYEVKTFRESEEAKNKLIDCAKEFLSKNLSYCIYDWSVLKEANDYVNYGEFCNEVDSIAFRVINRYVSKKLVDDAVERGNLYMFEISSLDMYKDSSRMKNIMALRFNQIINGMFTGDKSIIINNAPQIRYRPVVIEKKDVHPVGSRLVNKNTTDGRTIPGDVYLELCAYYNGKKDSLSPEASLYNEKVSVKDSDRAHIKDKHYTEEKFLITFSYTANKNVASATSGYQLNEMVRKEIRENGCNIMAVIRGIDNLLYYAVVDENGNRIEAGDLNVVGDTDFYEKLTILGKQRYTDQKNWKHENKVADLKDTYLGQVCRKIASIAVKNNAVIVIDKINESTKRKNAAFDNNMYRKFENALVNSLTDYYDIGIRGDEPGSVKNPLQLTVKEDNGFQNGIIFYQFDTFTKNICMRTGFVNLLNTFEIKTVASKVAFLKKLSGIYYDNDINEFVFEFTWRNIGCILKDEELPLYDGMDKIWKVRTHFTRYMRNAEKNKYVEIDGTEVLKELIRKNHPDMIGGKIDVDRLTSEEVKKVFEIFTLYTNGYIPRMDDAESGYMSPACDWNNFGTIRYDEMTALQLAKKSSLMIGKVKSGKDWKDMNVSRVEWLNHVLKADW

SEQ ID NO: 1172 - protein, 1259 aa, unidentified
  REGION 1..1259: note = Description of Unknown:uncultivated organism sequence
  REGION 1..1259: note = Category: MG61 effectors
  REGION 1..1259: note = Description: MG61-9 effector
MDFTKFQKLNSIIKTCSFEMIPIGKTRETMEKHNVIEEDAERKSNAELTKEVSDSFIREFIADYKEDMDWKDLYDAYGEDRARFTDIMNQKAEKLAKRFSDSFNEYINTFLKANGINDKKSKWSDSGYVDVVLPLYVSIHPDFSNDKYERAVASLLHCSNSLFKKYTTSYARIIAGTKKGSFADRSMENFQTACANSVMFDLISRNLSSVGSHDAFKEVFADAPLNMNEYLSQKGISRYNEFVGDSFDESGQVIRYGVNHYINEWNQTHPDERMPKMHKLKKQILSIVEPSFRIRTINDETELFGTFDNIRTAEQRYAGMLESILENMNTADIYDKSGILVTSAERDSLANAITGEWSYFRRQIKEEEENRIREEYLQKKNRVKTKLTQKDNKQIEDALNKSIYSVADLNKMLGSDFGTIEEKLLDEYIRNKSKKESAYAQLVKTDFYDKKTIPAGDDVQRIQQYLDKVLSLTHIVRGLCADSQDPRTDFVFSDDVSSLEDDRVQIISCYNLIRNFVTKKREKTAKEKQIQLCFGRPAHFEQVWNNKQEGKFGNVDAALLEYAGKYYYMVPAAKNEAKLNFPVTDEPQMGECYNYLATKKAIGFAKAFAKFYIKSPEAMEGFEKTEEPFEISVGNDTMIISRKVYEDYEAKTFRESEEAKNKLIDCAKEFLSKNLSYCIYDWSGLKETKDYVNYGEFCNEVDSIAFRVINRYVSKKLVDDAVERGNLYMFEISSLDMYKDSSRMKNIMALRFNQIMNGMFTGDKFIIINNAPQIRYRPVVIEKKDVHPVGSRLVNKNTTDGRTIPGDVYLELCAYYNGKKDSLSPEASLYNEKVSVKDSDRAHIKDKHYTEEKFLITFSYTANKNVASATSGYQLNEMVRKEIRENGCNIMAVIRGIDNLLYYAVVDENGNRIEAGDLNVVGDTDFYEKLTILGKQRYTDQKNWKHENKVADLKDTYLGQVCRKIASIAVKNNAVIVIDKINERTKRKNAAFDNNMYRKFENALVNSLTDYYDIGIRGDEPGSVKNPLQLTVKEDNGFQNGIIFYQFDTFTKNICMRTGFVNLLNTFEIKTVASKVAFLKKLSGIYYDNDINEFVFEFTWRNIGCILKDEELSLYNGMDKIWKVRTHFTRYMRNAEKNKYVEIDGTEVLKELIRKNHPDMIGGKIDVDRLTSEEVKKVFEIFTLYTNGYIPRMDDAESGYMSPACDWNNFGTIRYDEMTALQLAKKSSLMIGKVKSGKDWKDMNVSRVEWLNHVLKADW

SEQ ID NO: 1173 - protein, 1259 aa, unidentified
  REGION 1..1259: note = Description of Unknown:uncultivated organism sequence
  REGION 1..1259: note = Category: MG61 effectors
  REGION 1..1259: note = Description: MG61-10 effector
MDFTKFQKLNSIIKTCSFEMIPIGKTRETMEKHNVIEEDAERKSNAELTKEVSDSFIREFIADYKEDMDWKDLYDAYGEDRARFTDIMNQKAEKLAKRFSDSFNEYINTFLKANGINDKKSKWSDSGYVDVVLPLYVSIHPDFSNDKYERAVASLLHCSNSLFKKYTTSYARIIAGTKKGSFADRSMENFQTACANSVMFDLISRNLSSVGSHDAFKEVFADAPLNMNEYLSQKGISRYNEFVGDSFDESGQVIRYGVNHYINEWNQTHPDERMPKMHKLKKQILSIVEPSFRIRTINDETELFGTFDNIRTAEQRYAGMLESILENMNTADIYDKSGILVTSAERDSLANAITGEWSYFRRQIKEEEENRIREEYLQKKNRVKTKLTQKDNKQIEDALNKSIYSVADLNKMLGSDFGTIEEKLLDEYIRNKSKKESAYAQLVKTDFYDKKTIPAGDDVQRIQQYLDKVLSLTHIVRGLCADSQDPRTDFVFSDDVSSLEDDRVQIISCYNLIRNFVTKKREKTAKEKQIQLCFGRPAHFEQVWNNKQEGKFGNVDAALLEYAGKYYYMVPAAKNEAKLNFPVTDEPQMGECYNYLATKKAIGFAKAFAKFYIKSPEAMEGFEKTEEPFEISVGNDTMIISRKVYEDYEAKTFRESEEAKNKLIDCAKEFLSKNLSYCIYDWSVLKEANDYVNYGEFCNEVDSIAFRVINRYVSKKLVDDAVERGNLYMFEISSLDMYKDSSRMKNIMALRFNQIMNGMFTGDKSIIINNAPQIRYRPVVIEKKDVHPVGSRLVNKNTTDGRTIPGDVYLELCAYYNGKKDSLSPEASLYNEKVSVKDSDRAHIKDKHYTEEKFLITFSYTANKNVASATSGYQLNEMVRKEIRENGCNIMAVIRGIDNLLYYAVVDENGNRIEAGDLNVVGDTDFYEKLTILGKQRYTDQKNWKHENKVADLKDTYLGQVCRKIASIAVKNNAVIVIDKINESTKRKNAAFDNNMYRKFENALVNSLTDYYDIGIRGDEPGSVKNPLQLTVKEDNGFQNGIIFYQFDTFTKNICMRTGFVNLLNTFEIKTVASKVAFLKKLSGIYYDNDINEFVFEFTWRNIGCILKDEELPLYDGMDKIWKVRTHFTRYMRNAEKNKYVEIDGTEVLKELIRKNHPDMIGGKIDVDRLTSEEVKKVFEIFTLYTNGYIPRMDDAESGYMSPACDWNNFGTIRYDEMTALQLAKKSSLMIGKVKSGKDWKDMNVSRVEWLNHVLKADW

SEQ ID NO: 1174 - protein, 1259 aa, unidentified
  REGION 1..1259: note = Description of Unknown:uncultivated organism sequence
  REGION 1..1259: note = Category: MG61 effectors
  REGION 1..1259: note = Description: MG61-11 effector
MDFTKFQKLNSIIKTCSFEMIPIGKTRETMEKHNVIEEDAERKSNAELTKEVSDSFIREFIADYKEDMDWKDLYDAYGEDRARFTDIMNQKAEKLAKRFSDSFNEYINTFLKANGINDKKSKWSDSGYVDVVLPLYVSIHPDFSNDKYERAVASLLHCSNSLFKKYTTSYARIIAGTKKGSFADRSMENFQTACANSVMFDLISRNLSSVGSHDAFKEVFADAPLNMNEYLSQKGISRYNEFVGDSFDESGQVIRYGVNHYINEWNQTHPDERMPKMHKLKKQILSIVEPSFRIRTINDETELFGTFDNIRTAEQRYAGMLESILENMNTADIYDKSGILVTSAERDSLANAITGEWSYFRRQIKEEEENRIREEYLQKKNRVKTKLTQKDNKQIEDALNKSIYSVADLNKMLGSDFGTIEEKLLDEYIRNKSKKESAYAQLVKTDFYDKKTIPAGDDVQRIQQYLDKVLSLTHIVRGLCADSQDPRTDFVFSDDVSSLEDDRVQIISCYNLIRNFVTKKREKTAKEKQIQLCFGRPAHFEQVWNNKQEGKFGNVDAALLEYAGKYYYMVPAAKNEAKLNFPVTDEPQMGECYNYLATKKAIGFAKAFAKFYIKSPEAMEGFEKTEEPFEISVGNDTMIISRKVYEDYEAKTFRESEEAKNKLIDCAKEFLSKNLSYCIYDWSVLKEANDYVNYGEFCNEVDSIAFRVINRYVSKKLVDDAVERGNLYMFEISSLDMYKDSSRMKNIMALRFNQIMNGMFTGDKSIIINNAPQIRYRPVVIEKKDVHPVGSRLVNKNTTDGRTIPGDVYLELCAYYNGKKDSLSPEASLYNEKVSVKDSDRAHIKDKHYTEEKFLITFSYTANKNVASATSGYQLNEMVRKEIRENGCNIMAVIRGIDNLLYYAVVDENGNRIEAGDLNVVGDTDFYEKLTILGKQRYTDQKNWKHENKVADLKDTYLGQVCRKIASIAVKNNAVIVIDKINESTKRKNAAFDNNMYRKFENALVNSLTDYYDIGIRGDEPGSVKNPLQLTVKEDNGFQNGIIFYQFDTFTKNICMRTGFVNLLNTFEIKTVASKVAFLKKLSDIYYDNDINEFVFEFTWRNIGCILKDEELPLYDGMDKIWKVRTHFTRYMRNAEKNKYVEIDGTEVLKELIRKNHPDMIGGKIDVDRLTSEEVKKVFEIFTLYTNGYIPRMDDAESGYMSPACDWNNFGTIRYDEMTALQLAKKSSLMIGKVKSGKDWKDMNVSRVEWLNHVLKADW

SEQ ID NO: 1175 - protein, 1259 aa, unidentified; identical to SEQ ID NO: 1172
  REGION 1..1259: note = Description of Unknown:uncultivated organism sequence
  REGION 1..1259: note = Category: MG61 effectors
  REGION 1..1259: note = Description: MG61-12 effector

SEQ ID NO: 1176 - protein, 1259 aa, unidentified
  REGION 1..1259: note = Description of Unknown:uncultivated organism sequence
  REGION 1..1259: note = Category: MG61 effectors
  REGION 1..1259: note = Description: MG61-13 effector
MDFTKFQKLNSIIKTCSFEMIPIGKTRETMEKHNVIEEDAERKSNAELTKEVSDSFIREFIADYKEDMDWKDLYDAYGEDRARFTDIMNQKAEKLAKRFSDSFNEYINTFLKANGINDKKSKWSDSGYVDVVLPLYVSIHPDFSNDKYERAVASLLHCSNSLFKKYTTSYARIIAGTKKGSFADRSMENFQTACANSVMFDLISRNLSSVGSHDAFKEVFADAPLNMNEYLSQKGISRYNEFVGDSFDESGQVIRYGVNHYINEWNQTHPDERMPKMHKLKKQILSIVEPSFRIRTINDETELFGTFDNIRTAEQRYAGMLESILENMNTADIYDKSGILVTSAERDSLANAITGEWSYFRRQIKEEEENRIREEYLQKKNRVKTKLTQKDNKQIEDALNKSIYSVADLNKMLGSDFGTIEEKLLDEYIRNKSKKESAYAQLVKTDFYDKKTIPAGDDVQRIQQYLDKVLSLTHIVRGLCADSQNPRTDFVFSDDVSSLEDDRVQIISCYNLIRNFVTKKREKTAKEKQIQLCFGRPAHFEQVWNNKQEGKFGNVDAALLEYAGKYYYMVPAAKNEAKLNFPVTDEPQMGECYNYLATKKAIGFAKAFAKFYIKSPEAMEGFEKTEEPFEISVGNDTMIISRKVYEDYEAKTFRESEEAKNKLIDCAKEFLSKNLSYCIYDWSVLKEANDYVNYGEFCNEVDSIAFRVINRYVSKKLVDDAVERGNLYMFEISSLDMYKDSSRMKNIMALRFNQIMNGMFTGDKSIIINNAPQIRYRPVVIEKKDVHPVGSRLVNKNTTDGRTIPGDVYLELCAYYNGKKDSLSPETSLYNEKVSVKDSDRAHIKDKHYTEEKFLITFSYTANKNVASATSGYQLNEMVRKEIRENGCNIMAVIRGIDNLLYYAVVDENGNRIEAGDLNVVGDTDFYEKLTILGKQRYTDQKNWKHENKVADLKDTYLGQVCRKIASIAVKNNAVIVIDKINESTKRKNAAFDNNMYRKFENALVNSLTDYYDIGIRGDEPGSVKNPLQLTVKEDNGFQNGIIFYQFDTFTKNICMRTGFVNLLNTFEIKTVASKVAFLKKLSGIYYDNDINEFVFEFTWRNIGCILKDEELPLYDGMDKIWKVRTHFTRYMRNAEKNKYVEIDGTEVLKELIRKNHPDMIGGKIDVDRLTSEEVKKVFEIFTLYTNGYIPRMDDAESGYMSPACDWNNFGTIRYDEMTALQLAKKSSLMIGKVKSGKDWKDMNVSRVEWLNHVLKADW

SEQ ID NO: 1177 - protein, 1259 aa, unidentified
  REGION 1..1259: note = Description of Unknown:uncultivated organism sequence
  REGION 1..1259: note = Category: MG61 effectors
  REGION 1..1259: note = Description: MG61-14 effector
MDFTKFQKLNSSIKTCSFEMIPIGKTRETMEKHNVIEEDAERKSNAELTKEVSDSFIREFIADYKEDMDWKDLYDAYGEDRARFTDIMNQKAEKLAKRFSDSFNEYINTFLKANGINDKKSKWSDSGYVDVVLPLYVSIHPDFSNDKYERAVASLLHCSNSLFKKYTTSYARIIAGTKKGSFADRSMENFQTACANSVMFDLISRNLSSVGSHDAFKEVFADAPLNMNEYLSQKGISRYNEFVGDSFDESGQVIRYGVNHYINEWNQTHPDERMPKMHKLKKQILSIVEPSFRIRTINDETELFGTFDNIRTAEQRYAGMLESILENMNTADIYDKSGILVTSAERDSLANAITGEWSYFRRQIKEEEENRIREEYLQKKNRVKTKLTQKDNKQIEDALNKSIYSVADLNKMLGSDFGTIEEKLLDEYIRNKSKKESAYAQLVKTDFYDKKTIPAGDDVQRIQQYLDKVLSLTHIVRGLCADSQDPRTDFVFSDDVSSLEDDRVQIISCYNLIRNFVTKKREKTAKEKQIQLCFGRPAHFEQVWNNKQEGKFGNVDAALLEYAGKYYYMVPAAKNEAKLNFPVTDEPQMGECYNYLATKKAIGFAKAFAKFYIKSPEAMEGFEKTEEPFEISVGNDTMIISRKVYEDYEAKTFRESEEAKNKLIDCAKEFLSKNLSYCIYDWSVLKEANDYVNYGEFCNEVDSIAFRVINRYVSKKLVDDAVERGNLYMFEISSLDMYKDSSRMKNIMALRFNQIMNGMFTGDKSIIINNAPQIRYRPVVIEKKDVHPVGSRLVNKNTTDGRTIPGDVYLELCAYYNGKKDSLSPEASLYNEKVSVKDSDRAHIKDKHYTEEKFLITFSYTANKNVASATSGYQLNEMVRKEIRENGCNIMAVIRGIDNLLYYAVVDENGNRIEAGDLNVVGDTDFYEKLTILGKQRYTDQKNWKHENKVADLKDTYLGQVCRKIASIAVKNNAVIVIDKINESTKRKNAAFDNNMYRKFENALVNSLTDYYDIGIRGDEPGSVKNPLQLTVKEDNGFQNGIIFYQFDTFTKNICMRTGFVNLLNTFEIKTVASKVAFLKKLSDIYYDNDINEFVFEFTWRNIGCILKDEELPLYDGMDKIWKVRTHFTRYMRNAEKNKYVEIDGTEVLKELIRKNHPDMIGGKIDVDRLTSEEVKKVFEIFTLYTNGYIPRMDDAESGYMSPACDWNNFGTIWYDEMTALQLAKKSSLMIGKVKSGKDWKDMNVSRVEWLNHVLKADW

SEQ ID NO: 1178 - protein, 848 aa, unidentified
  REGION 1..848: note = Description of Unknown:uncultivated organism sequence
  REGION 1..848: note = Category: MG61 effectors
  REGION 1..848: note = Description: MG61-15 effector
MLGSDFGTIEEKLLDEYIRNKSKKESAYAQLVKTDFYDKKTIPAGDDVQRIQQYLDKVLSLTHIVRGLCADSQDPRTDFVFSDDVSSLEDDRVQIISCYNLIRNFVTKKREKTAKEKQIQLCFGRPAHFEQVWNNKQEGKFGNVDAALLEYAGKYYYMVPAAKNEAKLNFPVTDEPQMGECYNYLATKKAIGFAKAFAKFYIKSPEAMEGFEKTEEPFEISVGNDTMIISRKVYEDYEAKTFRESEEAKNKLIDCAKEFLSKNLSYCIYDWSVLKEANDYVNYGEFCNEVDSIAFRVINRYVSKKLVDDAVERGNLYMFEISSLDMYKDSSRMKNIMALRFNQIMNGMFTGDKSIIINNAPQIRYRPVVIEKKDVHPVGSRLVNKNTTDGRTIPGDVYLELCAYYNGKKDSLSPEASLYNEKVSVKDSDRAHIKDKHYTEEKFLITFSYTANKNVASATSGYQLNEMVRKEIRENGCNIMAVIRGIDNLLYYAVVDENGNRIEAGDLNVVGDTDFYEKLTILGKQRYTDQKNWKHENKVADLKDTYLGQVCRKIASIAVKNNAVIVIDKINESTKRKNAAFDNNMYRKFENALVNSLTDYYDIGIRGDEPGSVKNPLQLTVKEDNGFQNGIIFYQFDTFTKNICMRTGFVNLLNTFEIKTVASKVAFLKKLSDIYYDNDINEFVFEFTWRNIGCILKDEELPLYDGMDKIWKVRTHFTRYMRNAEKNKYVEIDGTEVLKELIRKNHPDMIGGKIDVDRLTSEEVKKVFEIFTLYTNGYIPRMDDAESGYMSPACDWNNFGTIRYDEMTALQLAKKSSLMIGKVKSGKDWKDMNVSRVEWLNHVLKADW

SEQ ID NO: 1179 - protein, 1259 aa, unidentified; identical to SEQ ID NO: 1167
  REGION 1..1259: note = Description of Unknown:uncultivated organism sequence
  REGION 1..1259: note = Category: MG61 effectors
  REGION 1..1259: note = Description: MG61-16 effector

SEQ ID NO: 1180 - protein, 1259 aa, unidentified; identical to SEQ ID NO: 1172
  REGION 1..1259: note = Description of Unknown:uncultivated organism sequence
  REGION 1..1259: note = Category: MG61 effectors
  REGION 1..1259: note = Description: MG61-17 effector

SEQ ID NO: 1181 - protein, 519 aa, unidentified
  REGION 1..519: note = Description of Unknown:uncultivated organism sequence
  REGION 1..519: note = Category: MG61 effectors
  REGION 1..519: note = Description: MG61-16 effector
MYRTACFKLRVHPHDRRRLATALARWSAGMGEALDRARADQRALLRTLRPRGAGRSAPPGDGMGSDRPARFEVDSRALHARVLGYCRGLPRDLHSALAMALIVAVEGLLGSWLALYAEWLTSGKPAGRKPGFPTVAAGTARGARERWEAALDASRTVLTRAEEDRWRAAVTREARERRMPLYFGAAQSGVRPGHLAHCGLIRRADRKWFAALTLWPKGDPLGETPRRAGNRANRGPLANVRSREEYLPGRATSTMLVPIEMGTGPGRRRKRWERLFPGRGTPKSALLVERDGEYYLHVEFEYPRREPRPTSGAVLALLRGVHTLVAGVLLDARGRRLATTAIDGRDLMRTISALTRLRAIRQRKGRSLAGDRRAARVAEHVLYSAGHQIIDLACRHGAEIVLLEDPGRRRPTPLLRYKHFSRLAEILVQLTEEAGLPPARVRRIYGPSLTCTACGWAPGEPVRVEEAPAPACPGCGRDRELPFHAAELLALDTLRLRTGRKETRPTLPNYVKSVRRNVP

SEQ ID NO: 1182 - protein, 1259 aa, unidentified; identical to SEQ ID NO: 1167
  REGION 1..1259: note = Description of Unknown:uncultivated organism sequence
  REGION 1..1259: note = Category: MG61 effectors
  REGION 1..1259: note = Description: MG61-17 effector

SEQ ID NO: 1183 - protein, 369 aa, unidentified
  REGION 1..369: note = Description of Unknown:uncultivated organism sequence
  REGION 1..369: note = Category: MG61 effectors
  REGION 1..369: note = Description: MG61-18 effector
MAVIRGIDNLLYYAVVDENGNRIEAGDLNVVGDTDFYEKLTILGKQRYTDQKNWKHENKVADLKDTYLGQVCRKIASIAVKNNAVIVIDKINESTKRKNAAFDNNMYRKFENALVNSLTDYYDIGIRGDEPGSVKKPLQLTVKEDNGFQNGIIFYQFDTFTKNICMRTGFVNLLNTFEIKTVASKVAFLKKLSGIYYDNDINEFVFEFTWRNIGCILKDEELSLYDGMDKIWKVRTHFTRYMRNAEKNKYVEIDGTEVLKELIRKNHPDMIGGKIDVDRLTSEEVKKVFEIFTLYTNGYIPRMDDAESGYMSPACDWNNFGTIRYDEMTALQLAKKSSLMIGKVKSGKDWKDMNVSRVEWLNHVLKADW

SEQ ID NO: 1184 - protein, 350 aa, unidentified
  REGION 1..350: note = Description of Unknown:uncultivated organism sequence
  REGION 1..350: note = Category: MG61 effectors
  REGION 1..350: note = Description: MG61-19 effector
MSDSIVRCTTLSVASPVEGSWEALWRDLHACWAQTTAASNWLMTELAKADHQRLPGDAKLPPMPATYFYPKLTQLFPDLDTRTCASLERAVKRKYKAVLYQVLWQHAASLPTYRYPTPYPVHNQAWRPSWDQGNRPLVSLPLGRGAEKRWQLRLKGGPNFARQVALFRQFVEGAALKSEAKIYRRGNALLVGLVGRFPPPLLSERTRLMRVLTSSTCLWVVEIEGQEPRYWNHDDLRRLCISHRAYLQRIAEDSKYELRLPPGKLRHIREKRQERCQKHQRRIHTSLHQLTAQLVGLAERQKVARVIYTDHDKSWLPLFPWSELRRLLAYKLQGLGITFGGGDEDPNAHN

SEQ ID NO: 1185 - protein, 410 aa, unidentified
  REGION 1..410: note = Description of Unknown:uncultivated organism sequence
  REGION 1..410: note = Category: MG61 effectors
  REGION 1..410: note = Description: MG61-20 effector
MDFTKFQKLNSIIKTCSFEMIPIGKTRETMEKHNVIEEDAERKSNAELTKEVSDSFIREFIADYKEDMDWKDLYDAYGEDRARFTDIMNQKAEKLAKRFSDSFNEYINTFLKANGINDKKSKWSDSGYVDVVLPLYVSIHPDFSNDKYERAVASLLHCSNSLFKKYTTSYARIIAGTKKGSFADRSMENFQTACANSVMFDLISRNLSSVGSHDAFKEVFADAPLNMNEYLSQKGISRYNEFVGDSFDESGQVIRYGVNHYINEWNQTHPDERMPKMHKLKKQILSIVEPSFRIRTINDETELFGTFDNIRTAEQRYAGMLESILENMNTADIYDKSGILVTSAERDSLANAITGEWSYFRRQIKEEENRIREEYLQKKNRVKTKLTQKDNKQIEDALNKSIYETVSSFV

SEQ ID NO: 1186 - protein, 379 aa, unidentified
  REGION 1..379: note = Description of Unknown:uncultivated organism sequence
  REGION 1..379: note = Category: MG61 effectors
  REGION 1..379: note = Description: MG61-21 effector
MPEYLAISIPFSVHGESARLIWFTAWLSKLCAHRLLNDVKSNEVLINFSQTGFLGYARRRCYDLLPNRRYIDGITTLVHSTLKSTKRLRVDVKSLELKHWLLFQSEAEKEKKGNLNIRLLTLERAEVLVLNSNSESKRIIVELRTPKSYVKLLKTIMEKAWRNEIGYPARIVIKESNFYPGDVHLYCNLQVMVPYSVYVEVMKKHSKPLSNLVGGVDINVDRLNLTIVDRYGRLRDVKTFWFREVTARGYEKKPAWTKIHQAIHDMLSYAYHHGVSLLALESPEIIGYLRYYWVRNGDRGSRNYNYKVSIFRNRVIEAVSYKASLYAVDVAYVDPKGTTSSKEHDEVMKRYGLDRHSASAYLIALRGIEKHILTQKDTI

SEQ ID NO: 1187 - protein, 363 aa, unidentified
  REGION 1..363: note = Description of Unknown:uncultivated organism sequence
  REGION 1..363: note = Category: MG61 effectors
  REGION 1..363: note = Description: MG61-22 effector
MSYITIALPFNVGGEVAGRILSTAWLFKAATHRVLHLAKSSPALPGSDIGWKATFRKDAYAVIPNRRYADGAVVLVRGIYESCRELGVDFRGVELGDWLMFQQAEKEYPARNITLRPGGEVYVTTISYSGAVERVVLKPTVPKSYATLLEKILEERQEHAARVVIKGYGVRKGVVWISGEGQLTIPLTFYYRHMARYRANKGSLYGGVDVNVDRVNLAIIDNSGELRDTYTFWFREVVARGYPRRSARSVIGMRVHEMLEYAYHHGVKVLFLENPAVLGRLRLLWARSTERRSENYNWKVSAFRSSIIEMIALKAPLYGIEVAYVDPKGTSNSREHSEAMKKLRLDRHATSAYLIALRGVAKK

SEQ ID NO: 1188 - protein, 1262 aa, unidentified
  REGION 1..1262: note = Description of Unknown:uncultivated organism sequence
  REGION 1..1262: note = Category: MG61 effectors
  REGION 1..1262: note = Description: MG61-23 effector
MKYHKYTKLNSTIKSATFELVPVGKTRDFLELHDVIKEDSERKAKVVLVKEVSDTFIVEFLRNYNNAGICDWENLHKIYNSATCTEIRGCIEKEKEKIAKDLNSALNAYIESFLKYNDINCSDVGWNKKSYVEVALPLYAKSVPDFNTDEYEDALASMKESSSAMFKKCRATYERIINGTNHGSIADRVIENFETFLANKLLYEKILETATGFENDETFTNVSQFGKYLSQNGIDKYNSTIGDFYNSSGELIKRGVNSRITEWNQSNPDNKLPKLQKLKKQILVDREKMFTIETIENKSDFNKTLNTVLILDEKITIETTKLLTSILAKDMYNTEGVYVTRAGGSYIANGLTGSWDYFEAIKTDAITKTVKDKLLTDYFNAKGKVKTNLTKADEKEIEKATKDFSYTIAELDRMLAGTDYITVEEMLIKKLEELKSRKKESYHLMTTCAFWNNDNKPTQDENGVIQKYLDDVLAVVRFTKIFSIDVKLTNADTIFMEDVAGMDKDKHGINKTYNMIRNYLTKKTELDAKQRRVQLCFGRPTHFEQKWNLMHGDKGIFGNCDAGLLEKDGCYYYIVPASKNGEKLNIHVSDCEDEADSYNMLSTKKGMGFLKMLIKCTLKSKSAIAKYKETDEPFELPIGDETITISKKMAEDYANKKHSKSKEELIKVIDFAKEFIAKHPSFKRYDLSSLKESSAYDNLKQFSDEVDSLCFAVTRLYVSKEQIDDAVEKGNLYMFMITSQDMYKSADKKHNIYSIRFNAIMKSMFEAGNHIIVNNSPSIYYRPALIEAEDKHPAGSILVNKLTTEGKTIPGEIYLELCAFYNGKCDKLSPLASVYNEKVSVKESTFPHIKDKHYTEEKFSITLSYKMNTNVVGNTSVFTLNNLVQEDIRENGCNIMSVIRGMDNLLYYCIVDSGNKRIASGNLNTIGNADYYEKLCVLGTQRYIDAKNWKYEKKVAELKETYLRQICRKIIKIAIENNAVICIDKVSDLRKNKLSAFDNQVYKKFENTLITALANYYDTSIPNTEAGGSLNPLQLAVEGADTMQNGILFHVAETNTRNICMKTGFINLMSTFGISTVKAKMEYLKKVSRIYYDSKADDFVFEFTWRNLGCCLKKDELPLYNGLDKVWQLHTHLTRLKWNKEKSQYEEIDGTELIKAIRRSHSDMIGKDIEVDMLSSKEIQTLYDVFILYANGFMPKEFMEDTSSYDSPIVPWSSVGRIEYDEMTAYQLCRKASLTMEKIKKGLSSKELVVYRTEWLNYLLEN

SEQ ID NO: 1189 - protein, 1262 aa, unidentified
  REGION 1..1262: note = Description of Unknown:uncultivated organism sequence
  REGION 1..1262: note = Category: MG61 effectors
  REGION 1..1262: note = Description: MG61-24 effector
MKYRKYTKLNSTIKSATFELVPVGKTRDFLELHDVIKEDSERKAKVALVKEVSDAFIVEFLRNYNNAGICDWENLHKIYNSATRTEIRGCIEKEKEKIAKDLNSALNAYIESFLKYNDINCSDVGWNKKAYVEVALPLYAKSVPDFNTDEYEDALASMKASSSAMFKKCRATYERIINGTNRGSVADRVIENFETFLANKLLYEKILETATGFENDETFTNVSQFGKYLSQNGVDKYNSTIGDFYNSSGELIKRGINSRITEWNQSNPDNKLPKLQKLKKQILVDREKMFTIETIENKADFNKTLNTILILDEKITIETTKLLTSILAKDMYNTEGVYVTRAGGSYIANGLTGSWDYFEAIKTDAITKTVKDKLLTDYFNAKGKVKTNLTKADEKEIEKATKDFSYTIAELDRMLAGTDYTTVEEMLIKKLEKLKSRKNESYRLMTTCSFWNNDNKPTQDENGVIQKYLNDVLAVVRLTKIFSIDVKLANADTIFMEDVAGMDEDKHGVNKAYNMIRNYLTKKTELDAKQRRVQLCFGRPTHFEQKWNLMQEDKGIFGNCDAGLLEKDGCYYYIVPASKNGGKLNIHVSDFEDEVDSYNMLSTKKGMGFLKMLIKCTLKSKSAIAKYKETDEPFELPIGVETITISKKMAEDYANKKYSKSKEELIKVIDFAKEFIAKHPSFKRYDLSSLKESSAYDNLKQFSDEVDSLCFAITRLYVPKEQIDDAVEKGNLYMFMITSQDMYKSADKKRNVYSIRFNAIMKSMFEAGNHIIVNNSPSIYYRPALIEAEDKHPVGSILVNKLTTEGKTIPGEIYLELCAFYNGKCDKLSPLASVYNEKVSVKESTFPHIKDKHYTEEKFSITLSYKMNTNVVGNTSVFTLNNLVQEDIRENGCNIMSVIRGMDNLLYYCIVDSDNNRIASGNLNTIGNADYYEKLYVLSTQRYIDAKNWKYEKKVAELKETYLRQVCRKIIKIAIENNAVICIDKVSDLRKNKLSAFDNQVYKKFENTLINALANYYDTSLPNTEAGGSLNPLQLAVEGADTMQNGILFHVAETNTRNICMKTGFINLMSTFGISTVKAKMEYLKKVSRIYYDSKADDFVFEFTWRNLGCCLKKDELPLYNGVDKVWQLHTHLTRLKWNKEKSQYEEIDGTKLIKTIRRSHPDMIGKDIEVDMLSSKEIQTLYDIFILYANGFMPKEFAEDTSSYDSPIVPWSSVGRIEYDAMTAYQLCRKASLTMEKIKKGLSSKELVVYRTEWLNYLLEN

SEQ ID NO: 1190 - protein, 358 aa, unidentified
  REGION 1..358: note = Description of Unknown:uncultivated organism sequence
  REGION 1..358: note = Category: MG61 effectors
  REGION 1..358: note = Description: MG61-25 effector
MSQCQINSSVVDASALVEYATITGKLIPVSSEDYMKLARLAWSFRRAVQVAVRMIARGVEDSAVLKELRKTLNKAYADSAFKLAKAIVKGCIATGGNPRKAEIRKLFIVSDGESSRLGNRNIRLEDTGLVKVKYPYEGSWLVFRAQFEEEHTPLLRELVELAKQKRASYRAKIVFRDGKAYLHVSVPIELYLKHFKKGEAKGSLIAGFDLNSDRINLAIIDEYGRLVDTRTEWFPEVTSPGFPRGKAKALRLRALAKLLRYCYVHGVGAVVFENLFTVKRRRFTRSRSANRKMSKFAKRKLLQHAIVMSLKYGFKVLLVDPKGTTSSPEHAEIMKTHGLDRHTASAYLIAVRALGQNK

SEQ ID NO: 1191 - protein, 375 aa, unidentified
  REGION 1..375: note = Description of Unknown:uncultivated organism sequence
  REGION 1..375: note = Category: MG61 effectors
  REGION 1..375: note = Description: MG61-26 effector
MELPKYITLTIDFHVSGDYARNILSTAWLSKLVAHRVLRLIKENEVLADLSEYKFLKILRSKCYDILPNRRYVDGILKLVHSTLKSAKALEVNMKDIGLKQWLLFQSDGERGYARGNMNIRFIGTHRVRVLTLGYDKKTRYIELKVPTPKGWKKLIEVLVNRAFDGQIGYPARVVVKDYGIGKHGLHVHGEVQVMVPYSLYLDVMRRYDKPRGDKIAGVDVNVERLDAVVIDRHGNLLSYGTFWLKNATFMGVRRKRSWSLVGEKIHALLKWLYSQGVSVVGLENPEVIGYLRYYWIRNGERRESRWNWKVSMFRNSIIERITWKAPLYSIKPTYVNPKNTSKEGERIGRRLGLDRHLGSAYIMAKRTLKSLQRP

SEQ ID NO: 1192 - protein, 1258 aa, unidentified
  REGION 1..1258: note = Description of Unknown:uncultivated organism sequence
  REGION 1..1258: note = Category: MG61 effectors
  REGION 1..1258: note = Description: MG61-27 effector
MEFTKYTRSNKIVRSVIFEMSPIGNTRAAIKEHGVIEEDAVRKSNAVLIKEVSDNFIREFLNDDKLEKYDWVEWEDLCLLIDDKPAFDAKAEKMKESIATSISKSFDSYINRFMAANGKANGKYSWKSAGYIDEVIPMYILCHPDYQDEKYTLAAESLKHASSAMFKKYFVSYERILNGTKTGSIAYRVMENVLIFCTNSKMYKKFAAKISGADLFAKIADITVLEDLISQNGIDFYNEMIGDLYDKDGQLIRKGFNSRINEYNSTHPDDKIPYLKKMKKQILSYVEPFFTIDKIESKEDLDNILTSVRATEESLTENLKTLFSNLLSNDKFPLDRILLTSAARSTIANSLAGRWDYFENIIREKETDKLKADYFEKKNRILTKLTKKDQKKINDAVTSNISSIADLNQMLHNVSEETVEDFLIKSLNKQISLKESSYSVLNNSGFMKSDSKPAWDDNQKIQDYLDHVIAISRMLKYFYTDLMNEKVDPIFVEELQMFDDSKDKIVKSYNMIRNYCTTKTELTAKEKRIQLCFGRPVHFEQTWNNKQEGKFGNLDAALLEFDGLYYYIVPAAKNKRKLNFPVTDIPQEGVNYHYLSTKKSIKLSMALPKMTFKSPAAVKKYAETEEPFTINIGNSTMTVSKKMYDDYNLKTFSSSPDARIALIDYAKEFISKEFSFKCYDYSSLKPSEEYRSYGEFCNEVDSITFSTTSKYVNKDLVDNAVMDGDLYMFLITSADMYKDREKNKDITAIRFNTIMQSMFTGDTSIIINNSPTIYYRPQIIEAVDKHPVGSILVNKMTTDGRTIPGEIYLELCDFYNGKKDYLSAEAKAYNENVSVKESSFPHIKDAHYTREMFTISLSYTLNKGVSNEKLGYALNDEIRRDIVKEGCNVMSIIRGINNLLYYCIVDQNGNQLKAGSLNIVGGVDYYEKLTLLSTQRYIDSKNWKYEKKSAELKDTYLGQVCREIAKIAIANNAIIVIDKLIDSIKNKAASFDNQVYKKFENRLISTLGNYYDVTLPDNEPGGSSNPLQLTVPDNTSIQNGIIFFIIDSGTKNICQETGYVNLLNTYNVNTVTAKAKFLSKISKIYFDADLNEFVFEFSWKDIGSINLKEDEEIPLYLGMNKVWKVRTHITRYKKNKEKRSYEEIDGTEIMKAVMKNYPDMIGKDIDITKLSSKDIQAVYEVFTYYANGFIPRIGNEDSEFISPVSTWTSIGNVPYDEMSAYQLAKKSLLGINKIQFAEDSGRYQYTPVSKVEWYNSLL

SEQ ID NO: 1193 - protein, 1262 aa, unidentified
  REGION 1..1262: note = Description of Unknown:uncultivated organism sequence
  REGION 1..1262: note = Category: MG61 effectors
  REGION 1..1262: note = Description: MG61-28 effector
MKYHKYTKLNSTIKSATFELVPVGKTRDFLELHDVIKEDSERKAKVVLVKEVSDTFIVEFLRNYNNAGICDWENLHKIYNSATCTEIRGCIEKEKEKIAKDLNSALNAYIESFLKYNDINCSDVGWNKKSYVEVALPLYAKSVPDFNTDEYEDALASMKASSSAMFKKCRATYERIINGTNHGSIADRVIENFETFLANKLLYEKILETATGFENDETFTNVSQFGKYLSQNGIDKYNSTIGDFYNSSGELIKRGVNSRITEWNQSNPDNKLPKLQKLKKQILVDREKMFTIETIENKSDFNKTLNTVLILDEKITIETTKLLTSILAKDMYNTEGVYVTRAGGSYIANGLTGSWDYFEAIKTDAITKTVKDKLLTDYFNAKGKVKTNLTKADEKEIEKATKDFSYTIAELDRMLAGTDYITVEEMLIKKLEELKSRKKESYHLMTTYAFWNNDNKPTQDENGVIQKYLDDVLAVVRFTKIFSIDVKLTNADTIFMEDVAGMDKDKHGINKTYNMIRNYLTKKTELDAKQRRVQLCFGRPTHFEQKWNLMHGDKGIFGNCDAGLLEKDGCYYYIVPASKNGEKLNIHVSDCEDEADSYNMLSTKKGMGFLKMLIKCTLKSKSAIAKYKETDEPFELPIGDETITISKKMAEDYANKKYSKSKEELIKVIDFAKEFIAKHPSFKRYDLSSLKESSAYDNLKQFSDEVDSLCFAVTRLYVSKEQIDDAVEKGNLYMFMITSQDMYKSADKKHNIYSIRFNAIMKSMFEAGNHIIVNNSPSIYYRPALIEAEDKHPADSILVNKLTTEGKTIPGEIYLELCAFYNGKCDKLSPLASVYNEKVSVKESTFPHIKDKHYTEEKFSITLSYKMNTNVVGNTSVFTLNNLVQEDIRENGCNIMSVIRGMDNLLYYCIVDSGNKRIASGNLNTIGNADYYEKLCVLGTQRYIDAKNWKYEKKVAELKETYLRQICRKIIKIAIENNAVICIDKVSDLRKNKLSAFDNQVYKKFENTLITALANYYDTSIPNTEAGGSLNPLQLAVEGADTMQNGILFHVAETNTRNICMKTGFINLMSTFGISTVKAKMEYLKKVSRIYYDSKADDFVFEFTWRNLGCCLKKDELPLYNGLDKVWQLHTHLTRLKWNKEKSQYEEIDGTELIKAIRRSHSDMIGKDIEVDMLSSKEIQTLYDVFILYANGFMPKEFMEDTSSYDSPIVPWSSVGRIEYDEMTAYQLCRKASLTMEKIKKGLSSKELVVYRTEWLNYLLEN

SEQ ID NO: 1194 - protein, 1258 aa, unidentified
  REGION 1..1258: note = Description of Unknown:uncultivated organism sequence
  REGION 1..1258: note = Category: MG61 effectors
  REGION 1..1258: note = Description: MG61-29 effector
MEFTKYTRSNKIVRSVTFEMSPIGNTRAAIKEHGVIEEDAVRKSNAVLIKEVSDNFIREFLNDDKLEKYDWVEWENLCLLIDDKPAFDAKAEKMKESIAAALSKSFDSYINRFMAANGKANGKYSWKSAGYIDEVIPMYILCHPDYQDEKYTLAAESLKHASSAMFKKYFVSYERILNGTNAGSIAYRVMENVLIFCTNSKMYKKFAAKISGADLFAKIADITVLEDLISQNGIDFYNEMIGDLYDKDGQLIRKGFNSRINEYNSTHPDDKIPYLKKMKKQILSYVEPFFTIDKIESKEDLDNILTSVRATEESLTESLKTLFSNLLSNDKFSLDRILLTSAARSTIANSLAGRWDYFENVIREKETDKLKADYFEKKNRILTKLTKKDQKKINDAVTSNISSIADLNHMLHNISEETVEDFLIKSLNKQISLKESSYSVLNNCGFMKSDSKPAWDDNQKIQDYLDHVIAISRMLKYFYTDLMNEKVDPIFVEELQMLDGSKDKIVKSYNMIRNYCTTKTELTAKEKRIQLCFGRPVHFEQTWNNKQDGKFGNLDAALLEFDGLYYYIVPAAKNKRKLNFPVTDIPQEGVNYHYLSTKKNIKLSMALPKMTFKSPAAVKKYAETEEPFTINIGNSTMTVSKKMYDDYNLKTFSSSPDARIALIDYAKEFISKEFSFKCYDYSSLKPSEEYRSYGEFCNEVDSITFSTTSKYVNKDLVDNAVMDGDLYMFLITSANMYKDREKNKDITAIRFNTIMQSMFTGDTSIIINNSPIIYHRPQIIEAEDKHPVGSILVNKMTTDGRTIPGEIYLELCDFYNGKKDHLSAEAKVYNENVSVKESSFPHIKDAHYTREMFTISLSYTLNKGVSNEKLGYALNDEIRRDIVKEGCNVMSIIRGINNLLYYCIVDQNGNQLKAGSLNIVGGVDYYEKLTLLSTQRYIDSKNWKYEKKSAELKDTYLGQVCREIAKIAIANNAIIVIDKLIDSIKNKAASFDNQVYKKFENRLISTLGNYYDVTLPDNEPGGSSNPLQLTVPDNTSIQNGIIFFIIDSGTKNICQETGYVNLLNTYNVNTVTAKAKFLSKISKIYFDADLNEFVFEFSWKDIGSINLKEDEEIPLYLGMNKVWKVRTHITRYKKNKEKRSYEEIDGTEIMKAVMKNYPDMIGKDIDITKLSSKDIQAVYEVFTYYANGFIPRIGNEDSEFISPVSTWTSIGNVPYDEMSAYQLAKKSLLGINKIQFTEDSGRYQYTPVSKVEWYNSLL

SEQ ID NO: 1195 - protein, 363 aa, unidentified
  REGION 1..363: note = Description of Unknown:uncultivated organism sequence
  REGION 1..363: note = Category: MG61 effectors
  REGION 1..363: note = Description: MG61-30 effector
MSYITVSLSFNTNSDAAKRLLSTAWLFKIATHRVLDLARQTPVLPATDIGWKNMFRGVAYEAVPNRRYADGAITLIRSIYESCRVLGIDFRSVELGNWLMFQQSEMEYPVRNVTLREGYEFHITVIDYGGSTSRVIIKPTIPKGYRLLLDKILEERQEHTGRVVINGYGVRDNNVWVHGEVQLTIPIEFYYRHMVRYEQNNGRLFGGVDVNVDRINLTIVDEGGELRDVKTFWFEEASRKGVTRHRAWSVIGMAVHAMLDYAYHHGVKTLFLENPDILGRLKLMWIRNGDRRHENYNYRVATFRNSVIEMIVMKAPLYGINVEYVNPKGTTSSEDHDEVMKAYGLDKHTASAYLIVLKGLKQS

SEQ ID NO: 1196 - protein, 1262 aa, unidentified
  REGION 1..1262: note = Description of Unknown:uncultivated organism sequence
  REGION 1..1262: note = Category: MG61 effectors
  REGION 1..1262: note = Description: MG61-31 effector
MQYHKYTKLNSTIKSATFELVPVGKTRDFLELHDVIKEDSERKAKVVLVKEVSDTFIVEFLRNYNNAGICDWENLHKIYNSATCTEIRGCIEKEKEKIAKDLNSALNAYIESFLKYNDINCSDVGWNKKSYVEVALPLYAKSVPDFNTDEYEDALASMKASSSAMFKKCRATYERIINGTNHGSIADRVIENFETFLANKLLYEKILETATGFENDETFTNVSQFGKYLSQNGIDKYNSTIGDFYNSSGELIKRGVNSRITEWNQSNPDNKLPKLQKLKKQILVDREKMFTIETIENKSDFNKTLNTVLILDEKITIETTKLLTSILAKDMYNTEGVYVTRAGGSYIANGLTGSWDYFEAIKTDAITKTVKDKLLTDYFNAKGKVKTNLTKADEKEIEKATKDFSYTIAELDRMLAGTDYITVEEMLIKKLEELKSRKKESYHLMTTCAFWNNDNKPTQDENGVIQKYLDDVLAVVRFTKIFSIDVKLTNADTIFMEDVAGMDKDKHGINKTYNMIRNYLTKKTELDAKQRRVQLCFGRPTHFEQKWNLMHGDKGIFGNCDAGLLEKDGCYYYIVPASKNGEKLNIHVSDCEDEADSYNMLSTKKGMGFLKMLIKCTLKSKSAIAKYKETDEPFELPIGDETITISKKMAEDYANKKHSKSKEELIKVIDFAKEFIAKHPSFKRYDLSSLKESSAYDNLKQFSDEVDSLCFAVTRLYVSKEQIDDAVEKGNLYMFMITSQDMYKSADKKHNIYSIRFNAIMKSMFEAGNHIIVNNSPSIYYRPALIEAEDKHPAGSILVNKLTTEGKTIPGEIYLELCAFYNGKCDKLSPLASVYNEKVSVKESTFPHIKDKHYTEEKFSITLSYKMNTNVVGNTSVFTLNNLVQEDIRENGCNIMSVIRGMDNLLYYCIVDSGNKRIASGNLNTIGNADYYEKLCVLGTQRYIDAKNWKYEKKVAELKETYLRQICRKIIKIAIENNAVICIDKVSDLRKNKLSAFDNQVYKKFENTLITALANYYDTSIPNTEAGGSLNPLQLAVEGADTMQNGILFHVAETNTRNICMKTGFINLMSTFGISTVKAKMEYLKKVSRIYYDSKADDFVFEFTWRNLGCCLKKDELPLYNGLDKVWQLHTHLTRLKWNKEKSQYEEIDGTELIKAIRRSHSDMIGKDIEVDMLSSKEIQTLYDVFILYANGFMPKEFMEDTSSYDSPIVPWSSVGRIEYDEMTAYQLCRKASLTMEKIKKGLSSKELVVYRTEWLNYLLEN

SEQ ID NO: 1197 - protein, 1232 aa, unidentified
  REGION 1..1232: note = Description of Unknown:uncultivated organism sequence
  REGION 1..1232: note = Category: MG61 effectors
  REGION 1..1232: note = Description: MG61-32 effector
MDYAKFTKQGKLIKGIKLELVPQGNTRDAISEYKIVEADQQLADMVKEVVMAGNEFYKDFIKQIVGHMDGADWQAYGEAVENKATEQKTYDEAVKSISASIKNAILGTAELYGGKKTLFAKDFITIVLRKYVETAENFPYNRERILTCIDVLSDKNVLFKTPYVKWEHIIFGESKGSIAERMLSNFDIFYDNKNKYAALKEATAITDFDDFFTDYASYTRYVGQDGIELYNSAIRGIYSESGAKISEGINEYINKLKMKHPELHVNMLKKLQKQILSNSEPLFKVATIQNAEELKGIMNKVKVTEESVLSSAKELLVHMETSDLHDLYISGQRLYFVCQKIAKDGGILEELIFNNECSRVEKLTEKKKEEIRGAIVKHDYSFAYIDSLLSEYAEKTVKMVINEELQKLIATVVSSGASYDSITINPKWKAIPDKEITVIREYLESFVELNKFLKCLQVRDSDVYPDFKTYATLNVLVDELGALNKAYNMVRNFVTKKVNDKDGKTRLCFGRGALLERGWNRKNQAVDWLGNIDHMLLTKDGKYYYAVPAPVKRKTKIYISDTKPSDEVYEYMEISKQSSFLKTFARLFTSLGLKNIGDANDITMDLGNGSMTVTKEFLVKYKDGECKKNTDFMHKSIDIAKEFLTKHYSYATFNFSELKKTEDYTSFYEFANDVDKYTYAVKTKYIDAAIIDKAVEDKELLLFMLSSMDLYKSQEKCKDITALYTRYFFSEENRKKADIWLNANPAIYYRKPLIKFEKTHPAGSILVRKTYEDKDGITHIVPDNVYMSLYNYYNKNTPLNEEAMQYVDLVEHHVAVQDYVKDARYTREMFTINLSFTLNGNAGDAAQAYTINNMVKEEIKAKMPRMLTVVRGYRNLLEYCITDETGKVFESGNFNTIGEINFKEKLEDLDRARKADAQNWKYEKTVVNIKESYLGMVTSSIVKKAVAYNAIINVEQLSDAFKDKRSCMDNQVFKKFEEKLVSKLACYYDKAKAPTEPGGYLNPLQLASPNCLSNTQNGILFYVSPAYTNEVCPKSNFINLLDFSAAKTLKAKREFLRKMNEICYDAEHEAFHFSFCYDDMPIKLPVKEKKELNDKTNQEFGKHIWTVYINGVRTEYNKKERKLVELNGTEILGKECAKNNVMLTDHMDVDSMPNSVVNEMIHIFQKYSFGEVAQKDVYYVSPVSPQAEPICTPGELRLKNMSEKGYMILHNIVAGKEKFAVNKMEWLEEKLG

SEQ ID NO: 1198 - protein, 1262 aa, unidentified
  REGION 1..1262: note = Description of Unknown:uncultivated organism sequence
  REGION 1..1262: note = Category: MG61 effectors
  REGION 1..1262: note = Description: MG61-33 effector
MKYHKYTKLNSTIKSATFELVPVGKTRDFLELHDVIKEDSERKAKVVLVKEVSDTFIVEFLRNYNNAGICDWENLHKIYNSATCTEIRGCIEKEKEKIAKDLNSALNAYIESFLKYNDINCSDVGWNKKSYVEVALPLYAKSVPDFNTDEYEDALASMKASSSAMFKKCRATYERIINGTNHGSIADRVIENFETFLANKLLYEKILETATGFENDETFTNVSQFGKYLSQNGIDKYNSTIGDFYNSSGELIKRGVNSRITEWNQSNPDNKLPKLQKLKKQILVDREKMFTIETIENKSDFNKTLNTVLILDEKITIETTKLLTSILAKDMYNTEGVYVTRAGGSYIANGLTGSWDYFEAIKTDAITKTVKDKLLTDYFNAKGKVKTNLTKADEKEIEKATKDFSYTIAELDRMLAGTDYITVEEMLIKKLEELKSRKKESYHLMTTCAFWNNDNKPTQDENGVIQKYLDDVLAVVRFTKIFSIDVKLTNADTIFMEDVAGMDKDKHGINKTYNMIRNYLTKKTELDAKQRRVQLCFGRPTHFEQKWNLMHGDKGIFGNCDAGLLEKDGCYYYIVPASKNGEKLNIHVSDCEDEADSYNMLSTKKGMGFLKMLIKCTLKSKSAIAKYKETDEPFELPIGDETITISKKMAEDYANKKHSKSKEELIKVIDFAKEFIAKHPSFKRYDLSSLKESSAYDNLKQFSDEVDSLCFAVTRLYVSKEQIDDAVEKGNLYMFMITSQDMYKSADKKHNIYSIRFNAIMKSMFEAGNHIIVNNSPSIYYRPALIEAEDKHPAGSILVNKLTTEGKTIPGEIYLELCAFYNGKCDKLSPLASVYNEKVSVKESTFPHIKDKHYTEEKFSITLSYKMNTNVVGNTSVFTLNNLVQEDIRENGCNIMSVIRGMDNLLYYCIVDSGNKRIASGNLNTIGNADYYEKLCVLGTQRYIDAKNWKYEKKVAELKETYLRQICRKIIKIAIENNAVICIDKVSDLRKNKLSAFDNQVYKKFENTLITALANYYDTSIPNTEAGGSLNPLQLAVEGADTMQNGILFHVAETNTRNICMKTGFINLMSTFGISTVKAKMEYLKKVSRIYYDSKADDFVFEFTWRNLGCCLKKDELPLYNGLDKVWQLHTHLTRLKWNKEKSQYEEIDGTELIKAIRRSHSDMIGKDIEVDMLSSKEIQTLYDVFILYANGFMPKEFMEDTSSYDSPIVPWSSVGRIEYDEMTAYQLCRKASLTMEKIKKGLSSKELVVYRTEWLNYLLEN

SEQ ID NO: 1199 - protein, 1535 aa, unidentified
  REGION 1..1535: note = Description of Unknown:uncultivated organism sequence
  REGION 1..1535: note = Category: MG61 effectors
  REGION 1..1535: note = Description: MG61-35 effector
MEKKILGLDLGTNSIGWAVVNASFNMEDNRLKLENYMGIDDCGVRIFPEGVEPNTIGKGDREQSRNATRRDKRQMRRQFYRKRLRRIKLLELLVEQGMCPLDMELLKQWKNWDRKKKSEGRVFPETSEFLSWLHLNPYELRARALNEPLTFLELGRVFYHLIHRRGFLTSRKGKGNEDGTIFTKGKPDENILPVEETRKMMGNSTLGKTLYDIMVKPNEPFSINRNSDGKEIRVRGRYTVRDMYILEFERIWLAQAKFSPELNHRKVWVVRTRLLKGNIANKRNQKRLMLLEQKYGRDALTIDEGKHGIHKVTTRQQLDLKYYLAGDITILSEGDAISVQFKSNESVLFWQRPLRSQKSLLANCRFENELPVISANNQYLVKNCKIQTRSKKPCPLSHPEFERFRALQFVNNIKYGKDNRLTSEQREKVMAFINKNDASFTFDKIVKELKLNYEKFNYENDFKVTGNYTHKKVMTLFKPEIWAANSETIWHYFYFYDDNNMLTQRLSEKGFGQFADTDVKNIRLKDGYSNVSLKAIRNIMPFLEKGYTYDRAVILGGVRNAFGRRWEYFNAVQDQLEREIRSLLNGKHKEGAVIELIKDYLIDNNYGFVKNDPHFAHLYHHSQDVEQAEELSDFVPNVENLRNPIVQQGVNETRRLVNSLLKRYRKSDPNFQFARIHIEMGRELRNSRSQRQQMSDSIRENAQKNDEARERLAGFGLKPSRENVQKYLLAKEIELRAGRLVCPYTGRALGMNDVLGGRNLIQIEHIIPYSISLDDNFGNKTLCDAKFNQMKGEKTPYQFFCENQDPHLWGIRKYHNPMDGWEEISERAFRVLPFPKAKRFTSKSDFEAAGFIERQLNDTRYIARKTMEIMGHVCSDVRVMPGQLTAELRRLWGLNNVLQETQKVDFSGLSIQAEKAVPCYLFTDSDGKTISIVPKQSDYPETADYELVIGGKVVKGVFELRQAGFLMSAPEMPDGRYWVRLKVNSDISLLPVAADQPLPDVNHISFRGRVENRQFNNDNTGKVKTSEPDGTYFARFGIIRASFIAPERKNEPKAGKGQVLLYGTVNNGTFKCYIYTCPCDMPDGKYWILLDLDMTNVEFIRAFNERPTAGGNQLVIMASVTDGGLLSLDDDPRYVVPINADAGRYYATLDIEPISAELFPMDRAIPQFEKGQQLTEGTVWVDEHTGEIRFDPKKNRDDHRHHAIDAITIALTEQRFLQYMSTRNAQLKDKMRGKLNSTEKLPVPWMGFEDDVAKAANGILVSHKQNNKTLTKNRRGFSVRGQLHKESVFGKRKAPFAHEDGYHIRAKITELENNKHVAKVVDVTIRKLIEDHLKHQCGVDVANAKGYKIPKDAFFKNGEWQLFLPNKNGAPVPIKKVRICENIGNAMPLKDNVNQYVNPRNNHHVLIYKDANGELKEEVVMFWTVAERRLQGLPIYQLPEDGQSIVTTMEINDMFLVGLSPEDIMANWRNKALLSRCLYRVQKLSQMDFTFRHHLASTINDDDQGCRIASMKLWKEKNPIKVKLDETGQLTLVTQ

SEQ ID NO: 1200 - protein, 1264 aa, unidentified
  REGION 1..1264: note = Description of Unknown:uncultivated organism sequence
  REGION 1..1264: note = Category: MG61 effectors
  REGION 1..1264: note = Description: MG61-36 effector
MEDRYMDFTKFQKLNSIIKTCSFEMVPIGKTRETMEKHNVIEEDAERKSNAELTKEVSDSFIREFIADYKEDMDWKDLYDAYGEDRARFTDIMNQKAEKLAKRFSDSFNEYINTFLKANGINDKKSKWSDSGYVDVVLPLYVSIHPDFSNDKYERAVASLLHCSNSLFKKYTTSYARIIAGTKKGSFADRSMENFQTVCANSVMFDLISRNLSSVECHDAFKEVFADAPLNMNEYLSQKGISRYNEFVGDSFDENGQVIRYGVNHYINEWNQTHPDERMPKMHKLKKQILSIVEPSFRIRTINDETELFGTFDNIRTAEQRYAGMLESILENMNTADIYDKSGILVTSTERDSLANAITGEWSYFRRQIKEEEENRIREEYLQKKNRVKTKLTQKDNKQIEDALNKSIYSVADLNKMLGSDLGTIEEKLLDEYIRNKSKKESAYAQLVKTDFYDKKTIPAGDDVQRIQQYLDKVLGLTHIVRGLCADSQDPRTDFVFSDDVSSLEDDRVQIVSCYNLIRNFVTKKREKAAKEKQIQLCFGRPAHFEQVWNNKQEGKFGNVDAALLEYAGKYYYMVPAAKNEEKLNFPVTDEPQTGECYNYLATKKAIGFAKAFAKFYIKSPEAMEGYKKTDEPFEISVGNDTMLISKKVYEDYEAKIFRESEEAKNKLIDCAKEFLSKNLSYCIYDWSELKEAKNYVNYGEFCNEVDSIAFRVINRYVSKKLVDDAVESGNLYMFEISSLDMYKDSSRMKNIMALRFNQIMNGMFTGDKSIIINNAPQIRYRPVVIEKKDVHPVGSRLVNKNTTDGRTIPGDVYLELCAYYNGKKDSLSPEASLYNEKVSVKDSDRAHIKDKHYTEEKFLITFSYTANKNVASATSGYQLNEMVRKEIRENGCNIMAVIRGIDNLLYYAVVDENGNRIEAGDLNVVGDTDFYEKLTILGKQRYADQKNWKHENKVADLKDTYLGQVCRKIASIAVKNNAVIVIDKINERTKRKNAAFDNNMYRKFENALVNSLTDYYDIGIRGDEPGSVKNPLQLTVKEDNGFQNGIIFYQFDTFTKNICMETGFVNLLNTFEIKTVASKVAFLKKLSGIYYDNDINEFVFEFTWRNIGCILKDEELSLYDGMDKIWKVRTHFTRYMRNAEKNKYVEIDGTEVLKELIRKNHPDMIGGKIDVDRLTSEEVKKVFEIFTLYTNGYIPRMDDAESGYMSPACDWNNFGTIRYDEMTALQLAKKSSLMIGKVKSGKDWKDMNVSRVEWLNHVLKADW

SEQ ID NO: 1201 - protein, 1264 aa, unidentified
  REGION 1..1264: note = Description of Unknown:uncultivated organism sequence
  REGION 1..1264: note = Category: MG61 effectors
  REGION 1..1264: note = Description: MG61-37 effector
MEDRYMDFTKFQKLNSIIKTCSFEMIPIGKTRETMEKHNVIEEDAERKSNAELTKEVSDSFIREFIADYKEDMDWKDLYDAYGEDRARFTDIMNQKAEKLAKRFSDSFNEYINTFLKANGINDKKSKWSDSGYVDVVLPLYVSIHPDFSNDKYERAVASLLHCSNSLFKKYTTSYARIIAGTKKGSFADRSMENFQTACANSVMFDLISRNLSSVGSHDAFKEVFADAPLNMNEYLSQKGISRYNEFVGDSFDESGQVIRYGVNHYINEWNQTHPDERMPKMHKLKKQILSIVEPSFRIRTINDETELFGTFDNIRTAEQRYAGMLESILENMNTADIYDKSGILVTSAERDSLANAITGEWSYFRRQIKEEEENRIREEYLQKKNRVKTKLTQKDNKQIEDALNKSIYSVADLNKMLGSDFGTIEEKLLDEYIRNKSKKESAYAQLVKTDFYDKKTIPAGDDVQRIQQYLDKVLSLTHIVRGLCADSQDPRTDFVFSDDVSSLEDDRVQIISCYNLIRNFVTKKREKTAKEKQIQLCFGRPAHFEQVWNNKQEGKFGNVDAALLEYAGKYYYMVPAAKNEAKLNFPVTDEPQMGECYNYLATKKAIGFAKAFAKFYIKSPEAMEGFEKTEEPFEISVGNDTMIISRKVYEDYEAKTFRESEEAKNKLIDCAKEFLSKNLSYCIYDWSVLKEANDYVNYGEFCNEVDSIAFRVINRYVSKKLVDDAVERGNLYMFEISSLDMYKDSSRMKNIMALRFNQIMNGMFTGDKSIIINNAPQIRYRPVVIEKKDVHPVGSRLVNKNTTDGRTIPGDVYLELCAYYNGKKDSLSPEASLYNEKVSVKDSDRAHIKDKHYTEEKFLITFSYTANKNVASATSGYQLNEMVRKEIRENGCNIMAVIRGIDNLLYYAVVDENGNRIEAGDLNVVGDTDFYEKLTILGKQRYTDQKNWKHENKVADLKDTYLGQVCRKIASIAVKNNAVIVIDKINESTKRKNAAFDNNMYRKFENALVNSLTDYYDIGIRGDEPGSVKNPLQLTVKEDNGFQNGIIFYQFDTFTKNICMRTGFVNLLNTFEIKTVASKVAFLKKLSDIYYDNDINEFVFEFTWRNIGCILKDEELPLYDGMDKIWKVRTHFTRYMRNAEKNKYVEIDGTEVLKELIRKNHPDMIGGKIDVDRLTSEEVKKVFEIFTLYTNGYIPRMDDAESGYMSPACDWNNFGTIRYDEMTALQLAKKTSLMIGKVKSGKDWKDMNVSRVEWLNHVLKADW

SEQ ID NO: 1202 - protein, 1264 aa, unidentified
  REGION 1..1264: note = Description of Unknown:uncultivated organism sequence
  REGION 1..1264: note = Category: MG61 effectors
  REGION 1..1264: note = Description: MG61-38 effector
MEDRYMDFTKFQKLNSIIKTCSFEMIPIGKTRETMEKHNVIEEDAERKSNAELTKEVSDSFIREFIADYKEDMDWKDLYDAYGEDRARFTDIMNQKAEKLAKRFSDSFNEYINTFLKANGIKDKKSKWSDSGYVDVVLPLYVSIHPDFSNDKYERAVASLLHCSNSLFKKYTTSYARIIAGTKKGSFADRSMENFQTACANSVMFDLISINLSNVGSHDAFKEVFADAPLNMNEYLSQKGISRYNEFVGDSFDESGQVIRYGVNHYINEWNQTHPDERMPKMHKLKKQILSIVEPSFRIRTINDETELFGTFDNIRTAEQRYAGMLESILENMNTADIYDKSGILVTSAERDSLANAITGEWSYFRRQIKEEEENRIREEYLQKKNRVKTKLTQKDNKQIEDALNKSIYSVADLNKMLGSDFGTIEEKLLDEYIRNKSKKESAYAQLVKTDFYDKKTIPAGDDVQRIQQYLDKVLGLTHIVRGLCADSQDPRTDFVFSDDVSSLEDDRVQIISCYNLIRNFVTKKREKTAKEKQIQLCFGRPAHFEQVWNNKQEGKFGNVDAALLEYAGKYYYMVPAAKNEAKLNFPVTDEPQRGECYNYLATKKAIGFAKAFAKFYIKSPEAMEGFEKTEEPFEISVGNDTMIISRKVYEDYEAKTFRESEEAKNKLIDCAKEFLSKNLSYCIYDWSGLKETKDYVNYGEFCNEVDSIAFRVINRYVSKKLVDDAVERGNLYMFEISSLDMYKDSSRMKNIMALRFNQIMNGMFTGDKSIIINNAPQIRYRPVVIEKKDVHPVGSRLVNKNTTDGRTIPGDVYLELCAYYNGKKDSLSPEASLYNEKVSVKDSDRAHIKDKHYTEEKFLITFSYTANKNVASATSGYQLNEMVRKEIRENGCNIMAVIRGIDNLLYYAVVDENGNRIEAGDLNVVGDTDFYEKLTILGKQRYTDQKNWKHENKVADLKDTYLGQVCRKIASIAVKNNAVIVIDKINERTKRKNAAFDNNMYRKFENALVNSLTDYYDIGIRGDEPGSVKNPLQLTVKEDNGFQNGIIFYQFDTFTKNICMRTGFVNLLNTFEIKTVASKVAFLKKLSGIYYDNDINEFVFEFTWRNIGCILKDEELSLYDGMDKIWKVRTHFTRYMRNAEKNKYVEIDGTEVLKELIRKNHPDMIGGKIDVDRLTSEEVKKVFEIFTLYTNGYIPRMDDAESGYMSPACDWNNFGTIRYDEMTALQLAKKSSLMIGKVKSGKDWKDMNVSRVEWLNHVLKADW

SEQ ID NO: 1203 - protein, 1264 aa, unidentified
  REGION 1..1264: note = Description of Unknown:uncultivated organism sequence
  REGION 1..1264: note = Category: MG61 effectors
  REGION 1..1264: note = Description: MG61-39 effector
MEDRYMDFTKFQKLNSIIKTCSFEMIPIGKTRETMEKHNVIEEDAERKSNAELTKEVSDSFIREFIADYKEDMDWKDLYDAYGEDRARFTDIMNQKAEKLAKRFSDSFNEYINTFLKANGINDKKSKWSDSGYVDVVLPLYVSIHPDFSNDKYERAVASLLHCSNSLFKKYTTSYARIIAGTKKGSFADRSMENFQTACANSVMFDLISRNLSSVGSHDAFKEVFADAPLNMNEYLSQKGISRYNELVGDSFDESGQVIRYGVNHYINEWNQTHPDERMPKMHKLKKQILSIVEPSFRIRTINDETELFGTFDNIRTAEQRYAGMLESILENMNTADIYDKSGILVTSAERDSLANAITGEWSYFRRQIKEEEENRIREEYLQKKNRVKTKLTQKDNKQIEDALNKSIYSVADLNKMLGSDFGTIEEKLLDEYIRNKSKKESAYAQLVKTDFYDKKTIPAGDDVQRIQQYLDKVLSLTHIVRGLCADSQDPRTDFVFSDDVSSLEDDRVQIISCYNLIRNFVTKKREKTAKEKQIQLCFGRPAHFEQVWNNKQEGKFGNVDAALLEYAGKYYYMVPAAKNEAKLNFPVTDEPQMGECYNYLATKKAIGFAKAFAKFYIKSPEAMEGFEKTEEPFEISVGNDTMIISRKVYEDYEAKTFRESEEAKNKLIDCAKEFLSKNLSYCIYDLSVLKEANDYVNYGEFCNEVDSIAFRVINRYVSKKLVDDAVERGNLYMFEISSLDMYKDSSRMKNIMALRFNQIMNAMFTGDKSIIINNAPQIRYRPVVIEKKDVHPVGSRLVNKNTTDGRTIPGDVYLELCAYYNGKKDSLSPEASLYNEKVSVKDSDRAHIKDKHYTEEKFLITFSYTANKNVASATSGYQLNEMVRKEIRENGCNIMAVIRGIDNLLYYAVVDENGNRIEAGDLNVVGDTDFYEKLTILGKQRYTDQKNWKHENKVADLKDTYLGQVCRKIASIAVKNNAVIVIDKINESTKRKNAAFDNNMYRKFENALVNSLTDYYDIGIRGDEPGSVKNPLQLTVKEDNGFQNGIIFYQFDTFTKNICMRTGFVNLLNTFEIKTVASKVAFLKKLSGIYYDNDINEFVFEFTWRNIGCILKDEELPLYDGMDKIWKVRTHFTRYMRNAEKNKYVEIDGTEVLKELIRKNHPDMIGGKIDVDRLTSEEVKKVFEIFTLYTNGYIPRMDDAESGYMSPACDWNNFGTIRYDEMTALQLAKKSSLMIGKVKSGKDWKDMNVSRVEWLNHVLKADW

SEQ ID NO: 1204 - protein, 1253 aa, unidentified
  REGION 1..1253: note = Description of Unknown:uncultivated organism sequence
  REGION 1..1253: note = Category: MG61 effectors
  REGION 1..1253: note = Description: MG61-40 effector
MELNKFCRLNQSIKTCSLELVPIGRTRETIEKHNVIEEDSKRKENAVLAKEVSDSFIREFIADYKGDFDWSELVACFGKHEEYAGIKEKMEEKIAREFSDAFNGYISKFLKANGVGKADNKTKWSDASYIDVVLPLYASLHPDYDNPKYKEAIASICHCSSTIFKRYITAYEKIINGTKKGSFAERVMDNFQIICTNRLMCEIVFSKIKKADDFRLFLDAPESMNEYLSQKGIDQYNETIGDSFSEKGEILRYGLNHYINEWNQKNPDSRMPKLQKLKKQILSVAEPAFRIDVIDNEKELQETIKNIRAAEVRYSGKLKDILENLNYTNTYIHDGVLVKAAGRENLAKMITGEWNFFREQIREREERRIRDEYLQKKNRIKTKLTKKDEKQIEDTVSKGMYSLVDLNKMLGEEKANIESKLLDEYVKNRSEREKHYTVVANADFMSKESLPTSDEIKIIQNYLDKVIQMTHIIRCLDADAQNEKVDLVFLDDAAELEDDKTLIVTGYNLIRSFLTKKREKTAKEKAVQLCFGRPAHFEQKWNNKQAGKFGNVDAALLEENGKFYYIVPAAKNESKLNFPVTDEPQAGRCYNYLSTQKAIGFAKAFAKFTIKSPEAMSGYAKSEEPFEISVGNQKMTVSKKMYDSYEAKTFRDSEEEKIKLIDYAKEFLQKHGSYNTYDWSELRESKDYVNYGEFCSEVDSIAFRVVNRYISKDLVDDAVLRGDLYMFEITSQDMYKDKNRMKNIMALRFHAIMEGMKTGNKSIIINNAPQIRYRPQIIEAEDKHPAGSKLVNKKTTDGKTIPGDIYLELCDFYNGRKSSLSPEASLYNERVSVKVSDREHIKDKHYTAEKFLITLSYTMNKNVASNTSVYKLNEMIRNEIKENGCNIMSVIRGIDNLLYYAVIDENGNKIEAGDLNVVGDTDFNEMLSVVGTQRYIDQKNWKYEKKVAELKDTYLGQACRKIASIAVKNNAVIVIDKINENTKRKNAAFDNNVYRKFEDALVNTLSNYYDRSIKADEPGGISNPLQLCVNEDNNFQNGILFYTYDAFTKNICMDTGFINLLNTFNVKTVAAKLGFLKKMDGIYYDSDRQEFVFEFAWGKLGSVLKEEEAALYTGLDKSWKVRTHLTRYKRDRESGKYKEVDGTEILKKLIKEKHPDMIGEKINVDKLTSNEVQTVYEIFTLYVNGFIPRMDGESSEYMSPVSDWNSMSNIAYDEMTALQLARKGSLTIGRIKNGFEGKDINISRVDWLNEILR

SEQ ID NO: 1205 - protein, 1264 aa, unidentified
  REGION 1..1264: note = Description of Unknown:uncultivated organism sequence
  REGION 1..1264: note = Category: MG61 effectors
  REGION 1..1264: note = Description: MG61-41 effector
MEDIYMDFTKFQKLNSIIKTCSFEMIPIGKTRETMEKHNVIEEDAERKSNAELTKEVSDSFIREFIADYKEDMDWKDLYDAYGEDRARFTDIMNQKAEKLAKRFSDSFNEYINTFLKANGIKDKKSKWSDSGYVDVVLPLYVSIHPDFSSDKYERAVASLLHCSNSLFKKYTTSYARIIAGTKKGSFADRSMENFQTVCANSVMFDLISRNLSSVECHDTFKEVFADAPLNMNEYLSQKGISRYNEFVGDSFDESGQVIRYGVNHYINEWNQTHPDERMPKMHKLKKQILSIVEPSFRIRTINDETELFGTFDNIRTAEQRYAGMLESILENMNTADIYDKSGILVTSAERDSLANAITGEWSYFRRQIKEEEENRIREEYLQKKNRVKTKLTQKDNKQIEDALNKSIYSVADLNKMLGSDFGTIEEKLLDEYIRNKSKKESAYAQLVKTDFYDKKTIPAGDDVQRIQQYLDKVLSLTHIVRGLCADSQDPRTDFVFSDDVSSLEDDRVQIVTCYNLIRNFVTKKREKTAKEKQIQLCFGRPAHFEQVWNNKQEGKFGNVDAALLEYAGKYYYMVPAAKNEAKLNFPVTDEPQRGECYNYLATKKAIGFAKAFAKFYIKSPEAMEGFEKTEEPFEISVGNDTMIISRKVYEDYEAKTFRESEEAKNKLIDCAKEFLSKNLSYCIYDWSVLKEANDYVNYGEFCNEVDSIAFRVINRYVSKKLVDDAVERGNLYMFEISSLDMYKDSSRMKNIMALRFNQIMNGMFTGDKSIIINNAPQIRYRPVVIEKKDVHPVGSRLVNKNTTDGRTIPGDVYLELCAYYNGKKDSLSPEASLYNEKVSVKDSDRAHIKDKHYTEEKFLITFSYTANKNVASATSGYQLNEMVRKEIRENGCNIMAVIRGIDNLLYYAVVDENGNRIEAGDLNVVGDTDFYEKLTILGKQRYTDQKNWKHENKVADLKDTYLGQVCRKIASIAVKNNAVIVIDKINESTKRKNAAFDNNMYRKFENALVNSLTDYYDIGIRGDEPGSVKNPLQLTVKEDNGFQNGIIFYQFDTFTKNICMRTGFVNLLNTFEIKTVASKVAFLKKLSGIYYDNDINEFVFEFTWRNIGCILKDEELSLYDGMDKIWKVRTHFTRYMRNAEKNKYVEIDGTEVLKELIRKNHPDMIGGKIDVDRLTSEEVKKVFEIFTLYTNGYIPRMDDAESGYMSPACDWNNFGTIRYDEMTALQLAKKSSLMIGKVKSGKDWKDMNVSRVEWLNHVLKADW

SEQ ID NO: 1206 - protein, 371 aa, unidentified
  REGION 1..371: note = Description of Unknown:uncultivated organism sequence
  REGION 1..371: note = Category: MG61 effectors
  REGION 1..371: note = Description: MG61-42 effector
MSYITLCLPFNTNDSKAEKLFSTAWLFKTASHRMLTLAKQFPVLPATDIGWKNTFRKVIYEVISNRRYADGVIVLIRGVYESCRQLGIDFKDAELGDWLMFQQAEKEYPVRNITLRQGYEFHITTINYNGKPERITIKPTIPKNYKLLLEKIIEDKQKHTARIVVKDHGVRKDKLWVQGEVQLTIPLKFYYKYMVRFKRNYGRLYGGVDVNTDRINLAIVDKHGRLRDVKTFWFEDVSRKGYPRRRARVLIGMAVHEMLKYAYHHGVKTLFLENPDVLGKLKLLWIRNGRRLYKNYNWKVMTFRSSIVEIITIKAPLYAIKVDYVSPRGTTTSKQHDKLMRKYGLDRHTTSAYIIALKGMKRCTSIQNTTI

SEQ ID NO: 1207 - protein, 362 aa, unidentified
  REGION 1..362: note = Description of Unknown:uncultivated organism sequence
  REGION 1..362: note = Category: MG61 effectors
  REGION 1..362: note = Description: MG61-43 effector
MSPLYTIKLSFNEFGEKAKLLLSTAWLFKIACHKVLNKSKVLYENLVPSKIAWIKMFKDDAYSVIPNKRYSYGVVYLVYGVWESARKLGVDYRMVELSDWLMFQHYEREVSGNVIRVHGDGSALVTVYGYNGLKDRILIKAKPNKGQAQLLKAAVEENEKYMPKVVIRDYGVRDNTIYVRGEIHISLDYGFYAKHAQRFSEPKGNLIGGVDVNVDRINLAIVDEMGRLRDVKTFWFRETTARGYPRKRAWSIIGMRIHEMLKYAYHHGVKTIALENPDALGTLRLLWIRSGERRHENYNYKVALFRTSIIERIAMKALLYGMEVKYVDPKGTTSSREHNWIARAHGLDKHASSATLIALRSI

SEQ ID NO: 1208 - protein, 365 aa, unidentified
  REGION 1..365: note = Description of Unknown:uncultivated organism sequence
  REGION 1..365: note = Category: MG61 effectors
  REGION 1..365: note = Description: MG61-44 effector
MTYITLAFPFNVCCDVAKRFLSTAWLFKIAIHRLLSVAKQSPILPGTDIGWKNTFRRVAYEIIPNRRYADGVVTLVRSIYESCRQLGIDFKSVELSNWLMFQQSELEYPAKNITLKPSYEFHVTTVDYSKNTYRDVVKPIVPKSYKPLLEEILEERQKYTGRVVVKNYGIRKGNLWIRGEVQITVPIDFYYKHMVRCREPKGSLIGGIDVNVDRLNLAVIDERGNLRDSKTFWFSEATTRGFSRRSARSIIGAKIREMLSYAYHHSVKTLFLENPGVLGKLRLLWVKNGDRKHESYNYKVSVFRSSVTEMIAVKAPLYGIEAKYVDPKGTTSSKEHGEVAERCGLDRHVASAYLIALRGLRHQRI

SEQ ID NO: 1209 - protein, 374 aa, unidentified
  REGION 1..374: note = Description of Unknown:uncultivated organism sequence
  REGION 1..374: note = Category: MG61 effectors
  REGION 1..374: note = Description: MG61-45 effector
MKQINYITLRLPFHVTGEEARLIYWIAWLCKLCAHRLLNYVKENLLLADLSQYDFIKLGRKLCYDIIPNRRYVDGISTIVQASLQSAKALGADISKLELKPWLLFQSEAEPWARGNLNIQFKNYDVTKVLVFDNDKSSRKITIKPVIPKGYIKLVKTLVDKALKREVGYPARVYIRDYGDKLEYLYGELQVMVKYDFYIEVMKKYDKPLGNNIAGVDVNVDRLNLVVINRSGDIVWKYTTRFPHVTSRGFPRKRAWSIIGEKIHEILRNTYSHGASVIAVENPEIIGYLRYYWIRNGKRKTKNYNYKVSIFRNSMIERIIWKAPLYGLKVIPINPKGTTRSKDHEYVMRKYGLDRHVASAYLIALKARRNLQRP

SEQ ID NO: 1210 - protein, 372 aa, unidentified
  REGION 1..372: note = Description of Unknown:uncultivated organism sequence
  REGION 1..372: note = Category: MG61 effectors
  REGION 1..372: note = Description: MG61-46 effector
MYSQKLGKDIVITPNNSPITHVTIVGKLIISQPEDRMKLTRLAWSFKRVVEFMVREIISNRGVQEAVKRHHNVLPNYVYLESAYKHAKLIVEGCKRNNGNPRHVHVRKLFVISRGNRFDKGNRNIKLVPKGKFFEVHIKYPWGNSWLVCKAVFGEKYVPLLKELVILTERRVESYEAKIVFRRKRIELHVSIPLQLYLKYFSKTKPKGYGLLAGFDLNSDRINMVVIDENGRIITLRTEWFPEVTLHGYSRHKAKNTRLKALKKLLLHARRIGVDYVVFENLLTVKKNRRKRKLRSPHANRKKGKFAKKQLIIHGILMSLKLGLTPILINPKGTTHSKDHGEAMKRRGLDKHMASAYIIAYRDLKIIRNNEK

SEQ ID NO: 1211 - protein, 365 aa, unidentified
  REGION 1..365: note = Description of Unknown:uncultivated organism sequence
  REGION 1..365: note = Category: MG61 effectors
  REGION 1..365: note = Description: MG61-47 effector
MSYITLTLPFNISDSEAWRLLSTAWLFKIASHRMLSLAKQFPILPATDIGWKNTFRKIIYEVIPNRRYTDGVIVLVRGIYESCRQLGVNFKDVELGDWLMSQQAEKEYPVRNITLKQGYEFWITTVDYNGNSERIVIKPSIPKNYKLLLDRILEEKQKHTARVVIKDYGVRKNKLWIHGEIQLTIPLDFYHKYMTRYRRNYGKLYGGVDVNTDRINLAIVDEQGSLRDTYTFWFREVTARGYSRRKARSVIGMRVHEMLKYAYHHGVKTLFLENPEVLGKLKLLWIRNGKRLHKNYNWKVATFRSRILEMIAMKAPLYSIKVGYVDPKGTTNSKEHDEVMRKHRLDRHTASAYIIALRGLNHKFI

SEQ ID NO: 1212 - protein, 363 aa, unidentified
  REGION 1..363: note = Description of Unknown:uncultivated organism sequence
  REGION 1..363: note = Category: MG61 effectors
  REGION 1..363: note = Description: MG61-48 effector
MSVPRLSSVEELISHVTVIGKVIPETINDYMKLVRLAWSFKRVVDLMIREVINNAFMKDATKKLYQILPNYIYLESAYKHAKLIVEGCKFNNGNPKHVHVKKLFIVSRGNKYDKGNRNVKLIPDKGFFKALIKYPWDGSWIECRVLFGEKYIPLLKELLELTSKKKEGYGTRIVFRKSRIELHVSVPLHLYLKHFSAPRREGYGLVAGLDLNSDRANMVIIDSTARIVTMRTAWFPEVTLHGFPRDKARDVRLKKLRELLVFARRIGVDYIVFEDLFAVKKRSKVSSPSGNRKIVRFAKRQLLQHGLLMSLKLGLTPILVDPKGTTHSREHEEVMKKRGLDKHMASAYIIAYKGLKVIRNHEK

SEQ ID NO: 1213 - protein, 336 aa, unidentified
  REGION 1..336: note = Description of Unknown:uncultivated organism sequence
  REGION 1..336: note = Category: MG61 effectors
  REGION 1..336: note = Description: MG61-49 effector
MSYVTLVLPFNACCDEARKLLSTAWLFKVATHRMLSIAKQISALPATDIGWKSAFRKAVYEVIPNRRYTDGVITLVRSIYESCRQLGVDFKSVELGNWLMFQQSESEYPVRNITLKHGHEFHVTTISYNGSANRVIVKPTIPKNYRALLDKIIEEKQEHTARVVVKGFGVRKSVLWVHGEVHLTIPIEFYYGHVARYRKNGGRLYGGVDVNVDRINLTIVDEDGRLRDRKTFWFREVTARGCPRRRAWSAIGTRVHEMLSYAYHHGVKTIALENPNTLGALKLMWAKSGEKRHENYNYKVSIFRCKVVEMIAMKAPLYDIEVRCIDPRGDDPFKRT

SEQ ID NO: 1214 - protein, 376 aa, unidentified
  REGION 1..376: note = Description of Unknown:uncultivated organism sequence
  REGION 1..376: note = Category: MG61 effectors
  REGION 1..376: note = Description: MG61-50 effector
MSKSVAEYITLRLPFHVTGVDAKLIYWTAWLCKLCAHRLLEAIKLNPSLAYLSQYDFIKVGRRLCYDIIPNRRYVDGISTLIHASLQSAKALKVDITKLEPKHWLLFQSEAEPWAKGNLNIQFVDYDKVKVLVFDRDKSSRRIIIEPVIPKGYIRLVKALVDKALKKEIGYPARIYITDYGERLEHLYGEIQVMVKYNFYLEVMKRYDKPLGDNIAGVDVNVDRLNLVVINRDGDIVWKHTVRFPQITSRGCPRKRAWSIIGEAIHSILRNAYSHGASVVAVENPEVLGYLRYYWIKNGDRGTKNYNYRISIFRNSIIERIVWKAPLYGLHVVTVNPKGTTHSKDHEYVMRRYGLDRHTASAYLIALKTRRNLQRP

SEQ ID NO: 1215 - protein, 361 aa, unidentified
  REGION 1..361: note = Description of Unknown:uncultivated organism sequence
  REGION 1..361: note = Category: MG61 effectors
  REGION 1..361: note = Description: MG61-51 effector
MSTLRLSNVEELVPHVTVIGKLLPETPGDYMKLVRLAWSFRRAVELMIREVVNGTSMKDATKKVYYLLPNYVYLESAYKHAKLIIEGCRFNNGNPRHIHVRKLFIISRGNKYDKGNRNVEIIPSTKFFQVLIKYPWDGSWIECRAFFGEKYIPLLRELLELANQKREGYGARIVFREGRIELHISAPLFLYLKHFSLPERRGYGLLAGLDLNSDRINMVVIDSNGRIVAMKTAWFPELTLHGFPREKARDTRLKKLKELLSYARRIGVDYVAFENLFVMKKRGKVSSPSGNRKITRFAKKQLLQHGLLMTLKLGLSPILVDPKGTSHSREHKEVMKEKGLDRHMASAYIIAYRGLKAIRNH

SEQ ID NO: 1216 - protein, 355 aa, unidentified
  REGION 1..355: note = Description of Unknown:uncultivated organism sequence
  REGION 1..355: note = Category: MG61 effectors
  REGION 1..355: note = Description: MG61-52 effector
MSQFQISSTDASKLVTHVTIVGRLIPETDEDFVKLARLAHDFRKAVLYATRMIVKGIDANSILRELRSMLNKAYGDSAYKVAKAIVEGCKYSGGNPKHIKIRKLFIVSEGEASRLGNRNIRLESVDVVKIKYPYDSSWLTFKALFGEEYLQLVAELVELAKQKGVSYGARVVFRDGRIYLHLSVPLELYLKHFKKGEAREELIAGFDLNSDRVNMVIVDRFGRIRDVKTQWFTEVTSHGFPRNKAKTKRLEALAKLLRYAYHHNIGTVVFENLLAIKKRRYTSNSTANRKITRFAKRELLQHALVMAMKYGFKVKLVDPSGTTHSREHDEVMKRYGLDKHVASACLIALKELKQP

SEQ ID NO: 1217 - protein, 363 aa, unidentified
  REGION 1..363: note = Description of Unknown:uncultivated organism sequence
  REGION 1..363: note = Category: MG61 effectors
  REGION 1..363: note = Description: MG61-53 effector
MTYITLVFPFNVCCDVAERLLSTAWLFKIATHRLLNVVKHFPVLPATDIGWKNTFREIAYEIIPNRRYADGVVTLVRSIYESCRQFRIDLKSVELSNWLMFQQSELEHPARNITLKPGYEFHITTVDYNKNTYRDVVEPIIPKSYKPLLDKMLEERQKYTGRVAVKSYGIRKYNLWVRGEIQITIPTDFYYNHMTRYRKSKGSLIGGIDVNVDRLNLAIIDEKGNLRDCKTFWFSEAVARGFSRRSARSIIGAKIREMLSYAYHHNVKILFLENPEVLSKLKLLWVRNGDRKHENYNYKVSVFRSSVIEMIALKAPLYGIEAKYVNPKGTTNSEEHDEAMKRYGIDRHTASAYLIALRGLRNQ

SEQ ID NO: 1218 - protein, 374 aa, unidentified
  REGION 1..374: note = Description of Unknown:uncultivated organism sequence
  REGION 1..374: note = Category: MG61 effectors
  REGION 1..374: note = Description: MG61-54 effector
MNIVEYVTLRLPFHVAGEEARLVYWTAWLCKLCAHRLLSTVRQNPLLADLSQYDFIKIGRKLCYSIIPNRRYIDGISTLIHASLQSAKALGVEVTKLELKPWLIFQSEAEPWAKGNLNIQFTDYDKVRVLVFDRDKTSRKITIKPVIPEGYAKLVKALVDKALRKEIGYPARIYVRDYGDGLNHLYGELQIMVRYGFYLEVMKRYDKPLGSNIAGVDVNVDRINLVVINRAGDIVWKYTARFPEVMSRGCLRKKAWSIIGEAIHSVLKNAYSHGTSVIAVENPEIMGHLRYYWIRNGDRRTKNYNYKVSVFRNTVIERISWKAPLYGLHVIHINPRGTTHSEDHDYIMKRYGLDRHTASAYLIALKARRVLRRP

SEQ ID NO: 1219 - protein, 365 aa, unidentified
  REGION 1..365: note = Description of Unknown:uncultivated organism sequence
  REGION 1..365: note = Category: MG61 effectors
  REGION 1..365: note = Description: MG61-55 effector
MTYITLTFPFNVCCDVAKRFLSTAWLFKIATHRLLSIAKQSPVLPGTDIGWKSAFRGIAYEVIPNRRCADGVVTLVRSIYESCRQLRIDFKSVELSDWLMFQQSELEYPARNITLKPGYEFHITTVDYTKNTHRDVVKPTIPKSYKLLLDKMLEERQEYTGRVAIKSYGVEGGDLLVQGEVQITIPIDFYYKHVTRARANKGRLYSGVDVNVDRLNLAIVDGSGSLKDTHTLWFREVTARGFSKKSAGSIIGVKIREMLSYAYNHGVKTLFLENPDVLGKLKLLWVRSGDRMHENYNYRISVFRSSVIEMIALKAPLYGIEVKYVDPKGTTSSREHDEIVKRYGLDRHTASAYLIALRGLRHQRI

SEQ ID NO: 1220 - protein, 373 aa, unidentified
  REGION 1..373: note = Description of Unknown:uncultivated organism sequence
  REGION 1..373: note = Category: MG61 effectors
  REGION 1..373: note = Description: MG61-56 effector
MKVPRYITIRLPFHVDGNVASGIISTAWLSKVVAHRVLRIVKDNPLYLQLSETRFLKNLRNACYDVLPNRRYVDGVLKLVYSTLRSVQALGIDIRQIELKQWLLFQSDGEPQARGNLNIRLVEPYRVRILTFDYNKASEYVEFDVVLPKGWRKLVEELVERANRKEVGYPARIYVSDYGVGKNGLHVAGEVQIMAPCRLYQEVMKRYDTPRGDLVAGIDVNVERLDVAVVSPSGKLKLVKTFWLDGAVHMGVRRERAWSIIGEVIHKMLKWLYHSGVSTIVLENPEIIGYLRYYWIRNGERRGRKWNWKVSMFRSSIIERISWKAPLYAMEVRYVDPKGTTHSQDHDALMRRYGLDRHTASAYLIALKGLDRT

SEQ ID NO: 1221 - protein, 364 aa, unidentified
  REGION 1..364: note = Description of Unknown:uncultivated organism sequence
  REGION 1..364: note = Category: MG61 effectors
  REGION 1..364: note = Description: MG61-57 effector
MLHYQTNEVINAKTLISHVTIIGKLIPQTPNDFMKLVRLSYDFRKAVLYATRMISKGIKANEFLKELRGMLNKGYGDSAYKVAKSIVEGCRFNGGNPQHIKVEKLFIASEGETSRIGNRNVRLEATDRVKIKYPYDRTWLFFKVQFGKNYLPLVQEIVKLAKEKKTSYGAIIVFRDSRIYLHLSIPIDLYLKYFSKGSANGSLTAGFDLNADRINMVVVDGFGRIRDAKTEWFPEVTSHGFPRSKAKIKRLEALARLLDYAYHHNVGVVVFENLFIIKRRKFTKNSSANRKISRFTKKELLQYGIIMAMKYGFKVLLVNPKGTTHSKEHDEVMRKYGLDRHTASAYIIALRGMESHNLIRKAII

SEQ ID NO: 1222 - protein, 371 aa, unidentified
  REGION 1..371: note = Description of Unknown:uncultivated organism sequence
  REGION 1..371: note = Category: MG61 effectors
  REGION 1..371: note = Description: MG61-58 effector
MSYITLCLPFNVDGIEARKLLSIAWLFKIASHKMLSIAKQSPILPATDIGWKNTFRKTVYEVIPNRRYTDGVIVLIRGIYESCRQLGVNFKGVELGDWLMFQQAEKEYPVRNITLKQGHKFHITTIDYNGNPERITIKPTIPKNYKLLLEEIIEEKQKHTARVVVKDYGIRDSKLWVRGEIQLTIPLDFYYKHMTRYRRNYGRLYGGVDVNTDRINLAIVDKYGRLRDVKTLWYEDAPRKGYPRRKARVLISMAVHEMLKYAYYHGVKILSLENPNALGKLKLLWIKNGKRLHRNYNWKVMTFRSNIIEMVAMKAPLYSIKIEYVNPKGTTTSKEHDEVMWKYSLDRHTASAYLIALKGIERHTMIQKAII

SEQ ID NO: 1223 - protein, 349 aa, unidentified
  REGION 1..349: note = Description of Unknown:uncultivated organism sequence
  REGION 1..349: note = Category: MG61 effectors
  REGION 1..349: note = Description: MG61-59 effector
MRLVRLARDFRRAVLYATRMISKGIKVNDILKELRGMLNKAYGDSAYKVAKAIVEGCRFNGGEPQHVKIRRLFIVSEGEASRLGNRNVRIESTDLARIKYPYDKSWILLKVRFGKKYLPLIRELIELIKQRKVSFGARILFRDGKIYLHLSVPINLYLKYFSKGRAGGCLIAGFDLNSDRVNMVIIDRYGKIRDIKTGWFPEVTSHGYPRSKARAKRLEALAKLLRYAYHHNVGTVVFENLLTIKQRRCTGNPTANRKITKFAKRELLQYGIVMSMKYGFKTLLINPKGTTHSSEHNYIMRKHGLDKHTASAYLIALKGIESHMMIQKAVIYRFCPYTTTYTHSLVRSL

SEQ ID NO: 1224 - protein, 365 aa, unidentified
  REGION 1..365: note = Description of Unknown:uncultivated organism sequence
  REGION 1..365: note = Category: MG61 effectors
  REGION 1..365: note = Description: MG61-60 effector
MKYITLVMPFNVDGTKAKRLLSTAWLFKIASHRMLSLAKQFPILPTTDIGWKNAFRKIIYEIIPNRRYTDGVIVLVRSIYESCRQLGIDFKEVELGDWLMFQQVEKEYPVRNITLKQNYGFRIITIDYKYNTEKITVKPTISNNYRLILDKILEEKQKHTARIVVKDYGARREKVWIHGEIQLIVPLNFYYKYMTRYRKNYGKFYGGVDVNTDRINLVIVDKKGSLRDAYTFWFREITSRGFPRKKARTIIGMKIHEMLKYAYHHGVKILFLENPVILGKLKLLWIKNGMRLSKNYNWKVMTFRSSVTKIITMKAPLYNIRTKYVNPKGTTHSKEHDNIMKKYRLDKHMASAYLIALKGLDYGSV

SEQ ID NO: 1225 - protein, 373 aa, unidentified
  REGION 1..373: note = Description of Unknown:uncultivated organism sequence
  REGION 1..373: note = Category: MG61 effectors
  REGION 1..373: note = Description: MG61-61 effector
MNETYLTLRLPFNLCCDEARLLLSTARLFRHTALHLHSLILKENPRITSLIALKRMYRRRLQEILPNRRYVDGAITLVYSIYESAQALGVSFSDIEFKSWLLFQQSEKEHPCRNITLQKDYSFRITTINYQGVGKRISLKPTIPKNYKQTLGKIIGEKQPYVARIVLKGFGERKNMLWVHGEIHLSIPYRFYLEHFKRYKRNYGKLLGGVDVNVDRINLAIIDRYGRLRDVKTFWFEEASWKGCPRQRAWSIIGIAVHNMLRYAYHHGVKVLFLENPETLGYLKTLWIKKGERRSNNYNYRVQFFRNRIVERITMKTPLYSINIEYVNPKGTTHSREHDEVMRRYGLDRHTASAYLIALRGIEKHTIIQKAII

SEQ ID NO: 1226 - protein, 371 aa, unidentified
  REGION 1..371: note = Description of Unknown:uncultivated organism sequence
  REGION 1..371: note = Category: MG61 effectors
  REGION 1..371: note = Description: MG61-62 effector
MSYVTVTASFNASGDCAKLLLSTAWLFKIATHRVLAYAKSTPTLPGSKIGWKNTFRSVAYEVIPNRRYADSACTLVMGIYESVRRLGIDFREVELGDWLMFQQSEKEFPPRNITLKSEDEAWVTAFGYDGESRRLRLRISASGSFRRLLEAILREKQPYNPRITLKSWNVRGGELYVRGELQVSVPIDFYYRHLARCKTNSGRLYGGVDVNSDRINLAVVDGSGILRDARTIWFREVTARGYPRHRARTVIGMGVHEMLRYAYHHGVKTLFLEDPKVLGRLRLLWIRDGKRLHKNYNWRVSTFRVSIIEAIAVKAPLYSIRVEYIDPKGTTRSEEHDELMRRYGLDRHMASAYLIALRGMERYTTIQKATV

SEQ ID NO: 1227 - protein, 367 aa, unidentified
  REGION 1..367: note = Description of Unknown:uncultivated organism sequence
  REGION 1..367: note = Category: MG61 effectors
  REGION 1..367: note = Description: MG61-63 effector
MVYGLSYVTITAGFNARGEDAKLLLSTAWLFKIATHRVLGLAKSMPLLPASKISWKNTFREVAYEVIPNRRYADGVVVLVMGIYESCRQQGVDFREVELSNWLMFQQSEKEYPPRSITLKSVDEVWVTVLSYNGESSRIKLRVTTSGVFRKLIEMLLKEKQEYNPRVYIKTWNTRSGELYLRGELQIAVPLDFYYKHMVRRRENRGRLYAGVDVNVDRLNLAIVDERGELRDTKTFWFEEASRKGVSRRRARSILGMVVHEMLRYAYHHGVRTLFLENPEILGKLKLLWVRSGDRRGGNYNWRVNIFRSEVVEMIAVKAPLYAIDVKYVAPRGTTNSREHSEIMKKYRLDRHTSSAYLIALKGLKQT

SEQ ID NO: 1228 - protein, 361 aa, unidentified
  REGION 1..361: note = Description of Unknown:uncultivated organism sequence
  REGION 1..361: note = Category: MG61 effectors
  REGION 1..361: note = Description: MG61-64 effector
MNYITIQLPFNMNGKVAGELLSTAWLFRIAVHRVLTIAKQQEALPRSRIGWERAFHRIAYGATLQSDYADGAVVLVMGVYKSCRRLGIDFRRVELSDWLMFQPSKLSRKVGSIALKPNYEFHVTTVGYDGSYDRVVVRPGVSGAFRLVLDSVLDYGVEYMGRIVVRDYGVRGGQLWVRGGAHLTIPLLAYYKVMTRYLKNNGSLQGGVDVNVDRINLAIIDENGELRDTRTFWYREVASRGFPRGRAWSIIGMRIHELLNYARNNGVSVLYLENPGVIGRLRLMWVRNGDRGHENYNYKVSAFRSTIIEEIAMKAPLYSISVGYVNPRGTTSSKAHDELMRRYGLDRHTASAYLIALMGTR

SEQ ID NO: 1229 - protein, 373 aa, unidentified
  REGION 1..373: note = Description of Unknown:uncultivated organism sequence
  REGION 1..373: note = Category: MG61 effectors
  REGION 1..373: note = Description: MG61-65 effector
MPRYVTIGLDFHVDGEDAKAILSTAWLSKLVAHRVLNLVKENELLAGLSEYMFLKVMRRKCYSILPNRRYVDGMLKLIHSIIKSAKALGVDIESIELKQWLLFQSDGERGYARGNMNIKLIDTHHARVLTLDYTGKTRYEELKLTTPKGWNKLVESLIERASRGEIGYPVRLVIRDYGIGKHGLHVHGEVQVMAPYTLYLEVMRRYEEPRGKNIAGIDVNVGRLDAVVVDEHGNLLSYRTFWIKNATFMGVRRRRSRSLIGEQIHALLKWLYSQGVSIIGLENPEVIGYLRYYWVRSGERRGNMWNWKISMFRNSIIERLTWKAPLYSMKTIYVNPRNTSKEGKRIGKKLGLDRHLGSAYIIARRTLKNLQRP

SEQ ID NO: 1230 - protein, 376 aa, unidentified
  REGION 1..376: note = Description of Unknown:uncultivated organism sequence
  REGION 1..376: note = Category: MG61 effectors
  REGION 1..376: note = Description: MG61-66 effector
MNKSEVEYITLRLPFHAIGEYARLVYWTAWLCKLCAHRLLDMVKQNPLLANLSQYNFIKIGRKLCYDIIPNRRYIDGISTLIHASLQSAKALKVDIAKLELKPWLLFQSEAEPWAKGNLNIQFTSYNTVRVLVFEKDKSTRKITIKPVIPKGYTRLVQTLVDKALRKQIGYPARVYITDYGDKVEHLYGEIQVMVKHDFYLEVMKRYEKPLGNNIAGVDVNADRLNLVVINRNGDIVWRYTARFPQATSRGYPRKSAWSVIGEAIHSILNNAYSHGASVIAVENPEIIGYLRYYWVRNGERRTKNYNYKVTIFRNSIIEKIIWKSPLYGLQVVTVNPKGTTHSEDHEYVMRRYGLDKHTASAYLIALRARRNLHRP

SEQ ID NO: 1231 - protein, 375 aa, unidentified
  REGION 1..375: note = Description of Unknown:uncultivated organism sequence
  REGION 1..375: note = Category: MG61 effectors
  REGION 1..375: note = Description: MG61-67 effector
MGLPRYVTVALDFHVDGKEAEAVLSTAWLSKLVAHRVLNLVKKNELLVDLSEYRFLESLRSKCYNILPNRRYVDGVLKLVHSTLKSAKALGVDIKNIELKQWLLFQSDGERGYARGNMNIRLLDPNTVRVLTIGYSKEAKYVELKVSTPKGWRRLIETLVGRALNGQVGYPARVVVKDYGVGKNGLHVHGEVQAMVPYKLYLEVMRRYSRPRGSNIAGIDVNVERLDAVTIDVCGNILSYKTFWIKNATYMGIKRKRAWSLIGEQIHALLKWLYSQGTSIIGLENPEVIGYLRYYWIRNGERKGGKWNWKVSMFRSSIIERITWKTLLYSMKTTYINPRNTSKEGEKIGKKLGLDRHLGSAYIIAKRTLKRLQRP

SEQ ID NO: 1232 - protein, 360 aa, unidentified
  REGION 1..360: note = Description of Unknown:uncultivated organism sequence
  REGION 1..360: note = Category: MG61 effectors
  REGION 1..360: note = Description: MG61-68 effector
MSQYQTSSSVTGASTLIEYVTIAGKLIPISNEDYVKLARLAWSFRRAVQVATRMVVKGMDSNDVLKELRRMLNKAYADSAFKLAKAIVKGCITNGGNTLHVEIRKLFIISEGESDRCGNRNVRLEDTALVKVRYPYDGSWIILRAEFGEEYLSLLRELVELARQKRASYNAGIAFRDGGIYIRISVPIQLYLKHFKKGDALGELVAGFDVNSDRVNLAIIDKYGRLVDVRAEWFPEATSPGFPREKARELRVRALAKLLRYCYTHGVGTVVFENLYDVRKRRFTKSKTANRKISRFAKRELLHYAIVMSLKYGFKVLLADPKGTTSSAEHGRFMMKHGLDRHTASAYLIALRGLAHQIIK

SEQ ID NO: 1233 - protein, 373 aa, unidentified
  REGION 1..373: note = Description of Unknown:uncultivated organism sequence
  REGION 1..373: note = Category: MG61 effectors
  REGION 1..373: note = Description: MG61-69 effector
MNETYLTLRLPFNACDVEAGMLLSTAHLFRQVVLHLHNLILKENPRITSLIALKRMYRKRLQEILPNRRYVDGAITLVYSIYESAQALGVPFTDIEFKDWLLFQQSEKEYPCRNVTLQRDYSFRITTINYQGESKKILLKPTISRSYRQVLDKIIEEEQPYVARIVLRGFGERKGILWVHGEIHLSIPYKFYLENYRRYERNYGKLFGGVDVNVDRVNLAIVDRYGRLRDIKTFWFEEASWKGCPRQRAWSIIGMAIHDMLRYAYHHRVKVLFLENPETLGYLKTLWIKKGERRSNNYNYRVQIFRNRIIERITMKAPLYAINIEYVDPKGTTLSKEHDEVMRKYGLDRHTASAYIIALRGIERNTMIQKATV

SEQ ID NO: 1234 - protein, 363 aa, unidentified
  REGION 1..363: note = Description of Unknown:uncultivated organism sequence
  REGION 1..363: note = Category: MG61 effectors
  REGION 1..363: note = Description: MG61-70 effector
MSFITLRFPFNANGGVARELLSTAWWFKVATHRVLSLAKRQQVLPGTKIGWINTFRGIAYGIVPNRRYADGVVTLVMGVYESCRALGVDFRSVELSGRLMFQQSELEYPNRSITLKPNHEFHITAIRFNGLIGRVVIKPTIPKIYKALLDATITEHVGYMGRVVIDGVGVRNNQLWVHGEIHMTVPLDIYYEHMARHKKNSGKLFGGVDVNTDRVNLAIVDENGELIDHKTFWFSEVIARGFPKHSAWSLIGMRIHELLNYAYHHGVKTLFLENPEVLGRLKLVWIKRGDRGRENYNHKVATFRSSIIERIAIKAPLYSIRLGYVNPRGTTNSIEHDELMRKYGLDRHTTSAHLIALRGLKHQ

SEQ ID NO: 1235 - protein, 363 aa, unidentified
  REGION 1..363: note = Description of Unknown:uncultivated organism sequence
  REGION 1..363: note = Category: MG61 effectors
  REGION 1..363: note = Description: MG61-71 effector
MTYITLVFPFNVCCDVAERLLSTAWLFKIATHRLLNVVKHFPVLPATDIGWKNTFREIAYEIIPNRRYADGVVTLVRSIYESCRQFRIDLKSVELSNWLMFQQSELEYPARNITLKSGLEFHITTVDYNKNTYRDVVEPIIPKSYEPLLDKMLEERQKYTGRVAVKSYGIRKYNLWVRGEIQITIPTDFYYNHMTRYRESKGSLIGGIDVNVDRLNLAIIDEKGNLRDCKTFWFSEAVARGFSRRNTRSIIGAKIREMLSYAYHHNVKILFLENPEVLSKLKLLWVRNSDRKHENYNYKVSVFRSSVIEMIALKAPLYGIEAKYVNPKGTTNSEEHDEAMKRYGIDRHTASAYLIALRGLRNQ

SEQ ID NO: 1236 - protein, 379 aa, unidentified
  REGION 1..379: note = Description of Unknown:uncultivated organism sequence
  REGION 1..379: note = Category: MG61 effectors
  REGION 1..379: note = Description: MG61-72 effector
MVKQVSSPRYITVSLDFHSDVGQAKVLLSTAWLSKVVAHRVLALVKENPVLSDLSEYSFLKVLRSKCYDLLPNRRYVDGVLKLIYSTLKSGKALGVDIGNIELKQWLLFQSDAERGYAKGNMNIRLSDLHHVRVLTVDYSGNTRYVELEVSTPKGWGKLVENLIDKASRGVVGYPARVVVEDYGIGKSGLHVHGKVQVMVPYDLYLDVMKKYNKPRGNNIAGVDVNVERLDAVVIDEHGNLISYKTFWLKNATFMGVKRKRAWSLIGEQVHALLKWLYSQGVSVIGLENPEIIGYLKYYWIRSGERKGNKWNWKVSMFRNSIIERISWKSALYSLKVVYVNPRNTSREGEKVGEKLGLDKHLGSAYTIAKRALKNLQKP

SEQ ID NO: 1237 - protein, 393 aa, unidentified
  REGION 1..393: note = Description of Unknown:uncultivated organism sequence
  REGION 1..393: note = Category: MG61 effectors
  REGION 1..393: note = Description: MG61-73 effector
MQDQPLYTVKLTFNVNGEKAKKILSTARLFKMACHRVLRKSKELRNTLIPSKVAWIKMFKNHAYELIPNKRYSYGAVYLIYGIWESARKLNVDYNNIELSDWLLFQHYEREVNGNVIRVYEDDSALITVYYYGGSKDRILVKAKPNKCQVELLRKIIESGEKYMPKLIIRDYGVRNAKLYVRGEIHVAVSYDFYLKYMKRCNEPKGGLIGGVDVNSDRINLAIIDEDGKLRDKKTFWFTEVTARGYPRSRAWSIIGMKVHKLLKYAYHHGVLSIALENPEVIGRLRLAWIRNGKRLHENYNWKVSTFRNRIIEMIAMKAPLYSIKTIYVDPKGTTHSKEHNKVMKKYGLDRHTASAYMMAQKYLEVIRNHLKHQHLGNSLHPLLKLLQQLILS

SEQ ID NO: 1238 - protein, 374 aa, unidentified
  REGION 1..374: note = Description of Unknown:uncultivated organism sequence
  REGION 1..374: note = Category: MG61 effectors
  REGION 1..374: note = Description: MG61-74 effector
MKQIEYITLRLPFHVTGGNAKLIYWTAWLCKICAHRLLNIIKENPLLADLSQYDFIKFSRRLCYDIIPNRRYIDGISTLLHASLQSAKALKVDITKLELKPWLLFQSEAEPWAKGNLNIQFIDYNKVRVLVFDKDKSSRKITMKPVIPKGYAKLTRSLVEKALRKEIGYPARIYITDYGGGLEHLYGEIQVMVKYDFYLEAMKRYDKPPGNNIAGIDVNVDRLNLVVINRSGDIVWRYTARFPQVTSRGYKRKRAWSIIGERIHEILRNAYSHGASVIAVENPEIIGYLRYYWIRNGERKTKNYNYKVSIFRNSIIERIMWKAALYGLQVITVNPKGTTHSNNHEYVMRKCGLDEHTASAYLIALRARRNLQRP

SEQ ID NO: 1239 - protein, 381 aa, unidentified
  REGION 1..381: note = Description of Unknown:uncultivated organism sequence
  REGION 1..381: note = Category: MG61 effectors
  REGION 1..381: note = Description: MG61-75 effector
MSLPEYLTVSVPFTAKDEDAKFIWITAWLSKLCAHRLLDDVKSNDVLIDLSQANFLKYARKRCYDILPNRRYVDGVATLIHSTLKSARKLGVNIKSIELKQWLMFQSEAEKEKKGNLNIRLVSIDKAEVLVFDHRKEPRKIVVELKTPKGYEKTLKTLIEKALSKEIGYPARVVIKEYNFYPNNLHLYCSLQVMIPYNLYLKTMRKYDKPLGSHVAGVDVNVDRLNLAIVDRYGRLRDVRTFWFREITSRGYKKKPAWTKIHQAIHDMLDYAYHHGVSVIALENPEVIGYLRYYWIRNGDRKSKNYNYKKSIFRNKIIETVTCKAPLYSLKTIYVNPRGTTHSKEHDEIMKRYGLDRHTASAYLIALRGIERHTMIQKATV

SEQ ID NO: 1240 - protein, 342 aa, unidentified
  REGION 1..342: note = Description of Unknown:uncultivated organism sequence
  REGION 1..342: note = Category: MG61 effectors
  REGION 1..342: note = Description: MG61-76 effector
MVAHRVLRIVRENPLYLQLSEARFLKNLRSACYDILPNKRYVDGVLKLVYSTLRSVQALKIDVKQIELKQWLLFQSDGEPYARGNLNIRLLEPWRVRVLTFGYDHSSEYVELEVVVPKGWRKLIEVLIEKASRKEVGYPARIYISDYGMGKNGLHIAGELQVMVPYRLYCEVMKRFDSPLSDLVAGIDVNVERLDVAVVSPNGKLKLVKTFWLDGAIHMGVRKKRAWSIIGEIIHKMLRWLYHSGVSTIYLENPEIIGYLRYYWVRNGERKGRKWNWKVSMFRNSIIERITWKAPLYALNVKYVDPRGTTRSREHDEIMKKFGLDRHLASAYLIALKGLELP

SEQ ID NO: 1241 - protein, 363 aa, unidentified
  REGION 1..363: note = Description of Unknown:uncultivated organism sequence
  REGION 1..363: note = Category: MG61 effectors
  REGION 1..363: note = Description: MG61-77 effector
MSYVTVTAGFNASSGEAELLLSTAWLFKLATHRVLSYAKPMPALPASKIAWKNTFRRIAYEVISNRRYADSATVLVMGIYESCRQLGVDFREVELGDWLMFQQSEKEYPPRNITLKYIDEAWVTVLGYDGRRERIKLKISVSGAFRRLLEAILGEKQPYNPRIVLKSWNTRGGKLYVKGELHLAIPLDFYYRHMKRFEGNYGKLYGGVDVNADRVNLAIVDERGRLRDSYTFWFREATARGYPKRRARSVIGMRVHEMLRYAYHHGVKTLFIENSDVLGKLKLLWIRNGRRLHKNYNWKVSIFRSSIIEMIALKSPLYSIRVGYVNPGGTTHSKEHDEIMRKYRLDRHTASAYLIALKGLKQP

SEQ ID NO: 1242 - protein, 365 aa, unidentified
  REGION 1..365: note = Description of Unknown:uncultivated organism sequence
  REGION 1..365: note = Category: MG61 effectors
  REGION 1..365: note = Description: MG61-78 effector
MDYITIKLPFNANDGVAGELLSTAWLFKTVAHRVLAVAKQMQVLPGTKVGWVNMFRQIAYGIIPNRRYADSAVTLVMGVYESCRSLGVDFRSVELSNWLMFQQSELEYPNRNITLKPNYEFHVTTIRYNGTTSRVVVKPTIPRNHKELLDAILTEHIKYMGRVVVRDYGVRGSQLWVHGEIQVTVPMDVYYEHMARHRRNAGKLIGGADVNTDRINLAIIDEDGELIDHKTFWFSETSRKGFSRHSAWSIIGMRIHELLDYAYRHGVKTLFLENPEILGRLKLMWAKSGDRGHENYNHKVMTFRSSIIEKIAMKAPLYGIEVKYVNPRGTTNSTEHDETMKKHGLDRHTASAYLTALRGLKHQQK

SEQ ID NO: 1243 - protein, 371 aa, unidentified
  REGION 1..371: note = Description of Unknown:uncultivated organism sequence
  REGION 1..371: note = Category: MG61 effectors
  REGION 1..371: note = Description: MG61-79 effector
MSYITLCLPFNIESSEAERLFSTAWLFKIASHRMLSLTKQFPILPATDIGWKNTFRKIIYEVIPNRRYTDGVIVLVRGVYESCRQLGVDFKEVELGDWLMFQQAEKEYPVRNITLKQGYEFYVTTIDYNGSSERIVIKPTIPKNYKLLLDRILEYRQKHTARVVIKDFGIRKDKLWIHGEAQLTIPLDFYYKYTVRFKRNYGKLYGGVDVNTDRINLTIVDKYGRLRDTKTFWFEDVSRKGYSKRKARVLIGMAVHEMLKYAYHHGVKTLFLENPEVLGKLKLLWIRNGRRLYKNYNWKVTTFRSSIVEMIAIKAPLYAIKVDYVSPRGTTNSKEHDKLMRKYSLDKHTVSAYLIALKGIKRYTMIQKATD

SEQ ID NO: 1244 - protein, 363 aa, unidentified
  REGION 1..363: note = Description of Unknown:uncultivated organism sequence
  REGION 1..363: note = Category: MG61 effectors
  REGION 1..363: note = Description: MG61-80 effector
MSSLKLSNVDKLMPHVTIIGKLVPGTSDDYMKLVRLAWSFRRAVELMIREVMNGASMKDVTKKLYQILPNYIYLESAYKHAKLIVEGCKFNNGVPGHIHIRKLFIVSRGNKYDKGNRNVKIIPNTKFFRVLIKYPWDSSWIECRALFDEKYIPLLRELLELAYQRKEGYSARIVFREGRIELHISEPLYLYLKHFSLPKRRGYGLVAGLDLNSDRINMVVIDSDGRIAAMKTAWFPELTLHGFPREKARDTRLKKLKELLSYARRIGVDYVAFENLFVVKKRSKVSSPSGNRKITRFAKKQILQHGLLMTLKLCLTPVLVDPKGTTHSREHKEVMKKRGLDRHMASAYLIAIKGLKVIRNHEK

SEQ ID NO: 1245 - protein, 381 aa, unidentified
  REGION 1..381: note = Description of Unknown:uncultivated organism sequence
  REGION 1..381: note = Category: MG61 effectors
  REGION 1..381: note = Description: MG61-81 effector
MSLPEYITIDIPFTATGEEAKLIWCTAWFSKLCAHRLLSDVKRNEVVIDLSQISFLKYARKRCYDILPNRRYIDGVATLIHSTLRSARKLGVNIKSIELRQWLLFQSEAEKEKKGNLNIRLTTINKAELLVINHKKEPKKIVIDLRIPKGYRKTLETLIKKALNREIGYPARVVIKEYNFYPNNLHLYCSLQVMIPYNLYLETMRRYDKPLGDHIAGIDVNVDRLNLAIVDKYGRLKDVKTFWFREITNRGYRRKPAWTKVHQAIHDMLDYAYNHGVSLVALENPKVIGYLRYYWIKNGDRKSRNYNYRKSIFRNKIIEAVTYKAPLYSLKTIYVNPRGTTKSREHDKVMRRYGLDRHTASAYLIALRGIKRHTMIQKAIT

SEQ ID NO: 1246 - protein, 312 aa, unidentified
  REGION 1..312: note = Description of Unknown:uncultivated organism sequence
  REGION 1..312: note = Category: MG61 effectors
  REGION 1..312: note = Description: MG61-82 effector
MVENPLYTIKLSFNASGDRAKKILSTAWLFKLACHRVLSRSKELLNALIPSKIAWVKMFYSNARDLIPNKRYAYGAVYLVYGIWESSRRLKVDYRCVELSDWLMFQHYDREVDGNVIKVLEDGSALVTTYSYDSSKDRVLVKTKPNKGYGELLKLVVESKEKYMPRVVVRGYNIRNGKPYVSGEIQVTIGYDFYLKHMTRYREPKGGLIGGVDVNTDRINLAVIDEKGNLRDCKTFWFSEAVTRGYPRRKAWSVIGMKIHEMLKYAYNRGVSIIALENPEVLSYLKLAWIRNGDRIHENYNYKKTIFRNSIT

SEQ ID NO: 1247 - protein, 371 aa, unidentified
  REGION 1..371: note = Description of Unknown:uncultivated organism sequence
  REGION 1..371: note = Category: MG61 effectors
  REGION 1..371: note = Description: MG61-83 effector
MSYITITAGFNASDNEAKMLLSTAWLFKLATHRVFSYAKATPILPASKVGWKNMFRKVAYKIIPNRRYADSIVILVMGIYESCRRLGIDFQVVELGYWLIFQQSEKEYPPRSITLKSVNEAWVTVFDYHGDTNRLRFRVSTSKKYKELLKALLAERQPYNPRIVLKQQNVRGGKLYVKGELHVSIPLDFYYRHMVRFKGSGGSLCGGVDVNADRINLAIVDRYGRLRDVRTFWFEEVSRKGCPGRRARAITGMRVHEMLKYAYHHGVKTLFLENPNDLGKLRLLWIRSGKRLHRNYNWKVSVFRSSVIEAIAVKAPLYSIRVIYVNPRGTTCSREHDKIMRIHGLDRHSASAYLIALKGIKRHTMIQKDII

SEQ ID NO: 1248 - protein, 363 aa, unidentified
  REGION 1..363: note = Description of Unknown:uncultivated organism sequence
  REGION 1..363: note = Category: MG61 effectors
  REGION 1..363: note = Description: MG61-84 effector
MSYVTLSLPFNIGGAEARRLLSTAWLFKIAAHRMLDMAKQTAALPATDIGWKNTFRKTVYGVIPNRRYTDGVIALVRGIYESCRRLGVDFRTVDLGDWLMFQQVEKEFPARNITLKRGYESWVTTIGYGGDSERVAIRPSVPKSYRLLLDRILEERQRYTARVAIRDYGVRKNMLWIRGEVQLTIPIDFYYRHMARFRKNYGRLYGGVDVNADRINLAIVDESGRLRDSYTFWFREVTARGYPRRRARSVIGMRIHEMLRYAYHHGVKTLFLENPDVLGKLKMMWIRNGRRLHRNYNWKVATFRSSVIEMIAMKAPLYAIRVRYVDPRGTTHSEKHDKIMKKHGLDRHTASAYLIALKGLELP

SEQ ID NO: 1249 - protein, 365 aa, unidentified
  REGION 1..365: note = Description of Unknown:uncultivated organism sequence
  REGION 1..365: note = Category: MG61 effectors
  REGION 1..365: note = Description: MG61-85 effector
MNYVTLVLPFNAGGDTTKRLLSTAWLFKTAVHRVLDVAKQSPVLPGTDIGWKSAFRSLAYSVIPNRRYADGAVTLVRSIYESCRQLGVDFKSVELSDRLMFQQSELEYPARNITLKPGYEVHVTTISYDRESYRDVIKLVAPKNYSTLLSKIIEERQEYSGRVVVKGYGVRDNTLWVRGEVQITIPVDFYYKHAARYREPKGDLVGGVDVNADRINLVVVDEKGNLRDYKTFWFEKTTARGYSRRRTWSVIGMRIHEMLEYAYRHGVSTIVLENPEVLSKLKLLWIRRGDRRHENYNYKVSIFRSSIIEMVALKAPLYGLEVEYVNPRGTTNSVEHDMLMKEHGLDKHTASAYLIALRALAHQST

SEQ ID NO: 1250 - protein, 358 aa, unidentified
  REGION 1..358: note = Description of Unknown:uncultivated organism sequence
  REGION 1..358: note = Category: MG61 effectors
  REGION 1..358: note = Description: MG61-86 effector
MYVSQYQTSDIVDASGLVTHVTIIGKLVPLTSVDYMKLVRLAHDFRRAVQVATRMIARGVSVNDILREVRSMLNKAYGDSAYRVAKAIVEGCRFHNCDPRRIEVMKLFIVSVGDASRLGNRNVRLESTDTVRIKYPYDGSWLTFRACFGEEYLPLVRELVELARQRKISYGARVVFRGGRVYLHLSIPTWLYLRHFSRGVARGSLIAGFDLNSDRVNMVIIDGFGRIRDMRTEWFPEVTSHGYPRSKARARRLEALARLLRYAYHHGVGTVVFENLLVIKRRRYTRSGTANRKITRFAKRELLQHGVIIAMKYGFKVLLVDPKGTTNSREHDEVMRKYGLDRHMASAYLIATKALKQQ

SEQ ID NO: 1251 - protein, 376 aa, unidentified
  REGION 1..376: note = Description of Unknown:uncultivated organism sequence
  REGION 1..376: note = Category: MG61 effectors
  REGION 1..376: note = Description: MG61-87 effector
MSKSVAEYITLRLPFHVTGVDAKLIYWTAWLCKLCAHGLLEAIKLNPSLAYLSQYDFIKVGRRLCYDIIPNRRYVDGISTLIHASLQSAKALKVDITKLEPKHWLLFQSEAEPWAKGNLNIQFVDYDKVKVLVFDRDKSSRRIIIEPVIPKGYIRLVKALVDKALKKEIGYPARIYITDYGERLEHLYGEIQVMVKYNFYLEVMKRYDKPLGDNIAGVDVNVDRLNLVVINRDGDIVWKHTVRFPQITSRGCPRKRAWSIIGEAIHSILRNAYSHGASVVAVENPEVLGYLRYYWIKNGDRGTKNYNYRISIFRNSIIERIVWKAPLYGLHVVTVNPKGTTHSKDHEYVMRRYGLDRHTASAYLIALKTRRNLQRP

SEQ ID NO: 1252 - protein, 364 aa, unidentified
  REGION 1..364: note = Description of Unknown:uncultivated organism sequence
  REGION 1..364: note = Category: MG61 effectors
  REGION 1..364: note = Description: MG61-88 effector
MNEQPLYTVKLTFNTSGKKARMLLSTAWLFRIACHRVLSRSKQLKNMLVSSKIAWIKIFKNYAYEVIPNKRYSYGAVYLVYGIWESARELGVDYSSVELSDWLMFQHYEREVDGNVIRALEGGSTLITVYGYDGSKDRILVRAKPNKGQIELLGKVVKLKEKYMPKVVILDYGVRNNKLYVRGEIHITISYDFYLKHARRYDESKGNLIGGVDVNTDRINLAIVDRDGRLKDVKTFWFPEVTARGYPRRRAWSVIGEKVHELLKYAYHHGVSTIVLENPEVIGRLRLAWIKNGERLHRNYNWKVSVFRNKIIKMIAMKAPIYGLCVSYVNPKNTTHSKEHDDIMTKYGLDRHTASAYIIALKSI

SEQ ID NO: 1253 - protein, 363 aa, unidentified
  REGION 1..363: note = Description of Unknown:uncultivated organism sequence
  REGION 1..363: note = Category: MG61 effectors
  REGION 1..363: note = Description: MG61-89 effector
MSYITIRLPFNVNGGVAGELLSTAWLFRIAAHRVLGITKQMQVLPGNKIGWVSMFRKVAYGVIPNERYADGVITLVMSIYESCRALDVDFRGVELSDWLMFQQSSLEYPSRNITLKPNHEFHITTIRYDGSIGRIVVRPTIPRNYKGLLDVVLAGRVRYMGRVVVRDYGVRNSRLWVHGEIHMTVPLDIYYEHMVRHKKNSGKLIGGIDVNTDRLNLAIIDERGDLRDYKTFWFSETSRKGFSRRRAWSIIGMRIHEMLDYAYHHGVKTLFLENPEVLGRLKLMWIRNGNRGHENYNHKVAIFRSSIIERIALKAPLYGIETKYVNPRGTTNSVEHDELMRKHGLDRHTTSAHLIALRGLKHQ

SEQ ID NO: 1254 - protein, 356 aa, unidentified
  REGION 1..356: note = Description of Unknown:uncultivated organism sequence
  REGION 1..356: note = Category: MG61 effectors
  REGION 1..356: note = Description: MG61-90 effector
MELPESVTIVGRIEFPDKKSYLELGKLCYLFKKNLQKAVKMYARGIRRDIIIKVVTKELNLGYADTIYKLARFIVEGCMFNNGEPFKIRIRKVFLASRGFSSNKGNRNIRLISTSEVLVRTPDRKWIKLYVKFGKKYLPLVKELVDLALKKKISYFARIVFRDGKAYLHISIPIQLYLKHFRLGLARGKLIAGFDINSDRINMVVIDENGCIRDVKNKHFPEVVSHGFPSNKARYLRLNAIAELLDYAHHHGVKYICFENLDVIKKKKFTKNKKANRKISKFAKREILTHAVIRALRYGFRILFVNPKGSSKEARKIHKKLGLDIHTASAYIIAIRGLKILKENESVENNEKIKLW

SEQ ID NO: 1255 - protein, 370 aa, unidentified
  REGION 1..370: note = Description of Unknown:uncultivated organism sequence
  REGION 1..370: note = Category: MG61 effectors
  REGION 1..370: note = Description: MG61-91 effector
MSYVTLVLPFNAGGDVAKRLLSTAWFFKIAVHRVFGAAKQSPALPGTDIGWKSTFRSLAYNVIPNRRYADGAVVLVRGIYESCRQLGVDFKSVELSDWLMFQQSELEYPARNITLKPGYEVHVTTISYDRESYRDAIKPSIPKRLAALLSKILEERQEYTSRVVVKGYGVRGNTLWVHGEVQITIPVDFCYKYMARYKEHKGSLIGGVDVNVDRINLAIVDEEGNLRDHKTLWFAEAVARGYPRRRARSIIGMRVHEMLEYAYHHGVSTIALENPEVLGRLKLLWVWVKRGDRKHENYNYKKSVFKSSVIEMITLKAPLYGIKVKYVNPRGTTNSTEHDKFMKEHGLDRHTASAYLIALRGLAHQIKQMK

SEQ ID NO: 1256 - protein, 371 aa, unidentified
  REGION 1..371: note = Description of Unknown:uncultivated organism sequence
  REGION 1..371: note = Category: MG61 effectors
  REGION 1..371: note = Description: MG61-92 effector
MSYMTLTLPFNVGGVEARKLLSTAWLFKTATHRMLYLARQSPILPATDIGWKNTFRKTIYEAIPNRRYVDGVITIVRGIYESCRQLGVGFKEVELGDWLMFQQSEKEYPVRNITLKDDYSFHITTIGYRGEKDRIIIKPSIPKNYRLLLDRILEEKEKHTARVVVKDYGVRKNKIWVHGEIQLTIPIDFYYMHMSRYKRNYGRLYGGVDVNVDRINLAIVDRYGRLRDVKTFWFEEASRKGYPRRRARSIIGMRIHEMLRYAYHHGVKTVFLENPNVLGRLKLFWINNGKRLHRNYNWKVSIFRSRIIEIIGMKTPLYATKTEYIGPRGTTKSKEHDEITRRYGLDRHSASAYIIALRGIKRPDLIQKATI

SEQ ID NO: 1257 - protein, 377 aa, unidentified
  REGION 1..377: note = Description of Unknown:uncultivated organism sequence
  REGION 1..377: note = Category: MG61 effectors
  REGION 1..377: note = Description: MG61-93 effector
MAGEVREPEVTHVTVTGRITPLNSEDHVKLCYLAYRFRKNLVRAVKMYARGVDKQVIVKEITRELNLGYADTIYKMAKLIVEGARGNGSKPLKIKVRKLFIASRGFSANKGNRNIRLESTNTLYVNIPREGWVKFKVSFGEKYIPLVKELIELAKSRKYSYGARIVFRNGRIYLHLSVPVELYLKYFGKGEARGSLIAGFDLNSDRVNMVIVDKSGVIRDARTEWFPEVTSHGFPRNRAKVARLQALSKLIEYAYHHGVGVAVFEDLDRIKRRRFTCSPVANRKMSWFPKRKLLGHGVVMALKHGFNVYLVDPSYTSVVGGYLSRELGLDKHTASAYMLTAKYLGLDLKSLKVTQITRKPKTKQHTDSPRLLYLAVI

SEQ ID NO: 1258 - protein, 373 aa, unidentified
  REGION 1..373: note = Description of Unknown:uncultivated organism sequence
  REGION 1..373: note = Category: MG61 effectors
  REGION 1..373: note = Description: MG61-94 effector
MNETYLTLRLPFNACDVEAGMLLSTARLFRQVVLHLHNLFLKENLRITSLIALKRMYRKRLQEILPNRRYVDGAITLVYSIYESAQALGVPFSDIEFKNWLLFQQSEKEYPCRNVTLQRDYSFRVTTISYQGESKRTSLKPTVPKNYKQILDKIIEKKQPYVARIVLRGFGERKNMLWIHGEIHLSIPYKFYLEHFSKFKRNYGKHFGGVDVNVDRINLAIVDKYGRLRNVKTFWFEEASWKGCPRQRAWSIIGMAIHNMLRYAYYHGVNTLFLENPKVLGYLKILWIRKGKRKNRNYNYRVQIFRSSVAEKIAMKAPLYTINIEYIDPKGTTHSKEHDEIMRRYGLDKHTVSAYLIALRGIERRIMIQKAIV

SEQ ID NO: 1259 - protein, 365 aa, unidentified
  REGION 1..365: note = Description of Unknown:uncultivated organism sequence
  REGION 1..365: note = Category: MG61 effectors
  REGION 1..365: note = Description: MG61-95 effector
MAGEIREPKLTHVTVVGRVIPLDSESYMHLVLLAYKFRKVLIKATKMYAKGINRITIVKEVTKELNLRYADTIYKLAKLIVEGAKCNNSNPLKVKIRKLFIASRGFTVNKGNRNIRLLSSNELEINILWKGWIRFKVLFGRKYIPLVNELVKKALAKKLSYTAKIAFKNGNVYLHVSVPIELYLKYFSKGKAEGKLIAGFDLNSDRINMVIVDKYGIIRDVKTEWFPEVTSHGFPRNKAHTLRLQALAKLLDYAYHCSVEVVVFEDLERIKKRRFTMSRTANRKITRFPKRKLLKHAVVMAMKYGFKVHLVNPANTSKLGEKIGEKLGLDKHTASAYILTLKYLGVANLISCNPSSQRNQTTINY

SEQ ID NO: 1260 - protein, 387 aa, unidentified
  REGION 1..387: note = Description of Unknown:uncultivated organism sequence
  REGION 1..387: note = Category: MG61 effectors
  REGION 1..387: note = Description: MG61-96 effector
MLSRYISLLGYTPMKLIEYITLRLPFHVINEEARLIYLTAWLCKLCAHRLLNYVKENPLLANLSQYDFIKLGRKLCYDIIPNRRYVDGITTIVQASLQSAKALGADITKLELKPWLLFQSEAEPWAKGNLNIQFTSYNTVRVLVFEKDKSTRKITIKPVISKVYAKLIHALIDRALRKEIGYPARIYITNYGHKLEHLYGEIQIMVKYDFYLEVMRRYEKSLGNNIAGIDVNVDRLNLTVINRDGDIVWKYTVKFPQITSRGYRRKRAWSIIGEAIHSILKNAYSHGASILAVENPKIIGYLRYYWIRNGERGTKNYNYKVAIFRNSIIERIIWKAPLYGLQVATVNPKGTTHSEDHEYVMRRYGLDRHTASAYLIALKARRNLQRP

SEQ ID NO: 1261 - protein, 355 aa, unidentified
  REGION 1..355: note = Description of Unknown:uncultivated organism sequence
  REGION 1..355: note = Category: MG61 effectors
  REGION 1..355: note = Description: MG61-97 effector
MSRCQTSSIIDASSIVNYVTIIGRIYSASSEDYMHLVRLARDFRRAVQVATRMIARGLEENSVLRELRRMLNKAYADSAYKAAKTMVEGCIFNGGNPLHIEVKKPFIVSEGESSRLGNRNVRLEDTCLVKVKYPHDGSWITLRAEFGEKHLPLLRELVDLAKQKKLSYTARIVFKEGDIYLHISIPIQLYLKYFKEGEARGQLIAGFDLNSDRVNLVIIDEHGEIVDARTAWFPETTSHGFPREKAKALRLNALARLLKYCYRHGVSIVVFEDLLSVKRKRFTRSRTANRKITRFAKKQLIQHGVVMALKYGFKVLLVDPKGSTNSREHDELMRKYRLDRHTASAYLIALRGLKH

SEQ ID NO: 1262 - protein, 376 aa, unidentified
  REGION 1..376: note = Description of Unknown:uncultivated organism sequence
  REGION 1..376: note = Category: MG61 effectors
  REGION 1..376: note = Description: MG61-98 effector
MSYVTVVLPFNATGDVAGRLLSTTWLFRIATHRVLSLAKSTPALPGSDIGWKSVFRREAYSVIPNRRYADGVVALVRGIYESCRALGVSFRDAELGDWLMFQQSEREYPARNITLKAGYEFHVTVVGYDGSTGRVTVEPTVPKSYRVLLDGVLREKPKYCARVMVKGFGERKSDLWLNGEIHLTLPLELYHRCMAKDTPATGSNVAGVDVNVDRLNVAIVDTSGRLRDTTTFWFREVTSRGYPRRRARCVIGMSVHRMLKYLASHGVGMVVLENPEVIGYLRYCWVRSGERGSRNYNYKVAVFRSSIIEMIALKATLYGLKSVYVDPRGTSSSQEHRFVMEKHGLDRHTASAYLIALKHLQDEKIMNNRKAHEQHK

SEQ ID NO: 1263 - protein, 372 aa, unidentified
  REGION 1..372: note = Description of Unknown:uncultivated organism sequence
  REGION 1..372: note = Category: MG61 effectors
  REGION 1..372: note = Description: MG61-99 effector
MNYITITTGFNASDEEARLLLSTAWLFKIATHRVLSYAKSMPLLPTSKIAWKNTFRGVTYEVIPNRRYADSATILVMVVYESCRQLGVSFRDVELGDWLMFQQSEKEYPARNITIKNIDEAWVTVLGYGDRSRRIKLGIKSSKKACRKLIEAMLREKQEYNPRVYIRSWNVRGGKLFVRGELQVAIPIDFYYKHMVRFRENRGRLYGGVDVNIDRINLAIVDEGGRLRDVKTFWFEEASRKRCSRHRARSAIGMAIHSMLGYAYHHGVKTLFLENPDVLGKLKLLWIRGGKRKHENYNWKVMIFRSSVIEMIAMKVPLYTINVAYVDPKGTTHSEEHSEFMRRYGLDKHLASAYLIALRGIKRFNLIQKATE

SEQ ID NO: 1264 - protein, 363 aa, unidentified
  REGION 1..363: note = Description of Unknown:uncultivated organism sequence
  REGION 1..363: note = Category: MG61 effectors
  REGION 1..363: note = Description: MG61-100 effector
MSTLRLSSVEELIPHVTVIGKLLPETPEDYMKLVRLAWSFRKAVELMIREVVNGASMKDATKKLYQMLPNYIYLESAYKHAKFIVEGCKFNNGNPRHIHVKKLFIISRGNKYDKGNRNIKMIPSTKFFQVFIKYPWDSSWIKCRAFFGERYISLLRELLELANQKKEGYGTRIVLREGRIELHVSVPLFLYLKHFSLPERRGYGLVAGLDLNSDRINMVIIDPSGRIVAMKTAWFPEVTLHGFPRDKARDIRLKKLKELLSYARRIGVDYIVFENLFEVKKRSRVRSPSGNRKITRFAKKQLLQHGLLMSLKLGLTPILVDPKGTTHSQEHEEVMKKRGLDRHMASAYIIACKGLKVIKNHEK

SEQ ID NO: 1265 - protein, 379 aa, unidentified
  REGION 1..379: note = Description of Unknown:uncultivated organism sequence
  REGION 1..379: note = Category: MG61 effectors
  REGION 1..379: note = Description: MG61-101 effector
MSAVEYATVRLPFHATGDNARLIYWTAWLCKLCAHKLLDKVKENPQLADLSQYYFIKIGKELCYDIIPNRRYVYGISILIHASLQSAKALRVDITKLELKPWLLFQSEAEPLAKGNLNIQFTDHDRVKVLVFDKDGASKKITIKPVIPKSYAKLIKTLVDRAHRKEIGYPARVYIMNYGDGLEHLYGEVQVMVKYNFYLEVMKKYDKPLGNNIAGVDVNVDRLNLVVINRDGDIVWKYTARFPQVTARGYPRKKAWSVIGEAIHAVLRNAYSHGASVIAVENPEIMGYLKYYWIRSGDRRSRNYNYKVSIFRNSVIERIIWKASLYGLKAVPVSPKGTTHSEDHDYLMRKYGLDCHTTSAYLIALKARRNLRTSFSARL

SEQ ID NO: 1266 - protein, 363 aa, unidentified
  REGION 1..363: note = Description of Unknown:uncultivated organism sequence
  REGION 1..363: note = Category: MG61 effectors
  REGION 1..363: note = Description: MG61-102 effector
MTYITIALPFNVCCNVAKRFLSTAWLFKIATHRLLSIAKQSPVLPGTDIGWKSTFRRIAYEVIPNRRYADGVVVLVRSIYESCRQLKVDFKSVELSDWLMFQQSELEYPARNITLKPGYEFHVTTIDYHKNTYRDVVKLTVPKSYRLLLDKVLKERQVYAGRTVIKSYGTEGGNLWVQGEVQTTIPIDFYYKHMPRVRANNGKLYAGVDVNVDRVNLAIVDGEGRLRDTYTFWFEEASRKGCKRRRARSIIGMGVHEMLKYAYSHGVKVLFLENPEVLGKLKLLWVRSNDRRHENYNYKVSVFRSSIIEMIALKAPLYSIEVKYIDPRGTTSSREHDEIMKKHRLDRHVASAYLITLKGLKHQ

SEQ ID NO: 1267 - protein, 361 aa, unidentified
  REGION 1..361: note = Description of Unknown:uncultivated organism sequence
  REGION 1..361: note = Category: MG61 effectors
  REGION 1..361: note = Description: MG61-103 effector
MLQSQTSNVVDAFTVVNYVTITGKLHPVSGEDYMRLVRLAWDFKNAVRITTRMIAKGVRRNNILKELRGMLNKAYADSAYKLAKAMVEGCLFNGCNPLHIEVRKPFIISEGESSRLGNRNVRLEDTNIVKVKYPYDGSWITLRAEFGERYLPLLRELVELARQRKVSYGARIVFREGNIYLHLSIPIELYLKYFKRGEAKGGLVAGFDLNSDRVNLVIIDRYGRIVDTRTAWFTEVNSHGFSRNRTRALRLRALAKLLKYCYTHNVGVVVFENLLLIKRRRYTRSKTGNRKITLFAKRQLIQYGVVMALKYGFKTLFTNPRGTTNSKEHGEIMKKLGLDRHTASAYLIALRGLETLNENYK

SEQ ID NO: 1268 - protein, 388 aa, unidentified
  REGION 1..388: note = Description of Unknown:uncultivated organism sequence
  REGION 1..388: note = Category: MG61 effectors
  REGION 1..388: note = Description: MG61-104 effector
MNPTPKIIADKETIEQFMYITINGRLTPKSNEDYMKLCLLAYRFRQAVKHGINLVLRGVQQKEAYKELAKLLPSSIYGETAYKYAKLLVESAKEQVDDEIVVNKITIMRKWIASRGGVSWRGNLNVRLTSPDTAEILVFNHRKESRKITVNLRTPKRYKKLLERLIEKASNREVGYPARVVIKEYNFYQGNLHLYCGLQVVVPYYLYLETMRRYDKPLGNHVGGVDVNVDRINLAIVDKYGRLRDTRTFWFRETISRGYKKRRAWTKIYQAIHELLQYAYHHGTSTIALENPKIIGYLRYYWIRDGDRKTKNYNYKKSIFRNKIIDTITCKAPLYSLKTIYVNPKGTTHSKAHGEVMKRYGLDRHTASAYLIALKAIKRHATTQKAII

SEQ ID NO: 1269 - protein, 364 aa, unidentified
  REGION 1..364: note = Description of Unknown:uncultivated organism sequence
  REGION 1..364: note = Category: MG61 effectors
  REGION 1..364: note = Description: MG61-105 effector
MNGQPLYTVKLSFNISSEKAKKILSTVWLFKIACHRILSKSKEIKDMLVSSKVAWIKMFKNHAYEIIPNKRYSYGVVYLVYGIWESARRLRINYDDVELSDWLFIQHYEREVNGNVIRVYEDGSVLVTTYGYDGSKDRILVKAKPNKGQAELLNSIVESKEKYMPKLIIRDYGVRDDKLYVRGEVHISISYDFYLKHVKRYNEPKGSLIGGVDVNTDRINLAIIDEDGKLRDVKTFWFREVTARGYPRRRAWSIIGMRVHELLKYAYHHGVSTIVLENPEVIGRMRLAWIRNGKRLHRNYNWRVTIFRNRIIEMITMKAPIYGLRVNYVNPKGTTHSREHDDIMMRYGLDRHTASAYLIALKSI

SEQ ID NO: 1270 - protein, 373 aa, unidentified
  REGION 1..373: note = Description of Unknown:uncultivated organism sequence
  REGION 1..373: note = Category: MG61 effectors
  REGION 1..373: note = Description: MG61-106 effector
MNETYLTLRLPFNACDAEARMLLSTARLFRHVVLHLHSLILGENPRITSLIALKKMYRRRLQEILPNRRYVDGAITLVYSIYESAQALGVPFNDIEFKNWLLFQQAEKEYPCRNVTLQRDYSFRITTISYQGESRRIPLKPTISRSYRRVLGKIIEERQPYVARVVLRGYGERGNVLWVHGEIHLSIPYKFYLEHFKRYRGNHGALYGGVDVNVDRANLAVVDRYGRLRDVRTFWFEEASWKGCPRQRAWSIIGMAIHDMLRYAYHHGVKVLFLENPETLGYLKTLWVRKGERRSNNYNYRVQVFRNRVVERIALKASLYSIGVKYVDPRGTTRSEEHDELMRRHGLDRHTASAYLIALRGMERYTTIQKATV

SEQ ID NO: 1271 - protein, 356 aa, unidentified
  REGION 1..356: note = Description of Unknown:uncultivated organism sequence
  REGION 1..356: note = Category: MG61 effectors
  REGION 1..356: note = Description: MG61-107 effector
MAREVREPEITHVTITGRILPLDNDSYMELILLAYRFRKALIRAIKMYAKGLDRNTIVKEITKELNLGYADTIYKLAKLIAEGAKHNGSNPLRVRIGKLFIVSRGFSSNKGNRNIRLLSTNELQVNIPWKGLLRFKVAFGERYISLVSELVKKALSRKLSYTAKIVFRNGMVYLHVSVPIKLYLKHFSKGRAKGSLVAGFDLNSDRINMVIVDKLGIIRDVKTEWFPEVTSHGFPRNKAHTLRLQSLAKLLNYAYHHGVGVVLFEDLDRIKKRRYTRSRTANRKITRFPKRKLLEHSIVTALKNGFKVYLVNPAYTSKLGEKLGTELGLDKHIASAYVLVLKYLGVSEIPLSISSS

SEQ ID NO: 1272 - protein, 286 aa, unidentified
  REGION 1..286: note = Description of Unknown:uncultivated organism sequence
  REGION 1..286: note = Category: MG61 effectors
  REGION 1..286: note = Description: MG61-108 effector
MAREVRKPEITHVTITGRVIPLNNDSYMELVLLAYRFRRTLIKAIKMTTKGLGKNTIVKEVTKELNLGYADTIYKLAKLIVEGAKSNGSNPLRVKLRRLFIASGGFTANKGNRNIRLLSSSELQVNIPWKGWVKFKVVSGKRCIPLVNELVEKALSKKLSYTAKIVFRNGKVYLHISIPIELYLKYFSKGRAKGKLIAGFDLNSDRVNMVVVNRQGIIRGTKTEWFPEVTSHGFPRNKANTIRLQALAKLLDYAYHHGVGVALFEDLDRIKKRRYTRSKTANRKIT

SEQ ID NO: 1273 - protein, 374 aa, unidentified
  REGION 1..374: note = Description of Unknown:uncultivated organism sequence
  REGION 1..374: note = Category: MG61 effectors
  REGION 1..374: note = Description: MG61-109 effector
MKKVKYITLRLPFHITGVYARLVYWTAWLCKLCAHRLLYHVKQNPLLADLSQYDFIKLGRKLCYDIIPNRRYVDGISTIIHASLQSAKVLGVDVAKLELKPWLLFQSEAEPWAKGNLNIQFTSYNTVRVLVFEKDKSTRKITIKPVIPKGYARLIRTLVDKALRKQIGYPTRIYITDYGDKLEHLYGEIQVMVKYDFYLEVMKRYEKPLGNNIAGVDVNVDRLNLVVINRNGDIVWRYTARFPQASSRGYPRKSAWSVIGEAIHSNLNNAYSHGASVIAVENPKIIGYLRYYWIKNGNRKSENYNYKVTIFRSSIIERIIWKAPLYGLQVVTINPRGTTHSEDHEYVMRRYGLDKHTASAYLIALRARRNLQRP

SEQ ID NO: 1274 - protein, 363 aa, unidentified
  REGION 1..363: note = Description of Unknown:uncultivated organism sequence
  REGION 1..363: note = Category: MG61 effectors
  REGION 1..363: note = Description: MG61-110 effector
MSYITMCLSFNVSDNVARRLISTAWLFKTASHRMLSIAKQTSALPTTDIGWKDAFRKVIYEVMPNRSYVDGVIVLVRGIYESCRQLGVNFKEVELGNWLMFQQTEKEYPVRNITLKRGYEFYITTLDYDGNSERIVIKPTTLKNYKLLLDKILEESQKHTARVVVKDYGIRKGKLWVHGEIQLTIPLNFYYKYMTRYKRNYGKLYGGVDVNSDRINLAIVDKEGNLRDTYTFWFREVTARSYPRRKARTIIGMRIHEMLKYAYHHGVKTLFLENSEVLGRLKLMWMRNGKRLNRNYNWRVTTFRSSIIEMIAMKASLYAIRVMYVNPKGTTSSEKHDGIMRKYRLDKHTASAYLITLKGLDLL

SEQ ID NO: 1275 - protein, 366 aa, unidentified
  REGION 1..366: note = Description of Unknown:uncultivated organism sequence
  REGION 1..366: note = Category: MG61 effectors
  REGION 1..366: note = Description: MG61-111 effector
MSYVTITAGFNAFGENAKLLLSTAWLFKLASHRVLSYAKSMPILPASKIGWKNMFRKVAYDVIPNRRYADSTIVLVMGVYESCRQLGVNFKDVELGDWLMFQQSEKEYPPRNITLRDVSEAWVTVFGYDGESRRISLKVSTSGIFRKLLEAVLREKQPYNPRIVLRTWNVRGGKLYVRGELHVSIPIDFYYRHMTRFKRNNGRLYGGVDVNTDRINLAIVDRYGRLRDAKTFWFEDTARKGYPRRKARALIGMAVHEMLRYAYHHGVKTLFLENPEVLGKLRLLWIRNGKRLHRNHNWKVAVFRSSIIEMVAMKAPLYSINTEYIDPKGTTHSKEHDEVMRKHGLDRHTTSAYLIALKGIKRYRMI

SEQ ID NO: 1276 - protein, 355 aa, unidentified
  REGION 1..355: note = Description of Unknown:uncultivated organism sequence
  REGION 1..355: note = Category: MG61 effectors
  REGION 1..355: note = Description: MG61-112 effector
MSRYQTSSIVDASSIVNYVTIIGRVYPVSSEDYMRLVRLAWDFRRAVQVTTRMIARGLEENSVLRELRRVLNKAYADSAYKAAKAMVEGCVFNDGNSLNIEVKKPFIVSEGESSRLGNRNVRLEDTCLVKVKYPYNGSWITLQAEFGEKYLSLLRELVDLAKQKKLSYTARIVFREGDIYLHLSILIQLYLKYFKEREARGRLIAGFDLNSDRVNLVIIDEHGEIVDVRTAWFPEATSHGFPREKAKVLRLDALARLLKYCHRHGVSVVVFENLLSVKRKRFTRSKKANRKINRFAKKQLIQHGVVMALKYGLRALLVDPKGTTNSREHGELMKKYGLDRHTASAYLIALRGLRH

SEQ ID NO: 1277 - protein, 356 aa, unidentified
  REGION 1..356: note = Description of Unknown:uncultivated organism sequence
  REGION 1..356: note = Category: MG61 effectors
  REGION 1..356: note = Description: MG61-113 effector
MSQSRTSSVVDATTLIEYATIVGRLIPASGEDHMKLARLAWEFRRAVQVATKMIAKGEEANIILKELRKILNKAYADSAFKQAKAIVKGCLATGGDPRRIEVTKLFIISEGETSRNGNRNVRLEDTSLVKVKYPYDGSWIQLEAKFGEKYLPLLRELVELAKQRKVSYNARIVFRRGRIYIHVSVPIYLYLKHFEKGEARGELIAGFDLNSDRINLAIIDRYGGLVDAKTAWFTEVVSHGFPRNKAKALRLRALAKLLKYCYTHGVGIVVFENLYVVKKHRYTKSRNGNRRISKFAKRELLEHAIVMSLKYGFKVLLVDPKGTTNSKEHDEAMKRHGLDRHTASAYLIALRGLNPS

SEQ ID NO: 1278 - protein, 374 aa, unidentified
  REGION 1..374: note = Description of Unknown:uncultivated organism sequence
  REGION 1..374: note = Category: MG61 effectors
  REGION 1..374: note = Description: MG61-114 effector
MDRVEYITLRLPFHATGEDARLVYWTAWLCKQCAHRLLERVRQNPLLADLSQYDFIKIGRKLCYDIVPNRRYIDGISTLIHASLQSAKALKIDITKLELKPWLLFQSEAEPWAKGNLNIQFTKDKTARILVFDRDKSSRKIIVKPLISKCYTKLVHALIGKAFRKEIGYPARVYVKDYGDRLEHLYGEVQVMVKYDFYLEVMRRYDNPLGNNIGGIDVNVDRINLVVINRDGDIVWKYTARFPQVTSRGYPRKRVWSIIGEAIHRVLENAYSHGASVIAVENPRVIGYLRYYWIRNGERKNKNYNYKVAIFRNNIIERIMWKTPLYGLQAIPVSPRGTTHSETHEYVMRRYGLDKHTASAYLIALKARRNLQRP

SEQ ID NO: 1279 - protein, 376 aa, unidentified
  REGION 1..376: note = Description of Unknown:uncultivated organism sequence
  REGION 1..376: note = Category: MG61 effectors
  REGION 1..376: note = Description: MG61-115 effector
MDLDYVTISLPFHATGDVAKSIYWTAWLSKACAHRVLEHVKANLVLAKLSEYDFIKFTRELCYSLLPNRRYVDGVATLVYSSLQSVRKLKVDVSRVELKPWLLFQSEGEPWAKGNLNIQFTDYETVKVLVFKASGGSERVVVKPVVSKRYNRLLKELVDRAMRKEIGYPARVYIRSYSGDLEHLYGELQINVKHSLYLEIMKRFDKPLGSNVAGIDVNTDRLNLVVVNKDGEVVWMHTVRFPQILARGFPRKRAWSIIGEKIHEVLKHAYHHGASAVALENPGVIGYLRYYWVRNGERGGRNYNYKVAVFRSSIIERILWKAPLYGLKIVYVDPKGTTSSREHAETMKKHRLNKHTASAYLIASRALNILERPTKT

SEQ ID NO: 1280 - protein, 373 aa, unidentified
  REGION 1..373: note = Description of Unknown:uncultivated organism sequence
  REGION 1..373: note = Category: MG61 effectors
  REGION 1..373: note = Description: MG61-116 effector
MTKAYLSMRLPFNACHDGARLLLSTARLFRHCVLYLHQLILSERPHVVSSIALKRMYRHRLQRILPNRRYVDGAIILMYSIYESAQALGVSLNDIEFKSWLMLQQSEKEYPCRSITLQHDHSFEVTTISYQGESRRIVLRPTVPKHYGRVLDKILEEGQPYVARVVLKGYGERRGVLWTHGEIHLLIPYGFYLEHFTRYRENHGKLYGGVDVNVDRINLAIIDGYGRLRDAKTLWFEEAARRACSRRRAWSIISMAIHDMLKYAYHHGVKRLFLESPEVLGRLKTLWMKKGERGNENYNHRVQIFRSRIVERVALKAPLYAIDAEYVNPRGTTHFEEHDEAMRRYGLDRHAASAYLIALRGIERYATTQKAIV

SEQ ID NO: 1281 - protein, 379 aa, unidentified
  REGION 1..379: note = Description of Unknown:uncultivated organism sequence
  REGION 1..379: note = Category: MG61 effectors
  REGION 1..379: note = Description: MG61-117 effector
MGYTPMKLVEYITLRLPFHVINEEARLIYWTAWLCKLCAHRLLNYVKENPLLANLSQYDFIKLGRKLCYDIIPNRRYVDGISTIVQASLQSAKALGADISKLELKPWLLFQSEAEPWAKGNLNIQFTSYNTVRVLIFEKDKSTRKITIKLVIPKVYAKLIHALMDRALKKEIGYPARIYITNYGHKLEHLYGEIQIMVKYDFYLEVMRRYEKSLGNNIAGIDVNVDRLNLVVINRSGDIIWKHTVRFPQITSRGCRRKRAWSIIGEAIHKTLKNAYSHGASVIAVENPEVIGYLRYYWIKNGDRRSRNYNYKVSIFRNNIIERIIWKAPLYGLQATTVNPKGTTHSEDREYVMRRYGLDRHTASAYLIALKARRNLQRP

SEQ ID NO: 1282 - protein, 375 aa, unidentified
  REGION 1..375: note = Description of Unknown:uncultivated organism sequence
  REGION 1..375: note = Category: MG61 effectors
  REGION 1..375: note = Description: MG61-118 effector
MSYMTLCLSFNVDSIKAKQLLSTAWLFKTASHRMLSLAKQFPVLPASDIGWKNTFRKIIYEIIPNRRCTDGVIVLVRGIYESCRQLGIDFKEVELGDWLMFQQAEKEYPVRNITLRQDNEFHVTTIDYNGSVERIVIKPTIPKNYKLLLDKILEDKQKHTARIVVKDYGVRKNTLWVRGEIQLTIPLNFYCKYMVRFKKNYGRLYGGVDVNADRINLAIVDSEGKLRDTYTFRFPEVTARGYLRHRARTVIGMKIHEMLKYAYYHGVKKLFLENPEELDKLRLLWIRNGRRLHRNYNWKVSVFRSRVIEMIAMKSSLYSIGVKYVNPKGTSNSKEHSEIMKRFRLDKHTASAYLTALRGLNQQFISFNYQNIFRP

SEQ ID NO: 1283 - protein, 323 aa, unidentified
  REGION 1..323: note = Description of Unknown:uncultivated organism sequence
  REGION 1..323: note = Category: MG61 effectors
  REGION 1..323: note = Description: MG61-119 effector
MRLVRLAWDFRRAVQVVTRMIARGLEENSVLRELRRKLNKAYVDSAYKVAKTMVEGCIFNGGNPLNIEVKKLFIISEGESSRLGNRNVRLEDTCLVKVKYPHDGSWITLRAEFGERYLPLLRELVDLARQKKVSYTARVVFKGSNIYLHLSIPIQLYLKYFKKGEARGKLVAGFDLNSDRVNLVIIDEHGEIVDVRTAWFPEATSHGFPREKAKVLRLNALARLLEYCYRHGVSVVVFENLLLIKRRRFTRGKTANRKITQFAKKQLIQYGVVMALKYGFRVLLVDPKGATNSREHGEVTKRYRLDRHTASAYLIALRGLRHQ

SEQ ID NO: 1284 - protein, 371 aa, unidentified
  REGION 1..371: note = Description of Unknown:uncultivated organism sequence
  REGION 1..371: note = Category: MG61 effectors
  REGION 1..371: note = Description: MG61-120 effector
MTYITLCLPFNISDNEAGRMLSTAWLFKIASHKMLSLAKQFPILPATDIGWKNVFRKIIYEIIPNRRYTDGIIVLVRGIYEFCRQLGIDFKEVELGDWLMFQQTEKEYPVRNITLKQGYKFHVTTIDYNGNSERITVKPTIPKNYKLLLDKILEEKQKHTARVVIKDYGVRKNKLWVHGEIQLTIPLNFYYKYMVRYRRNYGRLYGGADVNVDRINLAIIDKYGRLRDVKTFWFEDVARRGYPRRKARILIGMAVHEMLRYAYHHGVKIMFLENPEVLGKLKLLWIRNGRRLHRNYNWKITVFRSSVIETISIKAPLYSINTEYIDPRGTTHSKEHDIVMKRYGLDRHTASAYLIALRGIEKYTKIQKAII

SEQ ID NO: 1285 - protein, 364 aa, unidentified
  REGION 1..364: note = Description of Unknown:uncultivated organism sequence
  REGION 1..364: note = Category: MG61 effectors
  REGION 1..364: note = Description: MG61-121 effector
MDGTPLYTLKLSFNVSGGKARRILSTTWLFKLACHRVLGRSKELQKSLIPSKIAWVRMFYGDARSFIPNKRYAFGAVYLVYGVWESSRKLGLDYGDVELSNWLMFQHYEREVDGNVIRIYDDGSTLITTYDYDGSKERILVKAKPNRGHVDILKLIVESREKYMPRVVVRGYNVRNGEFYVRGEIHVSVSYDFYLKHATRYREPRGSLVGGVDVNVDRINLAIVDKRGELRDYKTFWFPEVTARGYPERRAWSVIGMRVHEMLEYAYHHGVSTIALENPSVLGYLKLAWIRGNDRGHENYDYKKSIFRNSIIERIAIKTPLYGFNVKLVEPQGTTSSREHDEVMRRYGLDKHTASAYIIALRSI

SEQ ID NO: 1286 - protein, 357 aa, unidentified
  REGION 1..357: note = Description of Unknown:uncultivated organism sequence
  REGION 1..357: note = Category: MG61 effectors
  REGION 1..357: note = Description: MG61-122 effector
MDVPKYVTVCGRVIFDNNETYLELGKLCYLFRKNLQKAVKMYAKGLSKNIIVKTITKEMNLGYADTIYKLAKFIVKGCRANGGNPLRIRIKRMFLVSRGFSSNKGNRNIRLVSTREVLVRTLDKRWLKLGVKFGKKYLTLIEELVKLALQKRASYSARIIFRNGKAYLSVSVPIQLYLKYFKLGKAKGKLIAGLDINSDRINMVIIDDDGNIRDVKNEHFHEVTSQGFPRNKAKYIRLNAIARLLDYAYHHGVRYVCFENLDVIKKKKFTKSKKANRKITKFAKRQILSHAVIRAMRYGFKILFVNPKNSTKEAKKIHRKLGFDVHTASAYIIALRGLKILKNNGNFQNILTTQTSE

SEQ ID NO: 1287 - protein, 358 aa, unidentified
  REGION 1..358: note = Description of Unknown:uncultivated organism sequence
  REGION 1..358: note = Category: MG61 effectors
  REGION 1..358: note = Description: MG61-123 effector
MLRYQTSSAVDASSIVNYVAIVGRVYPASNEDYMRLVVLAWDFRRAVQVATRMIARGLEENSVLRELRRVLNKAYADSAFKVAKAMVEGCLFNGGNPLRIEVRRLFIASEGESSRLGNRNVRLEDTHLVKVRYPHDGSWITLRAEFGERYLPLLRELVDLARQKKLSYKAIVVFREGGIYLHLSVPIQLYLKYLKKGEARGQFIAGFDLNSDRVDLVIIDEHGRIVDTRTAWFPEATSHGFPREKAKVLRLNALARLLECCYRHGVGTVVFENLLLVKRRRFTGDRTGNRKIARFAKRQLIQHGVVMALKYGFRVLLVDPRGTSGSKEHDEIMKRFGLDKHVASAYLIALRGLRYQQI

SEQ ID NO: 1288 - protein, 373 aa, unidentified
  REGION 1..373: note = Description of Unknown:uncultivated organism sequence
  REGION 1..373: note = Category: MG61 effectors
  REGION 1..373: note = Description: MG61-124 effector
MSETYLTMRLPFNTCGYEAGLLLSTARLFRFTVLKLHSIILDENPRITSLIALKRMYRRRLQEILPNRRYVDGAITLLYSVYESAQALGVPFNNIEFRDWLMFQQGEKEYPCRNITLQHDHTFRVTTISYQGESNRITLKPTIPRSYEEVLNSILEKKHPYVARIVLRGFGERKNMLWVHGEIHLSIPYKFYLENFRKHKRNYGKLLGGVDVNVDRINLAIVDRYGKLRDTKTFWFEEASWKGCPRQRAWSVIGMAIHDMFKYAYHHGVKTFYLENPETLGYLKTLWIKKGERRNNNYNYRVQIFRNRIVERIAMKAPLYAINIEYVDPRGTTHSKELDEMMRKYGLDKHTASAYMIALRGIERHKMIQKAIN

SEQ ID NO: 1289 - protein, 375 aa, unidentified
  REGION 1..375: note = Description of Unknown:uncultivated organism sequence
  REGION 1..375: note = Category: MG61 effectors
  REGION 1..375: note = Description: MG61-125 effector
MELPKYITVSLDFHADGGYARSILSTAWLSKLVAHRVLKLVKESKTLANFSEYMFLKMLRSECYDTLPNRRYVDGILKLVYSTLKSAKALKINIRDIEMKQWLLFQSDGERGYARGNMNIRLIDTHHVRVLTVGYDKKTSYIELKLTVPKRWKKFIEVLINRAFTGQVGYPARVVVKDYGVGKYGLHVHGEVQVMVPYSLYLEVMKRYDKPRGSNTAGVDVNVERLDAVVIDRYGNLLSHRTFWLKNATFMGVRRKRSWSLIGEQIHTLLKWLYSQGVSVIGLENPEIIGYLRYYWIRNGERRGNKWNWKVSMFRNSIIEGIMWKAPLYSMKTVYVNPKNTSREGERIGKKQGLDRHLGSAYIIAKRALKNLQRP

SEQ ID NO: 1290 - protein, 382 aa, unidentified
  REGION 1..382: note = Description of Unknown:uncultivated organism sequence
  REGION 1..382: note = Category: MG61 effectors
  REGION 1..382: note = Description: MG61-126 effector
MSYITIVLPFNVVGDPSKRLLSTTWLFKIASHRLLNLVKQSPVLPVTDIGWKRTFRGVVYDVIPYRRYVDGVITLIMGIYESCRQLGVDFRDVELSDWLMFQQAEMEYPVRGITFKDGYEFHITTIGYDGESERVIVKPTIPRVYKLLLDKILEEKQRHTARVVIKDYGVREGKLWVHGEVQLTLPMDFYYKHMVRYVRNYGDLYGGVDVNSDRINLVIVDVEGRLRDTYTFWFREITTRGYPKRRARSVIGMRVHEMLRYAYHNGVKTLFLENPDILGKLRLLWVRNGRRLHENYNWKVATFRSSVIEMIAMKTPLYDIGVKFVNPRGTTHSKEHEEAMRRYRLDRHAASAYTIALKGLKNLDQNSYPHSFKDETFKCKRL

SEQ ID NO: 1291 - protein, 359 aa, unidentified
  REGION 1..359: note = Description of Unknown:uncultivated organism sequence
  REGION 1..359: note = Category: MG61 effectors
  REGION 1..359: note = Description: MG61-127 effector
MSQYQTSSTVVDASTLVEYATITGRLIPASSEDYMKLTRLAWSFKRAVQVATRMIAKGVDSNDVLKELRKMLNKAYADSAFKIAKAIVRGCITNGGDPLHVEVRKLFIVSEGESSRLGNRNVRFEDTNLVKVKYPYDGSWTQFRAKFGEKYLPLLRELVKLAKQKKASYNAKIVFRNTKIYLHLSVPIQLYLKYFKRGDALGEFIAGFDLNSDRVNLVIIDKYERIVDVKTEWFPEVTSPGFSREKARALRLRALAKLLKYCYTHGVGAVVFENLLDVKKRRFAKSKTANRKISRFAKRELLHYVIVMSLKYGFKVLLADPKGTTSSAEHGRFMMKHGLDRHTASAYLVALRGLTHQIT

SEQ ID NO: 1292 - protein, 364 aa, unidentified
  REGION 1..364: note = Description of Unknown:uncultivated organism sequence
  REGION 1..364: note = Category: MG61 effectors
  REGION 1..364: note = Description: MG61-128 effector
MFENPLYTIKLSFNASGDSAGKVLSTAWLFKLACHRVLSRSKELLNALIPSKIAWVKMFYNDARDLIPNKRYAYGAIYLVYGIWEGARELGIDYRSVELSGWLMFQHYDREVDGNVIRILEDGSALVTTYSYDGSKDRVLIKSKPNRGHGELLKLVVESKEKYMPRVVVRGYNVRSGKLYVSGEIHVTIDYSFYLKHAARYGEPKGSLIGGVDVNSDRINLAIVDEKGNLRDCKTFWFPEAVARGYPRRRAWSVIGMKIHEMLRYAYSHGVATIALENPEALGYLKLAWVRNGDRKHENYNYKKSVFRNSIIERVAMKAPLYGLNTKFVDPKGTTSSREHDEIMKRFGLDRHIASAYMIASRSI

SEQ ID NO: 1293 - protein, 360 aa, unidentified
  REGION 1..360: note = Description of Unknown:uncultivated organism sequence
  REGION 1..360: note = Category: MG61 effectors
  REGION 1..360: note = Description: MG61-129 effector
MSYITIQLPFNVSGKMAGELLSTAWLFRMAVHRVLDTARQQALPRSRIGWERAFHKVAYDVIPQSDYADGAVVLVMGAYKSCRVLGLDFKSVELSDWLLFQPSKLTRKVGSIALKPNYEFHVTTIGYDGSYDRVVLRPVVSGALGLILDSVLDYGVEYMGRIVVRDYGVRDGKLWVRGGVHLTVPLLAYYKIMARYLENNGGLQGGVDVNVDRINLAIIGEDGELIDHKTFWYREVTSRGFPRGRAWSIIGMRIHELLNYARNNGVRVLYLENPGIIGKLRLMWVRNGNRGHENYNYRVAVFRSTIVEKIAMKAPLYSISVGYVNPRGTSSSKAHDELMRKHGLDRHTASAYLIALMGTR

SEQ ID NO: 1294 - protein, 380 aa, unidentified
  REGION 1..380: note = Description of Unknown:uncultivated organism sequence
  REGION 1..380: note = Category: MG61 effectors
  REGION 1..380: note = Description: MG61-130 effector
MSYITICLPFNVSGDVARRLFSTAWLFKAASHRMLDLAKHFPILPATDIGWKNTFRKIIYEIIPNRRYTDGVIVLVRGIYESCRQLGVAFKDVELGDWLMFQQVEKEYPVRNITLKQGYEFHITTVDYNGNSDRVVIKPSIPKNYKLLLDGVLEEKQKHIARVVIKDYGVRKNRLWIHGEIQLTIPLDFYYKHMTRYRVINGKLYGGVDVNVDRINLAIVDSEGKLRDTYTFWFREITARSYPRRRARTVIGMKVHEMLNYAYHHGVKTLFLERPDVLGRLRLLWIRNGRRLHRNYNWKVATFRSSIIEMITMKASLYSIKVDYVDPRGTTSSKEHDEIMKKYRLDRHTASAYLIALKGLNPKDPHIGFCPTATARSRSP

SEQ ID NO: 1295 - protein, 363 aa, unidentified
  REGION 1..363: note = Description of Unknown:uncultivated organism sequence
  REGION 1..363: note = Category: MG61 effectors
  REGION 1..363: note = Description: MG61-131 effector
MLQYRISDVIATRLVTYTTIIGKLIPTSPENHMKLVRLAYDFRRAVLYATRMIGKDMKTNDILKELRNMLNKAYGDSAYKVAKAIVEGCRFNGGEPRHIKIKRLFIVSEGEASRFGNRNVRLETTDIVKVRYPYDKSWIILRTCFGRKYLSLVREVSELAKQRRISYGARIVFKDGRIYLHLSIPINLYLKYFSKGKAHGELVVGFDINSDRMNMVIIDRYGKIRDIKTKWFSEVTSHGYPKSKAKARRLEALAKLLKYTYHHNVGIVVFENLFTIKKREYSRNPTANRKITRFAKKELLRYGILMAMKYGFKVLLVNPRGTTRSKEHDEVMKKLGLDRHVASAYLIALRGIRRYTMIQKAMI

SEQ ID NO: 1296 - protein, 368 aa, unidentified
  REGION 1..368: note = Description of Unknown:uncultivated organism sequence
  REGION 1..368: note = Category: MG61 effectors
  REGION 1..368: note = Description: MG61-132 effector
MGYVTVSLSFNVGGDAAKGLLSTAWLFKVATHRVLDLVRQSPVLPATDIGWKNTFRSVAYEVVPNRRYADGVVVLVRGIYESCRQLGVDFRSVELGNWLMFQQSEIEYPVRNITLREGYEFYVTTINYLGKSDRVVIKPTIPRDYKPLLDKVIEERVEHTGRVVIKDYGVRRGMLWIHGEVQVTLPLDFYYRHMIRYRQNDGRLYGGVDVNTDRINLAIVSENGELRDVRTYWFREVTARGYPRRRAWSVIGMRVHEMLRYAYHHGVKTLFLEKPDILGRLKLMWIRNGRRLHENYNYKIAVFRSSVIEVIAMKAPLYSIEAKYVNPKGTTNSREHDEAMRKYGLDKHTASAYLIALKALKQPKKSQP

SEQ ID NO: 1297 - protein, 365 aa, unidentified
  REGION 1..365: note = Description of Unknown:uncultivated organism sequence
  REGION 1..365: note = Category: MG61 effectors
  REGION 1..365: note = Description: MG61-133 effector
MSYVTLRLPFNVNGDMAKELLSTAWWFKTAAHRVLSLAKQMQFLPGTKIGWVSMFRSITYEIIPNRRYADGAVTLVMGIYESCRALGVDFRSVELGDWLMFQQSGLEYPAKSITLRPGYEFHVTTIKYDGLISRVVVKPTVSEDYRELIDAIYRERIKYMGRVVIRDYGARNNQLWVHGEIHITVPLDIYYEHMAKHRRNSGRLFGGVDVNTDRINLAIVDESGDLRDYKTFWFSETTARGFPKHKAWSIIGMRIHELLNYAYNHGVKTLFLENPEVLGRLRLMWVWNGGRNHENYNYKVMIFRSTIIEKIALKAPLYSIRVNYVNPRGTTNSKEHEEAMRRYRLDRHTTSAYLIALKGLTHQQK

SEQ ID NO: 1298 - protein, 363 aa, unidentified
  REGION 1..363: note = Description of Unknown:uncultivated organism sequence
  REGION 1..363: note = Category: MG61 effectors
  REGION 1..363: note = Description: MG61-134 effector
MSYVTITVSFNVSDEPAELILSTAWLFKIATHRVLEYAKNTPTLPASKIGWKNMFRSIAYDIISNRRYADSAVILVMGIYESCRQLGVNFKSVELSDWLMFQQSEKEYPPRNITIKSPEEAWVTIYSYDGRSERITLRISTSGAYKELLEAILEEKQPYNPRIVVKSWNVREGRLYVRGELQVSIPIDFYYKHMARYREPKSNLTGGVDVNVDRVNLAIIDEKGNLRDTYTFWFREVTARGYPRKRAWSVIGMRIHEMLRYAYHHGVSILALEDPDVLGRLRLMWIRNSRRLHEDYNWKVATFRSRVIEMIALKAPLYSIRVVYVDPKGTTSSKKHDEAMKEHRLDKHTASAYLIALKGLKQP

SEQ ID NO: 1299 - protein, 366 aa, unidentified
  REGION 1..366: note = Description of Unknown:uncultivated organism sequence
  REGION 1..366: note = Category: MG61 effectors
  REGION 1..366: note = Description: MG61-135 effector
MSYITLTLPFNICDGEARRLLSTAWLFKIASHKMLSIAKQFPALPATDIGWRNTFRKIIYEVIPNRRYTDGVIVLVRGIYESCRQLGVDFKDVELGDWLMFQQAEKEYPVRNITLKQDYEFWITTVDYNGNPERIVIKPSIPKNYKLLLDKILEEKQKHTARVVIKDYGVRKNKLWIHGEIQLTIPSDFYYKYMTRYKRNNGKLYAGVDVNADRLNLAIVDRYGRLRDVKTLWFENACRKGYPRRKARVLIGMAVHHMFHYAYHHGVKTLFLENPEVLGKLRLLWIRNGKKLHKNYNWKVSIFRTSIIEMITMKAPLYSIRISHVDPKGTTSSKEHDDVMGEYGLDRHAASAYLIALKGIERHKMI

SEQ ID NO: 1300 - protein, 363 aa, unidentified
  REGION 1..363: note = Description of Unknown:uncultivated organism sequence
  REGION 1..363: note = Category: MG61 effectors
  REGION 1..363: note = Description: MG61-136 effector
MTYVTLAFPFNVCCDVAKRLLSTAWLFKTATHRLLSIAKQLPALPGTDIGWKSAFREVVYEVIPNRRYADGVVVLIRGIYESCRQLKVDFKSVELSDWLMFQQSELEHPARNITLKPGYEFHITTVDYNRNTYRDVVKPTMPESYKLLLNKVLEERQKYAGRVVVKDYGVRKNALRVRGEVQITIPIDFYYRHMTRVKANKGKLCGGVDVNVDRINLAIVDDSGELRDVYTFWFREVTARGFPKRSARSIIGMRIHEMLSYAYHQGVKTLFLENPEVLGKLKLLWVRSGDRGHENYNYRVSVFRSSVIEMVALKAPLYGIEVRYVDPKGTTSSRKHDEITEKHRLDRHTASAYLIALKGLKQP

SEQ ID NO: 1301 - protein, 363 aa, unidentified
  REGION 1..363: note = Description of Unknown:uncultivated organism sequence
  REGION 1..363: note = Category: MG61 effectors
  REGION 1..363: note = Description: MG61-137 effector
MTYITLVFPFNVCCDVAKRFLSTAWLFKIATHRLLNVVKHFPVLPATDIGWKNTFRGIAYEIIPNRRYADGVVTLIRSIYESCRQLRIDFKSVELSNWLMFQQSELEYPARNITLRSGYEFHITTVDYNKNTYRDVVKPIIPKNYKPLLDKMLEERHKYTGRVVVKSYGIRKGNLWVRGEIQITIPTDFYYKHMTRCGESKGSLIGGIDVNVDRLNLAIIDEKGNLRDCKTFWFSEATTREFSRRSARSIIGAKIREMLSYAYHHNVKTLFLESPEVLGKLKLLWVRNGDRKHENYNYKKAVFRSSVIEMIELKTPLYGIEAKYVDPKGTTNSEEHDEAMKRYGLDRHTASAYLIALRGLRNQ

SEQ ID NO: 1302 - protein, 363 aa, unidentified
  REGION 1..363: note = Description of Unknown:uncultivated organism sequence
  REGION 1..363: note = Category: MG61 effectors
  REGION 1..363: note = Description: MG61-138 effector
MSYVTVTAGFNASGKPAELILSTAWLFKIATRRVLEYAKSTPTPPASKISWKNAFRSVAYDVIPNRRYADSTVVLVMGIYESCRQLGVDFREVELGDWLMFQQSEKEYPPRNITIKSPEEAWVTVYSYDGWSERIALKISTSGAYKELLETILGERQPYNPRIVVKSWNAREGRLYVRGELQVSIPIDFYYKHMARYRENRGRLYGGVDVNTDRVNLAIVDEHGDLRDTYTFWFRGVVARGYPGKRAWTVISMRIHEMLKYAYHHGVKTLYLEDPGVLGGLRLMWIRSGRRLHEGYNWKVATFRSRVIEIIALKAPLYSIRVVYVDPKGTTNSKAHGEAMKKHRLDKHTASAYLIALKGLKQP

SEQ ID NO: 1303 - protein, 373 aa, unidentified
  REGION 1..373: note = Description of Unknown:uncultivated organism sequence
  REGION 1..373: note = Category: MG61 effectors
  REGION 1..373: note = Description: MG61-139 effector
MSIRRLARNIILENDYPLITHVTVIGKLIPNNSQDYMKLVRLAWSFRKAVEQMAREIVNGASMKDATKKLYNALPNYVYLESAYKHAKLIVEGSRFNNGNPRHIHVRKFFIVSRGNKYDYGNRNIRLVPSEKYFEVQVKYPWDGSWIKARTFFGRRYIPLLNELMELCRRRLEGYGARIVFKDGRMELHLSIPLYLYLKYFSYPKCKGYELVAGLDLNSDRINMVVIDGDKRIVAMRAAWFPEVTLPGFPRNKARDIRLKKLKELLVFARRIGVDYVVFENLFAVKKSSRVSSPSGNRKITRFAKRQLLQHGLLMAMKQGLTPILVDPRGTTHSHEHEEVMNRRGLDRHMASAYIIACKGLKIIKTHEKYHKT

SEQ ID NO: 1304 - protein, 376 aa, unidentified
  REGION 1..376: note = Description of Unknown:uncultivated organism sequence
  REGION 1..376: note = Category: MG61 effectors
  REGION 1..376: note = Description: MG61-140 effector
MKLPKYITSSLDFHVDDDYAKNILATAWLSKLVAHRVLGLVKENPLLADLLEYRFLKMLRGKCYNILPNRRYVDGVLKLIHSTLKSAKALKVSIEDIELKQWLLFQSDGERGYARGNMNIRFIDTCHVRVLTLNYDRRTRYVELEVTTPKGWRKLIEVLVDRASRGVIGYPARVIIKDYGMGKNGLHVHGEVQVMIPYSLYLEVMRRNTTPKGGNIGGIDINVERLDAVVIDEYGNILSYRTFWIKNATFMGVRKKRAWSLIGEQIHALLKWLYSQGVHVIGLENPEIIGYLRYYWIRNGERRETKWNWKLSMFRNSIVERITWKAPLYSMKAIYIDPRNTSKEGEKIGEKLGLGRHLGSAYIIARRVLKTVLQRP

SEQ ID NO: 1305 - protein, 292 aa, unidentified
  REGION 1..292: note = Description of Unknown:uncultivated organism sequence
  REGION 1..292: note = Category: MG61 effectors
  REGION 1..292: note = Description: MG61-141 effector
MNLSDGWGIDFREVELGDWLMFQQSEKEFPPRNITLKSEDEAWVTAFGYDGESRRLRLRISASGSFRRLLEAILREKQPYNPRITLKSWNVRGGKLYGRGELQVSVPTDFYYRHLARYKTNSGRLYGGVDVNSDRINLAVVDGSGILRDAHTIWFREVTARGYLRHRARTVIGMGVHEMLSYAYHHGVKTLFLENPKVLGRLRLLWIRNGKRLHKNYNWRVSTFRASIIEAIAVKAPLYSIRVEYIDPKGTTRSKEHDELMRRYGLDRHMASAYLIALRGMERYTTIQKATV

SEQ ID NO: 1306 - protein, 363 aa, unidentified
  REGION 1..363: note = Description of Unknown:uncultivated organism sequence
  REGION 1..363: note = Category: MG61 effectors
  REGION 1..363: note = Description: MG61-142 effector
MTYVTLTFSFNVCCVVAERVLSTAWLFKIATHRLLSIAKQAPILPGTDIGWKNTFRGIVYEVIPNRRYADGVVAFVRGVYESCRQLGADFRVVELSDWLMFQQSELEYPAKNITLKPGYEFHITTIDYNENSYRDVVKPVVPKSYRLLLDKVLEGRQRYMGRVVLKSYGIRKDDLWVRGEVQITIPIDFYYKHMARARASNGMFYGGVDVNTDRINLAIIDKEENLRDCKTFWFSEVIARGFLRRSARSIMGAKIHEMLRYAYSHGVSTIALENPDVLGKLKLLWVRSGDRKHENYNYRVSIFRSSVIEMIALKAPLYGIEVKYVDPKGTTNSREHDDAMMKYRLDRHTASAYLIALRGLRHQ

SEQ ID NO: 1307 - protein, 365 aa, unidentified
  REGION 1..365: note = Description of Unknown:uncultivated organism sequence
  REGION 1..365: note = Category: MG61 effectors
  REGION 1..365: note = Description: MG61-143 effector
MSYVTLRFPFNVNGGVAGELLSTAWWFKVATHRVLSLAKQQQVLPGTPVGWRGMFRGVAYRVVPNARYADGVVTLVMSIYESCRELGIDFRSVELSDWLVFQQSWLEYPAKSITLKPGYEFHVTTIRYNGSTSRVVIRPTVPENYKGLLDVVLAGRVEYMGRVVVRDYGVRNNQLWVRGEVQITVPLDLYYRHMARHKRNAGRLFGGVDVNADRINLAIIDDGGVLKDYKTFWFSEVAVRGFPRYKAWRIIGMRVHELLNYAYHHGVKTLFLENPEVLGRLRLMWIRAGDRKHENYNHKVSIFRSSIIERITMKAPLYSIEVKYVSPSGTTNSVEHDELMRRYGLDRHTASAYLIALRGLTHQQK

SEQ ID NO: 1308 - protein, 356 aa, unidentified
  REGION 1..356: note = Description of Unknown:uncultivated organism sequence
  REGION 1..356: note = Category: MG61 effectors
  REGION 1..356: note = Description: MG61-144 effector
MSRCQTSSIIDASSIVNYVTIIGRIYSASSEDYMHLVRLARDFRRAVQVATRMIARGLEENSVLRELRRMLNKAYADSAYKAAKTMVEGCIFNGGNPLHIEVKKPFIVSEGESSRLGNRNVRLEDTCLVKVKYPHDGSWITLRAEFGEKHLPLLRELVDLAKQKKLSYTARIVFKEGDIYLHISIPIQLYLKYFKEGEARGQLIAGFDLNSDRVNLVIIDEHGEIVDARTAWFPETTSHGFPREKAKALRLNALARLLKYCYRHGVSVVVFEDLLSVKRKRFTRSRTANRKITRFAKKQLIQHGVVTALKYGFKALLVDPKGSTNSREHDELMKKFGLDRHTASAYLIALRGLRNQ

SEQ ID NO: 1309 - protein, 323 aa, unidentified
  REGION 1..323: note = Description of Unknown:uncultivated organism sequence
  REGION 1..323: note = Category: MG61 effectors
  REGION 1..323: note = Description: MG61-145 effector
MFRREAYSVIPSRRYADGVVALVRGIYESCRALGVSFRDAELGDWLMFQQSEREYPARNITLKAGYEFHVTVVGYDGSTGRVTVEPTVPKSYRVLLDGVLREKPKYCARVMVKGFGERKSDLWLNGEIHLTLPLELYHRCMAKDTPATGSNVAGVDVNVDRLNVAIVDTSGRLRDTTTFWFREVTSRGYPRRRARCVIGMSVHRMLKYLASHGVGMVVLENPEVIGYLRYCWVRSGERGSRNYNYKVAVFRSSIIEMIALKATLYGLKSVYVDPRGTSSSQEHRFVMEKHGLDRHTASAYLIALKHLQDEKIMNNRKAHEQHK

SEQ ID NO: 1310 - protein, 374 aa, unidentified
  REGION 1..374: note = Description of Unknown:uncultivated organism sequence
  REGION 1..374: note = Category: MG61 effectors
  REGION 1..374: note = Description: MG61-146 effector
MSGVEYVTLRLPFHATGEDARLIYWTAWVCKLCAHRLLETVKHNLLLADLSQYDFIKLGRKLCYDILPNRRYVDGISTLIHASLQSAKALKVDISKLELRPWLLFQSEAEPWAKGNLNIQFTSYDTVKVLVFDKDKSSTKITLEPVIPKGYSRLVRVLVDKALRKEVGYPARLYVTDYGDSLEHLYGEIQVMVKYDLYLEVMKRHEKPPGENIAGIDVNIDRINLVVIDRNGDIVWKYTARFPQVTARGFKRKSAWSIIGEAIHGVLKNAYSHGASVVAVENPGVIGYLRYYWIRNGDRKTRNYNYRVSIFRNSIIERIMWKAPLYSLHVVTVKPRGTTSSKEHEYVVKQHGLDRHTASAYLIALRARRNLQRH

SEQ ID NO: 1311 - protein, 327 aa, unidentified
  REGION 1..327: note = Description of Unknown:uncultivated organism sequence
  REGION 1..327: note = Category: MG61 effectors
  REGION 1..327: note = Description: MG61-147 effector
MGSSRPPSGKLREQGSPHPPDRRYVDGAITLTYSIYESAQALGVSFNDIEFKSWLLFQQSEKEHPCRNITLRNDYSFRITTINYRGEGKRISLKPTIPKNYKRILGKIIEGKRPYVARVVLKGFGERKNALWIHGEVHLSVSYRFYLGHFKEFKRNYGKHFGGVDVNVDRINLAIVDKYGRLRDVKAFWFEEASWKGCPRQRAWSVIGVAIHEMLKYAYRHGVKTLFLENPEVLGYLKTLWVRKGERRSNNYNYRVQIFRNGIVERITVKAPLYSIGVEYVNPKGTTNSGEHEEIMREYGLDRHSASAYLIALRGIKSHNLIRKATI

SEQ ID NO: 1312 - protein, 305 aa, unidentified
  REGION 1..305: note = Description of Unknown:uncultivated organism sequence
  REGION 1..305: note = Category: MG61 effectors
  REGION 1..305: note = Description: MG61-148 effector
MESRHLSTPLQSAKALKVDVSRLELRQWLLFQSEAEPWAKGNLNIRFVDYSRVGVLVFDRDKSSKKIIVEPVISKGYAKLVKALVDKALRKEIGYPARIYITDYGERLKHLYGELQVMVKYKLYLEVMRRCDEPLGNNIAGVDVNADRLNLVVINRDGEIVWKYTARFPQVIARGCPGKRAWSIIGEAIHSVLRNAYSHGAFVVAVENPKIVGYLRCYWIKSGDRGHESYNYKKSIFRSSLIERIALKAPLYGLSVKFVNPKGTTSSKEYDKAMKRYGLDRHAASAYLIALKARKTYKNLERPTS

SEQ ID NO: 1313 - protein, 365 aa, unidentified
  REGION 1..365: note = Description of Unknown:uncultivated organism sequence
  REGION 1..365: note = Category: MG61 effectors
  REGION 1..365: note = Description: MG61-149 effector
MNYITITAGFNASGEKAKLLLSTAWLFKIASHRVLSNAKSMPILPIFKIGWKNTFRRTAYEFIPNRRYADSVVVLVMGIYESCRQLGIDFKKVELSNWLMFQQSEKEYPPRNITLKDINEVWITVFKYNRESKRISLKISTSRDFRKLLEAILREKQPYNPRIILKSWNTRDGKLYVRGELQISIPIDFHYKHMTRYRKNYGRLYGGVDVNCDRINLAIVDGEGNLRDTYTFWFREVTARGYPRRRARTIIGMKVHEMLKYAYHHGVKTLFLENPNVLGKLRIIWIRNGRRLHRNYNWRVSVFRNSIIEMIALKAPLYSIKTKYVDPRGTTHSREHDMVMKKYRLDKHTASAYLIALKGLNHKFI

SEQ ID NO: 1314 - protein, 361 aa, unidentified
  REGION 1..361: note = Description of Unknown:uncultivated organism sequence
  REGION 1..361: note = Category: MG61 effectors
  REGION 1..361: note = Description: MG61-150 effector
MSLFRMSDVVDASTVVDYVTIIGKLHPVSSEDYMRLVRLAWDFKNAVRITTRMIAKGVDKNSILRELRGMLNKAYADSAYKVARAIVEGCLFNGCNPLHIEVRRPFIVSEGESSRLGNRNVRLENTGLVKVKYPYDGSWITLRTEFGQKYLPLLRELVDLARQREVSYGARIVFRGGSIYLHLSIPIKLYLKHFRKGEAEGGFVGGFDLNSDRVNLVIIDEHGRIVDTRTAWFTETTSHGFPRNRARALRLRALAKLLKYCYTHNVGVVVFENLPLIKRRRFTRSRVGNRKITRFAKRQLIQYGIVMALKYGFKTLLTNPRGTTNSKEHEELMRRYGLDRHTASAYLTALRGLKALNENHK

SEQ ID NO: 1315 - protein, 365 aa, unidentified
  REGION 1..365: note = Description of Unknown:uncultivated organism sequence
  REGION 1..365: note = Category: MG61 effectors
  REGION 1..365: note = Description: MG61-151 effector
MSYTTICLPFNVDGEEARGLLGTAWLFKIASHRMLSFAKQFPVLPATDIGWKNTFRKTIYEIIPNRRYTDGVIVLVRGIYESCRQLRVNFREVELGDWLMFQQVEKEYPVRNITLKQRCEFRISTVDFNGNSERIVIKPSIPKSYKFLLDRILEEKQKHTARVVIKDYGIRKSKLWIHGEIQLTIPLNFYHKYMIKYRRNYGKLYGGVDVNTDRINLAIVDKYGRLRDTYTFWFREVTARGYSRRKARSVIGMRVHEMLKYAYHHGVKTLFLENPEVLGKLKLLWIRNGKRLHKNYNWKLSTFRSRIIEMIAMKAPLYSIKVGYVDPKGTTNSKEHDEVMRKHRLDRHTASAYIIALRGLNHKFI

SEQ ID NO: 1316 - protein, 289 aa, unidentified
  REGION 1..289: note = Description of Unknown:uncultivated organism sequence
  REGION 1..289: note = Category: MG61 effectors
  REGION 1..289: note = Description: MG61-152 effector
MVRSIYESCRQLGVDFRGVELSDWLMFQQGELEYPARNITLKPGYEFHITTIDYSKNSYRDVVKPIIPKSYRLLLDKVLDDRQRYTGRVVLKSYGIKECNLWVQGEVQITIPIDFYYKHMARAKAGNGKLYGGVDVNVDRINLAIVNGGGELRDVYTFWFEEASRKGCSRQRARSIVGMRVREMLEYAHRHGVKVLFLENLEVLGKLKLLWIRSNDRRHENYNYKVSVFRSSVIEMIALKAPLYSIEVKYVDPKGTTNSEEHDEIMKRFGLDRHIASAYLIALRGLRHR

SEQ ID NO: 1317 - protein, 368 aa, unidentified
  REGION 1..368: note = Description of Unknown:uncultivated organism sequence
  REGION 1..368: note = Category: MG61 effectors
  REGION 1..368: note = Description: MG61-153 effector
MSYITIALSFNVGGEVAGRILSTAWLFKAATHRVLHLAKSSPALPGSDIGWKAAFRKDAYAVIPNRRYADGAVVLVRGIYESCRELGVDFRGVELGDWLMFQQAEKEYPARNITLRPGGEVYVTTISYSGAVERVVLKPTVPKSYATLLEKILEERQEHAARVVIKGYGVRKGVVWISGEVQLTIPLTFYYRHMARYRANKGSLYGGVDVNVDRVNLAIIDNSGELRDTYTFWFREVVARGYPRRSARSVIGMRVHEMLEYAYHHGVKVLFLENPAVLGRLRLLWARSTERRSENYNWKVSAFRSSIIEMIALKAPLYGIEVAYVNPKGTSNSREHSEAMKKLRLDRHATSAYLIALRGVAKQSKRAQ

SEQ ID NO: 1318 - protein, 363 aa, unidentified
  REGION 1..363: note = Description of Unknown:uncultivated organism sequence
  REGION 1..363: note = Category: MG61 effectors
  REGION 1..363: note = Description: MG61-154 effector
MSTLKLSNVDKLMPHVTIIGKLVPGTSDDYMKLVRLAWSFRRAVELMIREVMNGTSMKDVTKKLYQILPNYIYLESAYKHAKLIVEGCKFNNGVPGHIHIRKLFIVSRGNKYDKGNRNVKIIPNTKFFRVLIKYPWDSSWIECRALFDEKYIPLLRELLELAYQRKEGYSARIVFREGRIELHISEPLYLYLKHFSLPKRRGYGLVAGLDLNSDRINMVVIDSDSRIVAMKTAWFPELTLHGFPREKARDTRLKKLKELLSYARRIGVDYVAFENLFVVKKRSKVSSPSGNRKITRFAKKQFLQHGLLMTLKLCLTPVLVDPKGTTHSREHKEVMKKRGLDRHMASAYLIAIKGLKVIRNHEK

SEQ ID NO: 1319 - protein, 363 aa, unidentified
  REGION 1..363: note = Description of Unknown:uncultivated organism sequence
  REGION 1..363: note = Category: MG61 effectors
  REGION 1..363: note = Description: MG61-155 effector
MSFITIRFPFDANGSVAGELLSTAWWFKVATHRVLSLAKRQQVLPGTKIGWINTFRESAYGIVPNRRYADGAVILMMGIYESCRALGVDFRSIELSSWLMFQQVELEYPARNITLKPGYEFHVTTVDYGGNTHRVVVKPTVPGNYGLLLDKVLRERQRYTGRVVLRSYGIGGSNLWVQGEVQVTIPMGFYYRHMARYRRNDGKLYGGVDVNTDRINLAIIDEDGELIDHKTFWFSEASRKGCSGRRAWSIIGMRIHELLDYAYNNGVNTLFLENPEVLGRLKLMWAKSGDRGHGNYNHKVMTFRSTIIERVALKAPLYSIEVKYVNPKGTTNSVEHDEAMRKHGLDRHNASAYLIALRGLKHQ

SEQ ID NO: 1320 - protein, 364 aa, unidentified
  REGION 1..364: note = Description of Unknown:uncultivated organism sequence
  REGION 1..364: note = Category: MG61 effectors
  REGION 1..364: note = Description: MG61-156 effector
MSQYQISDVVNASNIVNYVTIVGRLVPISTEDYMKLVRLAHEFRKAVLYTTRMIVAGMNVNAILKELRRMLNKAYGDSAYKVAKAIVEGCKFNGGNPRHVKVRKLFIVSEGEASRFGNRNIRLESTSMVKVKYPYDGSWLTFKARFGEKYLPLIEELVKLTKHKEISYSARIVFRDGKIHLHLSIPITLYLRYFSKGRTKGSLVAGFDLNSDRINMVIIDRYSRIRDVKTEWFSEVTSHGYPRGKARAKRLEALARLLRYAYHHNVGTVIFENLLVIKKKRHTKSKRANRKIARFAKRELLQHGIVMAMKYGFKVLLVNPKGTTNSEEHSKIMRRYGLDRHTASAYLIALRGIEKYTKMQKAII

SEQ ID NO: 1321 - protein, 358 aa, unidentified
  REGION 1..358: note = Description of Unknown:uncultivated organism sequence
  REGION 1..358: note = Category: MG61 effectors
  REGION 1..358: note = Description: MG61-157 effector
MVGEVREPEITHVTVTGRVIQLDSDSYMELVLLAYRFRKALAKAVKMYAEGVGKDTIVKEVTKELNLGYADTIYKLAKLIVEGVRHNNSNPLRIRLRKLFIASRGFSSNKGNRNIRLLSSSELEVNIPWKGWVKFKVLFGKQYIPLIHELVEKSLCKEMSYTAKILFKNGKIYLHVSVPVELYLKHFKKGEVHGKLIATFDLNSDRINMVILDELSIIRDVKTEWFPEITSHGFPRNKANTLRLQALARLLSYAHHHGVGVVMFEDLERIKKQRCTKSRSANRKIAKFPKRILLKHAIVMAMKYGFKVYLVNPSYTSRVGEELGKLLGLDKHTASAYVLTLKTGKNFASLTNLLKFSK

SEQ ID NO: 1322 - protein, 380 aa, unidentified
  REGION 1..380: note = Description of Unknown:uncultivated organism sequence
  REGION 1..380: note = Category: MG61 effectors
  REGION 1..380: note = Description: MG61-158 effector
MDYINLRLPFNVDGDVARELLSTAWWFKVATHRVLAIAKQQVLPGNRIGWKNAFRQFAYEIIPNRRYADGVVTLVMGIYESCRALGVDFRGVELGDWLVFQQSELEYPAKSITLRQGYEFHITTIKYDGSIGRVVVKPTMSEDYRELIDAIYRERVRYMGRVVIRDYGVRNNQLWLHGEVHVTVPLDVYYEHMTRHKRNGGKLFGGIDVNADRINLAIIDEEGGLRDYKTFWFSEASRKGFGRHSAWSIIGMRIHEMLDYAYHHGVKTLFLENPEVLGRLKLMWVRGGDRKHENYNYKVSVFRSSIIERIALKAPLYSIKVGYISPRGTTNSEEHDELMKKYGLDRHTASAYLIALRGLRHQQKMSATNNHENRNSPLTD

SEQ ID NO: 1323 - protein, 363 aa, unidentified
  REGION 1..363: note = Description of Unknown:uncultivated organism sequence
  REGION 1..363: note = Category: MG61 effectors
  REGION 1..363: note = Description: MG61-159 effector
MGYITVSLSFNVGGDVAKGLLSTAWLFKVATHRVLDLARQAPVLPATDIGWRNTFRSVAYEVIPNRRYADGAITLVRSIYESCRVLGVDFRGVELDDWLMFQQSEMEYPVRNVTLREDYEFHITVIDYGGSASRVIIKPTIPKNYRLLLDKILEERQEHTGRVVINGYGVRGNTMWVHGEIQLTIPIEFYYKHMTRYRQNNGKLFGGVDVNADRINLVIVDKDGRLRDIKTFWFEEASRKGVTRHRARSIIGMAVHEMLGYAYHHGVKTLFLENPDILGRLKLMWIRSGDRRHENYNWKKAIFRNSVIEMIAMKAPLYGINVEYVNPKGTTSSEEHDEVMRRYGLDRHAASAYLIALKGLKQP

SEQ ID NO: 1324 - protein, 364 aa, unidentified
  REGION 1..364: note = Description of Unknown:uncultivated organism sequence
  REGION 1..364: note = Category: MG61 effectors
  REGION 1..364: note = Description: MG61-160 effector
MDYFTIRFPFNVNNSVAKELLSTAWLFKIATHRVLAVAKQQEVLPGTKIGWVNAFRSIAYGVVRNRRYADGAVTLVMGIYESCRSLGVDFRGVELGDWLMFQQSELEYPNRNVTLKPNYEFHVTTVRYNGATGRVVLKPTIPKTYKALLDAILTERVGYMGRVVIRDYGIRNNQLWVHGEVQVTVPLDLYYEHMARHKRNSGRFIGGIDVNSDRINLTIIDSIGRLIDHKTFWFSEATARGFPKHSAWGIIGMRIHEMLNYAYNNGVKTLFLENPEVLGRLKLVWIKNGDRGRENYNHKVATFRSTIIERITMKAPLYSIEVKHVNPRGTTNSKEHDELMKRYELDRHTASAYLIALRGLGMMN

SEQ ID NO: 1325 - protein, 351 aa, unidentified
  REGION 1..351: note = Description of Unknown:uncultivated organism sequence
  REGION 1..351: note = Category: MG61 effectors
  REGION 1..351: note = Description: MG61-161 effector
MAGEVREPEVAHITITGRIIPLDNDNYMELVLLAHRFRKSLAKAIKMYAKGINRNTIVKEVTKELNLGYADTIYKLAKLIVAGARHNNSNPLKIRIRKLFIASRGFAANKGNRNIRLLSTSGLQVNIPWKGWVPFKVLFGEQYVPLVKELVEKALAKKLSYSAKIVFRNGEVYLHVSIPVELYLKYFSKGRANGSLVASFDLNSDRINMVIVDRQGIIRDTRTEWFPEVTSHGFPRNKAETIRLQALAKLLDYAYDHGVGIVLFEDLEMIKKRKHTRSRTANRKISRFSKRKLLEHGIIMAMKYGFKVYLVNPAYTSKLGEKLGKEVGLDKHTASAYLTALKGLKKLQQLL

SEQ ID NO: 1326 - protein, 363 aa, unidentified
  REGION 1..363: note = Description of Unknown:uncultivated organism sequence
  REGION 1..363: note = Category: MG61 effectors
  REGION 1..363: note = Description: MG61-162 effector
MLQYQTSDVIATRLITYTTIIGKLIPTSPENHMKLVRLAYDFRRAVLYATRMIGKDMKTNDILKELRNMLNKAYGDSAYKVAKAIVEGCRFNGGEPRHIKIKRLFIVSEGEASRFGNRNVRLETTDIVKVRYPYDKSWIILRTCFGRKYLSLVREVSELAKQRRISYGARIVFKDGRIYLHLSIPINLYLKYFSKGKAHGELVVGFDINSDRMNMVIIDRYGKIRDIKTKWFSEVTSHGYPKSKAKARRLEALAKLLKYTYHHNVGIVVFENLFTIKKREYSRNPTANRKITRFAKKELLRYGILMAMKYGFKVLLVNPRGTTRSKEHDEVMKKLGLDRHVASAYLIALRGIRRYTMIQKAMI

SEQ ID NO: 1327 - protein, 356 aa, unidentified
  REGION 1..356: note = Description of Unknown:uncultivated organism sequence
  REGION 1..356: note = Category: MG61 effectors
  REGION 1..356: note = Description: MG61-163 effector
MSQSRTSSVVDATTLIEYATIVGRLIPASGEDHMKLARLAWEFRRAVQVATKMIAKGEEANIILKELRRMLNKAYADSAFKQAKAIVKGCLATGGDPRRIEVTKLFIISEGETSRNGNRNVRLEDTSLVKVKYPYDGSWIQLEAKFGEKYLPLLRELVELAKQRKVSYNARIVFRRGRIYIHVSVPIYLYLKHFEKGEARGELIAGFDLNSDRINLAIIDRYGGLVDAKTAWFTEVVSHGFPRNKAKALRLRALAKLLKYCYTHGVGIVVFENLYVVKKHRYTKSRNGNRRISKFAKRELLEHAIVMSLKYGFKVLLVDPKGTTNSKEHDEAMKRHGLDRHTASAYLIALRGLNPS

SEQ ID NO: 1328 - protein, 369 aa, unidentified
  REGION 1..369: note = Description of Unknown:uncultivated organism sequence
  REGION 1..369: note = Category: MG61 effectors
  REGION 1..369: note = Description: MG61-164 effector
MVESPLYTIKLAFNVDGDRAKKILSNAWLFKLACHRVLSRSKELLNALISSKIAWIKMFYSDARDLIPNKRYAYGAIYLIYGIWESSRSLKIDYTNVELSDWLMFQHYDREVDGNVVRVYSDGSALVTTYSYDGSKDRVLVKAKPNRGHEKLLKLVVESREKYMPRVLVRGYNVRDRELYISGEIHVTISYDFYLKHVKRYGNPKGDLIGGVDVNADRINLAIIDEKGNLRDYKAFWFSETTARGYPRRGVWSVVGMKIHEMLRYAYNHGVATITLENPEVLSYLKLAWVRNGDRKHENYNYKVSVFRNSIIERIATKAPFYGLNTKFVDPKGTTNSREHDEIMKRFGLDRHTTSAYLIALRGLRNQRT

SEQ ID NO: 1329 - protein, 351 aa, unidentified
  REGION 1..351: note = Description of Unknown:uncultivated organism sequence
  REGION 1..351: note = Category: MG61 effectors
  REGION 1..351: note = Description: MG61-165 effector
MCKLCAHRLLEHIKQTPLLADLSQYDFIEIGRKLCYDIVPNRRYIDGISTLIHASLQSAKALKVDVSRLELRQWLLFQSEAEPWAKGNLNIRFVDYSRVGVLVFDRDKSSKKIIVEPVISKGYAKLVKALVDKALRKEIGYPARIYITDYGERLKHLYGELQVMVKYKLYLEVMRRCDEPLGNNIAGVDVNADRLNLVVINRDGEIVWKYTARFPQVIARGCPGKRAWSIIGEAIHSVLRNAYSHGAFVVAVENPKIVGYLRCYWIKSGDRGHESYNYKKSIFRSSLIERIALKAPLYGLSVKFVNPKGTTSSKEYDKAMKRYGLDRHTASAYLIALKARKTYKNLERPTS

SEQ ID NO: 1330 - protein, 356 aa, unidentified
  REGION 1..356: note = Description of Unknown:uncultivated organism sequence
  REGION 1..356: note = Category: MG61 effectors
  REGION 1..356: note = Description: MG61-166 effector
MSRCQTSSAVRAEKLIPYATVVGRLTANTCDDYMKLVRLVYEFRKAVTYAARMVVRGVNVNEALKELRGMLNKAYGDSAYKVARAIVKGCRLNGGDPRHIKVRGLFIVSEGEASRSGNRNVRVEATDVVRIKYPFDGSWLTFKARFGERYLPLVQELVELAKDCKVSYGARITFRGGRVYLHLSVPVELYLKHFRKGDAKGGLVAGLDLNSDRINMAIVDRCGRIRDIKAEWFPEVVCHGYPRGKARARRLEALARLLNYAYHHGVGRVVFEDLLAIKHRTRTGSPSANRRITRFAKKQLLRHGILMAMKYGFEVLLVNPRGTTRSKQHDEVARKYGLDRHTASAYMVALKGLNLP

SEQ ID NO: 1331 - protein, 374 aa, unidentified
  REGION 1..374: note = Description of Unknown:uncultivated organism sequence
  REGION 1..374: note = Category: MG61 effectors
  REGION 1..374: note = Description: MG61-167 effector
MNEVKYVTLRLPFHAVGEGAKPIYWTAWLSKLCAHRLLDQVKQNPLLASLSQYEFVKMGRSLCYGVLPNRRYVDGVSTIIHASLQSAKALKIDVTKLELKPWLLFQSEAEPRAKGNLNIQFADYSTVKVLVFDKDGTSRKIAIRPVVPKGYAKLVKVLVDKALRREIGYPARIYVRDYGDGLAHLYGELQVMVKYDLYLEVMKRHGKPLGENIAGVDVNVDRLNLVVVNRDGDIVWTHTVRFPQVTARGFPRKKAWSIIGEAVHSVLKNAYSHGASVLAVESPEVIGYLKYYWIRNGNRGSRSYNYRVSIFRNAIIERLVWKAPLYGLKVVPISPRGTTRSKDHDYVMRRYGLDRHTASAYLIALKTRNIVRTY

SEQ ID NO: 1332 - protein, 364 aa, unidentified
  REGION 1..364: note = Description of Unknown:uncultivated organism sequence
  REGION 1..364: note = Category: MG61 effectors
  REGION 1..364: note = Description: MG61-168 effector
MNDTPLYTLKLSFNVSGEVARKILSTAWLFKLACHRVLSKSKELEKHLIPSKVAWIKMFYDDARSFIPNKRYAYGAIYLVYSVWESARGLKVDYKSVELSDWLLFQHYEREVDGNVIRVSEDGSALITTCSYNGSKDRVLVRAKPNRGYAKLLRFAVESREKYMPRVVVRGYNVRGGALYVHGEIHIVISYDFYLKHTTRFREPRGGLVGGVDVNADRINLAIVDEKGNLRDYKTFWFRETTARGYPRRSAWSTVGEKIHEMLRYAYYHGVSTIAMENPETLGYLKLAWIRGNDRRHENYNYKKSIFRSSVIERIAMKAPLYGLSVKFINPKGTTSSRDHAEAMKRYGLDKHTASAYLIALRCI

SEQ ID NO: 1333 - protein, 373 aa, unidentified
  REGION 1..373: note = Description of Unknown:uncultivated organism sequence
  REGION 1..373: note = Category: MG61 effectors
  REGION 1..373: note = Description: MG61-169 effector
MNGPYLTLRLPFNVYRDEARLLLSTARLFRFIVLHLHSLLLEENPHITSLIALKRVYRRRLQEMLPNRRYVDGAITLVYSIYESAQALGVSFSDIEFRNWLLFQQSEKEYPCRNITLQKDYSFRITTINYQGESIRIALKPTIPKNYKQVLDKIIEKKQPYVARVVLKGFGERKKILRVHGEIHLSILYKFYLEHFRRYKRNYGKLYGSVDVNVDRINLAIVDRYGRLRDTKTFWFEEASWKGCPRHRAWSIIGLAIHSMLKYAYHHGVKTLFLENPEALGYLKTLWIKKGERRNSNYNYRVQIFRNRVIERIAMKALLYSINIEYVGPKGTSHSKEHDEIMRKYGLDKHTASAYLIAFKGIERHTTIQKAII

SEQ ID NO: 1334 - protein, 379 aa, unidentified
  REGION 1..379: note = Description of Unknown:uncultivated organism sequence
  REGION 1..379: note = Category: MG61 effectors
  REGION 1..379: note = Description: MG61-170 effector
MSKSVVEYVTLRLPFHVTGENARLIYWTAWLCKICAHRLLELIKQNPILAGLSQYDFIKISRKMCYDIVPNRRYIDGVSTLIHASLQSAKALKVDVSKLELKSWLLFQSEAEPWAKGNLNIQFTDYDTVRVLVFDKDKSTRKITIKPIIPKGYAGLIKTLVDKALKKEIGYPARVYITDYGKRLEHLYGELQVMVRYSLYLEVMKRYDEPRGDNIAGVDVNVDRINLVVINRDGDIVWKYTARFPQVTARGYPRKRAWSIVGEAIHGILKNAYSHGASVIAVENPEVIGYLKYYWVRNGDRKSENYNYKVSIFRNSIIERIVWKAPLYGLHVVTVDPKGTTHSKDHEYVMRRYGLDRHTASAYLIALKARRNLQKPIET

SEQ ID NO: 1335 - protein, 378 aa, unidentified
  REGION 1..378: note = Description of Unknown:uncultivated organism sequence
  REGION 1..378: note = Category: MG61 effectors
  REGION 1..378: note = Description: MG61-171 effector
MKDTGLPDYIAINIPFTVNGEEAKLVWYTAWFSKLCAHRLLNDVKGNDALLGFSQASFLKYARERCYELLPNRRYIDGVATLVHSTLRSARKLGVNIRDIELGQWLLFQSEAESEKRGNLNIRLLSVNRAEVLVLNYDGASKRIDIGLKTPKGYVELLKVLIERAGKYEVGYPARVMVRGYNFRPGNMHLYCGLQVMVPYSLYLNVMRRYSEPRGNLIGGVDVNVNRLNLAIVDRYGRLRDVKTFWFREVTARGFKGVVAWTKIHQAIHELLNYAYHHGVSAISLENPRTIGYLRYYWVRNGDRGSRNYNYRVSIFRSRTIEVISYKAPLYAMRTIYVNPKGTTNSQQHDEVMRRLGLDRHAASAYLIALRGLNKQGR

SEQ ID NO: 1336 - protein, 365 aa, unidentified
  REGION 1..365: note = Description of Unknown:uncultivated organism sequence
  REGION 1..365: note = Category: MG61 effectors
  REGION 1..365: note = Description: MG61-172 effector
MTYITLTFPFNACCDVARRLLSTAWLFRVATHRLLSIARKFPVLPGTDIGWKSTFRGMVHEVIPNRRYADGVVVLVRSIYESCRQLRVDFRSVELSSWLMFQQVELEHPARNITLKPGYEFHVTTVDYGENTHRVVVKPTVPGNYGLLLDKVLRERQRYTGRVVLRSYGIGGGNLWVQGEVQMTIPMDFYYRHMARYRRNDGKLYGGVDVNTDRINLAIIDEDGELIDHKTFWFSEASRKGCSGRRAWSIIGMRIHELLDYAYNNGVKTLFLENPEVLGRLKLMWAKSGDRGHGNYNHKVMTFRSTIIERIALKAPLYGIEVSYVNPKGTTNSKEHDETMKKHGLDRHTASAYLTALKGLTHQRK

SEQ ID NO: 1337 - protein, 376 aa, unidentified
  REGION 1..376: note = Description of Unknown:uncultivated organism sequence
  REGION 1..376: note = Category: MG61 effectors
  REGION 1..376: note = Description: MG61-173 effector
MSKSVAEYITLRLPFHVTGVDAKLIYWTAWLCKLCAHRLLEAIKLNPSLAYLSQYDFIKVGRRLCYDIVPNRRYVDGISTLIHASLQSAKALKVDITKLEPKHWLLFQSEAEPWAKGNLNIQFVDYDKVKVLVFDRDKSSRRIIIEPVIPKGYIRLVKALVDKALKKEIGYPARIYITDYGERLEHLYGEIQVMVKYNFYLEVMKRYDKPLGDNIAGVDVNVDRLNLVVINRDGDMVWKHTVRFPQITSRGCPRKRAWSIIGEAIHSILRNAYSHGASVVAVENPEVLGYLRYYWIKNGDRGTKNYNYRISIFRNSIIERIVWKAPLYGLHVVTVNPKGTTHSKDHEYVMRRYGLDRHTASAYLIALKTRRNLQRP

SEQ ID NO: 1338 - protein, 371 aa, unidentified
  REGION 1..371: note = Description of Unknown:uncultivated organism sequence
  REGION 1..371: note = Category: MG61 effectors
  REGION 1..371: note = Description: MG61-174 effector
MSYITICLPFNVDGVEARRLLSTAWLFRVASHRMLSLAKQFPVLPATDIGWKNTFRKVIYEIIPNRRYTDGVIVLVRGIYESCRQLGIDFKEVKLGGWLMFQQSEKEYPVRNITLKQGYEFHITTISYGGEAERVVIKPTIPKNYKLLLDKILEEKQKHTARVVIKDYGVRRNKVWIHGEIQLTILINFYYKYMTRFKRNYGRLYGGVDVNIDRINLAIVDRYSRLRDAKTFWFEDTARKGYPRRKARALIGMVVHEMLRYAYHHGVKTLFLENPEVLGKLKLLWIRNGRRLHRNYNWRVSVFRSSVIEMVAMKTPLYSIKVDYVDPKGTTHSKEHNEIMRKYGLDSHTTSAYLIALKGIKRHTMIQRAII

SEQ ID NO: 1339 - protein, 364 aa, unidentified
  REGION 1..364: note = Description of Unknown:uncultivated organism sequence
  REGION 1..364: note = Category: MG61 effectors
  REGION 1..364: note = Description: MG61-175 effector
MDETLLYTLKLSFNASGGVARRILSTAWLFRLACYRVLSRSRELKERLVPSKVAWVKMFYEDARSYIPNKRYAYGAIYLVYGIWESARKLKLNYADVELSNWLLFQHYEREVDGNVIRVAEDGSALVTTYNYDGSKDRVLVRAKPNRGYAKLLESVVESKEKYMPRVVIKGYNIRNGTLYIHGEIHVIVSYDFYLKHSARYREPTGDLIGGVDVNVNRINLAIVDKKGNLRDYKTFWFAEATARGYPRQCAWSFIGARIREMLEYAYHHGVSTIALESPEVLGYLKLAWIRGNDRKHEDYNYKKSIFRGSIIERIAVKAPLYGLSVKFVDPKGTTSSIEHDNAMRKYGLDRHTASAYLIALKCI

SEQ ID NO: 1340 - protein, 363 aa, unidentified
  REGION 1..363: note = Description of Unknown:uncultivated organism sequence
  REGION 1..363: note = Category: MG61 effectors
  REGION 1..363: note = Description: MG61-176 effector
MSYVTVALPFNVCGREASLVLSTAWRFKIAAHRVLGVAKEMRMLPGSDIGWRNTFRSLVYEVMPNRRYADGVITLVRGIYESCRQLGVDFREVELGDWLMFQQTEKEYPPRNITLKPGYEVHVTVIDWHGERHRISLKPTVSGRWSKLLDTILEKRIKYTGQIVVEDYGVRDGVLWLHGKVHLIVPYDVYLECMARYKMNMGRLYGGVDVNTDRINLAIVDGSGRLRDIKTFWFEEASRKNCPRQRARSVVGMAVHEMLRYAYHHGVKTLFLEDPGVLGRLRLAWIRNGRRGSRNYNWKVSIFRSSVIEMIARKAPLYAIKTVYVDPRGTTHSQEHDEIMKRYGLDRHAASAYLIALKGLERP

SEQ ID NO: 1341 - protein, 1509 aa, unidentified
  REGION 1..1509: note = Description of Unknown:uncultivated organism sequence
  REGION 1..1509: note = Category: MG61 effectors
  REGION 1..1509: note = Description: MG61-177 effector
MSKRILGLDLGTNSIGWAVVDEAKEEIVNAGVRIFPEGVVSKTIGSGDKEETKNAARRRARQTRRQFYRKRLRKAKLLEVLIEQNMCPLSLDELNKWRHWDKKEKSQAKVFPNSDEFMNWIRMNPYELRARAIIGTVTAMELGRIFYHLIQRRGFLSSRKGDVKESKTLFEKGKPELNILPINRTEKEIAESGCQTMGEYLNRVVPKEGESYKPILDSDGNEIRARGRYATRKMYVEEFEAIWNAQADHLGLDKRSVLFKKVRMLKGNENSERNKKRISTLKKFYGAENVFVENRGNNLHITTTRTLPFKIFLAGDDVELKRNESVLFWQRPLRSQKGTLGNCSFEDTLPVINMDGTQRKNEKGKPVTYSKKPCPISHPLFELFRTHQFINTIEFGEKQRLSKDQKKQVLELINRKDNAFSFKEIVKKLELFSETFNYENDFKVSGNYTISKLSKLLGKKVWDEHPLAYWEAFYFYDDSTKLQKKLNKAYGLNLKVEEVDKIRLKEGYSRVSIKAIQNILPFLEKGYFYSTAVILGGVKNAFGSRWDSYLQDETKEKIEDDILKMLKDKNKEGELIEKIKAYLSDSSNRYGFSENSPAFKKLYHHSQSVEKKELKNKLPPVENIRNPIVQQSLYEMRKVVNALLEKYKEEDPTFSFSSIRVEMGRDLKNGKKQRQKINQVIRKNRENNDEARERLAEFGLQPSRNNIQKYLLFKEMERRAGHVQSPYTGRTISLTDLLGKDNLIQIEHIMPFSKSLNDSFANKTLCESSVNGLKGDKTPYAFYHQNPDPKIWGVSSWDEVKHRAFKLLPYAKAKRFVSDKSVDAEDFISRQLNDTRYIAKKATEILSEICSDVQVMPGQLTAELRHLWGLNNVLESSFGVTKQFSDIPLKPGEYYLVLNEQRESIQLIPKHNPKPKTNPNELLVAGEINNAIFESKKLVLELGAPDQANGKYWAKLTLKPIQKFSPKYISKPITDENRIVFKGLVKNQRFSSDSIPKNPIAEHKDGIYWGSFAVKNKRIERSTVAPITNRKEIKLFGEVKDGIFKSYIYECSTTAENGKYWLVLEPDFETPEFIQASNPEPQHSENEHIITGTIDDNGVFVSDLDPSYSVKTDHSAGKYYAVIELASKENDFYLMENPAPKVEKEHRLIEGTVWVDKYSSELKFDPKKNREDQRHHAIDAITIALTKRGYLNALSHYRAKELPEDYKPSFPEPWDGFEHDVKNAAEKILISYRKNDRIISKGKKGFSVRGQLHKENVFGKHKGKEDEKKSFYHRRKYLNDLKTNKHVSKIVDERIKQLVLDHLKNSCGVNISSEKGFKIPPNAFFTKDGKPRLFLPPNPRKKKNSQPVPIKKVRIKEEIGNARQLKNGINQYVNPRNNHHVMVYKTHSGDVKESIISFWDAVNRMKKNQSVYQLPEDGVEILAVLEQNDMYLIGITDEELEKRKNDQKFLSNHLYRVQKLSSMYYTFRHHLASTVTNPDEEERIVSFDRFQLRNPKKVKISELGEISLC

SEQ ID NO: 1342 - protein, 365 aa, unidentified
  REGION 1..365: note = Description of Unknown:uncultivated organism sequence
  REGION 1..365: note = Category: MG61 effectors
  REGION 1..365: note = Description: MG61-178 effector
MTYVTLVLPFNAGGDTTKRLLSTAWLFKTAVHRVLDVAKRSPVLPGTDIGWKSAFRSLAYSVIPNRRYADGAVTLVRSIYESCRQLGVDFKSVELSDRLMFQQSELEYPARNITLKPGYEVHVTTISYDRESYRDVIKLVAPKNYSTLLSKIIEERQEYSGRVVVKGCGVRDNTLWVRGEVQITIPVDFYYKHADRYREPKGDLVGGVDVNADRINLVVVDEKGNLRDYKTFWFEKTTARGYSRRRTWSVIGMRIHEMLEYAYRHGASTIVLENPEVLSKLKLLWIRRGDRRHENYNYKVSIFRSSIIEMVALKAPLYGLEVEYVNPRGTTNSVEHDMLMKEHGLDKHTASAYLIALRALAHQST

SEQ ID NO: 1343 - protein, 363 aa, unidentified
  REGION 1..363: note = Description of Unknown:uncultivated organism sequence
  REGION 1..363: note = Category: MG61 effectors
  REGION 1..363: note = Description: MG61-179 effector
MNYITITLPFNAHGKTARLLLSTARLFRITVLKVYEKLLEDKVKYISPIMLKKYYRSLAYEIIPNRRYADGALTLIWSIYESCEALGVPFNEIEWKNWLMFQQTEKEFPCRSITLRRNYTVGVSVIGFNGEKEKIELSPTVSRNYMKLIDYVIEERIPYTGRVVLKGYGERRGVLWVNGRIDVTVPYSAYFEVMRKFKRNYGKLYGGVDVNSDRLNLAIVDGNGRLRDTYTFWFREVTARGYSRHSAWSIIGMRIHEMLKYAYHNGVKTLFLEDPEVLGRLRLYWVRNGERLHENYNWKVSTFRCSIIERITMKAPLYSIKVKYVNPRGTTNSRKHREIMKKHRLDQHNTSAYLIALRGLNLF

SEQ ID NO: 1344 - protein, 364 aa, unidentified
  REGION 1..364: note = Description of Unknown:uncultivated organism sequence
  REGION 1..364: note = Category: MG61 effectors
  REGION 1..364: note = Description: MG61-180 effector
MTYITLVLPFNASGDVAKRLLSTVWLFKIASHRLLDIAKQTLVLPRTDTGWKITFRRVTYDVIPNRRYADGVVTLIRGIYESCRHLGVGFKSVELSDWLMFQQSEKEYPPRNITLKPGYEVHVTTISYSGESYRDVVKPSIPKSFSTLVDKIIEESQEYTGRVVVKDSSVRDCTTWVRGEVQVTVPVDFYYKHMARHREPKGNLIGGVDVNVDRVNLAIIDENGNLRGYKTFWFREATARGYPRRSARRVIGARIHEMLDYAHHQGVSILTLENPEVLGKLRLLWVKHGERGHENYNYRVSAFRCRVIEMIALKAPLYALEIKYVNPAGTTNSKDHDEAMRRYGLDKHASSAYLIATRSLNQKR

SEQ ID NO: 1345 - protein, 365 aa, unidentified
  REGION 1..365: note = Description of Unknown:uncultivated organism sequence
  REGION 1..365: note = Category: MG61 effectors
  REGION 1..365: note = Description: MG61-181 effector
MSYVTLCLPFNVGDDVAGKLLSTSWLFKAASHRMLDLAKQMPILPATDIGWKNTFRKIIYEITPNRRYTDGVIVLVRGIYESCRQLGVGFKDVELRDWLMFQQVEKEYPVRNITLKQGYEFHITTIDYNDGVERIVVEPTIPKNYKLLLDKILEEKQKHTARVVIKDYGVRKNKLWIHGEIQLTIPLDFYRKHMTRYRRNYGKLYGGVDVNSDRINLAIIDSEGNLRDTYTFWFREVTARGYPRRKARSVIGMRVHEMLKYAYHHGVKTLFLENPEVLGKLRLLWVRNGKRLHKNYNWKVATFRSSIIEIIAMKAPLYSIKIGYIDPKGTSNSGEHDKYMRKYRLDKHTASAHLIALKGLNHEFK

SEQ ID NO: 1346 - protein, 364 aa, unidentified
  REGION 1..364: note = Description of Unknown:uncultivated organism sequence
  REGION 1..364: note = Category: MG61 effectors
  REGION 1..364: note = Description: MG61-182 effector
MVENAFYTIKLAFNVGGDRARKVLSTAWLFKLACHRVLSRSKELLNALIPSKIAWVKMFYSDARDLIPNKRYAYGAVYLVYGIWESSRSLKIDYRNVELSNWLMFQHYDREVDGNVVKVLEDGSALVTTYSYDSSKDRVLIKAKPNRGHGELLKLVVESKEKYMPRVVVRGYNVRNGKPYVNGEIHVTIGYDFYLKHMTRHREPKGSLIGGVDVNADRINLAIIDEKGNLRDSKTFWFTEAVTRGYPRRKAWSVIGMKIHEMLRYAYNHGVSTIALEAPEVLGYLRLAWVRDGGRKHENYNYKKAIFRSSVIERIAMKTPLYGLNTKFVDPKRTTSSREHNEIMKRFGLDRHTASAYIIALRSI

SEQ ID NO: 1347 - protein, 353 aa, unidentified
  REGION 1..353: note = Description of Unknown:uncultivated organism sequence
  REGION 1..353: note = Category: MG61 effectors
  REGION 1..353: note = Description: MG61-183 effector
MLLSTARLFRQVVLHLHNLFLKENLRITSLIALKRMYRKRLQEILPNRRYVDGAITLVYSIYESAQALGVPFSDIEFKNWLLFQQSEKEYPCRNVTLQRDYSFRVTTISYQGESKRTSLKPTVPKNYKQILDKIIEKKQPYVARIVLRGFGERKNMLWIHGEIHLSIPYKFYLEHFSKFKRNYGKHFGGVDVNVDRINLAIVDKYGRLRDVKTFWFEEASWKGCPRQRAWSIIGMAIHNMLRYAYYHEVNTLFLENPKVLGYLKILWIRKGKRKNRNYNYRVQIFRSSVAEKIAMKAPLYTINIEYIDPKGTTHSKEHDEIMRRYGLDKHTVSAYLIALRGIERRIMIQKAIV

SEQ ID NO: 1348 - protein, 369 aa, unidentified
  REGION 1..369: note = Description of Unknown:uncultivated organism sequence
  REGION 1..369: note = Category: MG61 effectors
  REGION 1..369: note = Description: MG61-184 effector
MSQYQMHRVRDASKLVEYVTIVGRLEPLTEEDYVKLVRLAHEFRKAATYATRMIAKGIDPNTVLRELRSMLNKAYGDSAFKLAKAIVESARSNNGNPLKIEIRRLFIVSEGEAGRLGNRNVRLDDSSTVRIRYPYERSWLSFRARFGENHVPLVKELSELAKSRKCSYGAKIVFRKGRVYLHLSVPVELYLKYFGRGEAIGSLIAGFDLNSDRVNMVIVDKYGRVVDVRTAWFPEVTSPGYPGSKAMVVRLRALAELLNYAYHHGVGVVVFEDLDKIKQRRFTSSPTANRKITRFAKKQLLTHAVVMALKYGLKPVLVDPRGTTSSPVHSTVMKKHGLDRHTASAYLIALRYLQDEKTVNGHKAHKQYK

SEQ ID NO: 1349 - protein, 381 aa, unidentified
  REGION 1..381: note = Description of Unknown:uncultivated organism sequence
  REGION 1..381: note = Category: MG61 effectors
  REGION 1..381: note = Description: MG61-185 effector
MSLPEYITIDIPFTATGEEAKLIWCTAWFSKLCAHRLLSDVKRNEVVIDLSQISFLKYARKRCYDILPNRRYIDGVATLIHSTLRSARKLGVNIKSIELRQWLLFQSEAEKEKKGNLNIRLTTINKAELLVINHKKEPKKIVIDLRIPKGYRKTLETLIKKALNREIGYPARVVIKEYNFYPNNLHLYCSLQVMIPYDLYLETMRRYDKPLGDHIAGIDVNVDRLNLAIVDKYGRLKDVKTFWFREITNRGYRRKPAWTKVHQAIHDMLDYAYNHGVSLVALENPKVIGYLRYYWIKNGDRKSRNYNYRKSIFRNKIIEAVTYKAPLYSLKTIYVNPRGTTKSREHDKVMRRYGLDRHTASAYLIALRGIKRHTMIQKAIT

SEQ ID NO: 1350 - protein, 363 aa, unidentified
  REGION 1..363: note = Description of Unknown:uncultivated organism sequence
  REGION 1..363: note = Category: MG61 effectors
  REGION 1..363: note = Description: MG61-186 effector
MTYITLTFPFNACCDVARRLLSTAWLFRVATHRLLSIARKFPVLPGTDIGWKSTFRGMVHEVIPNRRYADGVVVLVRSIYESCRQLRVDFRSVELSSWLMFQQVELEYPARNITLKPGYEFHVTTVDYGGNTHRVVVKPTVPGNYGLLLDKVLRERQRYTGRVVLRSYGIGGGNLWVQGEVQMTIPMDFYYRHMARYRRNDGKLYGGVDVNTDRINLAIIDEDSELIDHKTFWFSEASRKGCSGRRAWSIIGMRIHELLDYAYNNGVKTLFLENPEVLGRLKLMWAKSGDRGHGNYNHKVMTFRSTIIERVALKAPLYGIEVKYVNPKGTTNSVEHDEAMRKHGLDRHNASAYLIALRGLKHQ

SEQ ID NO: 1351 - protein, 368 aa, unidentified
  REGION 1..368: note = Description of Unknown:uncultivated organism sequence
  REGION 1..368: note = Category: MG61 effectors
  REGION 1..368: note = Description: MG61-187 effector
MNYVTLVLPFNIGGDTAKRLLSTAWLFKAAVHRVLGVAKQSPALPGTDIGWKSAFRSIAYSVIPNRRYADGAVTLVRSIYESCRQLGVDFRSVELSSWLMFQQSEKEYPARNITLKHGYEVHVTTISYSKESHRDVIKPSIPKSYSALLSRIIEERQEYSGRVVVKGYGVRGNTLWVRGEVQITIPADFYCKHMAKYREPKGSLIGGVDVNVDRVNLAIIDEKGSLRDYKTFWFTEATVRRYPRKRARSVIGMRVHELLKYAYHHGVSTIALESPEVLGRLKLLWARRGDRKHEDYNYRKSVFRSSVIEMIALKAPLYGMKVEYVDPRGTTNSTEHDRLMKVCGLDRHTASAYMIALRGLAHQVKQMK

SEQ ID NO: 1352 - protein, 369 aa, unidentified
  REGION 1..369: note = Description of Unknown:uncultivated organism sequence
  REGION 1..369: note = Category: MG61 effectors
  REGION 1..369: note = Description: MG61-188 effector
MDYITIKLPFNVDGDVAKGLLSTAWLFRVAAHRVLALARQQESLPGSRIGWKNMFRQFAYGIIPNRRYADGAVILVMSIYESCRELGVDFKGVELSDWLMFQQSELEYPAKSITLKPNYEFHVTTVRYDGSTGRVVVKPTIPRSYGELLNAVLAERVKYMGRVVVKDYGVRGNQLWVRGEVHMTVPLDVYYERMARHKRNGGKLFGGVDVNTDRVNLAIVDEGGDLRDYKTFWFSEVTARGFPRHSALSIIGMRIHEMLNYAYHHGVKTLFLENPEVLGRLKLVWIRNGDRGRENYNHKVATFRSTIIERTALKAPLYSIEVGYVSPRGTTNSEEHDELMRKYRLDRHTASAYLIALKGLITNGNKHYD

SEQ ID NO: 1353 - protein, 363 aa, unidentified
  REGION 1..363: note = Description of Unknown:uncultivated organism sequence
  REGION 1..363: note = Category: MG61 effectors
  REGION 1..363: note = Description: MG61-189 effector
MTYVTLTFPFNICCDVAKRFLSTAWLFKIATHKLLGVAKQSPVLPGTDIGWKNTFRGIVYEVIPNRRYADGVITLVRSVYESCRQLGVDFRSVELSDWLMFQQGELEYPARNITLKPGYEFHITTIDYSKNSYRDVVKPIIPKSYRLLLDKVLDERERYTGKVVLKSYGIKECNLWVQGEVQITIPIDFYYKHMARAKAGNGKLYGGVDVNVDRINLAIVNGGGELRDVYTFWFEEASRKGCSRQRVRSIVGMRVHEMLEYAHRHGVKVLFLENLEVLGKLKLLWIRSNDRRHENYNYKVSVFRSSVIEMIALKAPLYSIEVKYINPKGTTNSEEHDEIMKRFGLDRHIASAYLIALRGLRHR

SEQ ID NO: 1354 - protein, 365 aa, unidentified
  REGION 1..365: note = Description of Unknown:uncultivated organism sequence
  REGION 1..365: note = Category: MG61 effectors
  REGION 1..365: note = Description: MG61-190 effector
MSYVILRLPFNINGGVAKELLSTAWWFKTAAHRVLSLAKRMQFLPGAKIGWVNMFRGIAYEIVPNRRYADGAVTLVMGVYESCRALGIDFRGVELGDWLMFQQSELEYPAKSITLRPGYEFHVTTIKYDGLIGRVVVKPTVSEDYRELIDAIYRERIKYMGRVVIRDYGARNNQLWVHGEIHITVPLDIYYEHMAKHRRNSGRLFGGVDVNTDRINLAIVDEGGDLRDYKTFWFSETMARGFLKHRAWSIIGMRIHELLDYAYNHGVKTLFLENSEVLGRLRLMWVWNGGRNHENYNYKVMIFRSTIIEKIALKAPLYSIRAGYVNPRGTTNSKEHEEAMRRYRLDRHTTSAYLIALKGLTHQQK

SEQ ID NO: 1355 - protein, 364 aa, unidentified
  REGION 1..364: note = Description of Unknown:uncultivated organism sequence
  REGION 1..364: note = Category: MG61 effectors
  REGION 1..364: note = Description: MG61-191 effector
MSQYQTHRVINASKLVEYVTIVGRLEPLTEEGYVKLVRLAHEFRKAVTYATRMITKGIDSKAVLRELRSILNKAYGDSAFKLAKAIVESAGVNDGNPLKVEIRKLFIVSEGETSRQGNRNVRLDDSGIVRIKYPYDRSWLIFKARFREEYVPLVKELSELARSKKLSYGARVVFRSGRVYLHLSVPVELYLKYFRRGEARGSLIAGFDLNSDRVNMVIVDEYGRIVDMRTAWFPEVTSHGFPRNRAKVARLQALSKLIEYAYHHGVGVTVFEDLGRIKRREFTGSPTANRKISRFAKRQLLAHVVVMSLKYGLKPALVDPRGTSSSHEHYFIMEKYGLDRHTASAYLIALKYLRDENHEPSQST

SEQ ID NO: 1356 - protein, 302 aa, unidentified
  REGION 1..302: note = Description of Unknown:uncultivated organism sequence
  REGION 1..302: note = Category: MG61 effectors
  REGION 1..302: note = Description: MG61-192 effector
MRLCLIADMLVIVLVRGIYESCRQLGVNFKEVELGNWLMFQQTEKEYPVRNITLKQGYELHITTLDYDGNSERIVIKPTTPKNYKLLLDKILEERQKHTARVVVKDYGIRKGKLWVHGEIQLTIPLNFYYKYTTRYKRNYGKLYGGADVNSDRINLAIVDKEGNLRNTYTFWFREVTARSYPRRKARTIIGMRIHEMLKYAYHHGVKTLFLENPEVLGRLKLMWMRNGKRLNRNYNWRVTTFRSSIIEMIAMKASLYAIRVMYVNPKGTTSSEKHDGIMRKYRLDKHTASAYLITLKGLDLL

SEQ ID NO: 1357 - protein, 356 aa, unidentified
  REGION 1..356: note = Description of Unknown:uncultivated organism sequence
  REGION 1..356: note = Category: MG61 effectors
  REGION 1..356: note = Description: MG61-193 effector
MAGEIREPGVTHVTVTGRVVPLDSNSYMELVLLAHRFRKALTKAVKMRARGVDKNAIVKEITRELNLGYADTIYKLAKLVVEGARRNNSNLLKVEIRKLFVASRGFSSNKGNRNIRLLSTSELEVNIPWRGWVKFRVLFGGQYIPLVSELIEKALRRELSYTAKIVFRNGRPYLQVSTPIELYLKHFKKEVARGDLIAGFDLNSDRINMVIVDKLGVIRDVKTEWFPEVTSPGFPREKANTLRLQALAKLLGYAYHHGVGVVVFEDLERIRGRRYTKSRSANRKIGRFPKRKLLQYAIVMALKYGFKVYLANPAYTSKIGEKLGKELGFDKHTASAYVLALKALQPENYKLLTELR

SEQ ID NO: 1358 - protein, 369 aa, unidentified
  REGION 1..369: note = Description of Unknown:uncultivated organism sequence
  REGION 1..369: note = Category: MG61 effectors
  REGION 1..369: note = Description: MG61-194 effector
MDYLTIKFPFNANGDVAKELLSTAWLFKIATHRVLSLVKQQQVLPGTRVGWKGMFRGIAYGVVPNERYADGAITLVMGIYESCRALGIDFRSAELGDWLMFQQSSLEYPSRNITLKPNYEFHITTIRFNGSIDRVVVKPTIPRSYEKLLGAVITKRVGYMGRVVVRDYGVRGNQLWVRGEVQVTIPLDIYYEHMSKHKRNAGKLVGGVDVNTDRINLAIIDEDGELIDHKTFWFSEVTARGFPKHSAWSIIGMRIHELLNYAYHHGVRILFLENPEVLGRLRLMWIRSGDRGHENYNHKVTTFRSTIIEKIALKAPLYSIEVKYVNPKGTTNSTKHDELMKKHGLDRHTTSAYLIALRGLGINKYVHYK

SEQ ID NO: 1359 - protein, 286 aa, unidentified
  REGION 1..286: note = Description of Unknown:uncultivated organism sequence
  REGION 1..286: note = Category: MG61 effectors
  REGION 1..286: note = Description: MG61-195 effector
MAREVRKPEITHVTITGRVIPLNNDSYMELVLLAYRLRITLIKAIKMTTKGLGKNTIVKEVTKELNLGYADTIYKLAKLIVEGAKSNGSNPLRVKLRRLFIASRGFTANKGNRNIRLLSSSELQVNIPWKGWVKFKVVSGKRCIPLVYELVEKALSKKLSYTAKIVFRNGKVYLHISIPIELYLKYFSKGRAKGKLIAGFDLNSDRVNMVVVNRQGIIRGTKTEWFPEVTSHGFPRNKANTIRLQALAKLLDYAYHHGVGVALFEDLDRIKKRRYTRSKTANRKIT

SEQ ID NO: 1360 - protein, 363 aa, unidentified
  REGION 1..363: note = Description of Unknown:uncultivated organism sequence
  REGION 1..363: note = Category: MG61 effectors
  REGION 1..363: note = Description: MG61-196 effector
MGYVTLCLPFNVDGVEARELLSTAWLFKAATHRVLYLARRAQALPATDIGWKDAFREAVYEVVPNRRYADGVVVLVRGIYEACRQLGVDFKDVELGDWLMFQQVEKEYPVRNITLRRGFELHITAIGYDGEVERIAVKPTVSKAYRALLDKVIEEKQKHTARVVIKGYGVRRDKLWVHGEVQLTLPLDFYYKHMTRYRGNYGKLYGGVDVNADRINLAIVDENGGLRDTYTFWFREVTARGYPRRRARSVIGMKVHDMLRYAYHHGVKAIFLESPEALGRLRLLWIRNGKRLHENYNWKVAAFRSSIIEMIAMKAPLYSIKVGYVGPRGTTHSKEHDEVMKKHRLDKHTASAYLIALKGLKQP

SEQ ID NO: 1361 - protein, 373 aa, unidentified
  REGION 1..373: note = Description of Unknown:uncultivated organism sequence
  REGION 1..373: note = Category: MG61 effectors
  REGION 1..373: note = Description: MG61-197 effector
MNETYLTLRLPFNACDVEAGMLLSTARLFRQVVLHLHNLFLKENLRITSLIALKRMYRKRLQEILPNRRYVDGAITLVYSIYESAQALGVPFSDIEFKNWLLFQQSEKEYPCRNVTLQRDYSFRVTTISYQGESKRTSLKPTVPKNYKQILDKIIEKKQPYVARIVLRGFGERKNMLWIHGEIHLSIPYKFYLEHFSKFKRNYGKHFGGVDVNVDRINLAIVDKYGRLRNVKTFWFEEASWKGCPRQRAWSIIGMAIHNMLRYAYYHGVNTLFLENPKVLGYLKILWIRKGKRKNRNYNYRVQIFRSSVAEKIAMKAPLYTINIEYIDPKGTTHSKEHDEIMRRYGLDKHTVSAYLIALRGIERCIMIQKAIV

SEQ ID NO: 1362 - protein, 371 aa, unidentified
  REGION 1..371: note = Description of Unknown:uncultivated organism sequence
  REGION 1..371: note = Category: MG61 effectors
  REGION 1..371: note = Description: MG61-198 effector
MSYITLTLPFNIDGGEARKLLSTAWLFKIASHRMLSLVKQFPILPATDIGWKNTFRKIIYEIIPNRRYTDGVIVLVRGIYESCRQLGIDFKEVGLGDWLMFQQTEKEYPVRNITLKQGYEFHITTINYNGNSERITIKPTIPKNYKLLLDKILEEKQKHTARIVIKDYGVRKNKLWIHGEIQLTIPLNFYYKCMVRYRRNYSRLYGGVDVNVDRINLAIIDRYGRLRDVKTFWFEDATRRGYPRRKARILIGMAVHGMLQYAYHHGVKMLFLENPSILSRLRLIWIRNGRRLHRNYNWKISVFRSSVIETISMKAPVYSINTEYIDPKGTTHSKKHDEVMKKYGLDRHTASAYLIALKGIKGYRMIQKATD

SEQ ID NO: 1363 - protein, 363 aa, unidentified
  REGION 1..363: note = Description of Unknown:uncultivated organism sequence
  REGION 1..363: note = Category: MG61 effectors
  REGION 1..363: note = Description: MG61-199 effector
MSFITLRFPFNVDGDAAKGLLSTAWLFKIAAHRVLDVAKQQEVLPGTKIGWVNVFRGIAYGVVPNRRYADGAVTLVMGVYESCRALGVDFRSVELGDWLMFQQSELEYPSRSITLKPNYEFHVTTVGFDGTVGRVILKPTIPRNYKELLDTVITEHVKHMGRVVITDYGVRNNRLWVHGEVQVTIPLDVYYEHMSKHKRNSGRFIGGVDVNTDRINLAIIDSVGRLIDHKTFWFSEASRKGFSRHSAWSIIGMRIHETLNYAYHHGVRALFLENPEVLSRLRLMWVRGGDRKHENYNHKVSIFRSTIIEKIAMKAPLYSIRAGYVSPRGTTNSKEHDEAMKRYELDKHTASAYLIALKGLTHQ

SEQ ID NO: 1364 - protein, 293 aa, unidentified
  REGION 1..293: note = Description of Unknown:uncultivated organism sequence
  REGION 1..293: note = Category: MG61 effectors
  REGION 1..293: note = Description: MG61-200 effector
MTYIMLVFPFNVCGDVAKRFLSTAWLFKIATHRLLNVVKHFPVLPATDIGWKNTFRGITYEIIPNRRYADGVVTLVRSIYESCRQFRIDLKSVELSNWLMFQQSELEYPARNITLRSGYEFHITTVDYNKNTYRDVVKPIIPKNYKPLLDKMLEERHKYTGRVAVKSYGIRKYNLWVRGEIQITIPTDFYYNHMTRYRESKGSLIGGIDVNVDRLNLAIIDEKGNLRDCKTFWFSEAVARGFSRRGARSIIGAKIREMLSYAYHHNVKILFLENPEVLSKLKLLWVRNGDRKT

SEQ ID NO: 1365 - protein, 305 aa, unidentified
  REGION 1..305: note = Description of Unknown:uncultivated organism sequence
  REGION 1..305: note = Category: MG61 effectors
  REGION 1..305: note = Description: MG61-201 effector
MGLLSERYADGAVTLVMSIYESCRELGVDFKGVELSNWFMFQQSELEYPAKSITLKQNHGFHVTTVRFDGVIGRVVVKPTIPRSYKELLDAILTERIKYVGKVLIDGVGARGSQLWVHGEVQVTIPMDVYYEHMARHRRNAGKLIGGVNVNSDRINLAIIDEDSEPIDHKTFWFSEASRKGFSRHKAWSIIGMRIHETLNYAYRHGVKTLFLENPEVLGRLKLVWIRSGDRKHENYNYKVMTFRSSIIERITMKAPLYGIETKYVNPRGTTNSEEHDEAMRKHRLDKHTASAYLTALRGLKHQQK

SEQ ID NO: 1366 - protein, 364 aa, unidentified
  REGION 1..364: note = Description of Unknown:uncultivated organism sequence
  REGION 1..364: note = Category: MG61 effectors
  REGION 1..364: note = Description: MG61-202 effector
MVENPLYTIKLSFNASGDRAKKILSTAWLFKLACHRVLSRSKELLNALIPSKIAWVKMFYSDARDLIPNKRYAYGGIYLVYGIWEGTRELGIDYRSIELSDWLMFQHYDREVDGNVIRILEDGSALVTTYSYDGSKDRVLIKSKPNRGHGELLKLVVESKEKYMPRVVVRGYNVRSGKLYVSGEIHVTIGYDFYLKHATRYGEPRGSLIGGVDVNSDRINLAIVDEKGNLRDCKTFWFSETTARGCPRRKAWSIIGMKIHEMLRYAYEHGVSTIALENPEALGYLKFAWVREGDRKHENYNYKIAVFRNSIIERIAMKAPLYWLDVKFVDPRGTTSSREHDEIMKRLGLDRHTASAYIIALRNI

SEQ ID NO: 1367 - protein, 363 aa, unidentified
  REGION 1..363: note = Description of Unknown:uncultivated organism sequence
  REGION 1..363: note = Category: MG61 effectors
  REGION 1..363: note = Description: MG61-203 effector
MSYVTVVAGFNASGEEAKLLFSTAWLFKLATYRVLSVAQNMPILPVSRIAWKNVFRRVAYEVIPNRRYADSTVILVMGIYESCRQLGIDFRRVELGDWLMFQQTEKEYPPRNITLKSVDEAWVTVFGYDLEARRVKLRVSTSGSFKELLGKVLEEKQPYNPRIVIRSWNARDGILYVRGELHISIPLGFYYKHMTRYGRNCGKLYGGVDVNVDRVNLAIVDEYGRLRDTKTFWFEEASWKGCPRQRAWSIIGMAIHNMLRYAYHHGVKTLYLENPETLGHLKTLWIRKSDRGNSNYNFRVQVFRTRIVEKISLKAPLYSIDTRYVDPRGTTSSRKHGEIMRKYGLDRHTASAYLIALKGLKQP

SEQ ID NO: 1368 - protein, 373 aa, unidentified
  REGION 1..373: note = Description of Unknown:uncultivated organism sequence
  REGION 1..373: note = Category: MG61 effectors
  REGION 1..373: note = Description: MG61-204 effector
MGIYPSSGLKVSYVTIVTGFNASDEKARLLLTTAWLFKVATHRLFNIVKQMPVLPASDIGWKSAFYKAVYDVIPNRRYSYGVITLVRSVYESCRQLGIDFRSVKLSDWLMFQQSEKEYPPRSITLKSPSEVEVTVFSYSKESKRVALRVSTSGVYRKLLDVILREKQLYMPRIYVKSWNVRDGKLFVRGELQIAIPVDFYYKHMPRASANNGKLYAGVDVNVDRVNLAIVDGDGRLRDVYTFWFEEASRKGCSRHRARSIIGMRVHEMLEYAYSHGVKVLLLENPEVLGKLKLLWVRSSDRRHENYNYRKAIFRSSVIEMIALKAPLYSIEAKYIDPKGTTNSREHDDVMRKYRLDRHTASAYLIALKGLKQP

SEQ ID NO: 1369 - protein, 356 aa, unidentified
  REGION 1..356: note = Description of Unknown:uncultivated organism sequence
  REGION 1..356: note = Category: MG61 effectors
  REGION 1..356: note = Description: MG61-205 effector
MSRYQTSSVVDTSSIVNYVTIIGRAYPASSEDYMRLVRLAWNFRRAVQVATRMTVKGLEEDSILRELRRMLNKAYADSAYNAAKAMVEGCIFNGGNPLHIEVRKLFIISEGESSRLGNRNVRLEDTCLVKVKYPYDSSWITLRAEFGEKYLPLLRELVDLAKQKKLSYTARIVFREGSIYLHLSIPIQLYLKYFKKGEARGELIAGFDLNSDRVNLVIIDEHGRILDTRTAWFPEATSHGFPRGKAKALRLNALARLLEYCYRHSVSIVVFENLLSVKRKRFTRSKIANRKITRFAKKQLIQYSVVMALKYGFRVFLVDPKGTTNSREHYDVMRKYRLDRHAASAYLIALRGLRHQ

SEQ ID NO: 1370 - protein, 321 aa, unidentified
  REGION 1..321: note = Description of Unknown:uncultivated organism sequence
  REGION 1..321: note = Category: MG61 effectors
  REGION 1..321: note = Description: MG61-206 effector
MLPATDIGWKSAFREALYEVIPNRRYADGAIVLIRGIYEACRQLGVDFKEVELGDWLMFQQAEKEYPVRNITLRRGFEFHITTIGYDGEVERAVVKPTIPKTYRTLLDKVIEEKQKHTAKVVIKGYGVRRSELWVHGGIQLTIPLDFYYKHMTRYRGNYGKLYGGVDANTDRINLAIVDENGGLRDTYTFWFREVTARGYPRRRARSIIGMKIHEMLKYAYHHGVKTISLENPEMLGRLRLLWIRNGRKLHKNFNWKVSTFRSSIIEMIAVKAPLYSITVKYVDPKGTTHSKEHDEIMKKRRLDKHTASAYIIALKGLKLP

SEQ ID NO: 1371 - protein, 340 aa, unidentified
  REGION 1..340: note = Description of Unknown:uncultivated organism sequence
  REGION 1..340: note = Category: MG61 effectors
  REGION 1..340: note = Description: MG61-207 effector
MCVSRYQMLKPGGASRLIEYVTVTGRLEPLTEEDYMKLVRLAHEFRKAVVYATRMIAKGLDSNAVLGELRLMLNKAYGNSAFKLARTLIEGARAKGEDPLRIEVERLFIVSEGEASRQGNGNVRLGDPGTVRIRYPYDGSWLSFRSRFGEEYVPLVKELSELAKSKRCSYGARVVFRSGRIYLHLSVPVELYLKYFRKGKAGGDLIAGFDLNSDRINMVVMDEHGRIVDTRTAWFLKVTSPGFPRNKARVARLQAFSKLIEYAYYHGVGVAVFEGLDKVKRREFTSSPTTNRKMSRFAKRQLLTHAVIMSLRYGLKPVLVDPRGTTSSPIHLVIMKIWFR

SEQ ID NO: 1372 - protein, 370 aa, unidentified
  REGION 1..370: note = Description of Unknown:uncultivated organism sequence
  REGION 1..370: note = Category: MG61 effectors
  REGION 1..370: note = Description: MG61-208 effector
MSQCQTSSAGGVEADVVDASKLVKYVTVTGRLAPISSEDHMKLARLAHDFKRAVLMATRMVAKGVREAEVLRELRKRLNKAYADSAFKTAKAIVEGCLFNGGNPLHIEVRKLFIVSEGEASRLGNRNVKFEGTDIIKVKYPYDGSWLSLRAEFGGEQLPLVKELVDLAERRRISYRTEIVFRSGKVYLHLSIPIELYLKHLGRGRGRRGRGGLVAGIDLNSDRVCMVVVDSLGRVRDLKTKWFSELTSHGFSRGRARARRLEALSKIFEYARDHNVGVVVFEDLFKVKRRRFVKSRKANRKISKFAKRKLLQHGVVMALRRGFEVLLVEPRGTTSSEEHAKVMRELGLDKHVASAYLIALRGLHEAGARK

SEQ ID NO: 1373 - protein, 362 aa, unidentified
  REGION 1..362: note = Description of Unknown:uncultivated organism sequence
  REGION 1..362: note = Category: MG61 effectors
  REGION 1..362: note = Description: MG61-209 effector
MLYLQKPSSVEELVTHVTVIGKLVPETSEDYMKVARLAWSFRRAVELMVREIANGTSMKEATKRLYHVLPNYVYLESAYKHAKLIAEGCKFNNSNPKHIHIKKLFIISRGNKYDVGNRNVKLVSEGSFFRALIKYPWDGSWITCRAFFGEKYIPLLLELVELTKQRKDGYGSHIVFREGKVELHVSVPLNLYLKHFSLQRRRGYGLVAGLDLNSDRINMLVMDSSGRIVTLKTTWFPEVTLHGYPRNKTQDIRLKKLKELLSYARRIGVDYVILENLFMVKRRNRVRSPSGNRKITRFAKKQLLQHGLLTALKLGLTPVLISPKGTTNSREHEEVMKSRGLDRHVASAYVIAQRGLEVIKSH

SEQ ID NO: 1374 - protein, 362 aa, unidentified
  REGION 1..362: note = Description of Unknown:uncultivated organism sequence
  REGION 1..362: note = Category: MG61 effectors
  REGION 1..362: note = Description: MG61-210 effector
MTYITLTLPFNISGGVAGRLLSTAWLFKVASHRLLDVAKQTPVLLGTDVGWKNAFRRIVYDVIPNRRYADGVATLVRGIYESCRQLNVDFKSVELSDWLMFQQSELEYPARSVTLKPEYEVHVTTISYSGESYRDVIRPSIPKGLSALVGKIIEERQEYAGRVVIKDFGVRDGTIWVRGEAQVTVPVDFYYKHMARYKEPRGSLIGGVDVNVDRVNLAIVDKNGDLRDYKTFWFGEATARGYPRRSARSVIGMRIHEMLDYAYHHGVSTIALENPEVLGKLRLLWVKHGKRGHENYNYRVSVFRCRVIEMITIKTSLYAVKVKYVNPASTTNSKEHAETMERYGIDRHTSSAYLIALKAQNQ

SEQ ID NO: 1375 - protein, 366 aa, unidentified
  REGION 1..366: note = Description of Unknown:uncultivated organism sequence
  REGION 1..366: note = Category: MG61 effectors
  REGION 1..366: note = Description: MG61-211 effector
MSRCLTSSVVNGADVVRYVTVTGRLVPHTPEDFMKLIRLARDFRRAVVYATRMIVKKLDRNEVLRELRSMLNKAYGDSAYKVAKALVKGAKFNGGDPRRIEVKRLFIVNGGEASRLGNRNVRLESTDTVKVKYPHDGSWLTFRACFGEEYLPLVSELVELARARKASYGARMIFRSGRVYLHLSIPVELCLKHFRRGEARGNLAAGFDLNSDRINMVIVDRYGRIRDVKTAWFPEVTSHGFPRNKAKARRLEALAKLFEYAYYHGVGTVVFENLLAIKHRRYVRSPTANRKIAKFAKRELLQHAIVSAMKYGFKVLLIDPRGTTRSREHDETMRKHGLDSHAASAYLIALRGIEGYRKYNLRFQPT

SEQ ID NO: 1376 - protein, 362 aa, unidentified
  REGION 1..362: note = Description of Unknown:uncultivated organism sequence
  REGION 1..362: note = Category: MG61 effectors
  REGION 1..362: note = Description: MG61-212 effector
MSYITLRFPFNAGGDVAKELLSTAWLFKIATHRVLRITKQQQTLPITKIGWKTTLRKVAYDVIPNERYADGSITLVMGIYESCRELGIDFGSVELSDWLMFQQSWLEYPSRSISLKPNYEFHTTTIRYNGTTSRVVVKPTIPRSYKQLLDTIITEHVKYIGRVVIRDYGVRDNQLWVRGEVHMTVPLDVYYERMARHKRNGGKLFGGVDVNVDRINLAIINDDGELIDHRTFWFSEVTARGFPKHRAWSIIGMRIHEMLDYAYRHGVKTLFLENPEVLGRLKLMWIRNGNRKHENYNYKVSVFRSTIIEKIVLKAPLYSIKVGYVNPRGTTNSTEHDELMRKYRLDRHSTSTYLIALRGLRH

SEQ ID NO: 1377 - protein, 363 aa, unidentified
  REGION 1..363: note = Description of Unknown:uncultivated organism sequence
  REGION 1..363: note = Category: MG61 effectors
  REGION 1..363: note = Description: MG61-213 effector
MSYITITLPFNVNGREAGSLLSTAWLFKIASHRMLSLARQTPVLPATDIGWKSVFRKAVYEIIPNRRYADGVIVLVRSIYESCRQLGVDFKNVEFSDWLMFQQAEMEYPVRNITLREGYVFHITTIDYVGNIDRVVVKPTIPRGYRLLLDKVLEERVGHTARVVIKDYGIRENRLWVHGEVQLTVPMDFYYRHMIRYGQNNGRLFGGVDVNVDRINLVIVDEGGELRDVKTFWFREVTTRGYPRHRAWSVIGMRVHEMLDYAYHHGVKTLFLEDPGVLGRLKLMWIRNGRRLHENYNYRVATFRSSVIGMITMKAPLYSIEVKYVNPKGTTSSEEHDEVMRKHGLDRHTASAYIIALKGLKQP

SEQ ID NO: 1378 - protein, 364 aa, unidentified
  REGION 1..364: note = Description of Unknown:uncultivated organism sequence
  REGION 1..364: note = Category: MG61 effectors
  REGION 1..364: note = Description: MG61-214 effector
MQVQPLYTVKLLFNASGENAKKVLSTAWLFKIACHEVLNKSKQVRDVLIPSKIAWIKMFKNYAYELIPNKRYSYGVVYLIYGIWESARSLGIDYDNVELSDWMLLQHYEREVNGNVIRVYEDGSALVTTYDYDGSKDRILVRAKPNKGQAGFLRKIVELREKYMPKLIIRDYGVRKGKLYVRGEIHISISYDFYLKYVKRYNEPKGNLVGGIDVNSDRINLAVIDEEGKLRDVKTFWFQEVTTRGYPRRKAWSVIGMKVHELLKYAYHHGVSTIVLENPEVIGRLRLVWVRNGKRLHRNYNWRVTIFRNRIIEMITMKALIYGLHVNYVNPKGTTHSREHDDIMMRYGLDRHTASAYLIALKSI

SEQ ID NO: 1379 - protein, 369 aa, unidentified
  REGION 1..369: note = Description of Unknown:uncultivated organism sequence
  REGION 1..369: note = Category: MG61 effectors
  REGION 1..369: note = Description: MG61-215 effector
MSQYQTHRVRDASKLVEYVTIVGRLEPLTEEDYVKLVKLAHEFRKAVTYATRMIAKGIDSKVVLRELRSMLNKAYGDSAFKLAKAVVESARANNGNPLKIEIRRLFIVSEGEAGKQGNRNVRLDDSSKVRIRYPYDKSWLSFRARFGENYIPLVRELSELAKSRKCSYGARIVFRSGRIYLHLSVPVELYLKYFRKGEARGSLIAGFDLNSDRINMVIVDKSGVIRDVRTEWFPEATSPGYPRNKARVVRLRALTKLLSYAYHHGAGVAVFEELDKIKWRRFTSSPKANRKIAKFAKKQLLTHAVVMGLKYGLKPVLVDPRGTTSSSVHSAVMKKHGLDKHTASAYLIVLRYLQNRKTVNSYKAYKQHK

SEQ ID NO: 1380 - protein, 367 aa, unidentified
  REGION 1..367: note = Description of Unknown:uncultivated organism sequence
  REGION 1..367: note = Category: MG61 effectors
  REGION 1..367: note = Description: MG61-216 effector
MDREVREPEITHVTVAGRVVPSNSKDYMKLALLAHRFRKCLVKVVRMLAKGIDKNTIVKEITRELNLGYADTIYKMAKLIVEGAKHNKSNPLRIEIRKLFIASRGFSSNKGNRNIRLVSTEQVEVNIPKEEEDWVKFKVVFGERYIPLVRELVDKSLSKQLSYTAKIVFRDGRIYLHLSVPLELYLKHFRKGEARGDLVAGFDLNSDRVNMVIVDKLGIIRDVKTVWFPEVTSHGYPENKAHTTRLQALAKLLDYAYHHGVGVVVFEDLERIKKRRFTNNEKANRKIARFPKRRLLQHAVVMAMKYGFRVYLVNPAHTSKLGAEVGKELGLDRHTASAYIIALKYLGIAEHLRNIVYNYNYNQSIAK

SEQ ID NO: 1381 - protein, 361 aa, unidentified
  REGION 1..361: note = Description of Unknown:uncultivated organism sequence
  REGION 1..361: note = Category: MG61 effectors
  REGION 1..361: note = Description: MG61-217 effector
MDYITIKLPFNVDGDVAKELLSTAWLFRITTHRVLTIAKQQVLPATRIGWKNAFRGIAYRVIPNRRYADGAIILVMGVYESCRALGIDFRSVELSDWLMFQQSELEYPAKSITLKQNHEFHVTTVRYNGSTGRVIVKPTVPRNYRELLDAILTGRVEYMGRVVITDYGVRNNRLWVHGEVHITIPLDVYYEHMARHKKNSGKLIGGVDVNTDRINLAIIDEDGELIDHETFWFSEVTARGFPKHKAWSIIGMRVHEMLNYAYHHGVRILFLENPEVLGRLRLMWVRNGDRKHENYNHKVATFRSTIIEKITMKAPLYGIEVKYVNPRGTTNSKEHDKLMRKYGLDKHTTSAYLTALKGLKH

SEQ ID NO: 1382 - protein, 368 aa, unidentified
  REGION 1..368: note = Description of Unknown:uncultivated organism sequence
  REGION 1..368: note = Category: MG61 effectors
  REGION 1..368: note = Description: MG61-218 effector
MGDGWLSVLQSQTGNVVDAFTVVNYVTIIGKLHPASGEDYMRLVRLAWDFKNTVRITIRMIAKGVGRSNILKELRGVLNKAYADSAYKLAKAMVEGCLFNGCNPLHIEVRRPFIVSEGESSRLGNRNVRLEDTNIVKVKYPYDGSWITLRAEFGERYLPLLRELAELARRKKVSYGARIVFREGNIYLHLSIPIKLYLKYFKRGEAKGGLVGGFDLNSDRVNLVIIDVHGRIVDTRTAWFTEAVSHGFSRNRARALRLGALAKLLKYCYTHNVGVVVFENLPLIKRRRYTRSRVGNRKITLFAKRQLIQYGIVMALKYGFKTLLTNPKGTTNSKEHSEVMKKYGLDRHTASAYLTALRGLETLNENYK

SEQ ID NO: 1383 - protein, 363 aa, unidentified
  REGION 1..363: note = Description of Unknown:uncultivated organism sequence
  REGION 1..363: note = Category: MG61 effectors
  REGION 1..363: note = Description: MG61-219 effector
MTYVTLVLPFNASGDVAKRLLSTAWLFKVASHRLLSIAKQMPVPPGSDIGWKSAFRSVAYEVIPNRRYADGVVTLIRSIYESCRQLGVDFRSVELGDWLMFQQSELEYPARNITLKPGHEVHVTTVSYSGESYRDVVKPLIPRSCGMLVDKVVEERQEYTGRVVVNDFGVRGNTIRVCGEVQIIIPLSFYYKYMAKHREPKGNLIGGVDVNVDRVNLAIIDERGILRDYKTFWFKEVAARGYPRASTRSAIGARVHEMLEYAHHHGVSTIVLENPEVLGKLRLLWIKNGKRGGENYNYKVSIFRCRVIEKIALKAPLYALKVKYASPAGTTNSKEHDEAMKRHGLDRHTASAYLIALRELNPS

SEQ ID NO: 1384 - protein, 372 aa, unidentified
  REGION 1..372: note = Description of Unknown:uncultivated organism sequence
  REGION 1..372: note = Category: MG61 effectors
  REGION 1..372: note = Description: MG61-220 effector
MEPPRYVTIALDFHADSGEAKAVLSTAWLSKLVAHRVLNLVKRNELLVDLLEYRFLKTLRGKCYDILPNRRYVDGILKLIHSTLKSAKALEVNIKEIELKRWLLFQSDRERGYAKGNMNIRLIDLHHIRVLTIGYDGKTTYIELEVSVPKGWRKLIESLVDRANKGLMGYPARVIVKDYGLGKNGLHVHGEVQVMVPYELYLEVMRRYSEPRGINVAGVDVNVERIDAVVIDEYGNLVSNKTFWIKRATHMGIRRKRAWSLIGEQIHALLKWLYSQGVSIIGLENPEIIGYLRYYWIRNGERKGGKWNCKVSMFRNSIIERITWKAPLYSMKTIYVNPRNTSKEGEKIGKKLGLDRHLGSAYIIAKRALKYL

SEQ ID NO: 1385 - protein, 346 aa, unidentified
  REGION 1..346: note = Description of Unknown:uncultivated organism sequence
  REGION 1..346: note = Category: MG61 effectors
  REGION 1..346: note = Description: MG61-221 effector
MCKLCAHRLLNIVKENPLLADLSQYDFIKFGRKLCYGIIPNRRYVDGISTLLHASLQSAKALKVNITKLELKPWLLFQSEAEPWAKGNLNIQFINNDKVRVLVFDKDKSSRKITIEPVIPKGYAKLIRSLVGKALRKEVGYPARVYITDYGGRLEHLYGEIHVMVKYDLYLEVMRRYKKPLGDNIGGVDVNVDRLNLVVINRDGDIVWKHTVRFPQIASRGYRGEKAWSIIGEAIHSILKNAYSHGASVIAVENPEVIGYLRYYWIRNGERRTKNYNYKVAIFRNSIIERIMWKAPLYGLHVVAVNPKGTTHSEDHEHVMRRYGLDRHTASAYLIALKARRNIQRP

SEQ ID NO: 1386 - protein, 363 aa, unidentified
  REGION 1..363: note = Description of Unknown:uncultivated organism sequence
  REGION 1..363: note = Category: MG61 effectors
  REGION 1..363: note = Description: MG61-222 effector
MSYITLTLPFNANGLEAKRLLSTAWLFKIASHRMLSIAKQSPVLPVTDIGWKNTFRRVIYEIVPNRRYTDGVIVLVRGIYESCRQLEVAFRDVELGDWLMFQQVEREYPVRNITLKQGYEFHITTIDYNGEAERVIVKPTVPKSYKLLLNRILDEKQKHIARVVIKDYGVRRDMLWVHGEIQLTIPIDFYYKYMTRYRRNYGRLYGGVDVNVDRVNLAIVDDEGKLRDKKTFWFREVVARGFPKKKARTIIGMKVHKMLRYAYHHGVKVLFLENPSTLGKLKLLWIRNGKRLHGNYNWKVSIFRSSVIEMIVMKAPLYSMKVGYVDPRGTTNSREHDEIMRRCRLDKHTTSAYLIALKGLKQP

SEQ ID NO: 1387 - protein, 371 aa, unidentified
  REGION 1..371: note = Description of Unknown:uncultivated organism sequence
  REGION 1..371: note = Category: MG61 effectors
  REGION 1..371: note = Description: MG61-223 effector
MSYTTLVLPFNVDDVAARWLLSTSWLFKVATHRMLSLAKQFPVLPATDIGWKNTFRKTVYGVVPNRRYTDGVIVLVRDIYESCRQLGVDFREVELGDWLMFQQSEKEFPVRNITLRQNYEFWITTINYNGESKRMTIKPTIPKNCRPLLDRILEEKQKYTARVVIKDYGIRKNKLWIHGEIQVTIPIDFYYKHTARYRGNNGRLYGGVDVNTDRINLAIVDRYCRLRDVKTFWFEDATRRGYPRRKARILVGMAVHKMLRYAYHHGVRMLFLEDPSVVSRLRLLWIRNGRRLHRNYNWRVSVFRSSVMEMITMKAPLYAVKVDYVDPKGTTNSEGHNEIMKRYGVDRHTASAYLIAMKGIKRHAMIQKATT

SEQ ID NO: 1388 - protein, 1513 aa, unidentified
  REGION 1..1513: note = Description of Unknown:uncultivated organism sequence
  REGION 1..1513: note = Category: MG61 effectors
  REGION 1..1513: note = Description: MG61-224 effector
MSKRILGLDLGTNSIGWAVVDEAKEEIVNAGVRIFPEGVVSKTIGSGDKEETKNAARRRARQTRRQFYRKRLRKAKLLEVLIEQNMCPLSLDELNKWRHWDKKEKSQAKVFPNSDEFMNWIRMNPYELRARAIIGTVTAMELGRIFYHLIQRRGFLSSRKGDVKESKTLFEKGKPELNILPINRTEKEIAESGCQTMGEYLNRVVPKEGESYKPILDSDGNEIRARGRYATRKMYVEEFEAIWNAQADHLGLDKRSVLFKKVRMLKGNENSERNKKRISTLKKFYGAENVFVENRGNNLHITTTRTLPFKIFLAGDDVELKRNESVLFWQRPLRSQKGTLGNCSFEDTLPVINMDGTQRKNEKGKPVTYSKKPCPISHPLFELFRTHQFINTIEFGEKQRLSKDQKKQVLELINRKDNAFSFKEIVKKLELFSETFNYENDFKVSGNYTISKLSKLLGKKVWDEHPLACWEAFYFYDDSTKLQKKLNKAYGLNLKVEEVDKIRLKEGYSRVSIKAIQNILPFLEKGYFYSTAVILGGVKNAFGSRWDSYLQDETKDKIEDDILKMLKDKNKEGELIEKIKAYLSDSSNRYGFSENSPAFKKLYHHSQSVEKKELKNKLPPVENIRNPIVQQSLYEMRKVVNALLEKYKEEDPTFSFSSIRVEMGRDLKNGKKQRQKINQVIRKNRENNDEARERLAEFGLQPSRNNIQKYLLFKEMERRAGHVQSPYTGRTISLTDLLGKDNLIQIEHIMPFSKSLNDSFANKTLCESSVNALKGDKTPYAFYHQNSDPKIWGVSSWDEVKHRAFKLLPYAKAKRFVSDKSVDAEDFISRQLNDTRYIAKKATEILSEICSDVQVMPGQLTAELRHLWGLNNVLESSFGVTKQFSDIPLKPGEYYLVLNEQRESIQLIPKHNPKPKTNPNELLVAGEINNAIFESKKLVLELGAPDQANGKYWAKLTLKPIQKFSPKYISKPITDENRIVFKGLVKNQRFSSDSIPKNPIAEHKDGIYWGSFAVKNKRIERSTVAPITNRKEIKLFGEVKDGIFKSYIYECSTTAENGKYWLVLEPDFETPEFIQASNPEPQHSENEHIITGTIDDNGVFVSDLDPSYSVKTDHSAGKYYAVIELASKENDFYLMENPAPKVEKEHRLIEGTVWVDKYSSELKFDPKKNREDQRHHAIDAITIALTKRGYLNALSHYRAKELPEDYKPSFPEPWDGFEHDVKNAAEKILISYRKNDRIISKGKKGFSVRGQLHKENVFGKHKGKEDEKKSFYHRRKYLNDLKTNKHVSKIVDERIKQLVLDHLKNSCDVNISSEKGFKIPPNAFFTKNGKPRLFLPPNPRKKKNSQPVPIKKVRVSETIKNAQQKRLGVNQYVNPRNNHHVMIYKTQSGELKEIIVSFWDAVHRLIKGEDLYKLPKDGIEVVLVLEKNDMVLLNLSKEEFDRRKHDICLLSTNLYRVQKIYSGDESFEYVFRHHLASTLNNKNEEVMIKSFDKFRKINPKKVKVSELGEISLC

SEQ ID NO: 1389 - protein, 356 aa, unidentified
  REGION 1..356: note = Description of Unknown:uncultivated organism sequence
  REGION 1..356: note = Category: MG61 effectors
  REGION 1..356: note = Description: MG61-225 effector
MSQYQTSSIVNASTLVKYATIVGRVVPASSEDYMKLTRLAWNFRRAVQVVARIIAKGVEANDVLKELRRMLNKAYADSAFNQAKAVVRACLATGGDPRKIEIGKLFIISEGESSRMGNRNIRFEDTNIVKVKYPYDGSWIQLKARFGEKYLSPLKELVELAKQKKVSYNAKIVFRSSRIYIHVSVPIHLYLKHFKKADARGELVAGFDLNSDRINLAIIDKYGRLADAKTVWFTEITSHGFPHNKAKTTRLRALAKLLKYCYAHGVGTVVFENLYEVKKRRFTKSRNTNRKISRFAKRELLDHAIVMSLKHGFKVLLADPKGTTNSKEHDEAMRTHGLDRHTASAYLIALRGLKPP

SEQ ID NO: 1390 - protein, 365 aa, unidentified
  REGION 1..365: note = Description of Unknown:uncultivated organism sequence
  REGION 1..365: note = Category: MG61 effectors
  REGION 1..365: note = Description: MG61-226 effector
MNYITPSFPFNVNGEVAKKLLSTAWLFKIATHRMLSIAKQTPVLPATDIGWKNVFRKIIYEVIPNRRYADGVITLVRGIYESCRELEIGFREVELSNWLMFQQSEKEYPVRNITLKEGYEFRITTIDYNGNSERVVIKPTTSKNYVLLLDKILEERQKHTAKVVIKDYGVRKSRLWVHGEIQLTIPIDFYYKCMTRYKKNKGKLYGGVDVNTDRINLAIVDSEGNLRDAYTFWFRETTARGYPRRRARTVIGMRVHEMLKYAYHHGVKEVFLENPKVLGRLRLLWIRNGRRLHRNYNWKVMTFRSRIIEMITTKAPLYSISIKYVDPRGTTSSKEHDEIMKKYRLNRHTASAYIIALRGLNRKFI

SEQ ID NO: 1391 - protein, 387 aa, unidentified
  REGION 1..387: note = Description of Unknown:uncultivated organism sequence
  REGION 1..387: note = Category: MG61 effectors
  REGION 1..387: note = Description: MG61-227 effector
MELPKYITVTMDFHVNGDYARNILSTAWLSKLVAHRVLGLIKENELLADLSEYKFLKVLRSKCYDVLPNRRYVDGILKLVHSTLKSAKALKVNIKDIELKQWLLFQSDGERGYARGNMNIRFIDTQHVRALTLGYDKRTRYVELEVTTPKGWKKLIEFLINRAFDGQIGYPARVVVKDYGIGKHGLHAHGEVQVMVPYSLYLEVMRRYDKPRGSNIAGIDVNVERLDAVVVDEYGNLVSYRTFWMKNTTFMGVRRKRSWSLIGEQIHTLLKWLYSQGVSIIGLENPEIIGHLRYYWIRNGERRDRKWNWKVSMFRNSIIERMTWKAPLYSMKVTYVDPKNTSKEGEKIGKKLGLDKHLGSAYIIAKRTLKHLQKLKTYKEKTVAQLS

SEQ ID NO: 1392 - protein, 364 aa, unidentified
  REGION 1..364: note = Description of Unknown:uncultivated organism sequence
  REGION 1..364: note = Category: MG61 effectors
  REGION 1..364: note = Description: MG61-228 effector
MVENPLYTIKLSFNASGDRAKKILSTAWLFKLACHRVLSRSKELLNALIPSKIAWVKMFYSDARDLIPNKRYAYGGIYLVYGIWEGARELGIDYRSIELSDWLMFQHYDREVDGNVIRILEDGSALVTTYSYDGSKDRVLIKSKPNRGHGELLKLVVESKEKYMPRVVVRGYNVRSGKLYVSGEIHVTIGYDFYLKHATRYGEPRGSLIGGVDVNSDRINRAIVDEKGNLRDCKTFWFSETTARGCPRRKAWSIIGMKIHEMLRYAYEHGVSTIALENPEALGYLKFAWVREGDRKHENYNYKIAVFRNSIIERIAMKAPLYWLDVKFVDPRGTTSSREHDEIMKRLGLDRHTASAYIIVLRSI

SEQ ID NO: 1393 - protein, 370 aa, unidentified
  REGION 1..370: note = Description of Unknown:uncultivated organism sequence
  REGION 1..370: note = Category: MG61 effectors
  REGION 1..370: note = Description: MG61-229 effector
MDYLTIKLPFNVDGDVAKGLLSTAWLFRVAAHRVLALARQQESLPGSRIGWKNMFRQFAYGVVPNRRYADGAVTLVMSIYESCRELGVDFKGVELSNWLMFQQSELEYPAKSITLKQNHGFHVTTVRFNGSISRVVIKPTVSRSYRELLNAVLFERVKYMGRVVVRDYGVRNNQLWVHGEVQVTVPMDVYYEHMARHRRNAGRLFGGVDVNTDRINLAIIDEEGELRDTHTFWFSEASARGFPMHKAWGIIGMRIHELLDYAYNHGVKTLFLENPEILGRLKLMWVRGGDRRHENYNHKVSVFRSSIIERIALKAPLYSIETKYVSPRGSTNSEEHDELMRKYRLDRHTASAYLIALRGLITNGNKYYYD

SEQ ID NO: 1394 - protein, 351 aa, unidentified
  REGION 1..351: note = Description of Unknown:uncultivated organism sequence
  REGION 1..351: note = Category: MG61 effectors
  REGION 1..351: note = Description: MG61-230 effector
MRKLAEYATIQGLLLPETPEDHLRLIRLAYEFRRAVTYATRMIARGVGERAALRELRSMLNKAYGDSAYKVAKMLVRSCASNGGDPRRIKIRKLFIISGGEASRKGNRNIRLGCGYVLIKYPFDGSWLKFRCCFGKYSGLIEELAQLATEKKVSYGARIVFRRGRIYLHLSVPVELYLKHFRRGRASGSHVAGFDFNSDRINMVIVDEYGKIRDARTEWFPEVTSHGYPRSKARARRLEALARLLDYAYHHGVGVVAFENLFLVKRGEFTGCARANRKISKFAKRQLIQHAILMARKYGFKVILVDPKGTTKSREHDEAMRRHGLDRHAASAYLVALRGIERCTTKQNAIV

SEQ ID NO: 1395 - protein, 363 aa, unidentified
  REGION 1..363: note = Description of Unknown:uncultivated organism sequence
  REGION 1..363: note = Category: MG61 effectors
  REGION 1..363: note = Description: MG61-231 effector
MSVQRLSSNTVDGVISHVTIIGKLIPETPEDYMKLARLAWSFKRAVELMVREVANGTPMKVATKKLYSLIPNYVYLESAYKHAKLVVEGCRFNNGNPRHVHIKKLFIVSRGNKWDKGNRNIKVIPRHDYFEVLIKYPWGGSWTKCRVFFGEKYIPLLRELVELSEKRIEGYGARIVFRNRRLELHLSVPLSLYLKYFSLPKRRGYELVAGIDLNSDRINMVVIDPNARIITMKTAWFPEVTLHGFPRDRARDIRLKKLKKLLSYARRIGVDYVVFENLFVVKKRGKAPSPSGNRRITRFAKKQLLQHGLLMVLKFGLTPILVDPRGTTHSREHREVMRKRGLDRHMASAYIIAFKGLKIIKNH

SEQ ID NO: 1396 - protein, 379 aa, unidentified
  REGION 1..379: note = Description of Unknown:uncultivated organism sequence
  REGION 1..379: note = Category: MG61 effectors
  REGION 1..379: note = Description: MG61-232 effector
MSLDVTKSLPEYLTVDLPFTVKGDHAKLIWFTSWLSKPCARRLLGDVKDDDLLVDLSQTSFLKYARKRCYGILPNRRYVDGVATLMHSTLKSARKLGINIESIELKQWLLFQSEAEKEKKGNLNIRLISANKAEILVFNHRRETEKIVVRLRIPKGYRKVLETLVEKALNKEIGYPARIVIKEYNFYPSNLHLYCSLQVMIPYSIYLETMKKYDKPLRDHVAGVDVNVDRLNLTIVDKYGRLRDTKTFWLREITSRGYRRKQAWTKIHQAIHAMLDYAYHHGVSVVALENPEIIGYLRYYWIRNSYRKTKNYNYKVAVFRNRIIEVVTYKAPLYSLKTIYVNPKGTSHSKEHDETMRKYGLDRHSASAYLIALKGLNLP

SEQ ID NO: 1397 - protein, 392 aa, unidentified
  REGION 1..392: note = Description of Unknown:uncultivated organism sequence
  REGION 1..392: note = Category: MG61 effectors
  REGION 1..392: note = Description: MG61-233 effector
MDYLTIRLPFDANGDVVKELLSTAWLFKIAAHRVLAVAKQMQVLPGTRIGWKNTFRDIAYGVIPNRRYADGAVTLVMGVYESCRTLGVDFRGVELGDWLMFQQSELEHPSRNITLKPNYEFHITTIRYNGTTSRVVVKPTIPRSYGELLDAGLTGRVGYIGRVVVRDYGVRGVHGEVQVTIPLDFYYEHMSRHKRNSGRFVGGVDVNADRINLAIIDSVGRLIDHKTFWFSETSRKGYSGHSAWSIIGMRIHETLNYAYHHGVKTLFLENPEILGRLKLMWVRSGDMGHGNYNHKVATFRSTIIEKIALKTPLYGIEVSYVNPRGTTNSIEHDKLMRKYRLDKHTASAYLTALKGLNTNENEQPQITMKTETVQRGLRPCIMCLMVTLTTSQ

SEQ ID NO: 1398 - protein, 364 aa, unidentified
  REGION 1..364: note = Description of Unknown:uncultivated organism sequence
  REGION 1..364: note = Category: MG61 effectors
  REGION 1..364: note = Description: MG61-234 effector
MSHYQTNEVIDGKSLVFHVTIIGKLAPQTPNDFMKLVRLAYDFRKAVLYATRMISKGMKANEFLKELRGMLNKGYGDSACKVAESIVEGCKFNGGNPQHIKVKKLFIASEGETSRFGNRNVRLEATDKVKIKYPYDRTWLFFKAQFGKDYLPLVQEIVKLAKEKKMSYGARIVFRDGRIYSHLSIPVDLYLKYFSKGSANGSLTAGFDLNADRINMVVVDKFGRIRDVKTEWFPEVTSHGFPRSKAKIKRLEALARLLDYAYHHNVGVVVFENLFIIKRRKFTKNSSANRKMSRFAKKELLQYGIIMARKYGFKVLLINPKGTTHSKEHGEVMRKYGLDRHTASAYLIALRGIESHNLIRKAII

SEQ ID NO: 1399 - protein, 370 aa, unidentified
  REGION 1..370: note = Description of Unknown:uncultivated organism sequence
  REGION 1..370: note = Category: MG61 effectors
  REGION 1..370: note = Description: MG61-235 effector
MDYITLKLPFNADGDAARELLSTAWLFKIATHRVLGVARQQALPGSRIGWKNMFRKIAYGIIPNERYADGVITLVMGVYESCRELSIDFRGVELSDWLMFQQSSLEYPSRNTTLKPNYEFHVTTVRFDGSTGRVVVKPTIPKIYKALLDAVLFEHVKYMGRVVVTDYGVRSNQLWVRGEVHMTVPMDVYYERMARHKKNSGKLIGGVDVNTDRFNLAIIDKEGRLIDHRTFWFSEATARGFPKHSAWSIIGVRIHEMLNYAYHHGVKTLFLENPEVLGRLRLMWIRSGDRNHENYNHKVSIFRSSIIERIAMKAPLYSIETKYVNPRGTTNSKEHDETMKKHGLDKHTTSAYLTALRGLGINKHVHYKQS

SEQ ID NO: 1400 - protein, 364 aa, unidentified
  REGION 1..364: note = Description of Unknown:uncultivated organism sequence
  REGION 1..364: note = Category: MG61 effectors
  REGION 1..364: note = Description: MG61-236 effector
MVENTLYTIKFTFNVGGDRAKKILSTAWLFKLACHRVLSRSKELLNALIPSKIAWVKMFYSDARDLIPNKRYAYGAIYLIYGIWESSRSLKIDHRNVELSNWLMFQHYDREVDGNVIRVLGDDTILVTTYSYDGSKDRVLIKAKPNRGHGELLKLVVESKEKYMPRVVVRGYNVRNGKPYVSGEIHVTIGYDFYLKHMTRHREPKGSLIGGVDVNADRINLAIVDEKGNLRDSKTFWFTEVVARGYPRRRAWSVIGMRIHEMLRYAYSHGVATIALETPEVLGYLRLAWVRDGGRKHENYNYKKAIFRSSVIERIAMKAPLYGLNAKLVDPKGTTSSREHDEIMKRSGLDRHTASAYLIALRSI

SEQ ID NO: 1401 - protein, 370 aa, unidentified
  REGION 1..370: note = Description of Unknown:uncultivated organism sequence
  REGION 1..370: note = Category: MG61 effectors
  REGION 1..370: note = Description: MG61-237 effector
MAGEVREPEITHATIIGRVVPLDNEGYMELVLLAYRFRKALVKAIKMYTKGIDRNTIVKEITKELNLGYADTIYKLAKLIVKGIRHNESNPLKIKIRKLFIASRGFASNKGNRNIRLLSTNELQVNIPWKGWVKFKVVFGKRYIPLVNELIEKALSKQLSYSGKIVFRDGKPHLHVSVPIELYLKYFSKGRANGKLVAGFDLNSDRINMVIVDIQGIIRDTKTEWFPEATSHGFSKNKAHTMRLQALARLLNYAYRHGVGIVLFEDLARIKKRRYTKSKTANRKITRFPKRKLLQHGIVMAMKYGFRVYLVNPAYTSKIGEKLGKELGLDKHTASAYILALKYLGVANLISGSSSIQKKPEYHYLLNSLV

SEQ ID NO: 1402 - protein, 371 aa, unidentified
  REGION 1..371: note = Description of Unknown:uncultivated organism sequence
  REGION 1..371: note = Category: MG61 effectors
  REGION 1..371: note = Description: MG61-238 effector
MSYITLTLPFNIDGGEARKLLSTAWLFKIASHRMLSLAKQIPVLPVTDIGWKNTFRKVIYEVIPNRRYTDGVIVLVRSIYESCRQLGVNFKDVELGDWLMFQQVEKEYPVRNITLKQGYEFHITTIDFNGNSDRIVVKPSIPENYRLLLDGILEEKQKHTARVVIKDYGVRKNKLWVHGEVQLTIPLDFYYKYMVRYRRNYGRLYGGVDVNVDRINLAIIDRYGRLRDVKTFWFEDVTRRGYSKRKARILIGMAVHGMLQYAYHHGVKTLFLENPSILSRLRLIWIRNGRRLHRNYNWKISVFRSSVIETISMKAPLYSINTEYIDPKGTTHSKKHDEVMKKYGLDRHTASAYLIALKGIKGYRMIQKATD

SEQ ID NO: 1403 - protein, 364 aa, unidentified
  REGION 1..364: note = Description of Unknown:uncultivated organism sequence
  REGION 1..364: note = Category: MG61 effectors
  REGION 1..364: note = Description: MG61-239 effector
MLHYQTNEVINAETLISHVTITGKLIPQTPSDFMKLVRLAYDFRKAVLYATRMISKSMKANELLKELRGMLNKGYGDSAYKVAKSIVEGCRFNGGNPQHIKVKKLFIVGEGEAVRFGNRNVRLEATDRVKIKYPYNRTWLFFKIQYGKDYLPLVQEIVKLAKEKKISYSARIVFRDGRMYLHLSIPVDSYLKYFSKGSANGSLTAGFDLNADRINMVIVDKFGRIRDVKTEWFPEVTSHGYPRSKAKIKRLEALAKLLKYAYHHNVSVVVFENLFIIKRRKFTRNSTANRKISRFAKKELLQYGIIMAMKWGFKVLLIDPKETTSSKQHSIVMKKYGLDKHTASAHLIALKGIERHSLIQKATT

SEQ ID NO: 1404 - protein, 398 aa, unidentified
  REGION 1..398: note = Description of Unknown:uncultivated organism sequence
  REGION 1..398: note = Category: MG61 effectors
  REGION 1..398: note = Description: MG61-240 effector
MPFLSRWQRLGASAIYLSTVSLGPLTVVALGSLTIKLPFNVDGDTAKELLSTAWLFKIATHRVLAVVKQQQILPGSRIGWKNAFRRIAYEIIPNRRYADGAVTLVMGVYESCRALDVDFKSVELGDWLMFQQSELEYPAKSITLKPGYEFNITTIRYNGATGRVVLKPTIPKIYKALLDAIITRRVGYMSRVVVTDYGVRSNQLWVRGEVHVTIPLDLYYERMARHKKNSGKLIGGVDVNADRINLAIIDEDGELIDHKTFWFSEASRKGFSRHKAWSIIGMRIHEMLNYAYHHGVRALFLENPGVLGRLKLVWIKNGDRGRENYNHKVSIFRSTIIEKIALKAPLYSIETKYVNPRGTTNSTEHDETMRKHRLDRHTASAYLIALKGLTPMNTSNRK

SEQ ID NO: 1405 - protein, 363 aa, unidentified
  REGION 1..363: note = Description of Unknown:uncultivated organism sequence
  REGION 1..363: note = Category: MG61 effectors
  REGION 1..363: note = Description: MG61-241 effector
MSYITLCLPFNVDGVEAKKLLSTAWLFKVASHRMLSIVKQSPIPPVTDIGWKNTFRKVIYDVIPNRRYTDGVIVLVRGIYESCRQLGIDFKSVELGDWLMFQQVEKEYPVRNITLKQGYEFHITTIDCNGNSDRIVIKPSIPKKYRVLLDKILEEKQKHTARVAIKDYGVRKGMLWIHGEIQLTIPLNFYHKYMIKYRRNYGKLYSGVDVNSDRINLVIVDGEGNLRDTYTFWFREVTARGYPRRRARSVIGMKIHEMLKYAYHHGVRELFLENPEVLGRLKLLWVRNGKRLHKNYNWKVATFRSSVIEMIAMKAPLYSIDVKYVDPRGTTHSKEHVEIMRKHRLDKHTSSAYMTALKGLKQP

SEQ ID NO: 1406 - protein, 369 aa, unidentified
  REGION 1..369: note = Description of Unknown:uncultivated organism sequence
  REGION 1..369: note = Category: MG61 effectors
  REGION 1..369: note = Description: MG61-242 effector
MPVDYITLRFPFNASGSTAGELLSTAWWFKIATHRLLNVLKQQQTLPITTIGWVNTFKDIVYGIIPNYRYATGVITLMMGIYESCRKLGIDFKRVELSDWLMFQQGYLEYSVKSITLKTNYKFHITTIKYDGSISRVVINPTIPENYEKLLSVIITKQIKHTGRVVIDRFGVRNNQLWIHGEVQVTIPLDIYYEHMARHKRNNGKLIGGVDVNTDRINLAIVDENGGLRNYKTFWFSETIARGFPKDKARIIIGSKIHEMLDYAYNNGVKTLFLEDPEVLGRLKLMWVRSGDRKHENYNYKVMVFRSSIIERIALKAPLYSIEVKYVNPGGTTNSEEHKDIMRRYGLDKHTASAYLIAIRGLGLSPRAV

SEQ ID NO: 1407 - protein, 314 aa, unidentified
  REGION 1..314: note = Description of Unknown:uncultivated organism sequence
  REGION 1..314: note = Category: MG61 effectors
  REGION 1..314: note = Description: MG61-243 effector
MSMFRSIAYGIVPNRRYADGAVTLVMGVYESCRALGVDFRGVGLSGWLMFQQSELEYPAKSITLRRGYEFHITTIRFDGSTSRVVIKPTIPRNYKGLLDAVLTRHVEYMGRVVVRDYGVRNNQLWVHGEVHMTVPLDIYYEHMSRHKRNGGKLFGGVDVNTDRINLAIIDEEGGLRDYKTFWFSEVTARGFPRQKAWRIIGMRIQELLNYAYNNGVKTLFLENPEVLGRLKLMWVRNGDRKHENYNYKVSVFRSSIIERITMKAPLYSIETKYVNPKGTTNSTEHDELMKKYGLDRHTASAYLIALRGLTHQQK

SEQ ID NO: 1408 - protein, 329 aa, unidentified
  REGION 1..329: note = Description of Unknown:uncultivated organism sequence
  REGION 1..329: note = Category: MG61 effectors
  REGION 1..329: note = Description: MG61-244 effector
MAKQQQVLPGDKIGWVSMFREVAYGIVPNRRYADGAVTLVMGVYESCRALGVDFRSVELTDWLMFQQSGLEYPAKSITLRRGYEFHITTIKYDGSIGRVVVKPTVSEGYRELIDAIYRERIKYMGRVVIGDYGVRNNQLWVHGEVQVTVPLDVYYEHMARHRRNAGKLIGGVDVNTDRINLAIVDEEGGLRDYKTFWFSEVTTRGFPKHKAWSIIGMRIHEMLNYAYNNGVKTLFLENPEVLGRLRLVWIRNGDRKHENYNYKVSVFRSSIIEKIVLKAPLYSIETKYVNPKGTTNSTEHDEAMRKYGLDRHTASAYLIAIRGLTHQQK

SEQ ID NO: 1409 - protein, 364 aa, unidentified
  REGION 1..364: note = Description of Unknown:uncultivated organism sequence
  REGION 1..364: note = Category: MG61 effectors
  REGION 1..364: note = Description: MG61-245 effector
MLQYQISDVVDASKLVTHTTVIGKLIPTSPEDYMKLVKLAYDFRRAVLYATRVISKGMKTNDILRELRSMLNKAYGDSAYKVAKTIVEGCRFNGGESHHIKIRRLFIVSEGEASRLGNRNVRLESTDVVKVRYPYDKSWIVLKVHFGRKYLPLAREVSELAKQRRVSYGARIVFKDGRIYLHLSVPINLYLKYFSKGKAHGELVAGFDLNSDRVNMVIIDRYGKIRDVKTERFSEVTSHGYPRSKAKARRLEALAKLLKYAYHHNVGTIDLENLFVIKKREYTRNPTANRKITRFAKKELLRHGILMAMKYGFKVLLVNPKGTTRSKEHDEVMRKYGLDRHTASAYVIALRGIESHNLMRKAII

SEQ ID NO: 1410 - protein, 370 aa, unidentified
  REGION 1..370: note = Description of Unknown:uncultivated organism sequence
  REGION 1..370: note = Category: MG61 effectors
  REGION 1..370: note = Description: MG61-246 effector
MDYLTIKLPFNVDGDVAKGLLSTAWLFRVAAHRVLALARQQESLPGSRIGWKNMFRQFAYGVVPNRRYADGAVTLVMSIYESCRELGVDFKGVELSNWLMFQQSELEYPAKSITLKQNHGFHVTTVRFNGSISRVVIKPTVSRSYRELLNAVLFERVKYMGRVVVRDYGVRNNQLWVHGEVQVTVPMDVYYEHMARHRRNAGRLFGGVDVNTDRINLAIIDEEGELRDTHTFWFSEASARGFPMHKAWGIIGMRIHELLDYAYNHGVKTLFLENPEILGKLRLMWIKNGDRKHENYNHKVSVFRSSIIERIALKAPLYSIETKYVNPKGTTNSKEHDELMRKYRLDRHTASAYLIALRGLITNGNKYYYD

SEQ ID NO: 1411 - protein, 363 aa, unidentified
  REGION 1..363: note = Description of Unknown:uncultivated organism sequence
  REGION 1..363: note = Category: MG61 effectors
  REGION 1..363: note = Description: MG61-247 effector
MSYVTVTAGFNTSGEKAKLLLSTAWRFKIAAHRVFTHAKAMPILPATKIAWKSTFREVARSAIPNRRYADSAIILVMGIYEACRELGIDFRDVELGEWLMFQQSEKEWPPRNITLKRLDEVWVTTFDYDGTSRRIRLTVSTSGIFRKLLKALLDEKQPYNPRIYIKSWNMRQGTLYVRGQLQVAIPYSFYVAHAARYRRNRGSLYAGVDVNTDRINLAIVDSKGWLRNVKTFWFREVTARGYPRHRARSVIGMRVHEMLKHAYHNGVKTLFLEDPGVLGRLKFLWIRGGKRKSRNYNYKVSVFRSSTIEMIAMKAPLYAINTRYVSPRGTTNSEEHDEVMRRYGLDKHTASAYIVALRGLGYA

SEQ ID NO: 1412 - protein, 374 aa, unidentified
  REGION 1..374: note = Description of Unknown:uncultivated organism sequence
  REGION 1..374: note = Category: MG61 effectors
  REGION 1..374: note = Description: MG61-248 effector
MNEIEYVTLRLPFHAVGEGAKLIYWTAWLSKLCAHRLLDQVKQNPLLASLSQYEFVKMGRSLCYGVLPNRRYVDGVSTIIHASLQSAKALKIDVTKLELKPWLLFQSEAEPRAKGNLNMQFADYSTVKVLVFDKDGTSRKIAIRPVVPKGYAKLVKVLVDKALRREIGYPARIYVRDYGDGLAHLYGELQVMVKYDLYLEVMRRHGKPLGENIAGVDVNVDRLNLVVVNRDGDIVWTHTARFPQVTARGFPRKKAWSIIGEAVHSVLENAYSHGASVLAVESPEVIGYLKYYWIRNGNRGSRSYNYRVSIFRNAIIERLVWKAPLYGLKVVPISPRGTTRSKDHDYVMRRYGLDRHTASAYLIALKTRNIVRTY

SEQ ID NO: 1413 - protein, 366 aa, unidentified
  REGION 1..366: note = Description of Unknown:uncultivated organism sequence
  REGION 1..366: note = Category: MG61 effectors
  REGION 1..366: note = Description: MG61-249 effector
MLQYQINSKGVIDATKLVSHVTIVGKLVPISNEDYMKLVRLAHDFRKAVTYATRMIAKKHPTNNILRELRAVLNKAYGDSAYKIAKTLVEGAKFNGSSPRRIKVRKLFIISEGEASRFGNRNVRLEDIDMAKIRYPYNGTWLNFKVLFGTKHIPLVKELVELAKARKVSYGARIVFRNGSIYLHLSIPVHLYLKYFKKRYANGKLVAGFDLNSDRVNMVIVDRYGRIRDMKTAWFPEITSHGFPKNKAKAKRLEALAKLLKYAYYHDVGTVVFENLLMIKHRKYTRSPTANRKISRFAKKELLQHAIISAMKYGFKILLVNPRGTTRSKEHDKAMRKYGLDRHTASAYLIAVKSIEGRTMIQKTIT

SEQ ID NO: 1414 - protein, 364 aa, unidentified
  REGION 1..364: note = Description of Unknown:uncultivated organism sequence
  REGION 1..364: note = Category: MG61 effectors
  REGION 1..364: note = Description: MG61-250 effector
MLQYQTSEIVDASSLVSHATVIGRLIPFSPNDFMKLARLARDFRKAVLYATRMIGKGMEANKVLRELRVMLNKAYGDSAYKVAKAIVEGCKFNRGNPRHIKIRKLFIVSEGETLRFGNRNVRFESTDKVKVKYPYDKSWLLFKAQFGEDYIPLVQEVVKLAREKKLSYGTRIVFKNGRIYLHVSIPIDLYLQYFSKGEADGGLIAGFDINADRINMVIVDRYGRIRDIKTEWFPEVTSHGFPRSKARTRRLEALTKLLRYAYCHNVGIVVFENLLTIKRKKFTRNPTANRKITRFAKRELMQYGILMSMKYGFKVLLIDPRGTTRSKEHDDVMKRYGLDKHIASAYMIALRGMKRHSLLQKATV

SEQ ID NO: 1415 - protein, 381 aa, unidentified
  REGION 1..381: note = Description of Unknown:uncultivated organism sequence
  REGION 1..381: note = Category: MG61 effectors
  REGION 1..381: note = Description: MG61-251 effector
MSLPDYLTIIIPFTVTRGRAKLFWWTAWLSKLCAHRLLSDVKNNSMLIDLSQASFLKYARKRCYDILPNRRYIDGIATLIHSTLKSIRKLGINVKDIELKQWLLFQSEAEREKKGNLNIRLVTIHEAEILVFNHMKEPEKITIKLRTPKGYRKILETLIEKALNKEIGYPARIVVKEHNFYPNNLHLYRSLQVMIPYNLYLETMRKYNKPLGDHVAGVDVNTDRLNLAIVDKYSKLRDIKTFWFREITSRGYRRKPAWTKIHQAIHNMLDYAYNHGASHIALENSEIIGYLRYYWIRNGERKTKNYNYKISIFRNKVIEVITYKAPLYSLKTIHVNPKGTTRSEEHDEVMRRYGLDRHTASAYLIALRGIKRHTMIQKARI

SEQ ID NO: 1416 - protein, 360 aa, unidentified
  REGION 1..360: note = Description of Unknown:uncultivated organism sequence
  REGION 1..360: note = Category: MG61 effectors
  REGION 1..360: note = Description: MG61-252 effector
MSRCLTSSVVDASKLIEYVTVTGKLIPASSEDHVKLARLAWSFRRAVQLAVKMIAKGVKASDALRELRRTLNKAYADSAFKAAKAIVEGCMANGGDPLRVEVRRLFIISGGESSRLGNRNVRLEDVGSVRVKYPYDGSWIALRARFGEEYLSLLRELVELAKQKKASYNAKIVFRGGGIYVHVSVPIQLFLKHFKKGEARGGLIAGLDLNSDRINLAIIDERGRLVDVRTARFPETTSHGFPRSKARAMRLGALAKLLGYCYYHGVGTVAFEDLFEVKGRRFAKSKTANRKMSRFAKRELLQHAITMSLKYGLRVLLVDPKGTTSSREHDEVMKSHGLDRHAASAYLIALKALNQSEQMK

SEQ ID NO: 1417 - protein, 363 aa, unidentified
  REGION 1..363: note = Description of Unknown:uncultivated organism sequence
  REGION 1..363: note = Category: MG61 effectors
  REGION 1..363: note = Description: MG61-253 effector
MSYITITAGFSASGEEAKLLLSTAWLFKVATHRVLSYAKSMPLLPASKISWKNTFRKIAYEVIPNRRYADSAVVLVMGIYESCRELGVDFKDVELGDWLMFQQSEKEYPPRNITLKSVNEAWITVFSYDGRSERIKLRVSTSGTYRRLLEALLQEKQEYNPRIYIKSWNVRNGKLYVNGELQIAIPLDFYYKHVARFKVNNGKLYGGVDVNVDRINLAIIDAKGNLRDTYTFWFREVTSRGYPRHRARSVIGMRIHEMLKYAYHNGVKTLFLESPEVLGKLKLTWIRSGNRKSGNYNWKKTVFRSSVIEMVAMKAPLYAINVKYVNPRGTTNSEEHDEVMKRCGLDRHTASAYLIALKGLKQT

SEQ ID NO: 1418 - protein, 370 aa, unidentified
  REGION 1..370: note = Description of Unknown:uncultivated organism sequence
  REGION 1..370: note = Category: MG61 effectors
  REGION 1..370: note = Description: MG61-254 effector
MNEVEYVTLRLPFHAVGEGAKLIYWTAWLSKLCAHRLLDQVKQNPLLASLSQYEFVKMGRSLCYGVLPNRRYVDGVSTIIHASLQSAKALKIDVTKLELKPWLLFQSEAEPRAKGNLNIQFADYSTVKALVFDKDGTSRKITIRPVVPKGYTKLVKVLVDKALRREIGYPARIYVRDYGDGLAHLYGELQVMVKYDLYLEVMRRHGKPLGENIAGVDVNVDRLNLVVVNRDGDIVWTHTVRFPQVTARGFPRKKAWSIIGEAVHSVLENAYSHGASVLAVESPEVIGYLKYYWIRNGNRGSRSYNYRVSIFRNAIIERLVWKAPLYGLKVVPISPRGTTRSKDHDYVMRRYGLDRHTASAYLIALKTRKL

SEQ ID NO: 1419 - protein, 281 aa, unidentified
  REGION 1..281: note = Description of Unknown:uncultivated organism sequence
  REGION 1..281: note = Category: MG61 effectors
  REGION 1..281: note = Description: MG61-255 effector
MAKEVREPELTHVTITGRVVPLNNESYMELVLLAYRFRKSLTKAIKMYAKGVSRNTIVKEITKELNLGYADTIYKLAKLIVEGVKHNGSNPLKIRVRKLFIASRGFSSNKGNRNIRLLSTNELQVNIPWRGWIKYKAVFGGRYIPLVKELVKRALSKELSYTVKITFRDDKVYLHVSVPMGLYLKYFSKGKADGNLIAGFDLNSDRVNMVIVDRYGIIRDVKTEWFPEVTSHGFLRNKACTLRFQALAKLLKYAYYHGVGVVLFEDLSRIKKRRYTKKQDS

SEQ ID NO: 1420 - protein, 373 aa, unidentified
  REGION 1..373: note = Description of Unknown:uncultivated organism sequence
  REGION 1..373: note = Category: MG61 effectors
  REGION 1..373: note = Description: MG61-256 effector
MSETYLTLRLPFNACESEARLLLATARLFRHVALHLHRVILEEMPQITSLITLKRMYRRRLLEIMPNRRYVDGAITLVYSIYESAQALGVSLSEIEFKSWLLFQQSEKEYPCRNITLQKDFSFRITAISYGGESVRIQVKPTIPKKYVPILDKILEKRQPYVARVVLKGFGERKNILWVHGEIHLSVPYSFILEHFRVHKRNYGKLCGGVDVNVDRINLAIIDKYGRLRDVKTFWFEEASWKGCPKQKAWSIIGTAIHDMLKYAFHHGVETLFLENPEALGYLKTLWIRRGERKSNNYNYRVQVFRTRLVERIAMKAPLYAIDVKYVSPRGTTSSEEHDEVMKRCGLDRHSASACMIALRGREKHILTQKGII

SEQ ID NO: 1421 - protein, 365 aa, unidentified
  REGION 1..365: note = Description of Unknown:uncultivated organism sequence
  REGION 1..365: note = Category: MG61 effectors
  REGION 1..365: note = Description: MG61-257 effector
MSQCQTSEMSKTEVVSASEFVKYVTITGKLVPISIEDHMKLARLAHYFKRAVLMATRMVAKGVREAEVLRELRKRLNKAYADSAFKTAKAIVEGCSFNGGNPLHIEVRKLFIVSEGEASRLGNRNVKFESTDVIKVKYPHDGSWSLLRAEFGEKYLPLVRDLVDLAERRRISYRAKIVFRSGKVYLHLSIPIELYLKHLGKERSKGELVAGVDLNSDRICMVVVDSLGRVRDVKTEWFSELALHGFSRGRARARRLEALSKLLEYARNHNVGIVVFEDLFKIKRRRFVKSRRANRKISKFAKRELLQHGVVMALRRGFEVSLVEPRGTTSSEEHVKVMRELGLDRHVASAYLIALRRLHEASARK

SEQ ID NO: 1422 - protein, 369 aa, unidentified
  REGION 1..369: note = Description of Unknown:uncultivated organism sequence
  REGION 1..369: note = Category: MG61 effectors
  REGION 1..369: note = Description: MG61-258 effector
MSQYQTHRVRDASKLVEYVTIVGRLEPLTEEDYVKLVKLAHEFRKAVTYATRMIAKGIDSKVVLRELRSMLNKAYGDSAFKLAKAVVESARANNGNPLKIEIRRLFIVSEGEAGKQGNRNVRLDDSSKVRIRYPYDKSWLSFRARFGENYIPLVRELSELAKSRKCSYGARIVFRSGRIYLHLSVPVELYLKYFRKGEARGSLIAGFDLNSDRINMVIVDKSGVVRDVRTEWFPEATSPGYPRNKARVVRLRALTKLLSYAYHHGAGVAVFEELDKIKWRRFTSSPKANRKIAKFAKKQLLTHAVVMGLKYGLKPVLVDPRGTTSSSVHSAVMKKHGLDKHTASAYLIVLRYLQNRKTVNSYKAYKQHK

SEQ ID NO: 1423 - protein, 364 aa, unidentified
  REGION 1..364: note = Description of Unknown:uncultivated organism sequence
  REGION 1..364: note = Category: MG61 effectors
  REGION 1..364: note = Description: MG61-259 effector
MQEQLLYTLKMSFNASGEEARKILSTAWLFKIACHRVLNKSKQVRDVLIPSKIAWIKMFKSHAYELIPNKRYSYGAVYLVYGVWESCRRLNIDYNVVELSDWLLFRHYEREINGNVIRVYEDSSALVTTYDYSGSKDRILVRAKPNEGQSELLKKIIGSREKYMPKLIIRDYGVRSGTLYIRGEIHIAVSYNFYLKHMKKYNEPKGNLIGGVDVNTDRINLAIVDRDGKLRDVKTFWFSEETARGYPRRRAWSVIGMKVHELLKYAYHHGVSTIALENPEVIGRLRLAWVKNGKRLHRNYNWKVTIFRNRIIEMISMKTPIYGLNVKYVDPKGTSSSREHEEVMKKYGLDRHKASAYLIALKSI

SEQ ID NO: 1424 - protein, 371 aa, unidentified
  REGION 1..371: note = Description of Unknown:uncultivated organism sequence
  REGION 1..371: note = Category: MG61 effectors
  REGION 1..371: note = Description: MG61-260 effector
MSYTTLVLPFNVDDVAARWLLSTSWLFKVATHRMLSLAKQFPVLPATDIGWKNTFRKTVYGVVPNRRYTDGVIVLVRDIYESCRQLGVDFREVELGDWLMFQQSEKEFPVRNITLRQNYEFWITTINYNGESKRMTIKPTIPKNCRPLLDRILEEKQKYTARVVIKDYGIRKDKLWIHGEIQVTIPIGFYYKHTARYRGNNGRLYGGVDVNTDRINLAIVDRYCRLRDVKTFWFEDATRRGYPRRKARILVGMAVHKMLRYAYHHGVRMLFLEDPSVVSRLRLLWIRNGRRLHRNYNWRVSVFRSSVIEMIAMKAPLYAVKVDYVDPKGTTNSEGHNEIMKRYGVDRHTASAYLIAMKGIKRHAMIQKATT

SEQ ID NO: 1425 - protein, 359 aa, unidentified
  REGION 1..359: note = Description of Unknown:uncultivated organism sequence
  REGION 1..359: note = Category: MG61 effectors
  REGION 1..359: note = Description: MG61-261 effector
MSQYQTSSTVDDASTLVEYATITGRVIPASSEDYMKLAKLAWGFRRAVQVATRMIAKGVVSDDVLKELRRMLNKAYADSAFKIAKAIARGCIASGGDPLHVEVRKLFIVSEGESSRLGNRNVRFEGTNLVKVKYPYDGSWIQLRAKFGEKYLPLLRELVELAKQKKASYNARILFRDAKIYLHLSVPIQLYLKYFKRGDALGEFIAGFDLNSDRVNLVIIDKYGRLVDVKTEWFPEVTSPGFPREKARALRLRALAKLLKYCYTHSVGAVVFENLLDVKKRRFTKSKKANRKISRFAKRKLLQHAILMSLKYGFKVLLVDPKNTTSSREHREVMLKYGLDRHTASAYIVALRGLAYQIT

SEQ ID NO: 1426 - protein, 361 aa, unidentified
  REGION 1..361: note = Description of Unknown:uncultivated organism sequence
  REGION 1..361: note = Category: MG61 effectors
  REGION 1..361: note = Description: MG61-262 effector
MSQSQTSSTVASTPTVEYVSITGRLIPISSEDHMKLARLAWSFRRAVQVATRMIARGMDNNEILRELRKMLNKGYADSAFKIAKAIVKGCIATGGDPLHVEVRKLFIVSEGESSRLGNRNVRFMDTSMVKVKYPYDGSWIQLRAKFGEEYLPLLNELIGLANQKKASYTAKIVFRDGEVYLHVSVPIELYLKHFRNGNANGRLIAGFDLNSDRVNMVILDELGVIRDAKTEWFPEATSPGFPRSKATALRLRALAKLLEYAYHHGVGVVVLEDLERIKKRRRYTKSKSANRKITRFPKRKLLEHAIVMAMKYGFEVLLVDPKGTTSSSEHDEAMKKYGVDKHTASAYLVALRALHQIKQTK

SEQ ID NO: 1427 - protein, 363 aa, unidentified
  REGION 1..363: note = Description of Unknown:uncultivated organism sequence
  REGION 1..363: note = Category: MG61 effectors
  REGION 1..363: note = Description: MG61-263 effector
MTYITLVFPFNVCCDVAERLLSTAWLFKIATHRLLNVAKHFPALPATDIGWMNTFRGIAYEIIPNRRYADGVVALVRSIYESCRQLGIDFKSVELSNWLMFQQSELEYPARNITLKPGLEFHITTVDYSKNTYRDVVEPIIPKSYKPLLDKTLEERQEYTGRVAVKSYGIRKYNLWVRGEIQITIPTDFYYKHMTRYREPKGGLIGGIDVNVDRLNLAVIDERGNLRDCKTFWFSEATTRGFSRRSARSIVGARICEMLSYAYHHNVKTLFLENPGVLGKLKLLWVRNGDRKHENYNYRKAVFRGSVIEMIALKAPLYSINVKYVDPKGTTNSEEHDEAMKRYGLDRHTASAYLIALRGLRNK

SEQ ID NO: 1428 - protein, 408 aa, unidentified
  REGION 1..408: note = Description of Unknown:uncultivated organism sequence
  REGION 1..408: note = Category: MG61 effectors
  REGION 1..408: note = Description: MG61-264 effector
MVAYRGSSRFLPARVFIEDLSTPAGVTENGMWSIGCINPSVLGMSEPRYITVRLPFHADGIYAGLLLSTAWLSKIVAHRVLGIVKGNTILVELPEYRFLGKLRRKCYDILPNRRYVDGVLKLVYSTIRSAMALGVDVSKLELKQWLLFQSDGEASAKGNNNIRLLEPHRARILVFSYDRQPETMEIKLTVPKGYRKLVEELVRKAYSREIGYPARVYISDYGIGKFGLHVAGELQVMVPYQLYCEVMKRYDKPLSDNIAGIDVNVERLDVAIVSPSGRLRRVKTFWLDGTVHMGIRAGRAWSLIGETIHEMLEWLYHSGVSTIVLENPEVLGYLRYYWIRNGKRRGRYWNWKVSMFRTSIIERIAWKTPLYSINVVYIVGAKKFRYFHFSSNSLIFLLRAFQGSKSEA

SEQ ID NO: 1429 - protein, 365 aa, unidentified
  REGION 1..365: note = Description of Unknown:uncultivated organism sequence
  REGION 1..365: note = Category: MG61 effectors
  REGION 1..365: note = Description: MG61-265 effector
MTYITLTFPFNACCDVARRLLSTAWLFRVATHRLLSIAREFPVLPGTDIGWKSTFRGMVHEVIPNRRYADGVVVLVRSIYESCRQLRVDFRSVELSSWLMFQQVELEYPARNITLKPGYEFHVTTVDYGGNTHRVVVKPTVPGNYGLLLDKVLRERQRYTGRVVLRSYGIGGGNLWVQGEVQVTIPMDFYYRHMARYRRNDGKLYGGADVNTDRINLAIIDEDGELIDHKTFWFSEASRKGCSGRRAWSIIGMRIHELLDYAYNNGVKTLFLENPEVLGRLKLMWAKSGDRGHGNYNYKVMTFRSSIIERIALKAPLYGIEVSYVNPRGTTNSKEHDETMKKHGLDRHTASAYLTALKGLTHQRK

SEQ ID NO: 1430 - protein, 374 aa, unidentified
  REGION 1..374: note = Description of Unknown:uncultivated organism sequence
  REGION 1..374: note = Category: MG61 effectors
  REGION 1..374: note = Description: MG61-266 effector
MELPEYITIDVPFTVRGDSARLVWWTAWLSKLCAHRLLNDVKKNEMLTDLSQTSFLKYARERCYEILPNRRYVDGIAVLIYSTLKSARKLGISIKDIELKQWLLFQSEAEKGREGNLNIRLMSLDKAEILVLDREKTLKRIVVGLRTTKGYLRLLKVLVQKAMSGEIGYPARVVIKEYNFYQNDMHLYCGLQVMVPYYLYLDVMKRYGKPLGGNVGGVDVNVDRINLAIVDTNGKLRDVKTFWFREATSRGCRRKQVWTEIHQAIHDMLNYAHHHGVSTIALENPRIIGYLKYYWIRNNNDRGSRNYNYRKTIFRNRIIEVISYKAPLYGMKTVFVNPRGTTHSEEHDEVMKKYGLDRHLASAYIIALKGLKQP

SEQ ID NO: 1431 - protein, 365 aa, unidentified
  REGION 1..365: note = Description of Unknown:uncultivated organism sequence
  REGION 1..365: note = Category: MG61 effectors
  REGION 1..365: note = Description: MG61-267 effector
MGGRWLSVLQSQTGNVVDAFAMVNYVTITGKLHPASGEDYMRLVRLAWDFKNAVRITTRMIAKGVGRSNILKELRGVLNKAYADSAYKLAKAMVEGCLFNGCNPLHIEVRRPFIVSEGESSRLGNRNVRLEDTNIVKVKYPYDGSWITLRAEFGERYLPLLRELAELARRKKVSYGARIVFREGNIYLHLSIPIKLYLKYFKRGEAKGGLVAGFDLNSDRVNLVIIDGHGRIVDTRTAWFTEAVSHGFSRNRARALRLGALAKLLKYCYTHNVSVVVFENLPLIKRRRFTRSRVGNRKITLFAKRQLIQYGIVMALKYGFKTLLTNPKGTTNSKEHSEVMKKYGLDRHTASAYLTALRGLTHQQK

SEQ ID NO: 1432 - protein, 422 aa, unidentified
  REGION 1..422: note = Description of Unknown:uncultivated organism sequence
  REGION 1..422: note = Category: MG61 effectors
  REGION 1..422: note = Description: MG61-268 effector
MGSSRRRLDPLTVALRLRVSGIEAHRKLLVKKTYKAFGGIYPYVIVLNRPVTVDIPFTVTGEKARLVWWTAWFSKFCAHRLLNDAKENEILVDLSQTSFLKYARKRCYDVLPNRRYVDGIAVLIHSTLKSARKLGLKVNEIKLRQWLLFQCEADKKKKGNLNVRLTSTREAEALVFNQEREPRKIKINLRTHKKYEKLLKILVERAIKSEVGYPARIVIKEYNTHLNDLRLYCSLQVIVPYDLYLEVMRKYDAPLGNHVAGIDVNVDRLNIAIVDRYGRLRDVKTFWFREITSRGYRRKRAWTKIYQAIHDMLNYAYHHGVSHVVLENPEIVGYLKYYWIKNGNKKTKNYNYRISIFRNRIIETIAYKTPLYGLKTIYVNPKGTTRSKEHEKIMKKYGLDRHTASAYLIALRSLKKIHYATK

SEQ ID NO: 1433 - protein, 361 aa, unidentified
  REGION 1..361: note = Description of Unknown:uncultivated organism sequence
  REGION 1..361: note = Category: MG61 effectors
  REGION 1..361: note = Description: MG61-269 effector
MDYITIKLPFNVDGDVAKELLSTAWLFRITTHRVLTIAKQQVLPATRIGWKNAFRGIAYRVIPNRRYADGAIILVMGVYESCRALGIDFRSVELSDWLMFQQSELEYPAKSITLKQNHEFHVTTVRYNGSTGRVIVKPTVPRNYRELLDAILTGRVEYMGRVVVTDYGVRNNRLWVHGEVHITIPLDVYYEHMARHKKNSGKLIGGVDVNTDRINLAIIDEDGELIDHETFWFSEVTARGFPKHKAWSIIGMRVHEMLNYAYHHGVRILFLENPEVLGRLRLMWVRNGDRKHENYNHKVATFRSTIIEKITMKAPLYGIEVKYVNPRGTTNSKEHDKLMRKYGLDKHTTSAYLTALKGLKH

SEQ ID NO: 1434 - protein, 363 aa, unidentified
  REGION 1..363: note = Description of Unknown:uncultivated organism sequence
  REGION 1..363: note = Category: MG61 effectors
  REGION 1..363: note = Description: MG61-270 effector
MSYVTLCLPFNVDGVEAKRLLSTAWLFKIATHRMLSIAKQCPVLPATDIGWKNAFRKVIYEVIPNRRYVDGVIVLVQGIYESCRQLGVDFMKVELGDWLMFQQVEKEYPVRNITLKHGYEFHITAIGFDGEPSRVVIKPTIPRNYMKLLDGILVERQKHVARAVIRDYGVRKGRLWVRGEIQVTIPIDFYYRHMARYRVNNGRLYGGVDVNVDRINLAIVDEKGRLRDVKTFWFEEASRKNCPRRRARSIIGMAVHNMLRYAYHHGVKTLFLENPEVLGRLKLLWIRNGSRLHENYNYRVSVFRSSVIEMIAMKAPLYAIKTIYVDPRGTTHSKEHDELMRKYGLDRHTASAYLIALKGLKLP

SEQ ID NO: 1435 - protein, 364 aa, unidentified
  REGION 1..364: note = Description of Unknown:uncultivated organism sequence
  REGION 1..364: note = Category: MG61 effectors
  REGION 1..364: note = Description: MG61-271 effector
MLHYQTNEVINAETLISHVTITGKLIPQTPSDFMKLVRLAYDFRKAVLYATRMISKSMKANELLKELRGMLNKGYGDSAYKVAKSIVEGCRFNGGNPQHIKVKKLFIVGEGEAVRFGNRNVRLEATDRVKIKYPYNRTWLFFKIQYGKDYLPLVQEIVKLAKEKKISYSARIVFRDGRMYLHLSIPVDSYLKYFSKGSANGSLTAGFDLNADRINMVIVDKFGRIRDVKTEWFPEVTSHGYPRSKAKIKRLEALAKLLKYAYHHNVSVVVFENLFIIKRRKFTKNSSANRKMSRFAKKELLQYGIIMAMKYGFKVLLINPRGTTHSKEHDEVMRKYGLDRHTASAYIIALRGIESHNLIRKAII

SEQ ID NO: 1436 - protein, 371 aa, unidentified
  REGION 1..371: note = Description of Unknown:uncultivated organism sequence
  REGION 1..371: note = Category: MG61 effectors
  REGION 1..371: note = Description: MG61-272 effector
MSQYQISSTVVDASTLIEYVTITGKLAPSTGEDYMKLARLAWSFRKAVKVATRMIAKGVKANAVLKELRKTLDKAYADSAFKLAKAIVKGCMTNGGNPLHVNIRKLFIASEGESSKLGNRNIRFEDTSFVKVKYPYDGSWIQLKAEFGEEYLPLLRELTELAKQKRASYNAKIMFRDGKTYLHVSVPAELYLKHFKKGEAHGELIAGFDLNSDRISLAIVDKYGRLVDAKTEWFPEVTSHGFSREKAKALRLRALAKLLTYCYTHGVGTAVFEDLFNVNKRRFTWNRTANRKMSRFAKRELLQHAILMSLKYGFRVLLADPRGTTSSREHDEVMRSHGLDKHVASAYLIALRVLNQDKQTKQTIMKTETAL

SEQ ID NO: 1437 - protein, 328 aa, unidentified
  REGION 1..328: note = Description of Unknown:uncultivated organism sequence
  REGION 1..328: note = Category: MG61 effectors
  REGION 1..328: note = Description: MG61-273 effector
MGYVTVSLSFNVGGDAAKGLLSTAWLFKVATHRVLDLVRQSPVLPATDIGWKNTFRSVAYEVVPNRRYADGVVVLVRGIYESCRQLGVDFRSVELGDWLMFQQSEIEYPVRNITLREGYEFYVTTINYLGKSDRVVIKPTIPRNHKPLLDRLIEEGVEHTGRVMIRDYGVRRGMLWIHGEVQVTLPLDFYYRHMVRYGVNNGRFYGGVDVNADRINLAIVDGDGELRDVRTYWFREVTARGYPRRRAWSVIGMRVHEMLDYAYHHGVRTLLLEDPGVLGRLRLLWVRSGKRKHENYNWRVAIFRSSVIEMIAMKAPLYGIEAKYENPK

SEQ ID NO: 1438 - protein, 371 aa, unidentified
  REGION 1..371: note = Description of Unknown:uncultivated organism sequence
  REGION 1..371: note = Category: MG61 effectors
  REGION 1..371: note = Description: MG61-274 effector
MSYITLCLPFNIDSSEAERLFSTAWLFKIASHRMLSLVKQFPILPATDIGWKNSFRKIIYEVIPNRRYTDGVIVLIRGVYESCRQLGVDFKEVELGDWLMFQQVEKEYPVRNITLKQGYEFHVTTIDHNGSSERIVIKPTISKNYKLLLDRILEDKQKHTARIVIKDYGVRKDKLWVHGEVQLTIPLDFYYKYMVRFKRNYGKLYGGVDVNTDRINLAIVDKYGRLRNVKTFWFEDASRKGYPKRKARVLIGMAVHEMLKYAYHHGVKTLFLENPEVLGKLKLLWIRNGRRLYKNCNWKVMTFRSSIVEMVAIKAPLYAIKVDYVSPRGTTNSKEHVKIMRGYGLDRHTVSAYLIALRGIEGHTMIQKAII

SEQ ID NO: 1439 - protein, 362 aa, unidentified
  REGION 1..362: note = Description of Unknown:uncultivated organism sequence
  REGION 1..362: note = Category: MG61 effectors
  REGION 1..362: note = Description: MG61-275 effector
MAGEAREPEITHVTVTGRIMPLNSEDYVKLRYLAYKFRKNLVRAVKMYTRGVNKLVIVKEITRELNLGYADTIYKMAKLIVEGARKNGSNPVKIEVKKLFIASRGFSANKGNRNIRLESTDTLYVNIPREGWVKFKVSFGERYVPLVKELVELAESRKTSYTARIVFRNGRIYLHLSIPIELYLKYFRRGEANGDLIAGFDLNSDRVNMVIVDKSGVVRDVRTEWYPEVTSPGYPGSKATVARLQALSKLIEYAYHHGVGVAVFEDLGRIKRRRFTGSPVANRKMSRFPKRKLLEHAVVMALKYGFKVYLVDPSYTSVVGDYLSRELGLDKHTASAYMLTARYLGLDLKSVEITQITRKTKN

SEQ ID NO: 1440 - protein, 324 aa, unidentified
  REGION 1..324: note = Description of Unknown:uncultivated organism sequence
  REGION 1..324: note = Category: MG61 effectors
  REGION 1..324: note = Description: MG61-276 effector
MVGEVREPGITHVTITGRIILLNTNDYVKLCYLAYKFRKNLAKAIKMYARGVDKLVMVKEITRELNLGYADTIYKIAKLIVEGARRNGSNPLKIEVKKLFVASRGFSANKGNRNIRLESTDMVYVNILKERWIRFKVSFGEKYVPLVKELVELAKSRKNSYSAKVVFRNGRIYLHLSVPIELYLKYFRRGEAKGDLIAGFDLNSNRINMVIVDRCGVIRDVRIEWFPEVTSPGYPRNKAKVARLQALAKLLNYAYHHGVGVTVFEDLDKVKQRAFTSSPTANSYLSRELGLDKHTASAYMLTARYLGLDLKSVEITQITRKTKN

SEQ ID NO: 1441 - protein, 363 aa, unidentified
  REGION 1..363: note = Description of Unknown:uncultivated organism sequence
  REGION 1..363: note = Category: MG61 effectors
  REGION 1..363: note = Description: MG61-277 effector
MTYITLVLPFNVCCDVAKRFLSTAWLFKIATHRLFNVVKYFPVLPVTDIGWKNTFRGIAYEIIPNRRYADGVVTLVRSIYESCRQLRIDFKSVELSNWLMFQQSELEYPARNITLRSGYELHITTVYYNKNTYRDVVKPTIPKSYKPLLDKMSEERQKYTGRVAVKSYGTRKDNLWIRGGVQIIIPTDFYYKHMTRYREPKGSLIGGIDVNADRLNLAIIDEKGNLWDCKTFWLSEAAARGFSRRNARSIISAKIHEMLSYAYHYNVKTLFLESPVVLGKLKPLWVKNGGRRHENYNYKVSVFRSSVIEMIELKTPLYGIEVKYVDPKGTTNSEEHDEAMKRCGLDRHTASAYLIALRGPRNQ

SEQ ID NO: 1442 - protein, 363 aa, unidentified
  REGION 1..363: note = Description of Unknown:uncultivated organism sequence
  REGION 1..363: note = Category: MG61 effectors
  REGION 1..363: note = Description: MG61-278 effector
MSYVTIVAGFNTSGEDAKLLLSTAWLFKVATHRLFNIVKQMPVLPASDIGWKSMFYKAVYDVIPNRRYSYGVITLVRSIYESCRQLGVDFKSIELSDWLMFQQSEKEYPPRSITLKSLSEVEVTVFSYSKESKRIALRVSTSGVYRKLLNAILREKQPYMPRIYVKSWNARGGKLFVRGELQVAIPTDFYYKHMPRASANNGKLYGGVDVNVDRVNLVIVDGDERLRDAYTFWFEESSRKGCKRRRARSIIGMRVHEMLEYAYSHGVKTLFLENPEVLGKLKLLWVRSNDKRHENYNYGVSVFRSSVIEMIALKASLYSIEVKYVDPKGTTSSRKHDDVMRKYRLDRHTASAYLIALKGLKQL

SEQ ID NO: 1443 - protein, 362 aa, unidentified
  REGION 1..362: note = Description of Unknown:uncultivated organism sequence
  REGION 1..362: note = Category: MG61 effectors
  REGION 1..362: note = Description: MG61-279 effector
MDYLTIRLPFNVDGGVAGELLSTAWLFRVAAHRVLSLAKQMQFLPSTKVGWVNAFRESAYGVIPNRRYADGALTLVMSIYESCRELGVDFKGVELSNWLMFQQSELEYPAKSITLKPGYEFHVTTIKYNGSTGRVVIKPTVPRSYGKLLNAVLTERVKYMGRVVVRDYGVRGSQLWVRGEVQVTVPMDVYYEHMAKHRRNAGRLLGGVDVNSDRINLAIVDEDGELIDHKTFWFSEASRKGFSRHSAWSIIGMRIHEMLNYAYHHGVRALFLENPGVLGRLKLVWIKNGDRGRENYNHKVSIFRSTIIEKIALKAPLYSIEVKYVNPRGTTNSKEHDETMRKHGLDRHTASAYLIALRGLRH

SEQ ID NO: 1444 - protein, 363 aa, unidentified
  REGION 1..363: note = Description of Unknown:uncultivated organism sequence
  REGION 1..363: note = Category: MG61 effectors
  REGION 1..363: note = Description: MG61-280 effector
MSYVTVTAGFNASGEEAKLLLSTAWLFKIATHRVLSIAQNTPALPASKIAWKNTFRRIAYEVIPNRRYADSATVLVMGIYESCRQLGVNFKEVELGDWLMFQQSEKEYPPRNITLKYIDEAWVTVLGYEGRRERIKLKVSISGAFRRLLEAILREKQPYNPRIVLKSWNTRGGKLYVKGELHLAIPLDFYYKHMKRFEGNHGKLYGGVDVNSDRVNLAVVDDNGRLRDTYTFWFREATARGYPKRRARSVIGMRLHEMLRYAYHHGVKMLFLENPDVLGRLKLLWVRNGRRLGRNYSWRVMTFRSSIIEMIALKAPLYSIKIGYVDPRGTTHSEEHDEVMRRHGLDKHTASAYLIALKGLKQP

SEQ ID NO: 1445 - protein, 333 aa, unidentified
  REGION 1..333: note = Description of Unknown:uncultivated organism sequence
  REGION 1..333: note = Category: MG61 effectors
  REGION 1..333: note = Description: MG61-281 effector
MLHLAKNCDVLPASDIGWKSMFRKAIYSIIPNRRYADGVIVLIRGIYESCRQLEVNFKDVELGNWIMFQQSEMEYPVRTITLKQDYSFRITTFDYNGSSERISISPTIPKSYSLLLSKILEDKQKHTARIVIKDYGVRKNKVWVHGEIQLTIPLSFYYRYMVRFKKNKGKLFGGVDVNCDRINLAIVDRFGRLRDVKTFWFRETTARGFPRRKARVIIGMRVHEMLKYAYFHGVSKIFLENPEILGKLKLLWIRNGKRFSRNYNWKVAVFRSNIIEMISMKATLYSIKTRYVNPKGTTSSNEHKEIARKLGLDRHTASAYLIALRGLKQNDTI

SEQ ID NO: 1446 - protein, 371 aa, unidentified
  REGION 1..371: note = Description of Unknown:uncultivated organism sequence
  REGION 1..371: note = Category: MG61 effectors
  REGION 1..371: note = Description: MG61-282 effector
MSYITLCLPFNVDGFKARKLLSTTWLFKTASHRMLSLAKQFPILPATDIGWKNTFRKIIYEIIPNRRYTDGVIVLVRGIYESCRQLGVDFEDVELGDWLMFQQVEKEYPVRNITLKQGYEFHITTIDYNDGVERIAVEPTIPKNYRLLLDKILEEKQKHSARVIIKDYGVRKNKLWVHGEIHVTIPLDFYHKYMTRYRRNYGKLYGGVDVNTDRINLAIVDSEGNLRDTYTFWFREVTARGYPRRKARSVVGMRVHEMLKYAYYHGTKILFLENPEILGKLRLLWVRNGKRLHKNYNWKVATFRSSIIEMITMKAPLYSIKVGYVDPRGTTSSKEHGEIMRKYRLDRHIASAYLIALRGIERRATIQKATA

SEQ ID NO: 1447 - protein, 373 aa, unidentified
  REGION 1..373: note = Description of Unknown:uncultivated organism sequence
  REGION 1..373: note = Category: MG61 effectors
  REGION 1..373: note = Description: MG61-283 effector
MSEPRYITVRLPFHADGIYAGLLLSTAWLSKIVAHRVLGIVKGNTILVELPEYRFLGKLRRKCYDILPNRRYVDGVLKLVYSTIRSAMALGVDVSKLELKQWLLFQSDGEASAKGNNNIRLLEPHRARILVFSYDRQPETMEIKLTVPKGYRKLVEELVRKAYSREIGYPARVYISDYGIGKFGLHVAGELQVMVPYQLYCEVMKRYDKPLSDNIAGIDVNVERLDVAIVSPSGRLRRVKTFWLDGTVHMGIRAGRAWSLIGETIHEMLEWLYHSGVSTIVLENPEVLGYLRYYWIRNGKRRGRYWNWKVSMFRTSIIERIAWKTPLYSINVVYIDPKGTTSSREHSEIMRKYGLDRHTASAYLIALKGLKQP

SEQ ID NO: 1448 - protein, 363 aa, unidentified
  REGION 1..363: note = Description of Unknown:uncultivated organism sequence
  REGION 1..363: note = Category: MG61 effectors
  REGION 1..363: note = Description: MG61-284 effector
MSYITVTAGFNASGGEAKLLLSTAWLFKLATHRVLSYAKSMPILPASKIGWKSTFRKVAYEIIPNRRYADSAVTLVMGIYESCRQLGINFGDVGLGDWLMFQQSEKEYPPRNITLKDVDEAWITVLGYDGESRRIKLRVHASKAFRKLLDALLRERQPYNPRIVLKTWNVRDGKLYVRGELHVAIPLDFYYKHMARFTRNNGRLYAGVDVNVDRINLAVVDVEGNLRDTYTFWFREVTTRGYPRHRARSVIGMRIHEMLKYAYHHGVKTLFLENPEVLGKLKLLWIRNGDRKSKNYNWKKTIFRSSVIEMIAMKAPLYSINVKYVDPRGTTNSREHDEAMKRCRLDRHTASAYLTALKGLNLT

SEQ ID NO: 1449 - protein, 369 aa, unidentified
  REGION 1..369: note = Description of Unknown:uncultivated organism sequence
  REGION 1..369: note = Category: MG61 effectors
  REGION 1..369: note = Description: MG61-285 effector
MWAIALNESPLYTLKLSFNASGEAARRILSTAWLFKLACHRVLNKSKGLIDHLVPSKVAWLKVFYDDARAYIPNKRYAYGAVYLVYGVWQSAGELKVDYKNVELSDWLLFQHYEREVDGNVIRVSEDGSTLITTYSYDGSKDRVFIRARPNRGHAGLLKLVVESKEKYMPKVVVKGYNVRDGTLYLRGELHVAVSYSFYLKHSTRYREPRGGLVGGVDVNADRINLAIVDRKGNLRDYKTFLFAETTARGYPRRGAWSVIGMKIHEMLEYAYHHGVSAIALEGPEVLGYLKSAWMRGDDRSHENYNYKKAVFRSSLIERIAMKAPLYGLSVEFVNPRGTTSSVERDEAMRRYGLDKHTASAYLIALRCI

SEQ ID NO: 1450 - protein, 374 aa, unidentified
  REGION 1..374: note = Description of Unknown:uncultivated organism sequence
  REGION 1..374: note = Category: MG61 effectors
  REGION 1..374: note = Description: MG61-286 effector
MAYKLYWGFPITSYITIVLPFNAGGDVAERLLSTAWLFKVASHRMLRLAKQSPVLPATDIGWKNMFRKAVYEVIPNRRYADGAVVLVRGIYESCRQLGVGFKEAELSDWLMFQQAETEYPVRNITLKEDYEFHITTIGYEGATDRVVVEPTIPKNYRTLLDEILEERQRHTARVVIKDYGARENMLWVHGEVQLTIPIDFYCKHMARYRRNYGKLYAGVDVNVDRINLAIIDADGNLRDTYTFWFRETTARGFPRRRARSVIGMAVHEMLKYAYHHGVKTLFLENPDVLGKLKLMWVKSSERRHENYNYKVAIFRGSVIEMVAMKAPLYAIDVKYVSPRRTTNSKEHNEIMRKHRLDRHTASAYLTALKGLKQT

SEQ ID NO: 1451 - protein, 382 aa, unidentified
  REGION 1..382: note = Description of Unknown:uncultivated organism sequence
  REGION 1..382: note = Category: MG61 effectors
  REGION 1..382: note = Description: MG61-287 effector
MTSLPEYLTISLPFTVKGENAKLIWLTAWFSKLCAHRLLDDVKNNEFLIDLSQTSFLKYARKRCYDILPNRRYIDGIATLIHSTLKSVRKLGVTIGSIELKRWLLFQSEAEKEKKGNLNIRLVSVNRAEILVFNHKKESRRIEISLRTLKGYRRVLEALLGRALKSEVGYPARVVIKEFNFYPSNLHLYCSLQIMIPYNLYLETMRKYYKALGDHVAGVDVNVDRLNLAIVDKYGRLRDVKTFWFREITSRGYRRRPAWTKIHHAIHNMLNYAYHHGISCIALERPEIIGYLRYYWVRNGDRKSKNYNYRKSIFRNKIIEAITCKAPLYSLKTIYVNPKGTTRSKKHDEAMKKYGLDRHTASAYLIALRGIERHTMIQKATI

SEQ ID NO: 1452 - protein, 364 aa, unidentified
  REGION 1..364: note = Description of Unknown:uncultivated organism sequence
  REGION 1..364: note = Category: MG61 effectors
  REGION 1..364: note = Description: MG61-288 effector
MSQYQTNNVVDATNFITYVTITGELVPISPEDYMKLVRLAHDFRKAVLYATRMIAKGKNTNAILKELRSMLNKAYGDSAYKVAKALVEGCRFNGGNPRHIEVRKLFIVSEGESSRLGNRNIRLESTSTTRIKYPYDSSWLTFKARFGEKYLSLIEELVKLTRHKEISYGARIVFRSGKVYLHLSVPIGLYLKYFSKGKTKGNLIAGFDLNSDRINMVVIDRYGRIRDIKTEWFPEVASHGYPRSKAKTKRLEALAKLLRYAYYHNVGAVVFENLLVIRKRRYTRNRKANRKITRFAKRELLQHGIVMAMKHGFKVLLVNPKGTTNSEEHSKIMRRDGLDRHSASAYIIALRGIERHNPIQKTII

SEQ ID NO: 1453 - protein, 378 aa, unidentified
  REGION 1..378: note = Description of Unknown:uncultivated organism sequence
  REGION 1..378: note = Category: MG61 effectors
  REGION 1..378: note = Description: MG61-289 effector
MKDTGLPDYIAINIPFTVNGEEAKLVWYTAWFSKLCAHRLLNDVKGNDALLGFSQASFLKYARERCYELLPNRRYIDGVATLVHSTLRSARKLGVNIRDIELGQWLLFQSEAESEKRGNLNIRLLSVNRAEVLVLNYDGASKRIDIGLKTPKGYVELLKVLIERAGKYEVGYPARVMVRGYSFRPGNMHLYCGLQVMVPYSLYLNVMRRYSEPRGNLIGGVDVNVDRLNLAIVDRYGRLRDVKTFWFREVTARGVKGVVAWTKIHQAIHELLNYAYHHGVSAISLENPRTIGYLRYYWVRNGDRGSRNYNYRVSIFRSRTIEVISYKAPLYAMRTIYVNPKGTTNSQQHDEVMRRLGLDRHAASAYLIALRGINKQRK

SEQ ID NO: 1454 - protein, 300 aa, unidentified
  REGION 1..300: note = Description of Unknown:uncultivated organism sequence
  REGION 1..300: note = Category: MG61 effectors
  REGION 1..300: note = Description: MG61-290 effector
MLNKAYGDSAFKLAKTIVESARSNRGDPLKIEIRRLFIVSEGEAGRQGNRNVRLDDSSKVRIRYPYERSWLSFRARFGENYVPLVKELSELAKSRKCSYGVMIVFRNGRIYLHLSVPVELYLKYFRKGEAKGDLIAGFDLNSDRINTVIVDKYGRVVDVRTAWFPEVTSPGYPRNKARVVRLQALVELFNYAYHHGANVAVFEDLDKIKRRRFTSSPTANRKITRFAKKQLLTHAVVMSLRYGLKPALVDPRGTMSSPVHSAVMKKHGLDRHTTSAYLIALRYLQDEKTVNSYKAYKQSK

SEQ ID NO: 1455 - protein, 363 aa, unidentified
  REGION 1..363: note = Description of Unknown:uncultivated organism sequence
  REGION 1..363: note = Category: MG61 effectors
  REGION 1..363: note = Description: MG61-291 effector
MSYVTVTAGFNACGEEAKLLLSTAWLFKIATYRVLAHAKSMPVLPATKVAWKNAFREVALSAMPNRRYADSSIIVVMGIYESCRQLGMDFREVELGDWLMFQQSEKEYPPRNITLRDVDEVWVTVIGYGGESGRIKLRVSTSKTFRELLGALLRERQPYNPRVVLKAWNVRGGELYVRGELQVSVHMNLYYAHVAKHRRNEGRLYAGVDVNADRINLAIVDERGDLRDAYTFWFREVTARGYPRRRARSVIGMKVHDMLRYAYHHGVKMIFLEDPGILGRLRLMWIRNGRRLHKDYNWKVSAFRSSVIEMIATKAPLYTVKAVYVDPRGTTHSKRHDEVARKYGLDRHTASAYMIALKGLNLP

SEQ ID NO: 1456 - protein, 364 aa, unidentified
  REGION 1..364: note = Description of Unknown:uncultivated organism sequence
  REGION 1..364: note = Category: MG61 effectors
  REGION 1..364: note = Description: MG61-292 effector
MVENPLYTIKLSFNVSGDRAKKILSTAWLFKLACYRVLSRSKELLNALIPSKIAWVKMFYSDARDLIPNKRYAYGTIYLVYGIWESARELGINYRSVELSDWLMFQHYDREVDGNVIRILEDGSALVTTYSYDGSKDRVLIKAKPNKGYEELLKLVVESKEKYMPRVVVRGYNVRNDKLYVSGEIHVTIDYNFYLKHTTRYGEPKGSLIGGVDVNSDRINLAIVDEKGNLRDCKTFWFPETVTRGYPKRRAWSIIGIKIHEMLRYAYNHDVSTIALENPETLGYLKLAWVRNGDRKHENYNYKKSVFRNTIIERIVMKAPLYGLNTKFVDPKWTTSSREHDEIMKRFGLDRHTASAYIIALRSI

SEQ ID NO: 1457 - protein, 359 aa, unidentified
  REGION 1..359: note = Description of Unknown:uncultivated organism sequence
  REGION 1..359: note = Category: MG61 effectors
  REGION 1..359: note = Description: MG61-293 effector
MNYVTLTLPFNVDGDVAKRLVSTAWLFKTASHRMLSLAKQRPILPATDIGWKNTFRKLVYEIIPNRRYADGVIVLVRGVYESCRQLSIDFRRVELGDWLMFQQAEKEYPVRNITVKLGYEFHITTIDYNGIAERIVLKPTIPKNYKCLLDKILEEKQKHTARVVIKDYGVRKDRLWVHGEIQLTIPLDFYYKYMVRYTVNNGKLYGGVDVNTDRINLAIVDGNGRLRDTYTFWFSETTARGYPRHRARSIIGMKIHDMLRYAYHHGVKTLFLENPGVLGKLRLLWIKNGKRLHSNYNWKVSVFKSSAIEMIAMKAPLYAIITRNVDPGGETNSREHDNDTTNKILHTQLYKFIEFIIYA

SEQ ID NO: 1458 - protein, 1262 aa, unidentified
  REGION 1..1262: note = Description of Unknown:uncultivated organism sequence
  REGION 1..1262: note = Category: MG61 effectors
  REGION 1..1262: note = Description: MG61-294 effector
DRYMDFTKFQKLNSIIKTCSFEMIPIGKTRETMEKHNVIEEDAERKSNAELTKEVSDSFIREFIADYKEDMDWKDLYDAYGEDRARFTDIMNQKAEKLAKRFSDSFNEYINTFLKANGINDKKSKWSDSGYVDVVLPLYVSIHPDFSNDKYERAVASLLHCSNSLFKKYTTSYARIIAGTKKGSFADRSMENFQTACANSVMFDLISRNLSSVGSHDAFKEVFADAPLNMNEYLSQKGISRYNEFVGDSFDESGQVIRYGVNHYINEWNQTHPDERMPKIHKLKKQILSIVEPSFRIRTINDETELFGTFDNIRTAEQRYAGMLESILENMNTADIYDKSGILVTSAERDSLANAITGEWSYFRRQIKEEEENRIREEYLQKKNRVKTKLTQKDNKQIEDALNKSIYSVADLNKMLGSDFGTIEEKLLDEYIRNKSKKESAYAQLVKTDFYDKKTIPAGDDVQRIQQYLDKVLSLTHIVRGLCADSQDPRTDFVFSDDVSSLEDDRVQIISCYNLIRNFVTKKREKTAKEKQIQLCFGRPAHFEQVWNNKQEGKFGNVDAALLEYAGKYYYMVPAAKNEAKLNFPVTDEPQMGECYNYLATKKAIGFAKAFAKFYIKSPEAMEGFEKTEEPFEISVGNDTMIISRKVYEDYEVKTFRESEEAKNKLIDCAKEFLSKNLSYCIYDWSVLKEANDYVNYGEFCNEVDSIAFRVINRYVSKKLVDDAVERGNLYMFEISSLDMYKDSSRMKNIMALRFNQIINGMFTGDKSIIINNAPQIRYRPVVIEKKDVHPVGSRLVNKNTTDGRTIPGDVYLELCAYYNGKKDSLSPEASLYNEKVSVKDSDRAHIKDKHYTEEKFLITFSYTANKNVASATSGYQLNEMVRKEIRENGCNIMAVIRGIDNLLYYAVVDENGNRIEAGDLNVVGDTDFYEKLTILGKQRYTDQKNWKHENKVADLKDTYLGQVCRKIASIAVKNNAVIVIDKINESTKRKNAAFDNNMYRKFENALVNSLTDYYDIGIRGDEPGSVKNPLQLTVKEDNGFQNGIIFYQFDTFTKNICMRTGFVNLLNTFEIKTVASKVAFLKKLSGIYYDNDINEFVFEFTWRNIGCILKDEELPLYDGMDKIWKVRTHFTRYMRNAEKNKYVEIDGTEVLKELIRKNHPDMIGGKIDVDRLTSEEVKKVFEIFTLYTNGYIPRMDDAESGYMSPACDWNNFGTIRYDEMTALQLAKKSSLMIGKVKSGKDWKDMNVSRVEWLNHVLKADW

SEQ ID NO: 1459 - protein, 376 aa, unidentified
  REGION 1..376: note = Description of Unknown:uncultivated organism sequence
  REGION 1..376: note = Category: MG61 effectors
  REGION 1..376: note = Description: MG61-295 effector
RYVSKKLVDDAVERGNLYMFEISSLDMYKDSSRMKNIMALRFNQIMNGMFTGDKFIIINNAPQIRYRPVVIEKKDVHPVGSRLVNKNTTDGRTIPGDVYLELCAYYNGKKDSFSPEASLYNEKVSVKDSDRAHIKDKHYTEEKFLITFSYTANKNVASATSGYQLNEMVRKEIRENGCNIMAVIRGIDNLLYYAVVDENGNRIEAGDLNVVGDTDFYEKLTILGKQRYTDQKNWKHENKVADLKDTYLGQVCRKIASIAVKNNAVIVIDKINERTKRKNAAFDNNMYRKFENALVNSLTDYYDIGIRGDEPGSVKNPLQLTVKEDNGFQNGIIFYQFDTFTKNICMRTGFVNLLNTFEIKTVASKVAFLKKLSGIY

SEQ ID NO: 1460 - protein, 258 aa, unidentified
  REGION 1..258: note = Description of Unknown:uncultivated organism sequence
  REGION 1..258: note = Category: MG61 effectors
  REGION 1..258: note = Description: MG61-296 effector
MYRKFENALVNSLTDYYDIGIRGDEPGSVKNPLQLTVKEDNGFQNGIIFYQFDTFTKNICMRTGFVNLLNTFEIKTVASKVAFLKKLSGIYYDNDINEFVFEFTWRNIGCILKDEELPLYDGMDKIWKVRTHFTRYMRNAEKNKYVEIDGTEVLKELIRKNHPDMIGGKIDVDRLTSEEVKKVFEIFTLYTNGYIPRMDDAESGYMSPACDWNNFGTIRYDEMTALQLAKKSSLMIGKVKSGKDWKDMNVSRVEWLNH

SEQ ID NO: 1461 - protein, 122 aa, unidentified
  REGION 1..122: note = Description of Unknown:uncultivated organism sequence
  REGION 1..122: note = Category: MG61 effectors
  REGION 1..122: note = Description: MG61-297 effector
NKYVEIDGTEVLKELIRKNHPDMIGGKIDVDRLTSEEVKKVFEIFTLYTNGYIPRMDDAESGYMSPACDWNNFGTIRYDEMTALQLAKKSSLMIGKVKSGKDWKDMNVSRVEWLNHVLKADW

SEQ ID NO: 1462 - protein, 1264 aa, unidentified
  REGION 1..1264: note = Description of Unknown:uncultivated organism sequence
  REGION 1..1264: note = Category: MG61 effectors
  REGION 1..1264: note = Description: MG61-298 effector
MEDIYMDFTKFQKLNSIIKTCSFEMIPIGKTRETMEKHNVIEEDAERKSNAELTKEASDSFIREFIADYKEDMDWKDLYDAYGEDRARFTDIMNQKAEKLAKRFSDSFNEYINTFLKANGINDKKSKWSDSGYVDVVLPLYVSIHPDFSNDKYERAVASLLHCSNSLFKKYTTSYARIIAGTKKGSFADRSMENFQTACANSVMFDLISRNLSSVGSHDAFKEVFADAPLNMNEYLSQKGISRYNEFVGDSFDESGQVIRYGVNHYINEWNQTHPDERMPKMHKLKKQILSIVEPSFRIRTINDETELFGTFDNIRTAEQRYAGMLESILENMNTADIYDKSGILVTSAERDSLANAITGEWSYFRRQIKEEEENRIREEYLQKKNRVKTKLTQKDNKQIEDALNKSIYSVADLNKMLGPDFGTIEEKLLDEYIRNKSKKESAYAQLVKTDFYDKKTIPAGDDVQRIQQYLDKVLSLTHIVRGLCADSQDPRTDFVFSDDVSSLEDDRVQIISCYNLIRNFVTKKREKTAKEKQIQLCFGRPAHFEQVWNNKQEGKFGNVDAALLEYAGKYYYMVPAAKNEAKLNFPVTDEPQMGECYNYLATKKAIGFAKAFAKFYIKSPEAMEGFEKTEEPFEISVGNDTMIISRKVYEDYEAKTFRESEEAKNKLIDCAKEFLSKNLSYCIYDWSVLKEANDYVNYGEFCNEVDSIAFRVINRYVSKKLVDDAVERGNLYMFEISSLDMYKDSSRMKNIMALRFNQIMNGMFTGDKSIIINNAPQIRYRPVVIEKKDVHPVGSRLVNKNTTDGRTIPGDVYLELCAYYNGKKDSLSPEASLYNEKVSVKDSDRAHIKDKHYTEEKFLITFSYTANKNVASATSGYQLNEMVRKEIRENGCNIMAVIRGIDNLLYYAVVDENGNRIEAGDLNVVGDTDFYEKLTILGKQRYTDQKNWKHENKVADLKDTYLGQVCRKIASIAVKNNAVIVIDKINESTKRKNAAFDNNMYRKFENALVNSLTDYYDIGIRGDEPGSVKNPLQLTVKEDNGFQNGIIFYQFDTFTKNICMRTGFVNLLNTFEIKTVASKVAFLKKLSGIYYDNDINEFVFEFTWRNIGCILKDEELSLYDGMDKIWKVRTHFTRYMRNAEKNKYVEIDGTEVLKELIRKNHPDMIGGKIDVDRLTSEEVKKVFEIFTLYTNGYIPRMDDAESGYMSPACDWNNFGTIRYDEMTALQLAKKSSLMIGKVKSGKDWKDMNVSRVEWLNHVLKADW

SEQ ID NO: 1463 - protein, 343 aa, unidentified
  REGION 1..343: note = Description of Unknown:uncultivated organism sequence
  REGION 1..343: note = Category: MG61 effectors
  REGION 1..343: note = Description: MG61-299 effector
FNEYINTFLKANGINDKKSKWSDSGYVDVVLPLYVSIHPDFSNDKYERAVASLLHCSNSLFKKYTTSYARIIAGTKKGSFADRSMENFQTACANSVMFDLISRNLSSVGSHDAFKEVFADAPLNMNEYLSQKGISRYNELVGDSFDESGQVIRYGVNHYINEWNQTHPDERMPKMHKLKKQILSIVEPSFRIRTINDETELFGTFDNIRTAEQRYAGMLESILENMNTADIYDKSGILVTSAERDSLANAITGEWSYFRRQIKEEEENRIREEYLQKKNRVKTKLTQKDNKQIEDALNKSIYSVADLNKMLGSDFGTIEEKLLDEYIRNKSKKESAYAQLVKT

SEQ ID NO: 1464 - protein, 1258 aa, unidentified
  REGION 1..1258: note = Description of Unknown:uncultivated organism sequence
  REGION 1..1258: note = Category: MG61 effectors
  REGION 1..1258: note = Description: MG61-300 effector
MEFTKYTRSNKIVRSVIFEMSPIGNTRAAIKEHGVIEEDAVRKSNAVLIKEVSDNFIREFLNDDKLEKYDWVEWEDLCLLIDDKPAFDAKAEKMKESIATSISKSFDSYINRFMAANGKANGKYSWKSAGYIDEVIPMYILCHPDYQDEKYTLAAESLKHASSAMFKKYFVSYERILNGTKTGSIAYRVMENVLIFCTNSKMYKKFAAKISGADLFAKIADITVLEDLISQNGIDFYNEMIGDLYDKDGQLIRKGFNSRINEYNSTHPDDKIPYLKKMKKQILSYVEPFFTIDKIESKEDLDNILTSVRATEESLTENLKTLFSNLLSNDKFPLDRILLTSAARSTIANSLAGRWDYFENIIREKETDKLKADYFEKKNRILTKLTKKDQKKINDAVTSNISSIADLNQMLHNVSEETVEDFLIKSLNKQISLKESSYSVLNNSGFMKSDSKPAWDDNQKIQDYLDHVIAISRMLKYFYTDLMNEKVDPIFVEELQMFDDSKDKIVKSYNMIRNYCTTKTELTAKEKRIQLCFGRPVHFEQTWNNKQEGKFGNLDAALLEFDGLYYYIVPAAKNKRKLNFPVTDIPQEGVNYHYLSTKKSIKLSMALPKMTFKSPAAVKKYAETEEPFTINIGNSTMTVSKKMYDDYNLKTFSSSPDARIALIDYAKEFISKEFSFKCYDYSSLKPSEEYRSYGEFCNEVDSITFSTTSKYVNKDLVDNAVMDGDLYMFLITSADMYKDREKNKDITAIRFNTIMQSMFTGDTSIIINNSPTIYYRPQIIEAVDKHPVGSILVNKMTTDGRTIPGEIYLELCDFYNGKKDYLSAEAKAYNENVSVKESSFSHIKDAHYTREMFTISLSYTLNKGVSNEKLGYALNDEIRRDIVEEGCNIMSIIRGINNLLYYCIVDQNGNQLKAGSLNIVGGVDYYEKLTLLSTQRYLDSKNWKYEKKSAELKDTYLGQVCREIAKIAIANNAIIVIDKLIDSIKNKAAAFDNQVYKKFENRLISTLGNYYDVTLPDNEPGGSTNPLQLTVPDNTSIQNGIIFFIIDSGTKNICQETGYVNLLNTYNVNTVTAKAKFLSKISKIYFDADLNEFVFEFSWKDIGSINLKEDEEIPLYLGMNKVWKVRTHITRYKKNKEKRSYEEIDGTEMMKAVMKNYPDMIGKDIDITKLSSKDIQAVYEVFTYYANGFIPRIGNEDSEFISPVSTWTSIGNVPYDEMSAYQLAKKSLLGINKIQFTEDSGRYQYTPVSKVEWYNSLL

SEQ ID NO: 1465 - protein, 327 aa, unidentified
  REGION 1..327: note = Description of Unknown:uncultivated organism sequence
  REGION 1..327: note = Category: MG61 effectors
  REGION 1..327: note = Description: MG61-301 effector
MDFTKFQKLNSIIKTCSFEMIPIGKTRETMEKHNVIEEDAERKSNAELTKEVSDSFIREFIADYKEDMDWKDLYDAYGEDRARFTDIMNQKAEKLAKRFSDSFNEYINTFLKANGIKDKKSKWSDSGYVDVVLPLYVSIHPDFSNDKYERAVASLLHCSNSLFKKYTTSYARIIAGTKKGSFADRSMENFQTACANSVMFDLISINLSNVGSHDAFKEVFADAPLNMNEYLSQKGISRYNEFVGDSFDESGQVIRYGVNHYINEWNQTHPDERMPKMHKLKKQILSIVEPSFRIRTINDETELFGTFDNIRTAEQRYAGMLESILEK

SEQ ID NO: 1466 - protein, 278 aa, unidentified
  REGION 1..278: note = Description of Unknown:uncultivated organism sequence
  REGION 1..278: note = Category: MG61 effectors
  REGION 1..278: note = Description: MG61-302 effector
MDFTKFQKLNSIIKTCSFEMIPIGKTRETMEKHNVIEEDAERKSNAELTKEASDSFIREFIADYKEDMDWKDLYDAYGEDRARFTDIMNQKAEKLAKRFSDSFNEYINTFLKANGINDKKSKWSDSGYVDVVLPLYVSIHPDFSNDKYERAVASLLHCSNSLFKKYTTSYARIIAGTKKGSFADRSMENFQTACANSVMFDLISRNLSSVGSHDAFKEVFADAPLNMNEYLSQKGISRYNEFVGDSFDESGQVIRYGVNHYINEWNQTHPDERMPKMH

SEQ ID NO: 1467 - protein, 367 aa, unidentified
  REGION 1..367: note = Description of Unknown:uncultivated organism sequence
  REGION 1..367: note = Category: MG61 effectors
  REGION 1..367: note = Description: MG61-303 effector
MIRGIDNLLYYAVVDENGNRIEAGDLNVVGDTDFYEKLTILGKQRYTDQKNWKHENKVADLKDTYLGQVCRKIASIAVKNNAVIVIDKINESTKRKNAAFDNNMYRKFENALVNSLTDYYDIGIRGDEPGSVKTPLQLTVKEDNGFQNGIIFYQFDTFTKNICMRTGFVNLLNTFEIKTVASKVAFLKKLSGIYYDNDINEFVFEFTWRNIGWILKEEELPLYDGMDKIWKVRTHFTRYMRNAEKNKYVEIDGTEVLKELIRKNHPDMIGGKIDVDRLTSEEVKKVFEIFTLYTNGYIPRMDDAESGYMSPACDWNNFGTIRYDEMTALQLAKKSSLMIGKVKSGKDWKDMNVSRVEWLNHVLKADW

SEQ ID NO: 1468 - protein, 410 aa, unidentified
  REGION 1..410: note = Description of Unknown:uncultivated organism sequence
  REGION 1..410: note = Category: MG61 effectors
  REGION 1..410: note = Description: MG61-304 effector
FVHIISRKYKEATYNMNYAKFTKQGKLIKGIKLELVPQGNTRDAISEYKIVEADQQLADMVKEVVMAGNEFYKDFIKQIVEHMDGTDWQAYGEAVENKTADQKAYDEAVKSISASIKNAILDTAELYGGKKTLFAKDFITIVLRKYVETAENFPYNRERVLTCIDVLSDKNVLFKTPYVKWEHIIFGESKGSIAERMLSNFDIFYDNKNKYAALKEATAITDFDDFFTDYASYTRYVGQDGIELYNSAIRGIYSESGAKISEGINEYINKLKMKHPELHVNMLKKLQKQILSNSEPLFKVATIQNAEELKGIMNKVKVTEESVLSSAKELLVHMETSDLHDLYISGQRLYFVCQKIAKDGGLLEELIFNDECSRVEKLTEKKKEEIRGAIVKHDYSFAYVDSLLSEYAEK

SEQ ID NO: 1469 - protein, 1259 aa, unidentified
  REGION 1..1259: note = Description of Unknown:uncultivated organism sequence
  REGION 1..1259: note = Category: MG61 effectors
  REGION 1..1259: note = Description: MG61-305 effector
MDFTKFQKLNSIIKTCSFEMIPIGKTRETMEKHNVIEEDAERKSNAELTKEVSDSFIREFIADYKEDMDWKDLYDAYGEDRARFTDIMNQKAEKLAKRFSDSFNEYINTFLKANGINDKKSKWSDSGYVDVVLPLYVSIHPDFSNDKYERAVASLLHCSNSLFKKYTTSYARIIAGTKKGSFADRSMENFQTVCANSVMFDLISRNLSSVGSHDAFKEVFADAPLNMNEYLSQKGISRYNEFVGDSFDESGQVIRYGVNHYINEWNQTHPDERMPKMHKLKKQILSIVEPSFRIRTINDETELFGTFDNIRTAEQRYAGMLESILENMNTADIYDKSGILVTSAERDSLANAITGEWSYFRRQIKEEEENRIREEYLQKKNRVKTKLTQKDNKQIEDALNKSIYSVADLNKMLGSDFGTIEEKLLDEYIRNKSKKESAYAQLVKTDFYDKKTIPAGDDVQRIQQYLDKVLSLTHIVRGLCADSQDPRTDFVFSDDVSSLEDDRVQIISCYNLIRNFVTKKREKTAKEKQIQLCFGRPAHFEQVWNNKQEGKFGNVDAALLEYAGKYYYMVPAAKNEAKLNFPVTDEPQMGECYNYLATKKAIGFAKAFAKFYIKSPEAMEGFEKTEEPFEISVGNDTMIISRKVYEDYEAKTFRESEEAKNKLIDCAKEFLSKNLSYCIYDWSVLKEANDYVNYGEFCNEVDSIAFRVINRYVSKKLVDDAVERGNLYMFEISSLDMYKDSSRMKNIMALRFNQIMNGMFTGDKSIIINNAPQIRYRPVVIEKKDVHPVGSRLVNKNTTDGRTIPGDVYLELCAYYNGKKDSLSPEASLYNEKVSVKDSDRAHIKDKHYTEEKFLITFSYTANKNVASATSGYQLNEMVRKEIRENGCNIMAVIRGIDNLLYYAVVDENGNRIEAGDLNVVGDTDFYEKLTILGKQRYTDQKNWKHENKVADLKDTYLGQVCRKIASIAVKNNAVIVIDKINESTKRKNAAFDNNMYRKFENALVNSLTDYYDIGIRGDEPGSVKNPLQLTVKEDNGFQNGIIFYQFDTFTKNICMRTGFVNLLNTFEIKTVASKVAFLKKLSDIYYDNDINEFVFEFTWRNIGCILKDEELPLYDGMDKIWKVRTHFTRYMRNAEKNKYVEIDGTEVLKELIRKNHPDMIGGKIDVDRLTSEEVKKVFEIFTLYTNGYIPRMDDAESGYMSPACDWNNFGTIRYDEMTALQLAKKSSLMIGKVKSGKDWKDMNVSRVEWLNHVLKADW

SEQ ID NO: 1470 - protein, 1334 aa, unidentified
  REGION 1..1334: note = Description of Unknown:uncultivated organism sequence
  REGION 1..1334: note = Category: MG62 effectors
  REGION 1..1334: note = Description: MG62-1 effector
MKTFENFTNLYELNKTLRFELKPIWGTKELIEEKHILKLDKEKRENYEKVRPYFNKIHQEFINFALKNPNFDFLKHKEKYLNWLKDKKNKDLLKEKEKIDKIFLEKIWELFENSVKDFLKENGFESIIKQEDQDLKFFRRKEIFEVLQEKYGSELETQIIWKDWETKSIFSGWDKWLWYFDKFFNTRDNFYKTDGTSTAIATRIIKDNLKIFLENTIIFEKVKNKKIDFSEVEKNFSINIDSFFEINNFNNYFLQDGIDFYNKIIWWETLENWKKLKGLNEIINKYRQDTGDKIPYFKKLQKQILSEKDWVFIEKIEDDGGFYDILKKFYENAVEKEWFLRNIFENFYGIWDENLEKIYFNKVAFNTISHKFWNAQEFEKILYEEMKKSKVDWIKFEKKENKYKFPDFIQIIFIKKALENYDSENLFWKERYYKSEENTDWFLERNNKNLWEQFCKIFKFEFLNILKRKIIDDAWEEHEVWFDISKEILWKKLENFELNQENKWIIKDFADYALVLYSFWKYFAVEKWRNWDPNTEDIDDEFYKWENWYIEKFYDTGYDEIVKPYNLMRNYISKKPWEDSKKWKINFETSSLLSWWDKNLESNWSYIFQKWNKYYIWIINWSKPAKEVLEKLYSWNGEKIKRFIYDFQKPDNKNTPRMFIRSKKDSFSPAVGKYNLPVEDILEIYDNWLFKTENKDNSNYKESLSKLIDYFKLGFSKHESFKHFNFVWKDSKEYENIADFYRDVEKSCYQITSEFLDFEELKKLTFKKHLYLFQIYNKDFELDESLQKNWYNFRDEWQKNIHTKYFEALFLEENILRKSWAVFKLSWGWEVFFRKESIKAEKEKRKNIEVTKNRRYTEEKYFLHFPIQVNFKNEISWNFNQEINKFLANNPDINIIGIDRWEKHLAYFSVINQKWEILESGSFNKIENYDKNGEKILYSEREIKKTYKDWKLIDLELVETWKKVDYVDYKLLLEYKEEKRILQRQSWKEVEQIKDLKKWYISLLVRKIADLIIKYNAIVIFENLNFRFKQIRGWIEKSIYQQLEKALIDKLSFLVNKNEINLEKAGSLLKAYQLTVPVDSLKEIWKQTWVIFYTEAAYTSKIDPITGWRPNLYLKKNNSKINKENILKFDNIIFNSKENRFEFTYDLKKFLWKDAKFPEKTIWTVCSCVERFKWNKFLANNLWDYDHYEDLTDWKLLNRALKEWEFSNFKELFKKYLIDINWNILEQIKNLDTKNNERFFSEFINLFSLICQIRNTNQKEKWDENDFILSPVEPFFDSRKSKKFWKNLPKNGDENWAFNIARKGLIILDRISQNPEKTDLLILNSDWDNFVRNA

SEQ ID NO: 1471 - protein, 1333 aa, unidentified
  REGION 1..1333: note = Description of Unknown:uncultivated organism sequence
  REGION 1..1333: note = Category: MG62 effectors
  REGION 1..1333: note = Description: MG62-2 effector
MKNFQDFTNLYELSKTLRFELKPIWGTKKLIEEKNILKLDKKKRENYEKVKPYFNKIHQEFINFALRNPNFDFSQFEEKYLNWLKDKKNKDLLKEKESIDKIFLEKIWKLFENSVKDFLKENGFESIVKSEDQNLKFFRRKEIFEVLQEKYGSELETQMVNKDWEIKSIFNGWEKWLWYFDKFFNTRDNFYKTDWTSTAIATRIIKDNLKIFLENTIIFEKVKNKKIDFSEVEKNFSVSIDTFFEINNFNNCFLQDWIDFYNKVIWGETLENWEKLKWLNEIINKYRQDTGEKIPYFKKLQKQILSEKDWVFIDKIEDDGGFYEVLKNFYKNAAEKEWFLKNIFENFYTISDKNLEKIYFNKIAFNTISHKFWSALEFERILYEEMKKEKADWIKFEKKENKYKFPDFIQIIFIKRSLENYDSENLFWKERYYKSEENVDWFLEKNNNNIWEQFCKILNFEFLNILKRRIIDEAWEEYEVWFEISKNILWEKLENFELNQENKWIIKDFADYSLALYSFWKYFAVEKWRNWDLNIDISDDFYGWEDWYIEKFYNTGYDEIVKPYNLMRNYISKKPWEDSKKWKINFETSSLLSWWDKNLESNWSYIFQKWNKYYIWIINWSKPAKEVLEKLYSWNGEKIKRFIYDFQKPDNKNTPRMFIRSKKDSFSPAVGKYNLPVEDILEIYDNWLFKTENKDNSNYKESLSKLIDYFKLGFSKHESFKHFNFVWKDSKEYENIADFYRDVEKSCYQITSEFLDFEELKKLTFKKHLYLFQIYNKDFELDESLQKNWYNFRDEWQKNIHTKYFEALFLEENILRKSWAVFKLSWGWEVFFRKESIKAEKEKRKNIEVTKNRRYTEEKYFLHFPIQVNFKNEISWNFNQEINKFLANNPDINVIWIDRWEKHLAYFSVINQKWEILESWSFNKIENYNKNWEKLLFPEREIKEIHKDWSLIDLELVETWRKVDYVDYKLLLEYKERKRLLQRQSWKEVEQIKDLKKWYISALVRKIADLIIKHNAIVIFEDLNFRFKQIRGWIEKSIYQQLEKALIDKLNFLVNKNEINLEKAGSILKAYQLTVPVDSLKEIWKQTWVIFYTEAAYTSKIDPIKWWRPNLYLKKQNAEINKENILKFDNIIFNSKENRFEFTYDLKKFFWKDSKFPAKTVNTVCSCVERFKWNRNLNNNKWGYIHYENLTDWKLANKEQKEDEFSNFKELFEKYFIDINWNILEQIKNLDTKNNEKFFSSFIDLFTLVCQIRNTNQNAKWDENDFILSPVEPFFDSRKSQNFWKSLPKNWDENWAFNIARKGLIILNRISENPEKPDLLIFNADWDNFARNI

SEQ ID NO: 1472 - protein, 1333 aa, unidentified
  REGION 1..1333: note = Description of Unknown:uncultivated organism sequence
  REGION 1..1333: note = Category: MG62 effectors
  REGION 1..1333: note = Description: MG62-3 effector
MKNFQDFTNLYELSKTLRFELKPIWGTKKLIEEKNILKLDKKKRENYEKVKPYFNKIHQEFINFALRNPNFDFSQFEEKYLNWLKDKKNKDLLKEKESIDKIFLEKIWKLFENSVKDFLKENGFESIVKSEDQNLKFFRRKEIFEVLQEKYGSELETQMVNKDWEIKSIFNGWEKWLWYFDKFFNTRDNFYKTDWTSTAIATRIIKDNLKIFLENTIIFEKVKNKKIDFSEVEKNFSVSIDTFFEINNFNNCFLQDWIDFYNKVIWGETLENWEKLKWLNETINKYRQDTGEKIPYFKKLQKQILSEKDWVFIDKIEDDGGFYEVLKNFYKNAAEKEWFLKNIFENFYTISDKNLEKIYFNKIAFNTISHKFWSALEFERILYEEMKKEKTDWIKFEKKENKYKFPDFIQIIFIKRALENYDSENLFWKERYYKSEENADWFLEKNNNNLWEQFCKILNFEFLNILKRRIIDEAWEEYEVWFEISKNILWEKLENFELNQENKWIIKDFADYSLALYSFWKYFAVEKWRNWDLNIDISDDFYGWEDWYIEKFYNTGYDEIVKPYNLMRNYISKKPWEDNKKWKINFETSSLLSGWDKNLESNWSYIFQKWNKYYLWIINWSKPTNEILEKLYSWDGEKIKRFVCDFQKPDKKNTPRMFIRSKKDSFSPAVEKYNLPINDILEIYDNWLFKTENKDNPNYKESLRKLIDYFKLGFSKHESFKHFNFVWKDSKSYENIADFYRDVEKSCYKIDFEFLNFEELKKLTFEKHLYLFQIYNKDFELDESLQEKWYNFKGEWQKNIHTKYFEALFLEENISRKSWAVFKLSWGWEVFFRKKSIEVEKEKRNSVEVIKNKRYTECKYFLHFPIQVNFKEEISWNFNQEINKFLANNPDINVIWIDRWEKHLAYFSIINQKWEILESWSFNKIENYNKNWEKLLFPEREIKEIHKDWSLIDLELVETWRKVDYVDYKLLLEYKERKRLLQRQSWKEVEQIKDLKKWYISALVRKIADLIIKHNAIVIFEDLNFRFKQIRGWIEKSIYQQLEKALIDKLNFLVNKNEINLEKAGSILKAYQLTVPVDSLKEIWKQTWVIFYTEAAYTSKIDPITGWRPNLYLKKNNSKINKENILKFNNIVFNSKENRFEFTYDLKKFFWKDSKFPAKTVNTVCSCVERFKWNRNLNNNKWGYIHYENLTDWKLANKEQKEDEFSNFKELFEKYFIDINWNILEQIKNLDTKNNEKFFSSFIDLFTLVCQIRNTNQNAKWDENDFILSPVEPFFDSRKSQNFWKSLPKNWDENWAFNIARKGLIILNRISENPEKPDLLIFNADWDNFARNI

SEQ ID NO: 1473 - protein, 372 aa, unidentified
  REGION 1..372: note = Description of Unknown:uncultivated organism sequence
  REGION 1..372: note = Category: MG70 effectors
  REGION 1..372: note = Description: MG70-1 effector
MNYNTVYVGMDVHKESFTLCAYTIDAEKGSHFQRTEADYKNVLKYLEFLRTVYGNDANFICGYEAGCLGYTLYHQLTEHDVNCVILAPTTMLEQRSKRRIKTDRRDAEIIGKCLAQHNYSPVHIPTATDEETKEFLRMRDDHKLALKKVKQQILAFCLRHNYRYDGNSHWTAAHIKWLKSLNPEALYKEILDEYLLTYTTLSDKVERLDKRIEELASKDEYRESVKKLCCFIGIKTHTALSVLVEVGDFQRFASAQNFASYLGLVPGEDSSGDGQTRLGITKAGNRHVRMLLTEASQCYARGQIGFKSKELKSRQAGNSPQVIAYADKANERLRRRYYKMVLGKSKKHNVAKTAIARELACFMWGMMTEHIA

SEQ ID NO: 1474 - protein, 167 aa, unidentified
  REGION 1..167: note = Description of Unknown:uncultivated organism sequence
  REGION 1..167: note = Category: MG70 effectors
  REGION 1..167: note = Description: MG70-2 effector
MEFLRTIYGDDANFICGYEAGCLGYNLYHQLTANNIKCIILAPTTMLEQRSKKRIKTDKRDAEIIAKCLAQHNYSPVHIPTAKDEETKEFLRMRDDHKLALKKVPLLDRYKFYSHVICSGTKIKVITQPIDNRFYSHVICSGTKIHAADNTEAPVFYSHVICSGTKI

SEQ ID NO: 1475 - protein, 50 aa, unidentified
  REGION 1..50: note = Description of Unknown:uncultivated organism sequence
  REGION 1..50: note = Category: MG70 effectors
  REGION 1..50: note = Description: MG70-3 effector
MNNTTVYVGMDVHKESFTLCAYTLEKEKGSYSRRTPADYKEVLKYLEFLR

SEQ ID NO: 1476 - protein, 172 aa, unidentified
  REGION 1..172: note = Description of Unknown:uncultivated organism sequence
  REGION 1..172: note = Category: MG70 effectors
  REGION 1..172: note = Description: MG70-4 effector
MNYNTVYVGIDVHKESFSLCAYTIETKKASHYQKTDADYKNVLKYVEFLRTIYGDDANFICGYEAGCLGYNLYHQLTANNIKCIILAPTTMLEQRSKKRIKTDKRDAEIIAKCLAQHNYSPVHIPTAKDEETKEFLRMRDDHKLALKKVPLLDRYKFYSHVICSGTKIQREV

SEQ ID NO: 1477 - protein, 182 aa, unidentified
  REGION 1..182: note = Description of Unknown:uncultivated organism sequence
  REGION 1..182: note = Category: MG70 effectors
  REGION 1..182: note = Description: MG70-5 effector
MNYNTVYVGIDVHKESFSLCAYTIETKKASHYQKTDADYKNVLKYVEFLRTIYGDDANFICGYEAGCLGYNLYHQLTANNIKCIILAPTTMLEQRSKKRIKTDKRDAEIIAKCLAQHNYSPVHIPTAKDEETKEFLRMRDDHKLALKKVPLLDRYKFYSHVICSGTKIRILCNPIIISFTVT

SEQ ID NO: 1478 - protein, 172 aa, unidentified
  REGION 1..172: note = Description of Unknown:uncultivated organism sequence
  REGION 1..172: note = Category: MG70 effectors
  REGION 1..172: note = Description: MG70-6 effector
MNYNTVYVGIDVHKESFSLCAYTIETKKASHYQKTDADYKNVLKYVEFLRTIYGDDANFICGYEAGCLGYNLYHQLTANNIKCIILAPTTMLEQRSKKRIKTDKRDAEIIAKCLAQHNYSPVHIPTAKNEETKEFLRMRDDHKLALKKVPLLDRYKFYSHVICSGTKIQREV

SEQ ID NO: 1479 - protein, 183 aa, unidentified
  REGION 1..183: note = Description of Unknown:uncultivated organism sequence
  REGION 1..183: note = Category: MG70 effectors
  REGION 1..183: note = Description: MG70-7 effector
MNYNTVYVGIDVHKESFSLCAYTIETKKASHYQKTEADYKNVLKYVEFLRTIYGDDANFICGYEADCLDYNLYHQLTANNIKCIILAPTTMLEQRSKKKRIKTDKRDSEIIAKCLAQHNYSPVHIPTAKDEETKEFLRLRDDHKLALKKVPLLDRYKFYSHVICSGTKICTDTWVMMSCFTVT

SEQ ID NO: 1480 - protein, 198 aa, unidentified
  REGION 1..198: note = Description of Unknown:uncultivated organism sequence
  REGION 1..198: note = Category: MG70 effectors
  REGION 1..198: note = Description: MG70-8 effector
MNYNTVYVGIDVHKESFSLCAYTIETKKASHYQKTEVDYKNVLKYVEFLRTIYGDDANFICGYETGYLGYNLYHQLTANNIKCIILAPTTMLEQRSKKRIKTDKRDAEIIAKCLAQHNYSPVHIPTAKDEETKEFLRMRDDHKLALKKVPLLDRYKFYSHVICSGTKIESEEVTRLGQFYSHVICSGTKINCCIAVLH

SEQ ID NO: 1481 - protein, 173 aa, unidentified
  REGION 1..173: note = Description of Unknown:uncultivated organism sequence
  REGION 1..173: note = Category: MG70 effectors
  REGION 1..173: note = Description: MG70-9 effector
MNYNTVYVGMDVHKESFSLCAYTIEAEKASQYQRTEADYKKVLNYLEFLRTIYGDDANFICGYETGYLGYNLYHQLTANNIKCIILAPTTMLEQRSKKRIKTDKRDAEIIAKCLAQHNYSPVHIPTAKDEETKEFLRMRDDHKLALKKVPLLDRYKFYSHVICSGTKIFSLPG

SEQ ID NO: 1482 - protein, 173 aa, unidentified
  REGION 1..173: note = Description of Unknown:uncultivated organism sequence
  REGION 1..173: note = Category: MG70 effectors
  REGION 1..173: note = Description: MG70-10 effector
MNYNTVYVGMDVHKESFSLCAYTIETEKASHYQKTEVDYKNVLKYVEFLRTIYGDDANFICGYETGYLGYNLYHQLTANNIKCIILAPTTMLEQRSKKRIKTDKRDAEIIAKCLAQHNYSPVHIPTAKDEETKEFLRMRDDHKLALKKVPLLDRYKFYSHVICSGTKIFSLPG

SEQ ID NO: 1483 - protein, 198 aa, unidentified
  REGION 1..198: note = Description of Unknown:uncultivated organism sequence
  REGION 1..198: note = Category: MG70 effectors
  REGION 1..198: note = Description: MG70-11 effector
MNYNTVYVGMDVHKESFSLCAYTIETEKASHYQKTEVDYKNVLKYVEFLRTIYGDDANFICGYETGYLGYNLYHQLTANNIKCIILAPTTMLEQRSKKRIKTDKRDAEIIAKCLAQHNYSPVHIPTAKDEETKEFLRMRDDHKLALKKVPLLDRYKFYSHVICSGTKIIGGFVKHHDLFYSHVICSGTKICMPSFRTT

SEQ ID NO: 1484 - protein, 151 aa, unidentified
  REGION 1..151: note = Description of Unknown:uncultivated organism sequence
  REGION 1..151: note = Category: MG70 effectors
  REGION 1..151: note = Description: MG70-12 effector
MNYNTVYVGMDVHKESFSLCAYTIETEKASHYQKTEVDYKNVLKYVEFLRTIYGDDANFICGYETGYLGYNLYHQLTANNIKCIILAPTTMLEQRSKKRIKTDKRDAEIIAKCLAQHNYSPVHIPTAKDEETKEFLRMRDDTSWLSKKYLF

SEQ ID NO: 1485 - protein, 199 aa, unidentified
  REGION 1..199: note = Description of Unknown:uncultivated organism sequence
  REGION 1..199: note = Category: MG70 effectors
  REGION 1..199: note = Description: MG70-13 effector
MNYNTVYVGMDVHKESFSLCAYTIETEKASHYQKTEVDYKNVLKYVEFLRTIYRDDANFICGYETGYLGYNLYHQLTANNIKCIILAPTTMLEQRSKKRIKTDKRDAEIIAKCLAQHNYSPVHIPTAKDEETKEFLRMRDDHKLALKKVPLLDRYKFYSHVICSGTKIAPQAVYHGCWFYSHVICSGTKILNVHVKHLH

SEQ ID NO: 1486 - protein, 218 aa, unidentified
  REGION 1..218: note = Description of Unknown:uncultivated organism sequence
  REGION 1..218: note = Category: MG70 effectors
  REGION 1..218: note = Description: MG70-14 effector
MNYNTVYVGMDVHKESFSLCAYTIETEKASHYQKTEVDYKNVLKYVEFLRTIYRDDANFICGYETGYLGYNLYHQLTANNIKCIILAPTTMLEQRSKKRIKTDKRDAEIIAKCLAQHNYSPVHIPTAKDEETKEFLRMRDDHKLALKKVPLLDRYKFYSHVICSGTKIAPQAVYHGCWFYSHVICSGTKMQGLISPSTLGFYRHVICSGTKIGNTADS

SEQ ID NO: 1487 - protein, 214 aa, unidentified
  REGION 1..214: note = Description of Unknown:uncultivated organism sequence
  REGION 1..214: note = Category: MG70 effectors
  REGION 1..214: note = Description: MG70-15 effector
MNYNTVYVGMDVHKESFSLCAYTIETEKASHYQKTEVDYKNVLKYVEFLRTIYRDDANFICGYETGYLGYNLYHQLTANNIKCIILAPTTMLEQRSKKRIKTDKRDAEIIAKCLAQHNYSPVHIPTAKDEETKEFLRMRDDHKLALKKVPLLDRYKFYSHVICSGTKIAPQAVYHGCWFYSHVICSGTKMQGLISPSTLGFYRHVICSGTKIKV

SEQ ID NO: 1488 - protein, 172 aa, unidentified
  REGION 1..172: note = Description of Unknown:uncultivated organism sequence
  REGION 1..172: note = Category: MG70 effectors
  REGION 1..172: note = Description: MG70-16 effector
MNYNTVYVGMDVHKESFSLCAYTIETKKASHYQKTEADYKNVLKYVEFLRTIYGDDANFICGYEAGCLGYNLYHQLTANNIKCIILAPTTMLEQRSKKRIKTDKRDAEIIAKCLAQHNYSPVHIPTAKDEETKEFLRMRDDHKLALKKVPLLDRYKFYSHVICSGTKIVPSQ

SEQ ID NO: 1489 - protein, 372 aa, unidentified
  REGION 1..372: note = Description of Unknown:uncultivated organism sequence
  REGION 1..372: note = Category: MG70 effectors
  REGION 1..372: note = Description: MG70-17 effector
MNYNTVYVGMDVHKESFTLCSCKYEDEKASHYQRTPASYKNVLRYLAFLRTIYGEDTRFVCGYEAGCLRYSLYHQLENFNVECVILAPTTMLEQRSKRRIKTDKRDAEIIAKSLAQHNYSPVHIPTKMDNQTKEFIRMRDDHKAELKKIKQQILSFCLRQGYQYDGSGNWTAKHVKWLRSLKPAGLYKEILDEYLLTYTILTDKLNRLDQRIEELASKEEYKESVSKLTCFLGIKIHTALSVIVEVGDFQRFVSARKFAGYLGLVPGQHSSGDDRNGLGITKAGNTHVRRLLVESAQSYTRGKIGYKSRVLRSRQAGNSPQIINYADRANERLRRRYYQMVLKDGKKYNIAKIAVARELACFIWGMMTDNIY

SEQ ID NO: 1490 - protein, 414 aa, unidentified
  REGION 1..414: note = Description of Unknown:uncultivated organism sequence
  REGION 1..414: note = Category: MG70 effectors
  REGION 1..414: note = Description: MG70-18 effector
MQFGFLGIDYKNADLTIRDEISFTDQKKLEFFHKAEEIGVEQVMILSTCNRSEIYYFFDDEQQIKKIQNIYCDMFDKAEIEQYIRHCEEDKAVSYLFQVTAGLESMVLGEDQILGQVKDALDFSRTMGFSKKELNKVVRDAITCAKKVKTTFRISEKPVSVGYIGICELQKICDIKDKMVLVIGSGDTAVLALRYLQEYEAGKIYLCSRTLAHAGNVQKEFQEIEIISYEQRYEIMKQCDIVVSATSAPHVVVKQEYYTPEKQVTFLDLATPRDIDPKLSDDSKVNLINLDTIKEISKANQSEREELCRQSNTMISKAKEETMQWLFQAPMEETIRSLQEKCTEIVEDSYSYLSRKIDFGTREQKLLKKVLNASLQRMIKEPIQELKHLETRQEQADYKKMVEQLFGIETKKGK

SEQ ID NO: 1491 - protein, 372 aa, unidentified
  REGION 1..372: note = Description of Unknown:uncultivated organism sequence
  REGION 1..372: note = Category: MG70 effectors
  REGION 1..372: note = Description: MG70-19 effector
MYYNTIYVGMDVHKSSFTLCSYTIEAEKVSHFQRTEADYKKVLKYLEFLRTVYGDDARFVCGYEAGCLGYTLYHQLTEHHVECVILAPTTMLEQRSRKRIKTDKRDAEVIARCLAQHNYSAVHIPTATDEETKEYLRMRNDHKLALKRIKQQILAFCLRHGHIYGGKSNWTISHLKWLKELELNSMHREILDEYLLTYTTLTDKLERLDSRIEEIASKPEYNESVKKLSCFIGIKTHTALSTLVEVGDFHRFATASKFASYLGLVPGEDSSGDDQTRLGITKAGNRHLRLLLTEAAQCYARGQIGYKSKALKARQSGNPPEIIAYADKANERLRRKYYKMVLQERKTHNVAKTAITRELACFIWGMMTDRIA

SEQ ID NO: 1492 - protein, 198 aa, unidentified; identical to SEQ ID NO: 1480
  REGION 1..198: note = Description of Unknown:uncultivated organism sequence
  REGION 1..198: note = Category: MG70 effectors
  REGION 1..198: note = Description: MG70-20 effector

SEQ ID NO: 1493 - protein, 373 aa, unidentified
  REGION 1..373: note = Description of Unknown:uncultivated organism sequence
  REGION 1..373: note = Category: MG70 effectors
  REGION 1..373: note = Description: MG70-21 effector
MNYSIVYLGIDAHMQSFSLCCYTNEKEKAEYPQKVDGHYSKVINYIEAMRFHFGDDALFICGYEAGSLGFTLYHQLTDHGVKCVILAPTTMPTQKGGKRIKTDKRDAALIARCLAHRDYSPVHIPTEQDEQTKEYIRMRDDHKLALKKVKQQILSFCLRHNYRFDGTKHYWTQAHLNWLRALKPEGLYAEILMEYLLTYDNLTNKIERLDKRIEELAAGDAYRQNVHKLSCFLGVKTITALSVLTEVGDFKRFASAQHFSSYIGLTPGEDSSGNDKKRLGITKAGNRHVRTLLVEAAQNYSRGRIGVKSKALMARQEGNAPEVIAYADKANERLRRKYYRMVLKNNKKTNVAKTAVARELACFMWGMVTGNVV

SEQ ID NO: 1494 - protein, 373 aa, unidentified
  REGION 1..373: note = Description of Unknown:uncultivated organism sequence
  REGION 1..373: note = Category: MG70 effectors
  REGION 1..373: note = Description: MG70-22 effector
MEYSTVYVGMDVHKNSFSLCCFTNEKEEAEYPQKVTAHYSKVINYIEAMRFHYGNDALFICGYEAGCLGYTLYHQLTDHNIKCVILAPTTMAQQRGKKKVKTDKRDAALIARCLAHHDYSAVHIPTDQDEQTKEYIRMRDDHKLALKKIKQQILSFCLRHNCHYDGTKTHWTQTHLNWLRSLKLDGLYQEILDEYLLTYDRLSEKLERLENRIEELASGEAYADNVHKLSCFIGVKTTTALAALTEVGDFKRFETAQQFSSFLGLTPGEDSSGDDQNRLGITKAGNRHLRMLLIEAAQCYSRGAIGSKSKALKQRQEGNKPEVISYADKANERLRRKYYRMVLHNSKKANVAKTAVARELACFVWGMMVEDFA

SEQ ID NO: 1495 - protein, 372 aa, unidentified
  REGION 1..372: note = Description of Unknown:uncultivated organism sequence
  REGION 1..372: note = Category: MG70 effectors
  REGION 1..372: note = Description: MG70-23 effector
MNYNTVYVGMDVHKESFTFCAYTIDAEKGSHFQRTEADYKNVLKYLEFLRTVYGNDANFICGYEAGCLGYTLYHQLIEHHVNCVILAPTTMLEQCSRRRIKTDRRDAEIIAKCLAQHNYSPVHIPTATDEETKEFLRMRDDHKLALKKVKQQILAFCLRHNYRYDGNSHWTAAHIKWLKSLKPEALYKEILDEYLLTYTTLSDKLERLDKRIEELASKDEYRESVKKLCCFIGIKTHTALSVLIEVGDFQRFASAQKFASYLGLVPGEDSSGDEQTRLGITKAGNRHVRMLLTEASQCYARGQIGFKSKELKSRQAGNSPQVIAYADKANERLRRRYYKMVLGKSKKHNVAKTAIARELACFMWGMMTDHIT

SEQ ID NO: 1496 - protein, 376 aa, unidentified
  REGION 1..376: note = Description of Unknown:uncultivated organism sequence
  REGION 1..376: note = Category: MG70 effectors
  REGION 1..376: note = Description: MG70-24 effector
MNTNTIYVGMDVHKESFSLCCYSIEKDEASHQQKIGADYRLILKYLGSMRGVFGEDTEFVCGYEAGCLGFTLYRQLTDLNVKCIILAPTTMMAEQGRKRIKTDKRDAVLIARCLAYHTYHAVHIPTEQDEQIKEYIRMRDDHRLALKKDKQQILSFCLRHGFQYTETNSRWTQAHINWLRKLELEGLYQETMAEYLMTFDRLTEVIERLDKRIAGLAEQDTYRSNVKKLTCFMGVKTQTALAVLVEVGDFNRFARAENIAAYIGLVPGEDSSGGDKQRLSITKAGNTHVRRLLIEAAQSYSRGVVGYKSKALKERQEGNPPEVIAYADKANTRLRRRYYHMILQNGRKANVAKTAIARELMCFMWGMVTGNIEARI

SEQ ID NO: 1497 - protein, 379 aa, unidentified
  REGION 1..379: note = Description of Unknown:uncultivated organism sequence
  REGION 1..379: note = Category: MG70 effectors
  REGION 1..379: note = Description: MG70-25 effector
MKRIIKIGMDVHSTNYTLCALEPVIGAEDKIFAQIQVTPDYKNILMFINKLMLKLEPSDDYSIECGYEAGCLGYSLYNQLTSAGVKCTILAPTTMLTPKNKRVKTDSRDALMIAQCLAYGGYHPVYVPTEEDNSVKEYLRMRDDHKLALKKVKQQIISFCMRHGHQYSGTNWTGRHIAWLRKADFSALFREALNEYLVTYEELTSKIERFDKRIEEISSQKAYQEKVKKLSCFLGIRTHTALSLIVETGDFYRYKKGNIYSSFLGMAPGENSSGDHIKRTGITKAGNSHLRRLLIESARGICKGTIGYKSKDLKSRQAGNSAEVIAYADKANQRLRSRYYKMIRHGKKKNVAVVAIARELACFVWGMMTDNIYSASSAT

SEQ ID NO: 1498 - protein, 388 aa, unidentified
  REGION 1..388: note = Description of Unknown:uncultivated organism sequence
  REGION 1..388: note = Category: MG70 effectors
  REGION 1..388: note = Description: MG70-26 effector
MESLVAIGIDVHKEKFALVAILLVLGAQDQILGEIEVGSDYKEILAFIESIKQKALPGQTYSFVCGYEAGCLGYVLYHQLTAAGVRCVIMAPTTMLSEQGKRIKTDRRDARLIAKCLCCNGYHQVYIPTAEDEDVRDYLRMRDDHQGALKKLKQQINAFVLRHGCSYVGTKWTARHIGWLMDLQNKLDEMQAETLKEYMLSYAEQKDKIERFDEKIEEIARMDRYSKLVSKLVCFLGVKTHTALSLIVETGDFMRFAKGNIFAAFLGLAPGEHSSGSGVHRLGITKAGNTHLRTLLIEAASGICKGAVGHKSKALKARQAGQESEVIAYADKANTRLRSKYYRMMRHGKKRNVAVAAVARELACFIWGMATGNTGLTRQAQASAKAGI

SEQ ID NO: 1499 - protein, 372 aa, unidentified
  REGION 1..372: note = Description of Unknown:uncultivated organism sequence
  REGION 1..372: note = Category: MG70 effectors
  REGION 1..372: note = Description: MG70-27 effector
MNYNTVYVGMDVHKESFSLCAYTIEAEKASHYQRTEADYKKVLNYLEFLRTIYGDDANFICGYEAGCLGYTLYHQLTANNVKCIILAPTTMLEQRSKKRIKTDKRDAEIIAKCLAQHNYSPVHIPTAKDEETKEFLRMRDDHKLALKKVKQQILAFCLRHNYRYDGNSHWTAAHLKWLKALTPEALYKEILDEYLLTYQTLSDKLERLDKRIEELSTQDEYKEAVKKLCCFIGVKTHTALSVLVEVGDFNRFASAQHFASYLGLVPGEDSSGNDQNRLGITKAGNRHVRLLLTEASQCYARGQVGFKSKELKARQSGNTPAVIAYADKANERLRRRYYKMVLNKCKKHNVAKTAIARELACFMWGMMTDNIA

SEQ ID NO: 1500 - protein, 372 aa, unidentified
  REGION 1..372: note = Description of Unknown:uncultivated organism sequence
  REGION 1..372: note = Category: MG70 effectors
  REGION 1..372: note = Description: MG70-28 effector
MNYNTVYVGMDVHKESFTFCAYTIDAEKGSHFQRTEADYKNVLKYLEFLRTVYGNDANFICGYEAGCLGYTLYHQLTEYHVNCVILAPTTMPEQCSKRRIKTDRRDAEIIAKCLAQHNYSPVHIPTATDEETKEFLRMRDDHKLALKKLKQQILAFCLRHNYRYDGNSHWTAAHIKWLKSLKPEALYKEILDEYLLTYTTLSDKLERLDKRIEELASKDEYRESVKKLCCFIGIKTHTALSVLVEVGDFQRFASAQKFASYLGLVPGEDSSGDEQTRLGITKAGNRHVRMLLTEASQCYARGQIGFKSKELKSRQAGNSPQVIAYADKANERLRRRYYKMVLGKSKKHNVAKTAIARELACFMWGMMTDHIA

SEQ ID NO: 1501 - protein, 371 aa, unidentified
  REGION 1..371: note = Description of Unknown:uncultivated organism sequence
  REGION 1..371: note = Category: MG70 effectors
  REGION 1..371: note = Description: MG70-29 effector
MKSIIYLGMDVHTTNYTLCCYTLEDDRMCHLQQIAPDYRLILKYMDQVRRLYNNDVEFLCGYEAGCLGYSLYHQLTAHQVRCVILAPTTMGAVLGIRKVKTDKRDAMLIAKCLAFHTYHPVHIPTPEEEQVKEFIRMRDDHKLALKRIKQQISAFCLRHGFHYTATKSKWTQAHWKWLKSLKPDGLHQETLNEYLLTCSSLSDKLERLDRRIEELAAQEPFQERVRQLTCLVGVKTHTALSIIVEVGDFNRFPTAGKFASFLGLTPGEASSSDKQNRFGITKAGNTHVRRLLVEAAQSYARGQTGRKSKDLKARQAGNKEQVIAYADKGSERLRRRFRQLLYKGKQHNVIKTAIARELSCFIWGMMTDRIA

SEQ ID NO: 1502 - protein, 378 aa, unidentified
  REGION 1..378: note = Description of Unknown:uncultivated organism sequence
  REGION 1..378: note = Category: MG70 effectors
  REGION 1..378: note = Description: MG70-30 effector
MNRIIKIGMDVHTSNYTLCIFEPSFEHDGTVHCITQVKPEVKNIIHVIETFKKKHENEELNIVCGYEAGCLGYSLYHELKEKGIECVILAPTTMKTEKGGRKLKNDYRDAKMIAECLAYGGYSAVHIPTELDNSVKEFIRMRDDIKENLKSIKQQIIAFLTRNGKQFEGKSFWTRKHIDWINTVSFSEPLLQDTLKEYMIEYNHLCNRIETLDRQIEEISLKEEYVEKVQQLQCLIGIKTHTALSLIVETSDFNRFKKGNMYSAYLGLIPGDDSSGGHENKLGITKAGNSHLRRLLVEAAQGYTRGRVGFKSKDLKSRQEKCSSEVVAYADRANERLRRKYYRMTLRGKKFNVAKTAIARELACFVWGIMTDHIDLCN

SEQ ID NO: 1503 - protein, 405 aa, unidentified
  REGION 1..405: note = Description of Unknown:uncultivated organism sequence
  REGION 1..405: note = Category: MG70 effectors
  REGION 1..405: note = Description: MG70-31 effector
MQLGYVGINYKNSDLSVRDKITFTDSGIADFMQQAEEAGVNQCMCLSTCNRCEVFYLYEDETFVQVMSDLFNDYFGLTDTKLAGVKCGEEALVYLFCIAAGLESMVLGEDQILGQLKDAADLSRTLGHSGKELNYIVREAVSCAKRIKTEYKVSEKPVSVCYVGIQELDRVCGISGKHALVIGSGKTAALAIRYLAEYGADVTVCSRTYQHAKALLKEFPDIQVIAYDKKTEALKSSDIVVSATSSPHLVIKCAELSGGKKMTLLDLAAPRDIEKSAGDICGVTLIDLDRIGGIVKSNQNERAHLLKESQCVIDEYIAETKKWLTSSRMDTTIQSLGKKCDEIVQDSYDYLNRKIDLSDHDRVILKKILKSSLHRLLKEPIEELKNVEENEQQQYKDMVERLFGL

SEQ ID NO: 1504 - protein, 204 aa, unidentified
  REGION 1..204: note = Description of Unknown:uncultivated organism sequence
  REGION 1..204: note = Category: MG70 effectors
  REGION 1..204: note = Description: MG70-32 effector
MNYNTVYVGMDVHKESFSLCAYTIETKKASHYQKTEADYKNVLKYVEFLRTIYGDDANFICGYEAGCLGYNLYHQLTANNIKCIILAPTTMLEQRSKKRIKTDKRDAEIIAKCLAQHNYSPVHIPTAKDEETKEFLRMRDDHKLALKKVPLLDRYKFYSHVICSGTKIKVITQPIDNRFYSHVICSGTKIAWDYENCMNGFTVT

SEQ ID NO: 1505 - protein, 193 aa, unidentified
  REGION 1..193: note = Description of Unknown:uncultivated organism sequence
  REGION 1..193: note = Category: MG70 effectors
  REGION 1..193: note = Description: MG70-33 effector
MNYNTVYVGMDVHKESFSLCAYTIETKKASHYQKTEADYKNVLKYVEFLRTIYGDDANFICGYEAGCLGYNLYHQLTANNIKCIILAPTTMLEQRSKKRIKTDKRDAEIIAKCLAQHNYSPVHIPTAKDEETKEFLRMRDDHKLALKKVPLFDRYKFYSHVICSGTKIMFAGVAVYFGFYSHVICSGTKIVLH

SEQ ID NO: 1506 - protein, 415 aa, unidentified
  REGION 1..415: note = Description of Unknown:uncultivated organism sequence
  REGION 1..415: note = Category: MG70 effectors
  REGION 1..415: note = Description: MG70-34 effector
MIFGYVGICYKEAPLALRGQVALPDSKKIELWERLSVIGLKQCVIVSTCNRSEIFYFSHSDAVTGEQVQSCYQDIFPNVSFGDYCKKKEGSEAVSYLFRVAAGLESLVVGEDQILGQVVEAMDFARTMGHSGKELERIVRDAVTCAKWIKTNYRISEKPLSVSYIGVKELHRAGGVSGKNILVIGSGKTAALALTYLFEYGAKKIYLCSRTLAHAKELLAVHENLTVVDYHERYDAMKRCETVVSATSSPHLVVLYDKWKETGVTQMQFLDLASPRDIDSRLQEVPGVQLIDMDTLQKITEKNQNEREKLAADCEQVIEEKVQETMEWLLLSRVDGTIETLQKRCLQIETDSYEYLNRKISLNHREQKLLKKVLHASLQRLIREPIQELKQLEDEEKQKEYQNILKTLFRMYEDE

SEQ ID NO: 1507 - protein, 405 aa, unidentified
  REGION 1..405: note = Description of Unknown:uncultivated organism sequence
  REGION 1..405: note = Category: MG70 effectors
  REGION 1..405: note = Description: MG70-35 effector
MQLGYVGINYKNTDLSVRDKITFTDSGIADFMQQAEEAGVNQCMCLSTCNRCEVFYLYEDETFVQVMSDLFNDYFGLTDTKLAGVKCGEEALVYLFCIAAGLESMVLGEDQILGQLKDAADLSRTLGHSGKELNYIVREAVSCAKRIKTEYKVSEKPVSVCYVGIQELDRVCGISGKHALVIGSGKTAALAIRYLAEYGADVTVCSRTYQHAKALLKEFPDIQVIAYDKKTEALKNSDIVVSATSSPHLVIRASELSEGKKMTLLDLAAPRDIEKSAGDICGVTLIDLDRIGGIVKSNQNERAHLLKESQCVIDEYIAETKKWLTSSRMDTTIQSLGKKCDEIVQDSYDYLNRKIDLSDHDRVILKKILKSSLHRLLKEPIEELKNVEENEQQQYKDMVERLFGL

SEQ ID NO: 1508 - protein, 377 aa, unidentified
  REGION 1..377: note = Description of Unknown:uncultivated organism sequence
  REGION 1..377: note = Category: MG70 effectors
  REGION 1..377: note = Description: MG70-36 effector
MNRIIKIGMDVHTTNYTLCIFEPSFEHDGTVHCITQVKPEVKNILRVIETFKNKHPEESFKITCGYEAGCLGYSLYHDLKAKGIECVILAPTTMKVEKGGRKIKNDYRDARMIAECLAYGGYSAVHVPTQLDNSVKEYIRMRDDVQSNLKSIKQQIIGFMTRNGKFYDGKSYWTQKHLDWIRQTTFHDPLLREVLDEYMIEYSRLKERVETLDKRIEELSTKEEYVEKVKQLQCLIGIKTHTALSLIVETSDFKRFRKGDMYAAYLGLIPGEDSSAEHENRLGITKAGNRHLRRLLVEAAQGYTRGQIGFKSKALKERQEKCDHEVVAYADRANERLRRKYYRMIGRGKKYNVAKTAIARELACFVWGIMTDHIELQ

SEQ ID NO: 1509 - protein, 388 aa, unidentified
  REGION 1..388: note = Description of Unknown:uncultivated organism sequence
  REGION 1..388: note = Category: MG70 effectors
  REGION 1..388: note = Description: MG70-37 effector
MNRIIKIGMDVHSTNYTLCAMEPTIGAEDRVYGEVQVAPDYKEVVTFIASLKQKLGLDHDYSIECGYEAGCLGYTLYHQLSNAGIKCVILAPTTMLTQQGQRIKTDKRDAHLIAQCLCYGGYHPVYIPTGEDDSVKEYLRMRDDHKLALKKLKQQINAFVLRHGNQFTGTKWTIKHITWLKKLELDPMYRETLDEYLSSYEEQEAKIERYDKRIEEIADEARYQENTKKLGCFLGIRTHTALSLIVETGDFKRFAKGNTYAAFLGLAPGEHSSSKSVNRLGISKAGNTHLRCLLIEAAKGICKGAIGHKSRELRSRQSGQSAEVITYADKANTRLRSKYYRMIRHGKKKNVAVAAVARELACFIWGMMTGNISTAYSAGASNPAVSQG

SEQ ID NO: 1510 - protein, 373 aa, unidentified
  REGION 1..373: note = Description of Unknown:uncultivated organism sequence
  REGION 1..373: note = Category: MG70 effectors
  REGION 1..373: note = Description: MG70-38 effector
MKYSTVYVGMDVHKESFSLCCYTNEKEQAEYPQKVDAHYSKVINYIEAMRFHYGDDTLFICGYEAGCLGFTLYHQLMDHGVKCVILAPTTMLQQKGRKKVKTDKRDAALIARCLAHHDYSPVHIPTEQDEQTKEYIRMRDDHKLALKKVKQQILSFCLRHNYRFDGTANHWTQAHLKWLRSLKPEGLYAEILQEYLLTYDSLIDKLKRFDKRIEELAADEVYQENVRKLSCFIGVKTVTALAVLTEVGDFKRFASAQHFASYIGLTPGEDSSGDDQHRLGITKAGNRHVRSLLVEAAQSYSRGQIGFKSKALKARQDGNPPEVIAYADKANERLRRKYYHMVLKNNKKTNVAKTAVARELACFMWGMITGNVA

SEQ ID NO: 1511 - protein, 384 aa, unidentified
  REGION 1..384: note = Description of Unknown:uncultivated organism sequence
  REGION 1..384: note = Category: MG70 effectors
  REGION 1..384: note = Description: MG70-39 effector
MVTGITAYNRRSHMNSIVYVGMDVHKESYTLCCYCFDTDKVEFKQTIPSDYKLILKYIEAMRGKYGEDSKFVCGYEAGCLGYSLYHQLKEHSVDCRILAPTTMAITNTNHVKTDRRDAANIARCLAFHTYSEVYVPDDEDNSVKEYIRMRDDQKLMLKKTKQQILAFVLRQGKKFEGGKTYWTIAHMKWLKSLELDGLNKETLSEYLITYEYLTEKIARLDDRIEELASGEKYKEKVKNMGCFLGVKTHTALSMVVEIGDFNRFEKAPKFAGFLGLVPSEDSSGGNVNRYSITKAGNSHLRRLMVEAAQSYTRGNVGHKSVALKARQKGCNAEVIAYADKANERLRRRFYKMTLNKGVNRNVATTAIARELACFMWGMATGNIS

SEQ ID NO: 1512 - protein, 372 aa, unidentified
  REGION 1..372: note = Description of Unknown:uncultivated organism sequence
  REGION 1..372: note = Category: MG70 effectors
  REGION 1..372: note = Description: MG70-40 effector
MNYNTVYVGMDVHKESFSLCAYTIEAEKASHYQRTEADYKKVLNYLEFLRTIYGDDANFICGYEAGCFGYTLYHQLTANNVKCIILAPTTMLEQRSKKRIKTDRRDAEIIAKCLAQHNYSPVHIPTAKDEETKEFLRMRDDHKLALKKVKQQILAFCLRHNYRYDGKSHWTAAHLKWLKALTPEALYKEILDEYLLTYQTLSDKIERLDKRIEELATQDEYKEAVKKLCCFIGVKTHTALSVLVEVGDFKRFASAQHFASYLGLVPGEDSSGDDQNRLGITKAGNRHVRLLLTEASQCYARGQVGFKSKELKSRQSGNTPAVIAYADKANERLRRRYYKMVLNKYKKHNVAKTAIARELACFMWGMMTDNIA

SEQ ID NO: 1513 - protein, 382 aa, unidentified
  REGION 1..382: note = Description of Unknown:uncultivated organism sequence
  REGION 1..382: note = Category: MG70 effectors
  REGION 1..382: note = Description: MG70-41 effector
MNRIIKIGMDVHSTNFTLCALEPKIDGEDRIFANIKVEPDYKYILRFIEKLKEKLGSSDNYSIECGYEAGCLGYSLYRQLTKAGVKCVILAPTTMLTQQGKRVKTDTRDAVMIAQCLAYNGYHAVHVPTEKDNSVKEYLRMRDDHKIALKKLKQQINAFCLRNGHQYCGNKWTISHLTWLRKLELPELYRETLNEYLATYDEETAKIERFDKRIEELASDTDYKDHVRNLGALLGIKTHTALSLIVETGDFNRFAKGNTYAAFLGLAPGESSSGEHICRTGISKAGNAHLRTLLIEASRGICKGAVGYKSRALRARQAECSAEIIAYADRANTRLRSKYYRLIRHDKKKNVAVAAIARELACFIWGIMTDHTEIKTNGQKTA

SEQ ID NO: 1514 - protein, 392 aa, unidentified
  REGION 1..392: note = Description of Unknown:uncultivated organism sequence
  REGION 1..392: note = Category: MG70 effectors
  REGION 1..392: note = Description: MG70-42 effector
MNRIVYIGMDVHTSNYTLCSLDPGYGVEKDNYFAEVQFTNNFVTNVVNYVSNLKKKLKDCEFVCGYEAGCLGYSTYKDLTKVGIKCVLMAPSTMAVQKGGKKVKNDRRDARVIAQCLAYQTYKEVYVLSEHDEAVRGYLRMRDSHNKALKRIKQQIIAFCTGHGLFSPTKSNWTVAHLKWLKDLKFNDPVEQEILNEYLSSLTFLSDKIKAMDVRIEELASEKQYCENVKKLRCIKGIETNVALTLLAEIGDFNRFSKPTDFASYLGLIPGEQSSGDKVRGTGITKAGNSTLRRKLTESAKGYWRGRIGIKSATFKKLEKELPKEVTEYALKANTRLQRKFFNMTHVKGKNMNVAASACAREMACFVWGLITNHYDKAPAVPKTDEELLDLN

SEQ ID NO: 1515 - protein, 1272 aa, unidentified
  REGION 1..1272: note = Description of Unknown:uncultivated organism sequence
  REGION 1..1272: note = Category: MG75 effectors
  REGION 1..1272: note = Description: MG75-1 effector
MKFEEFTHLYQRSITIRMGLKPIGNTLEQIKEKHFLEKDEHRANSYKRVKNIIDEYYKDYIEKRLSDFSHSHHSDTDSSWNKLLKEYNGLYHSKRAENTEKSRFAEIQQTLRKEISKALNDKAQSLSGKELIQKDLISFLKTRKDLSKDEINDRLIPLVNEFEKFSTYFTGFSQNRENIFSSKEKSSSASYRLINENLPKFIDNMGTYGKLHSIPEISEMQDKLYEAFKKQIHYLKLGISSIDEMFQLEYFNNVLTQSQIDLYNAIIGGKTEGDLHIDGINQYVNRYNQTHKDERLPKLKTLFKQILSDRASLSAIPEKIENDDQAVKAVTGIYETIEQQVLAEDKLKNMLVSLSDYNLEGIFISNGQQLTQISKNMLGRREFISDAIVKCYQKSLPQKKRENYEDYLNRIRNNVRSIGSFSIADINQYIAKQPNGKDDYPKENPSTTIQDYFAKLDASDHTADIFSRISKAHQALLPALGKQNTGNISSFKDKNTLLLIKNLLDAILDLVHFVKPLLGTGDEIGKDERFYGDFSPLWNELKKFMSVYDMIRNYATQKPYKKDKIKINFENVQLLQGWDQNKEKEYASIILRRDGKYYLAIMDKDSKKLLGKAMPSDGDCYEKMVYKFIPDAKKMFPKVFLSKKGQETFKPTPLLIDNYNRGTHKKGKNFNLKDCHDLIDYFKHSIGMHEDWGKFGFNFSDTSSYEDISEFYNEVNQQSYKLTFTKVSVHFIDKLVDEGKMYMFQIYNKDFSEYSKGTPNIHTLYWKALFDERNLADVVYKLNGKAELFYRKKSIGHTHPTHPANQPIKNKSKDNEKAESTFGYDLIKDRRYTVDMFQFHVPITMNFKCGEKEKINLQVAEYLHTADDIHIIGVDRGERNLLYLVVIDIHGNIKEQFTLNDIVNEHNGNTYHTNYHDLLGEREEERIKARQSWQAIENIKELKEGYLSQVIHKITQLMMKYHAIVVLEDLNFGFKRSRQKVEKSVYQKFEKQLINKLQFLVNKQQSDPQAPGGVFNAYQLADKFESFQKLGKQSGFIFYIPAWNTSNIDPVTGFVNLFDTHYANVEKSKEFFKKFDTIRYNAEKDWFEFSFDYNHFTKKAEGSRTNWTLYTYGTRIKTFRNDKRNNEWDNEEMNLTDSFKTFFADNYVDINSNLQEAITNQNDKGFFVKLFELFKLLLQMRNSKIKSDVDFLLSPVADENGVFFDSRKYKGSRKCSGVVLPENADANGAFNIARKGLMLVRQMRIAKDEPFKPDLSNRQWLKFAQDKPYLND

SEQ ID NO: 1516 - protein, 1245 aa, unidentified
  REGION 1..1245: note = Description of Unknown:uncultivated organism sequence
  REGION 1..1245: note = Category: MG75 effectors
  REGION 1..1245: note = Description: MG75-2 effector
METFSGFTNLYPLSKTLRFRLIPVGETLKHFIDSGILEEDQHRAESYVKVKAIIDDYHRAYIENSLSGFELPLESTGKFNSLEEYYLYHNIRNKTEEIQNLSSKVRTNLRKQVVAQLTKNEIFKRIDKKELIQSDLIDFVKNEPDANEKIALISEFRNFTVYFKGFHENRRNMYSDEEKSTSIAFRLIHENLPKFIDNMEVFAKIQNTSISENFDAIQKELCPELVTLCEMFKLGYFNKTLSQKQIDAYNTVIGGKTTSEGKKIKGLNEYINLYNQQHKQEKLPKMKLLFKQILSDRESASWLPEKFENDSQVVGAIVNFWNTIHDTVLAEGGLKTIIASLGSYGLEGIFLKNDLQLTDISQKATGSWGKISSEIKQKIEVMNPQKKKESYETYQERIDKIFKSYKSFSLAFINECLRGEYKIEDYFLKLGAVNSSSLQKENHFSHILNTYTDVKEVIGLYSESTDTKLIQDNDSIQKIKQFLDAVKDLQAYVKPLLGNGDETGKDERFYGDLIEYWSLLDLITPLYNMVRNYVTQKPYSVDKIKINFQNPTLLNGWDLNKETDNTSVILRRDGKYYLAIMNNKSRKVFLKYPSGTDRNCYEKMEYKLLPGANKMLPKVFFSKSRINEFMPNERLLSNYEKGTHKKSGTCFSLDDCHTLIDFFKKSLDKHEDWKNFGFKFSDTSTYEDMSGFYKEVENQGYKLSFKPIDATYVDQLVDEGKIFLFQIYNKDFSEHSKGTPNMHTLYWKMLFDETNLGDVVYKLNGEAEVFFRKASINVSHPTHPANIPIKKKNLKHKDEERILKYDLIKDKRYTVDQFQFHVPITMNFKADGNGNINQKAIDYLRSASDTHIIGIDRGERNLLYLVVIDGNGKICEQFSLNEIEVEYNGEKYSTNYHDLLNVKENERKQARQSWQSIANIKDLKEGYLSQVIHKISELMVKYNAIVVLEDLNAGFMRGRQKVEKQVYQKFEKKLIEKLNYLVFKKQSSDLPGGLMHAYQLANKFESFNTLGKQSGFLFYIPAWNTSKMDPVTGFVNLFDVKYESVDKAKSFFSKFDSIRYNVERDMFEWKFNYGEFTKKAEGTKTDWTVCSYGNRIITFRNPDKNSQWDNKEINLTENIKLLFERFGIDLSSNLKDEIMQRTEKEFFIELISLFKLVLQMRNSWTGTDIDYLVSPVCNENGEFFDSRNVDETLPQNADANGAYNIARKGMILLDKIKKSNGEKKLALSITNREWLSFAQGCCKNG

SEQ ID NO: 1517 - protein, 1254 aa, unidentified
  REGION 1..1254: note = Description of Unknown:uncultivated organism sequence
  REGION 1..1254: note = Category: MG75 effectors
  REGION 1..1254: note = Description: MG75-3 effector
MRFEDFTGLYPVSKTLRFEARPVGNTLKYLIKSGLLEQDTHRADSYQKVKKLIDEYHKAFIDSVMSGFMFSNETLEEYFVLYANKSVDEESRNKYVELQKKMRESVSNALKGDERFKNIDKKELIKEDLYAFVRKADESQLAGLTLEQAEELLLEFKDFTTYFGGFHQNRANMYVPDEKSTSIAYRLVNENLPRFVDNIYVFKKIYSIPELRDNVKTVYDAFKEHLNVVELSDIFDVTFYSEVLTQKHIDLYNSIIGGRTDKESSKKIQGLNEYINLYNQTHKDEKLPKFKVLYKQILSDRVAVSWLPEAFSNDNETLCAIRDCYSGLEEHILGEKDLKILLESLDKYDLCGVFISNNKQLLSEISQKLYGNWGTIENAVRRHFEEVSPQRGKKETEEKYRERIAKSTKRYESFSIADLNEWVKQSNPDEARRIEDYFTSLGVVNSEDEQKEDLFRRVENAYTDVTDLLSSDYPEGKKLAQDSKAVEKIKNLLDAIKELQWFVKPLNGSGDENNKDERFYGEFSMLWAELDSFSLLYDKVRNYMTRKPYSQDKIKLNFANATLLKGWDRNKEVDNACVILRRNGLYYLGIMDKEHRRSFEGNYPCNGDVYEKMVYKLLPDPKKMLPKVFFSESREKDFNPTDSIRQLYKGNTYKAGPQFKIEDCRELIDFYKKSISLHEDWKNFGFQFSDTSTYEDLNGFFREVEQQGYKMTFKNVSVSYVEKLVDEGKLYLFQLYNKDFSAYSKGTPNIHTLYWKAVFDEKNLLNVVYKLNGEAELFFRKKSINITNPTHPANVSVANKNKLNQKRESVFDYDLVKDRRYTVDKFLFHVPITMNFKSKGKPQIEQQVRSYLHSAENTHIIGIDRGERHLLYVSVIDSYGNIKEQFSLNEIVNENAGNIYVTDYHALLDTKEAERKEARQSWQTIENIKELKEGYLSQAVHKVTQLMIKYNAIVVLEDLNMGFMRGRQKVEKQVYQKFEKMLIDKLNYMVDKKICVDEPGGIFHAYQLASKFESFTKLGKQSGFLFYIPAWNTSKIDPVTGFVNLFDLRYESIERTKLFFSKFKFVRYNQSSDWFEFAFDYNDFTDKATGTRTEWNITTHGTRIITFRNPEKNSQWDSREVVLTDEFKVLFSKYSIALNGNLKESIAIQTDRLFFETLLNCFKLTLQMRNSITGTDIDYLISPVADENGVFYDSRNCSNSLPKNADANGAYNIARKGLMLIDQIKHSDDFKTVKFDITNKAWLEFAQKKPYLND

SEQ ID NO: 1518 - protein, 1245 aa, unidentified
  REGION 1..1245: note = Description of Unknown:uncultivated organism sequence
  REGION 1..1245: note = Category: MG75 effectors
  REGION 1..1245: note = Description: MG75-4 effector
METFSGFTNLYPLSKTLRFRLIPVGETLKYFIGSGILEEDQHRAESYVKVKAIIDDYHRAYIENSLSGFELPLESTGKFNSLEEYYLYHNIRNKTEEIQNLSSKVRTNLRKQVVAQLTKNEIFKRIDKKELIQSDLIDFVKNEPDANEKIALISEFRNFTVYFKGFHENRRNMYSDEEKSTSIAFRLIHENLPKFIDNMEVFAKIQNTSISENFDAIQKELCPELVTLCEMFKLGYFNKTLSQKQIDAYNTVIGGKTTSEGKKIKGLNEYINLYNQQHKQEKLPKMKLLFKQILSDRESASWLPEKFENDSQVVGAIVNFWNTIHDTVLAEGGLKTIIASLGSYGLEGIFLKNDLQLTDISQKATGSWGKISSEIKQKIEVMNPQKKKESYETYQERIDKIFKSYKSFSLAFINECLRGEYKIEDYFLKLGAVNSSSLQKENHFSHILNTYTDVKEVIGLYSESTDTKLIQDNDSIQKIKQFLDAVKDLQAYVKPLLGNGDETGKDERFYGDLIEYWSLLDLITPLYNMVRNYVTQKPYSVDKIKINFQNPTLLNGWDLNKETDNTSVILRRDGKYYLAIMNNKSRKVFLKYPSGTDRNCYEKMEYKLLPGANKMLPKVFFSKSRINEFMPNERLLSNYEKGTHKKSGTCFSLDDCHTLIDFFKKSLDKHEDWKNFGFKFSDTSTYEDMSGFYKEVENQGYKLSFKPIDATYVDQLVDEGKIFLFQIYNKDFSEHSKGTPNMHTLYWKMLFDETNLGDVVYKLNGEAEVFFRKASINVSHPTHPANIPIKKKNLKHKDEERILKYDLIKDKRYTVDQFQFHVPITMNFKADGNGNINQKAIDYLRSASDTHIIGIDRGERNLLYLVVIDGNGKICEQFSLNEIEVEYNGEKYSTNYHDLLNVKENERKQARQSWQSIANIKDLKEGYLSQVIHKISELMVKYNAIVVLEDLNAGFMRGRQKVEKQVYQKFEKKLIEKLNYLVFKKQSSDLPGGLMHAYQLANKFESFNTLGKQSGFLFYIPAWNTSKMDPVTGFVNLFDVKYESVDKAKSFFSKFDSIRYNVERDMFEWKFNYGEFTKKAEGTKTDWTVCSYGNRIITFRNPDKNSQWDNKEINLTENIKLLFERFGIDLSSNLKDEIMQRTEKEFFIELISLFKLVLQMRNSWTGTDIDYLVSPVCNENGEFFDSRNVDETLPQNADANGAYNIARKGMILLDKIKKSNGEKKLALSITNREWLSFAQGCCKNG

SEQ ID NO: 1519 - protein, 1245 aa, unidentified
  REGION 1..1245: note = Description of Unknown:uncultivated organism sequence
  REGION 1..1245: note = Category: MG75 effectors
  REGION 1..1245: note = Description: MG75-5 effector
METFSGFTNLYPLSKTLRFRLIPVGETLKHFIDSGILEEDQHRAESYVKVKAIIDDYHRAYIENSLSGFELPLESTGKFNSLEEYYLYHNIRNKTEEIQNLSSKVRTNLRKQVVVQLTKNEIFKRIDKKELIQSDLIDFVKNEPDANEKIALISEFRNFTVYFKGFHENRRNMYSDEEKSTSIAFRLIHENLPKFIDNMEVFAKIQNTSISENFDAIQKELCPELVTLCEMFKLGYFNKTLSQKQIDAYNTVIGGKTTSEGKKIKGLNEYINLYNQQHKQEKLPKMKLLFKQILSDRESASWLPEKFENDSQVVGAMVNFWNTIHDTVLAEGGLKTIIASLGSYGLEGIFLKNDLQLTDISQKATGSWSKISSEIKQKIEVMNPQKKKESYESYQERIDKLFKSYKSFSLAFINECLRGEYKIEDYFLKLGAVNSSSLQKENHFSHILNAYTDVKEAIGFYSESTDTKLIQDNDSIQKIKQFLDAVKDLQAYVKPLLGNGDETGKDERFYGDLIEYWSLLDLITPLYNMVRNYVTQKPYSVDKIKINFQNPTLLNGWDLNKETDNTSVILRRDGKYYLAIMNNKSRKVFLKYPSGTDGNCYEKMEYKLLPGANKMLPKVFFSKSRINEFMPNERLLSNYEKGTHKKSGICFSLDDCHTLIDFFKKSLDKHEDWKNFGFKFSDTSTYEDMSGFYKEVENQGYKLSFKPIDATYVDQLVDEGKIFLFQIYNKDFSEHSKGTPNMHTLYWKMLFDETNLGDVVYKLNGEAEVFFRKASINVSHPTHPANIPIKKKNLKHKDEERILKYDLIKDKRYTVDQFQFHVPITMNFKADGNGNINQKAIDYLCSASDTHIIGIDRGERNLLYLVVIDGNGKICEQFSLNEIEVEYNGEKYSTNYHDLLNVKENERKQARQSWQSIANIKDLKEGYLSQVIHKISELMVKYNAIVVLEDLNAGFMRGRQKVEKQVYQKFEKKLIEKLNYLVFKKQSSDLPGGLMHAYQLANKFESFNALGKQSGFLFYIPAWNTSKMDPVTGFVNLFDVKYESVDKAKSFFSKFDSMRYNVERDMFEWKFNYGEFTKKAEGTKTDWTVCSYGNRIITFRNPDKNSQWDNKEINLTENIKLLFERFGIDLSSNLKDEIMQRTEKEFFIELISLFKLVLQMRNSWTGTDIDYLVSPVCNENGEFFDSRNVDETLPQNADANGAYNIARKGMILLDKIKKSNGEKKLALSITNREWLSFAQGCCKNG

SEQ ID NO: 1520 - protein, 1245 aa, unidentified
  REGION 1..1245: note = Description of Unknown:uncultivated organism sequence
  REGION 1..1245: note = Category: MG75 effectors
  REGION 1..1245: note = Description: MG75-6 effector
METFSGFTNLYPLSKTLRFRLIPVGETLKHFIGSGILEEDQHRAESYVKVKAIIDDYHRAYIENSLSGFELPLESTGKFNSLEEYYLYHNIRNKTEEIQNLSSKVRTNLRKQVVTQLTKNEIFKRIDKKELIQSDLIDFVKNEPDANEKIALISEFRNFTVYFKGFHENRRNMYSDEEKSTSIAFRLIHENLPKFIDNMEVFAKIKNTSISENFEAIQKELCPELVTLCEMFKLGYFNKTLSQKQIDAYNTVIGGKTTSEGKKIKGLNEYINLYNQQHKQEKLPKMKLLFKQILSDRESASWLPEKFENDSQVVGAMVNFWNTIHDTVLAEGGLKTIIVSLGSYGLEGIFLKNDLQLTDISQKATGSWSKISSEIKQKIEVMNPQKKKESYESYQERIDKLFKSYKSFSLAFINECLRGEYKIEDYFLKLGAVNSSSLQKENHFSHILNTYTDVKEVIGFYSESTDTKLIQDNDSIQKIKQFLDAVKDLQAYVKPLLGNGDETGKDERFYGDLIEYWSQLDLITPLYNMVRNYVTQKPYSVDKIKINFQNPTLLNGWDLNKEMDNTSVILRRDGKYYLAIMNNKSRKVFLKYPSGTDRNCYEKMEYKLLPGANKMLPKVFFSKSRINEFMPNERLLSNYEKGTHKKSGTCFSLDDCHTLIDFFKKSLNKHEDWKNFGFKFSDTSTYEDMSGFYKEVENQGYKLSFKPIDATYVDQLVDEGKIFLFQIYNKDFSEHSKGTPNMHTLYWKMLFDETNLGDVVYKLNGEAEVFFRKASINVSHPTHPANIPIKKKNLKHKDEERILKYDLIKDKRYTVDQFQFHVPITMNFKADGNGNINQKAIDYLCSASDTHIIGIDRGERNLLYLVVIDGNGKICEQFSLNEIEVEYNGEKYSTNYHDLLNVKENERKQARQSWQSIANIKDLKEGYLSQVIHKISELMVKYNAIVVLEDLNAGFMRGRQKVEKQVYQKFEKKLIEKLNYLVFKKQSSDLPGGLMHAYQLANKFESFNALGKQSGFLFYIPAWNTSKMDPVTGFVNLFDVKYESVDKAKSFFSKFDSMRYNVERDMFEWKFNYGEFTKKAEGTKTDWTVCSYGNRIITFRNPDKNSQWDNKEINLTENIKLLFERFGIDLSSNLKDEIMQRTEKEFFIELISLFKLVLQMRNSWTGTDIDYLVSPVCNENGEFFDSRNVDETLPQNADANGAYNIARKGMILLDKIKKNNGEKKLALSITNREWLSFAQGCCKNG

SEQ ID NO: 1521 - protein, 1236 aa, unidentified
  REGION 1..1236: note = Description of Unknown:uncultivated organism sequence
  REGION 1..1236: note = Category: MG75 effectors
  REGION 1..1236: note = Description: MG75-7 effector
METFSGFTNLYPLSKTLRFRLIPVGETLKHFIDSGILEEDQHRAESYVKVKAIIDDYHRAYIENSLSGFELPLESTGKFNSLEEYYLYHNIRNKTEKNQKSLSTVRFNLRKQMVKQLTKNELYKRIYKQNLIKKDLIDFVKNEPDANEKIALISEFRNFTVYFKGFHENRRNMYLDEEKSTSIAFRLIHENLPKFIDNMEVFAKIQNTSISENFDVIQKELCPELVTLCEMFKLGYFNKTLSQKQINAYNTVIGELNKYLNHYNQQHKQEKLPKMKLLFKQILSDRESTSWLPERFANDGQVVGAMVNFWNTIHDTVLAEGGLKTIIASLGSYGLEGIFLKNDLQLTDISQKATGSWSKISSEIKQKIEVMNPQKKKESYESYQERIDKLFKSYKSFSLAFINECLRGEYKIEDYFLKLGAVNSSSLQKENHFSHILNTYTDVKEVIGFYSESTDTKLIRDNGSIQKIKLFLDAVKDLQAYVKPLLGNGDETGKDERFYGDLIEYWSLLDLITPLYNMVRNYVTQKPYSVDKIKLNFRNPTLLDGWDLNRETANTSVILRRDGKYYLAIMNNKSRKVFLKYPSGTGKDCYEKMEYKLIPGAYKMLPKAFFSKSKINKFMPDEHLLSNYKKGTHKKNNANFDLDDCHTLIDFFKKSLNKHEDWKNFDFKFSDTSTYTDINNFYKEIDNQAYKLSFRPVPSDFVDKLVEEGKIFLFWIYNKDFSGHSKGTPNMHTLYWRMLFDERNLEDVVYSLNGGAEVFFRKASINVSHPTHPANIPIKKKNLKHKDEERILKYDLIKDKRYTIDQFQFHVPITMNFKVAGNGNININQKAIDYLRSASDTHIIGIDRGERNLLYLVVIDGNGKICEQFSLNEIEVEYNGEKYSTNYHDLLNVKENERKQARQSWQSIANIKDLKEGYLSQVIYKISELIVKYNAIVVLEDLNAGFMRGRQKVEKQVYQKFEKKLIEKLNYLVFKKQSSDLPGGLMHAYQLANKFESFNTLGKQSGFLFYIPAWNTSKMDPVTGFVNLFDVKYESVDKAKSFFSKFDSIRYNVERDMFEWKFNYGEFTKKAEGAKTDWTVCSYGNRIITFRNPDKNSQWDNKEINLTENVKLLFERFGIDLSSNLKDEIMERTEKEFFIELISLFKLVLQMRNSWTGTDIDYLVSPVCNENGEFFDSRNVDETLPQNADANGAYNIARKGMILLDKIKKNNGEKKLALSITNREWLSFAQGCCKNG

SEQ ID NO: 1522 - protein, 1248 aa, unidentified
  REGION 1..1248: note = Description of Unknown:uncultivated organism sequence
  REGION 1..1248: note = Category: MG75 effectors
  REGION 1..1248: note = Description: MG75-8 effector
METFSGFTNLYPLSKTLRFRLIPVGETLKHFIDSGILEEDQHRAESYVKVKAIIDDYHRAYIENSLSGFELPLESTGKFNSLEEYYLYHNIRNKTEEIQNLSSKVRTNLRKQVVTQLTKNEIFKRIDKKELIQSDLIDFVKNEPDANEKIALISEFRNFTVYFKGFHENRRNMYSDEEKSTSIAFRLIHENLPKFIDNMEVFAKIQNTSISENFDAIQKELCTELVTLCEMFKLGYFNKTLSQKQIDAYNTVIGGKTTSEGKKIKGLNEYINLYNQQHKQEKLPKMKLLFKQILSDRESASWLPEKFENDSQVVGAMVNFWNTIHDTVLAEGGLKTIIASLGSYGLEGIFLKNDLQLTDISQKATGSWSKISSEIKQKIEVMNPQKKKESYESYQERIDKLFKSYKSFSLAFINECLRGEYKIEDYFLKLGAVNSSSLQKENHFSHILNTYTDVKEVIGFYSESTDTKLIRDNGSIQKIKLFLDAVKDLQAYVKPLLGNGDETGKDERFYGDLIEYWSLLDLITPLYNMVRNYVTQKPYSVDKIKLNFRNPTLLDGWDLNRETANTSVILRRDGKYYLAIMNNKSRKVFLKYPLGTGKDCYEKMEYKLIPGAYKMLPKAFFAKSKINKFMPDEHLLSNYKKGTHKKNNANFDLDDCHTLIDFFKKSLNKHEDWKNFDFKFSDTSTYTDINNFYKEIDNQAYKLSFRPVPSDFVDKLVEEGKIFLFWIYNKDFSGHSKGTPNMHTLYWRMLFDERNLEDVVYSLNGGAEVFFRKASINVSHPTHPANIPIKKKNLKHKDEERILKYDLIKDKRYTVDQFQFHVPITMNFKADGNGNINQKAIDYLCSASDTHIIGIDRGERNLLYLVVIDGNGKICEQFSLNEIEVEYNGENYSTNYHDLLNVKENERKQARQSWQSIANIKDLKEGYLSQVIHKISELMVKYNAIVVLEDLNAGFMRGRQKVEKQVYQKFEKKLIEKLNYLVFKKQSSDLPGGLMHAYQLANKFESFNTLGKQSGFLFYIPAWNTSKMDPVTGFVNLFDVKYESVDKAKSFFSKFDSMRYNVERDMFEWKFNYGEFTKKAEGTKTDWTVCSYGNRIITFRNPDKNSQWDNKEINLTENIKLLFERFGIDLSSNLKDEIMQRTEKEFFIELISLFKLVLQMRNSWTGTDIDYLVSPVCNENGEFFDSRNVDETLPQNADANGAYNIARKGMILLDKIKKSNGEKKLALSITNREWLSFAQGCCKKWMIT

SEQ ID NO: 1523 - protein, 1250 aa, unidentified
  REGION 1..1250: note = Description of Unknown:uncultivated organism sequence
  REGION 1..1250: note = Category: MG75 effectors
  REGION 1..1250: note = Description: MG75-9 effector
MKTLSDFTNLFPLSKTLRFKLIPIGNTLKNIEASGILDEDRHRAESYVKVKAIIDEYHKAFIDRVLSDTCLQTESIGKHNSLEEFFFYYQIGAKSEQQKKTFKKIQDALRKQIADSLTKDKHFSRIDKKELIQEDLIQFVRDGEDAAEKTSLISEFQNFTVYFTGFHENRQNMYSPDEKSTAIAYRLINENLPKFVDNMKVFDRIAASELASCFDELYHNFEEYLQVERLHDIFSLDYFNLLLTQKHIDVYNALIGGKATETGEKIKGLNEYINLYNQRHKQEKLPKFKMLFKQILTDREAISWLPRQFDDNSQLLSAIEQCYNHLSTYTLKDGSLKYLLENLHTYDTEKIFIRNDSLLTEISQRHYGSWSILPEAIKRHLERANPQKRRETYEAYQSRIEKAFKAYPGFSIAFLNGCLTETGKESPSIESYFESLGAVETETSQQENWFARIANAYTDFREMQNRLHATDVPLAQDAEAVARIKKLLDALKGLQLFIKPLLDTGEEAEKDERFYGDFTEFWNELDTITPLYNMVRNYLTRKPYSEEKIKLNFQNPTLLNGWDLNKEVDNTSVILRRNGRYYLAIMHRNHRRVFSQYPGTERGDCYEKMEYKLLPGANKMLPKVFFSKSRIDEFNPSEELLARYQQGTHKKGENFNLHDCHALIDFFKDSIEKHEEWRNFHFKFSDTSSYTDMSGFYREIETQGYKLSFVPVACEYIDELVRDGKIFLFQIYNKDFSTYSKGKPNMHTLYWEMLFDERNLMNVVYKLNGQAEIFFRKASLSARHPEHPAGLPIKKKQAPTEESCFPYDLIKNKRYTVDQFQFHVPITINFKATGTSNINPSVTDYIRTADDLHIIGIDRGERHLLYLVVIDSQGRICEQFSLNEIVTQYQGHQYRTDYHALLQKKEDERQKARQSWQSIENIKELKEGYLSQVVHKVSELMIKYKAIVVLEDLNAGFKRSRQKVEKQVYQKFEKMLIDKLNYLVFKTAEADQPGGLLHAYQLTNKFESFKKMGKQSGFLFYIPAWNTSKIDPTTGFVNLFDTRYENVDKSRAFFGKFDSIRYRADKGTFEWTFDYNNFHKKAEGTRSSWCLSSHGNRVRTFRNPAKNNQWDNEEIDLTQAFRDLFEAWGIEITSNLKEAICNQSEKKFFSELFELFKLMIQLRNSVTGTNIDYMVSPVENHYGTFFDSRTCDSSLPANADANGAYNIARKGLMLARRIQATPENDPISLTLSNKEWLRFAQGLDETTTYE

SEQ ID NO: 1524 - protein, 1246 aa, unidentified
  REGION 1..1246: note = Description of Unknown:uncultivated organism sequence
  REGION 1..1246: note = Category: MG75 effectors
  REGION 1..1246: note = Description: MG75-10 effector
MMETFSDFTNLYPLSKTLRFRLIPVGETLRHFIDSGILEEDQHRAESYVKVKAIIDDYHRTYIENSLSGFELPVESTGKANSLEEYYLYHNIRNKTEDIQNALSKVRNNLRKQIVTQLTKNEMFKRIDKKELIQTDLIDFVKNDPDANEKIALISEFRNFTVYFKGFHENRKNMYSDEEKSTSIAFRLIHENLPKFIDNMEVFAKIQNTSISENFEAIQKDLCPETIAFADMFKLGYFNKTLSQKQIDAYNTVISGRTTAEGEKIKGLNEYINLYNQQHKQEKLPKMKLLFKQILSDRESASWLPEKLENDKQVVGALVDFWNAIHDTVLAEGGLKTVISSLVSYSLEGIFLKNDLQLTDVSQKATGSWSKIPAAIKQKLEAMNPQKKKESYEGYQERIDKIFKSYKSFSLAFINECLHGEYKIEDYFIKLGAINTDLLQKENHFSHILNTYTDIKEMIESYFESTDTKLIRDNGSIQKIKQFLDAVKDLQVYVKPLLGNGDETGKDERFYGDFVEYWNLLDLITPLYNMVRNYVTQKPYSIEKIKINFQNPTLLNGWDLNKETDNTSVILRRDGKYYLAIMNSKFRKVFLKYPSGSDRNCYEKMEYKLLPGANKMLPKVFFSKSRIQEFMPDERLLSNYEKGTHKKTGNCFSLTDCHALIDFFKKSLNKHEDWKNFGFKFSDTSTYTDMSGFYKEVENQGYKLSFKPIDAVYVDQLVDEGKIFLFQIYNKDFSGHSKGTPNMHTLYWKMLFDETNLGDVVYKLNGEAEVFFRKASIKVSSPTHPANVPIKKKNPKHKDEERILKYDLIKDKRYTVDQFQFHVPITMNFKSDGNGNINQKVIEYLRSASNIHIMGIDRGERNLLYLVVIDGSGNICEQFSLNEIKVEHNGETYSTNYHDLLDIKENERKQARQSWQSIANIKELKEGYLSQVIHKISELMVKYNAIVVLEDLNTGFMRGRQKVEKQVYQKFEKMLIEKLNYLVFKKQPSNLCGGLMHAYQLTNKFEGFNKLGKQSGFLFYIPTWNTSKMDPVTGFVNLFDLKYESIDKAKSFFSKFDSIRYNEERDMFEWKFNYDEFTKKAEGTKTNWTVCSYGNRIITFRNPNKNSQWDNKEINLTENIKLLFERFGIDLSSNLKDEIMQRTEKEFFIELISLFKLVLQMRNSWTGTDIDYLVSPVCNEKGEFFDSRNVDKALPQNADANGAYNIARKGLILLDRIKESTSDKKLNFSITNKEWLSFAQGCCKNG

SEQ ID NO: 1525 - protein, 1319 aa, unidentified
  REGION 1..1319: note = Description of Unknown:uncultivated organism sequence
  REGION 1..1319: note = Category: MG75 effectors
  REGION 1..1319: note = Description: MG75-11 effector
MAKNFEDFKRLYPLSKTLRFEAKPIGATLDNIVKSGLLDEDEHRAASYVKVKKLIDEYHKVFIDRVLDNGCLPLKNEGHNNSLTEYYDSYVSKSQNEDAKKAFEENQQNLRSIIAKKLTEDKAYANLFGKNLIESYKDKEDKTKIIDSDLIKFINTAESTQLDSMSQDEVKELVKEFWGFITYFYGFFDNRKNMYTSEEKSTGIAYRLINENLPKFIDNMEAFNTAITRPEIQANMDELYSNFSEYLNVESIQEMFQLDYYNMLLTQKQIDVYNAIIGGKTDDEHDVKIKGINEYINLYNQQHKDDKLPKLKALFKQILSDRNAISWLPEEFNSDQEVLNAIKDCYERLAENVLGDKVLKSLLGSLADYSLDGIFIRNDLQLTDISQKMFGNWGVIQNAIMQNIKRVAPARKHKESEEDYEKRIAGIFKKADSFSISYINDCLNEADPNNAYFVENYFATFGAVNTPTMQRENLFALVQNAYTEVAALLHSDYPTVKHLAQDKANVSKIKALLDAIKSLQHFVKPLLGKGDESDKDERFYGELASLWAELDTVTPLYNMIRNYMTRKPYSQKKIKLNFENPQLLGGWDANKEKDYATIILRRNGLYYLAIMDKDSKNLLGKAMPSDGECYEKMVYKQFDISKQLPKCTTELKHVRKALVEDAKRSCLLSDFNNWNKPLNVTRKLWELNNFVWDKKREDWVLRKKDNETRPKKFHKKYLELTSDKKGYNQAKNDWIKFTKEFLSSYKKVEAYDIHYKKRYNSVDELYKQLNGDLYAISFTYVSVSFIEQLVSEGKMYLFQIYNKDFSEYSKGTPNMHTLYWKALFDERNLADVVYKLNGQAEMFYRKKSIENTHPTHPANHPILNKNKDNKKKESLFEYDLIKDRRYTVDKFMFHVPITMNFKSSGSENINQDVKAYLRHADDMHIIGIDRGERHLLYLVVIDLQGNIKEQFSLNEIVNDYNGNTYHTNYHDLLDVREDERLKARQSWQTIENIKELKEGYLSQVIHKITQLMVKYHAIVVLEDLNMGFMRGRQKVEKQVYQKFEKMLIEKLNYLVDKKADASVSGGLLNAYQLTSKFDSFQKLGKQSGFLFYIPAWNTSKIDPVTGFVNLLDTRYQNVEKAKVFFSKFDAIRYNKDKDWFEFNLDYDKFGKKAEGTRTKWTLCTRGMRIDTFRNKEKNSQWDNQEVDLTAEMKSLLEHYYIDIHGNLKDAISAQTDKAFFMGLLHILKLTLQMRNSITGTETDYLVSPVADENGIFYDSRSCGDELPENADANGAYNIARKGLMMIEQIKEAKDLDNLKFDISNKSWLNFAQQKPYKNG

SEQ ID NO: 1526 - protein, 1245 aa, unidentified
  REGION 1..1245: note = Description of Unknown:uncultivated organism sequence
  REGION 1..1245: note = Category: MG75 effectors
  REGION 1..1245: note = Description: MG75-12 effector
METFSGFTNLYPLSKTLRFRLIPVGETLKHFIDSGILEEDQHRAESYVKVKAIIDDYHRAYIENSLSGFELPLESTGKFNSLEEYYLYHNIRNKTEEIQNLSSKVRTNLRKQVVVQLTKNEIFKRIDKKELIQSDLIDFVKNEPDANEKIALISEFRNFTVYFKGFHENRRNMYSDEEKSTSIAFRLIHENLPKFIDNMEVFAKIQNTSISENFDAIQKELCPELVTLCEMFKLGYFNKTLSQKQIDAYNTVIGGKTTSEGKKIKGLNEYINLYNQQHKQEKLPKMKLLFKQILSDRESASWLPEKFENDSQVVGAMVNFWNTIHDTVLAEGGLKTIIASLGSYGLEGIFLKNDLQLTDISQKATGSWSKISSEIKQKIEVMNPQKKKESYESYQERIDKLFKSYKSFSLAFINECLRGEYKIEDYFLKLGAVNSSSLQKENHFSHILNTYTDVKEVIGFYSESTDTKLIQDNDSIQKIKLFLDAVKDLQAYVKPLLGNGDETGKDERFYGDLIEYWSLLDLITPLYNMVRNYVTQKPYSIDKIKINFQNPTLLNGWDLNKETDNTSVILRRDGKYYLAIMNNKSRKVFLKYPSGTDRNCYEKMEYKLLPGANKMLPKVFFSKSRINEFMPNERLLSNYEKGTHKKSGTCFSLDDCHTLIDFFKKSLDKHEDWKNFGFKFSDTSTYEDMSGFYKEVENQGYKLSFKPIDATYVDQLVDEGKIFLFQIYNKDFSEHSKGTPNMHTLYWKMLFDETNLGDVVYKLNGEAEVFFRKASINVSHPTHPANIPIKKKNLKHKDEERILKYDLIKDKRYTVDQFQFHVPITMNFKADGNGNINQKAIDYLRSASDTHIIGIDRGERNLLYLVVIDGNGKICEQFSLNEIEVEYNGEKYSTNYHDLLNVKENERKQARQSWQSIANIKDLKEGYLSQVIHKISELMVKYNAIVVLEDLNAGFMRGRQKVEKQVYQKFEKKLIEKLNYLVFKKQSFDLPGGLMHAYQLANKFESFNALGKQSGFLFYIPAWNTSKMDPVTGFVNLFDVKYESVDKAKSFFSKFDSIRYNVERDMFEWKFNYGEFTKKAEGTKTDWTVCSYGNRIITFRNPDKNSQWDNKEINLTENIKLLFERFGIDLSSNLKDEIMQRTEKEFFIELISLFKLVLQMRNSWTGTDIDYLVSPVCNENGEFFDSRNVDETLPQNADANGAYNIARKGMILLDKIKKSNGEKKLALSITNREWLSFAQGCCKNG

SEQ ID NO: 1527 - protein, 1275 aa, unidentified
  REGION 1..1275: note = Description of Unknown:uncultivated organism sequence
  REGION 1..1275: note = Category: MG75 effectors
  REGION 1..1275: note = Description: MG75-13 effector
MAKNFEDFKRLYSLSKTLRFEAKPIGATLDNIVKSGLLDEDEHRAASYVKVKKLIDEYHKVFIDRVLANGCLPLKNEGHNNSLTEYYDNYVSKSQNEDAKKTFEENQQNLRSIIAKKLTEDKAYANLFGKNLLESYKDKTDKTKIIDSDLFKFINTAESTQLDSMSQDEAKELVKEFWGFITYFYGFFDNRKNMYTSEDKSTGIAYRLINENLPKFIDNMEAFNTAVTRPEIQANMDELYSNFSEYLNVESIQEMFQLDYYNMLLTQKQIDVYNAIIGGKTDDEHDVKIKGINEYINLYNQKHKDDKLPKLKALFKQILSDRNAISWLPEEFNSDQEVLNAIKDCYERLSENVLGDKVLKSLLGSLADYSLDGIFIRNDLQLTDISQKMFGNWGVIQNAIMQDIKHVAPARKHKESEEDYEKRIAGIFKKADSFSISYINDCLNEADPNNAYFVENYFATLGAVDTPTMQRENLFALVQNAYTEITALLHSDYPTEKNLAQDKANVAKIKALLDAIKSLQHFVKPLLGKGDESDKDERFYGELASLWTELDTVTPLYNMIRNYMTRKPYSQKKIKLNFENPQLLGGWDVNKKKDYATIILRRNGLYYLAIMNKDSKKLLGKAMPSDGECYEKMVYKLLPGANKMLPKVFFAKSRMEDFKPSKELVEKYNNGTHKKGKNFNIQDCHNLIDYFKQSIDKHEDWSKFGFKFSDTSTYEDFSGFYREVEQQGYKLSFARVSVSYINQLVEEGKMYLFQIYNKDFSEYSKGTPNMYTLYWKALFDERNLADVVYKLNGQAEMFYRKKSIENTHPTHPANHPILNKNKDNKKKESLFDYDLIKDRRYTVDKFMFHVPITMNFKSVGSENINQDVKAYLRHADDMHIIGIDRGERHLLYLVVIDLQGNIKEQYSLNEIVNEYNGNTYHTNYHDLLDVREEERLKARQSWQTIENIKELKEGYLSQVIHKITQLMVGYHAIVVLEDLSKGFMRSRQKVEKQVYQKFEKMLIDKLNYLVDKKTDVSTPGGLLNAYQLTCKSDSSQKLGKQSGFLFYIPAWNTSKIDPVTGFVNLLDTHSLNSKEKIKAFFSKFDAIRYNKDKKWFEFNLDYDKFGKKAEDTRTKWTLCTRGMRIGTFRNKEKNSQWDNQEVDLTTEMKSLLEHYYIDIHGNLKDAISTQTDKAFFTGLLHILKLTLQMRNSITGTETDYLVSPVADENGIFYDSRSCGDQLPENADANGAYNIARKGLMLIEQIKNAEDLNNVKFDISNKAWLNFAQQKPYKNG

SEQ ID NO: 1528 - protein, 1245 aa, unidentified
  REGION 1..1245: note = Description of Unknown:uncultivated organism sequence
  REGION 1..1245: note = Category: MG75 effectors
  REGION 1..1245: note = Description: MG75-14 effector
METFSGFTNLYPLSKTLRFRLIPVGETLKYFIGSGILEEDQHRAESYVKVKAIIDDYHRAYIENSLSGFELPLECTGKFNSLEEYYLYHNIRNKTEEIQNLSSKVRTNLRKHVVAQLTKNEIFKRIDKKELIQSDLIDFVKNEPDANEKIALISEFRNFTVYFKGFHENRRNMYSDEEKSTSIAFRLIHENLPKFIDNMEVFAKIQNTSISENFDAIQKELCPELVTLCEMFKLGYFNKTLSQKQIDAYNTVIGGKTTSEGKKIKGLNEYINLYNQQHKQEKLPKMKLLFKQILSDRESASWLPEKFENDSQVVGAIVNFWNTIHDTVLAEGGLKTIIASLGSYGLEGIFLKNDLQLTDISQKATGSWGKISSEIKQKIEVMNPQKKKESYETYQERIDKIFKSYKSFSLAFINECLRGEYKIEDYFLKLGAVNSSSLQKENHFSHILNTYTDVKEVIGLYSESTDTKLIQDNDSIQKIKQFLDAVKDLQAYVKPLLGNGDETGKDERFYGDLIEYWSLLDLITPLYNMVRNYVTQKPYSVDKIKINFQNPTLLNGWDLNKETDNTSVILRRDGKYYLAIMNNKSRKVFLKYPSGTDRNCYEKMEYKLLPGANKMLPKVFFSKSRINEFMPNERLLSNYEKGTHKKSGTCFSLDDCHTLIDFFKKSLDKHEDWKNFGFKFSDTSTYEDMSGFYKEVENQGYKLSFKPIDATYVDQLVDEGKIFLFQIYNKDFSEHSKGTPNMHTLYWKMLFDETNLGDVVYKLNGEAEVFFRKASINVSHPTHPANIPIKKKNLKHKDEERILKYDLIKDKRYTVDQFQFHVPITMNFKADGNGNINQKAIDYLRSASDTHIIGIDRGERNLLYLVVIDGNGKICEQFSLNEIEVEYNGEKYSTNYHDLLNVKENERKQARQSWQSIANIKDLKEGYLSQVIHKISELMVKYNAIVMLEDLNAGFMRGRQKVEKQVYQKFEKKLIEKLNYLVFKKQSSDLPGGLMHAYQLANKFESFNTLGKQSGFLFYIPAWNTSKMDPVTGFVNLFDVKYESVDKAKSFFSKFDSIRYNVERDMFEWKFNYGEFTKKAEGTKTDWTVCSYGNRIITFRNPDKNSQWDNKEINLTENIKLLFERFGIDLSSNLKDEIMQRTEKEFFIELISLFKLVLQMRNSWTGTDIDYLVSPVCNENGEFFDSRNVDETLPQNADANGAYNIARKGMILLDKIKKSNGEKKLALSITNREWLSFAQGCCKNG

SEQ ID NO: 1529 - protein, 1302 aa, unidentified
  REGION 1..1302: note = Description of Unknown:uncultivated organism sequence
  REGION 1..1302: note = Category: MG75 effectors
  REGION 1..1302: note = Description: MG75-15 effector
MEFNDFKRLYPLSKTLRFEAKPIGATLKNIIKSGLLEEDEHRAQSYVKVKKLIDEYHKVFIDRVLNEGCLTIENKGKKNSLEEYYESYMSKSNDENVSKTFKEIQENLRSVIAKKLTDDNAYANLFGNKLIESYKDKEEKNKIIDSDLIQFINSAEPSQLDSMSQDEANELVKEFWGFTTYFVGFFDNRKNMYTSEEKSTGIAYRLINENLPKFIDNMEAFKKAVAKPEIQANMEELYSNFAEYLNVESIQEMFQLDYYNMLLTQKQIDVYNAIIGGKTDEEHDVKIKGINEYINLYNQQHKDEKLPKLKALFKQILSDRNAISWLPEEFNSDQEVLNAIKDCYERLSENVLGDKVLKSLLCSLSDYNLNGIFVRNDLQLTDISQKMFGNWSVVQDAIMQNIKNVAPARKRKESEEDYEKRISDIFKKADSFSIQYINDCLNEMDDNNLHAVDGYFATLGAVNTPTMQRENLFALIQNAYTDISDMLDTPYPKNMNLAQDKTNVAKVKALLDAIKSLQHFVKPLLGKGDESDKDERFYGELASLWTELDTVTPLYNMIRNYMTRKPYSEKKIKLNFENPQLLGGWDANKEKDYATIILRRNGMYYLAIMNKDSKRLLGKSMPSDGEYYEKMVYKFFKDVTTMIPKCSTQLKDVQAFFKVNTDDFVLNSKAFNKPLTITKEVFDLNNVLYGKFKKFQKGYLSATGDTAGYTHAVNVWIKFCMDFLNSYESTCMYDFSLLKFESYLSLDAFYQDANLLLYKLSFTNVSVSFIDKLVDEGKMYLFQIYNKDFSDFSKGTPNMHTLYWKALFDERNLADVVYKLNGKAEIFYRKKSINNTHPTHPANHTIQNKNKDNKKKESVFEYDLIKDRRYTVDKFLFHVPITMNFKSVGSENINQQVREYLQQAEDTHIIGIDRGERHLLYLVVIDMQGEIKEQFTLNEIVNEYNGNTYRTNYHDLLDTREEERLKARPSWQTIENIKDLKEGYLSQAIHKITQLMVKYHAVVVLEDLNKGFMRGRQKVEKQVYQKFEKMLIDKLNYLVDKKADAAQSGGLLNAYQLTSKFDSFQKLGKQSGFLFYIPAWNTSKIDPVTGFVNLLDTRYQNIEKAKAFFSKFDAIRYNANKDWFEFNLDYDKFGTKAEGTRTKWILCTQGNRICTFRNAEKNSQWDNLKIDLTREMKSLFEHYHINICGNLKEEICSQTDKAFFTGLLHMLKLTLQMRNSITETETDYLVSPVADENGVFYDSRSCGDTLPKNADANGAYNIARKGLMLIGQIKETKDLANFKYDISNKAWLNFAQQKPYKK

SEQ ID NO: 1530 - protein, 1274 aa, unidentified
  REGION 1..1274: note = Description of Unknown:uncultivated organism sequence
  REGION 1..1274: note = Category: MG75 effectors
  REGION 1..1274: note = Description: MG75-16 effector
MAKNFEDFKRLYPLSKTLRFEAKPIGATLDNIVKSGLLDEDEHRAASYVKVKKLIDEYHKVFIDRVLDNGCLPLEDKGDNNSLAEYYDSYVSKSQNEDAKKAFKEIQQNLRSIIAKKLTDDKAYANLFGNKLIESYKDKADKTKIIDSDLIQFIHTAESTQLDSMSQDEAKELVKEFCGFTTYFVGFFDNRKNMYTAEEKSTGIAYRLINENLPKFIDNMEAFKKAIARPEIQANMEELYSDFSEYLNVESILEMFQLDYYNMLLTQKQIDVYNAIIGGKTDDEHDVKIKGINEYINLYNQQHKDDKLPKLKALFKQILSDRNAISWLPEEFNSDQEVLNAIKDCYERLAENVLGDKVLKSLLGSLADYSLDGIFIRNDLQLTDISQKMFGNWGVIQNAIMQNIKHVAPARKHKESEEDYEKRIAGIFKKADSFSISYINDCLNEEEPNNAYFVENYFATFGAVNTPTMQRENLFALVQNAYTEVAALLHSDYPTVKHLAQDKANVSKIKALLDAIKSLQHFVKPLLGKGDESDKDERFYGELASLWAELDTVTPLYNMIRNYMTRKPYSQKKIKLNFENPQLLGGWDANKEKDYATIILRRNGLYYLAIMNKDSKKLLGKAMPSDGECYEKMVYKLLPGANKMLPKVFFAKSRMEDFKPSKELVEKYNNGTHKKGKNFCIQDCHNLIDYFKQSIDKHEDWSKFGFNFSETSTYEDLSGFYREVEQQGYKLSFARVSVSYINQLVEEGKMYLFQIYNKDFSEYSKGTPNMHTLYWKALFDERNLADVVYKLNGQAEMFYRKKSIENTHPTHPANHPILNKNKDNKKKESLFEYDLIKDRRYTVDKFMFHVPITMNFKSSGSENINQDVKAYLRYADDMHIIGIDRGERHLLYLVVIDLQGNIKEQFSLNEIVNDYNGNTYHTNYHDLLDVREDERLKARQSWQAIENIKELKEGYLSQVIHKITQLMVKYHAIVVLEDLNMGFMRGRQKVEKQVYQKFEKMLIEKLNYLVDKKVDVSVSGGLLNAYQLTSKFDSFQKLGKQSGFLFYIPAWNTSKIDPVTGFVNLLDTRYQNVEKAKCFFSKFDAIRYIEDKEWFEFNLDYDKFGKKAEGTRTKWTLCTRGMRIDTFRNKEKNSQWDNQEVDLTAEMKSLLEHYYIDIHGNLKDAISAQTDKAFFTGLLHILKLTLQMRNSITGTETDYLVSPVADENGIFYDSRSCGDQLPENADANGAYNIARKGLMLIEQIKNAEDLNNVKFDISNKAWLNFAQQKPYKNG

SEQ ID NO: 1531 - protein, 1246 aa, unidentified
  REGION 1..1246: note = Description of Unknown:uncultivated organism sequence
  REGION 1..1246: note = Category: MG75 effectors
  REGION 1..1246: note = Description: MG75-17 effector
MMETFSDFTNLYPLSKTLRFRLIPVGKTLRHFIDSGILEEDQHRAESYVKVKAIIDDYHRSYIESSLSGFELPVESMGKSNSLEEYYLYHNIRNKTEDIQNALSKVRNNLRKQIVAQLTKNEMFKRIDKKELIQNDLIDFVKNEPDANEKIALISEFRNFTVYFKGFHENRKNMYSDEEKSTSIAFRLIHENLPKFIDNMEVFAKIQNTSISEKFDAIQKELCPDSVAFVDMFKLGYFNRTLSQKQIDAYNTVISGRTTAEGEKIKGLNEYINLYNQQHKQEKLPKMKLLFKQILSDRESASWLPEKLENDKQVVGALVDFWNTIHDTVLAEGGLKTVISLLVSYSLEGIFLKNDLQLTDVSQKATGSWSKIPTAIKQKLKAMNPQKKKESYEGYQERIDKIFKSYKSFSLAFINECLHGEYKIEDYFIKLGAINTDLLQKENHFSHILNTYTDIKEVIESYSESTDTKLIRDNGSIQKIKQFLDSVKDLQAYVKPLLGNGDETGKDERFYGDFVEYWNLLDLITPLYNMIRNYVTQKPYSVEKIKINFQNPTLLNGWDLNKETDNTSVILRRDDKYYLAIMTSKFRKVFLEYPSGSDRSCYEKMEYKLLPGANKMLPKVFFSKSRIQEFMPDERLLSNYEKGTHKKTGNCFSLTDCHALIDFFKKSLNKHEDWRNFGFKFSDTSTYTDMSGFYKEVENQGYKLSFKPIDAVYVDQLVDEGKIFLFQIYNKDFSEHSKGTPNMHTLYWKMLFDETNLGDVVYKLNGEAEVFFRKASIKVSSPTHPASVPIKKKNPKHMDEERILKYDLIKDKRYTVDQFQFHVPITMNFKSDGNGNINQKVVEYLRSASNIHIIGIDRGERNLLYLVVIDGSGKICEQFSLNEIKVEHNGETYSTNYHDLLDIKENERKQARQSWQSIANIKELKEGYLSQVIHKISELMVKYNAIVVLEDLNTGFMRGRQKVEKQVYQKFEKMLIEKLNYLVFKKQSLNLCGGLMHAYQLTNKFEGFNKLGKQSGFLFYIPAWNTSKMDPVTGFVNLFDLKYESIDKAKSFFSKFDSIRYNVERDMFEWKFNYDKFTKKAEGTKTNWTVCSYGNRIITFRNPNKNSQWDNKEINLTENIKLLFERFGIDLSSNLKDEIIQRTEKEFFIELISLFKLVLQMRNSWTGTDIDYLVSPVCNEKGEFFDSRNVDKALPQNADANGAYNIARKGLIFLDRIKESTSDKKLNCSITNKEWLLFVQNCCKNG

SEQ ID NO: 1532 - protein, 1270 aa, unidentified
  REGION 1..1270: note = Description of Unknown:uncultivated organism sequence
  REGION 1..1270: note = Category: MG75 effectors
  REGION 1..1270: note = Description: MG75-18 effector
MNFEQFTHLYPLSKTLRFELRPVGATLARIKEGGFLENDNHRAESYKKVKKLIDEYHKHFIEQALGDFSLTENETEGSKCLNSYLETYIQLYRSSRIEDAEKKAFEKVQAEMRKFIAKTLKGSEAYKRLFKKELIKEDLPAFLRTHADKELVAEFKNFTTYFKGFYKNRKNMYSEEEKSTAISYRLVNENLPKFVDNMAAFAIIAQVPEVRAMLDVLQKDLGAELDGTTIDELFTLPFFNKVLTQKQIAVYNAVIGGKVSDSHSKEESHIKGINQIVDCYNQQHKDARLPKLKKLYKQILSDREALSWIPEKFDKDADLLKAIHDGYERLASDRALEKLRTLLESMADYQTEGIFITNDQQLTRISQKMFGEWSFISEAILCALKKEVSQKRNECDEKYEKRIDKMLKNHGGFSIRFIDDCVAAYVNTLDDEEQKKRFIPTVEAYFATLGAFDTEKGQTINFFSRIQNARVALRGLLDSAYPEGRSLIQDKENGALLKELLDAILALMHFIKPLLGKNENGKDERFYGELIQIWDEFDTFVPLYNMSRNYLTQKAYSEEKYKLNFENSQLLNGWDLNKEVANTSIILRKDGLFYLAIMNKKHNKLFTRELPTDGDCYDKMTYKFLSGYRDLPHVFFSKSRKAEFVPSEHIMDVYEKGAFKKGDTFNLQDCHDLIDFYKASILKHEDWRQFDFKFSETEQYDDISGFYREVEAQGYKVTFRQVSVSYIDRLVKEGKLYLFQIYNKDFSPYSKGTPNMHTLYWRALFDERNLSDVVYKLNGEAEVFYRKKSIEAHPTHPANRPIKNKNKLNDKEESLFAYDLIKDRRYSEDKFSLHVPITMNFKSVGGPNINDDVVEFLRTNENLHFIGIDRGERHLLYLTVIDSHGHILEQRTLNDVVNNYQGKDYHTDYHDLLKTRERQRQEERSSWKVIENIKDLKEGYLAQVVHQIAQLMVKYHAIVVLEDLNGGFMRERQKKAERSVYQQFEKKLIDKLNYLVDKKTDAHAPGGLMNAYQLANQVESSKNKSSRNKNFKSMGRQSGFIFYIPAWNTSNIDPVTGFTNLFDTRYKNAHDAQQFFSTFKSIRYNKTADRFEFRFSYSDFTRKAEGSRTDWTVCTYGTRIKTFRDPQKNNEWTSKEVVLTEEFKKFFAAYHVDIHSNLKDSIAAHGEKAFFKQLLALMRLTLQIRNSKSGTDIDYLLSPVADENGVFFDSRSCGNSLPQDADANGAYNIARKGLMLVRQMREAKDLKKFKADMTNRNWLKFVQEKPYLND

SEQ ID NO: 1533 - protein, 1121 aa, unidentified
  REGION 1..1121: note = Description of Unknown:uncultivated organism sequence
  REGION 1..1121: note = Category: MG75 effectors
  REGION 1..1121: note = Description: MG75-19 effector
MVQFINTANLKQRLNLSKEEAKDLVQEFCGFTTYFGDFYQNRENMYSAEEKSTGIAYRLINENLPKFIDNMETFKKIAAIPEMEDNLKEIHDNLSEHLNVENIQDMFQLNYYNQLLTQKQIDVYNAIIGGKTDDEHKEKIKGINEYVNLYNQAHKDAKLPKLKTLFKQILSDRNAISWLPEEFDNDQETLNAIKDCYAHLSGNILKDENLKRLLCSLSEYDTKGIFLRNDSQLTSISKKMSGSWTDIPSAIKNDMKDGVPAKKRKESEEDYEKRIDNLFKKQDSFSIDYMDACLNKFVENNPYTIEGYFKELGAKDTQSEDIFKQIENAYTDVKPLLNSTYPKNKNLSQDKENVAKIKRFLDTLMSLVHFVKPLLGKGDERNKDEKFYGELSLLWTELETIVPLYNMVRNYMTRKPYSNSKIKLNFDNSQLLGGWDANKESDYSSILLYRDGKYYLAIFDKDSKKLLGKSMPSDGECYEKMVYKLLPGANKMLPKVFFAKSRIKDFKPSEQLLEKYNKGTHKKGKNFSISDCHALIDFFKQSINKHEDWKNFDFNFSETSTYEDLNSFYREVELQGYKITFTKVSASFIDKLVEEGKVYLFQIYNKDFSEYSKGTPNMHTLYWKALFDDRNLKDVVYKLNGQAEMFFRKKSINCNHPTHPANQPIQNKNKDNKKKESVFEYDLIKDHRYTVDKFMFHVPITMNFKSTNEKDINLHVREYLQTSNDTHIIGIDRGERHLLYLVVIDLHGNIVEQYTLNDIVNEYNGNTYRTNYHDLLDAREEDRLKQRQSWQTIENIKELKEGYLSQVIHKITQLMIKYHAIIVLEDLNIGFMRGRQKVEKQEYQKFEKMLIDKLNYLVDKKADIESTGGLLNAYQLTNKFASFKKLGKQSGFLFYIPAWNTSKIDPVTGFVNLLDTRYQNVDKAKAFFAKFDSIRYNKDKDWFEFALDYNNFGSKAEGTRTKWTLCTQGKRIKTSFNKMSSKWNNQEIDLTKDLKQLFVQYDIDINGNLKEAISKQTKYTFFVELMGLLKLTLQMRNSITGTETDYLVSPVADENGNFYDSRTCGPSLPENADANGAFNIARKGLMIIEQIKASDDLSKLKFDISNKSWLNFAQKKPYKHE

SEQ ID NO: 1534 - protein, 1235 aa, unidentified
  REGION 1..1235: note = Description of Unknown:uncultivated organism sequence
  REGION 1..1235: note = Category: MG75 effectors
  REGION 1..1235: note = Description: MG75-20 effector
METFSGFTNLYPLSKTLRFRLIPVGETLKHFIGSGILEEDQHRAESYVKVKAIIDDYHRAYIENSLSGFELPLESTGKFNSLEEYYLYHNIRNKTEKNQKSLSTVRFNLRKQIVKQLTKNELYKRIYKQNLIKKDLIDFVKNEPDANEKIALISEFRNFTVYFKGFHENRRNMYLDEEKSTSIAFRLIHENLPKFIDNMEVFAKIQNTSISENFDVIQKELCPELVTLCEMFKLGYFNKTLSQKQINAYNTVIGELNKYLNHYNQQHKQEKLPKMKLLFKQILSDRESTSWLPERFANDGQVIGAIVNFWNTIHDTVLAEGGLKTIIASLGSYSLEGIFLKNDLQLTDVSQKATGSWSKITAAIKQKLEDMNPQTKKESYETYQGRIDKLFKFYKSFSLAFINECLRGEYKIEDYFLKLGAVNSSSLQKENHFSHILNTYTDVKEVIGFYSESTDTKLIRDNGSIQKIKLFLDAVKDLQAYVKPLLGNGDETGKDERFYGDLIEYWSQLDLITPLYNMVRNYVTQKPYSVDKIKLNFRNPTLLDGWDLNQETANTSVILRRDGKYYLAIMNNKSRKVFLKPSGTGKDCYEKMEYKLIPGAYKMLPKVFFAKSKINKFMPDEYLLSNYKKGTHKKNNANFDLDDCHTLIDFFKRSLNKHEDWKNFDFKFSDTSTYTDINNFYKEIDNQAYKLSFRPVPSDFVDKLVEEGKIFLFWIYNKDFSGHSKGTPNMHTLYWRMLFDERNLEDVVYSLNGGAEVFFRKASINVSHPTHPANIPIKKKNLKHKGEERILKYDLIKDKRYTIDQFQFHVPITMNFKVAGNGNININQKAIDYLRSASDTHIIGIDRGERNLLYLVVIDGNGKICEQFSLNEIEVEYNGEKYSTNYHDLLNVKENERKQARQSWQSIANIKDLKEGYLSQVIHKISELIVKYNAIVVLEDLNAGFMRGRQKVEKQVYQKFEKKLIEKLNYLVFKKQSSDLPGGLMHAYQLANKFESFNTLGKQSGFLFYIPAWNTSKMDPVTGFVNLFDVKYESVDKAKSFFSKFDSIRYNVERDMFEWKFNYGEFTKKAEGAKTDWTVCSYGNRIITFRNPDKNFQWDNKEINLTENIKLLFERFGIDLSSNLKDEIMERTEKEFFIELISLFKLVLQMRNSWTGTDIDYLVSPVCNENGEFFDSRNVDETLPQNADANGAYNIARKGMILLDKIKKNNGEKKLALSITNREWLSFAQGCCKNG

SEQ ID NO: 1535 - protein, 1245 aa, unidentified
  REGION 1..1245: note = Description of Unknown:uncultivated organism sequence
  REGION 1..1245: note = Category: MG75 effectors
  REGION 1..1245: note = Description: MG75-21 effector
METFSGFTNLYPLSKTLRFRLIPVGETLKHFIDSGILEEDQHRAESYVKVKAIIDDYHRAYIENSLSGFELPLESTGKFNSLEEYYLYHNIRNKTEEIQNLSSKVRTNLRKQVVAQLTKNEIFKRIDKKELIQSDLIDFVKNEPDANEKIALISEFRNFTVYFKGFHENRRNMYSDEEKSTSIAFRLIHENLPKFIDNMEVFAKIQNTSISENFDAIQKELCPELVTLCEMFKLGYFNKTLSQKQIDAYNTVIGGKTTSEGKKIKGLNEYINLYNQQHKQEKLPKMKLLFKQILSDRESASWLPEKFENDSQVVGAMVNFWNTIHDTVLAEGGLKTIIASLGSYGLEGIFLKNDLQLTDISQKATGSWSKISSEIKQKIEVMNPQKKKESYETYQERIDKIFKSYKSFSLAFINECLRGEYKIEDYFLKLGAVNSSSLQKENHFSHILNAYTDVKEAIGFYSESTDTKLIQDNDSIQKIKQFLDAVKDLQAYVKPLLGNGDETGKDERFYGDLIEYWSLLDLITPLYNMVRNYVTQKPYSIDKIKINFQNPTLLNGWDLNKETDNTSVILRRDGKYYLAIMNNKSRKVFLKYPSGTDRNCYEKMEYKLLPGANKMLPKVFFSKSRINEFMPNERLLSNYEKGTHKKSGTCFSLDDCHTLIDFFKKSLDKHEDWKNFGFKFSDTSTYEDMSGFYKEVENQGYKLSFKPIDATYVDQLVDEGKIFLFQIYNKDFSEHSKGTPNMHTLYWKMLFDETNLGDVVYKLNGEAEVFFRKASINVSHPTHPANIPIKKKNLKHKDEERILKYDLIKDKRYTVDQFQFHVPITMNFKADGNGNINQKAIDYLRSASDTHIIGIDRGERNLLYLVVIDGNGKICEQFSLNEIEVEYNGEKYSTNYHDLLNVKENERKQARQSWQSIANIKDLKEGYLSQVIHKISELMVKYNAIVVLEDLNAGFMRGRQKVEKQVYQKFEKKLIEKLNYLVFKKQSSDLPGGLMHAYQLANKFESFNALGKQSGFLFYIPAWNTSKMDPVTGFVNLFDVKYESVDKAKSFFSKFDSMRYNVERDMFEWKFNYGEFTKKAEGTKTDWTVCSYGNRIITFRNPDKNSQWDNKEINLTENIKLLFERFGIDLSSNLKDEIMQRTEKEFFIELISLFKLVLQMRNSWTGTDIDYLVSPVCNENGEFFDSRNVDETLPQNADANGAYNIARKGMILLDKIKKSNGEKKLALSITNREWLSFAQGCCKNG

SEQ ID NO: 1536 - protein, 1245 aa, unidentified
  REGION 1..1245: note = Description of Unknown:uncultivated organism sequence
  REGION 1..1245: note = Category: MG75 effectors
  REGION 1..1245: note = Description: MG75-22 effector
METFSGFTNLYPLSKTLRFRLIPVGETLKHFIDSGILEEDQHRAESYVKVKAIIDDYHRAYIENSLSGFELPLESTGKFNSLEEYYLYHNIRNKTEEIQDLSSKVRTNLRKQVVVQLTKNEIFKRIDKKELIQSDLIDFVKNEPDANEKIALISEFRNFTVYFKGFHENRRNMYSDEEKSTSIAFRLIHENLPKFIDNMEVFAKIQNTSISENFDAIQKELCPELVTLCEMFKLGYFNKTLSQKQIDAYNTVIGGKTTSEGKKIKGLNEYINLYNQQHKQEKLPKMKLLFKQILSDRESASWLPEKFENDSQVVGAMVNFWNTIHDTVLAEGGLKTIIASLGSYGLEGIFLKNDLQLTDISQKATGSWSKISSEIKQKIEVMNPQKKKESYESYQERIDKLFKSYKSFSLAFINECLRGEYKIEDYFLKLGAVNSSSLQKENHFSHILNAYTDVKEAIGFYSESTDTKLIQDNDSIQKIKQFLDAVKDLQAYVKPLLGNGDETGKDERFYGDLIEYWSLLDLITPLYNMVRNYVTQKPYSVDKIKINFQNPTLLNGWDLNKETDNTSVILRRDGKYYLAIMNNKSRKVFLKYPSGTDGNCYEKMEYKLLPGANKMLPKVFFSKSRINEFMPNERLLSNYEKGTHKKSGICFSLDDCHTLIDFFKKSLDKHEDWKNFGFKFSDTSTYEDMSGFYKEVENQGYKLSFKPIDATYVDQLVDEGKIFLFQIYNKDFSEHSKGTPNMHTLYWKMLFDETNLGDVVYKLNGEAEVFFRKASINVSHPTHPANIPIKKKNLKHKDEERILKYDLIKDKRYTVDQFQFHVPITMNFKADGNGNINQKAIDYLCSASDTHIIGIDRGERNLLYLVVIDGNGKICEQFSLNEIEVEYNGEKYSTNYHDLLNVKENERKQARQSWQSIANIKDLKEGYLSQVIHKISELMVKYNAIVVLEDLNAGFMRGRQKVEKQVYQKFEKKLIEKLNYLVFKKQSSDLPGGLMHAYQLANKFESFNALGKQSGFLFYIPAWNTSKMDPVTGFVNLFDVKYESVDKAKSFFSKFDSMRYNVERDMFEWKFNYGEFTKKAEGTKTDWTVCSYGNRIITFRNPDKNSQWDNKEINLTENIKLLFERFGIDLSSNLKDEIMQRTEKEFFIELISLFKLVLQMRNSWTGTDIDYLVSPVCNENGEFFDSRNVDETLPQNADANGAYNIARKGMILLDKIKKSNGEKKLALSITNREWLSFAQGCCKNG

SEQ ID NO: 1537 - protein, 1264 aa, unidentified
  REGION 1..1264: note = Description of Unknown:uncultivated organism sequence
  REGION 1..1264: note = Category: MG75 effectors
  REGION 1..1264: note = Description: MG75-23 effector
MNFEQFTHLYPLSKTLRFELRPVGATLAKIKEGGFLENDNHRAESYKKVKKLIDEYHKHFIEQALGDFSLTKNETEGSKCLNSYLETYIQLYRSSRIEDAEKKAFEKVQAEMRKFIAKTLKGSEAYKRLFKQELIKEDLTAFLRTHGGTVADEELVAEFKNFTTYFTGLYENRENMYSEEEKSTAISYRLVNENLPKFVDNMAAFAIIAQVPEVRAMLDVMQKDLGAELDGTTIDELFTLPFFNKVLTQKQIAVYNAVIGGKVSDSHSKGESHIKGINQIVNLYNQQHKDARLPKLKMLYKQILSDREALSWLPEKFDKDADLLKAIHDGYERLASDGVLENLRTLLESMADYQAEGIFITNDQQLTRISQKMFGEWSFISEAILCALKKDVPQKRNECDEKYEERIDKMLKNHGGFSIRFIDDCVAAYVNTLDDEEQKKRFIPTVEAYFATLGAFDTEEEQTINFFSRIQNARDALQGLLDSAYPEGRALIQDKENGALLKELLDAILALMHFVKPLLGKNENGKDERFYGELMQIWDEFDSFVPLYNMSRNYLTQKPYSEEKYKLNFENSQLLKGWDLNKEADNTSIILRKDGLFYLAIMNKKHNKLFTRELPTDGDCYDKMDYKLLPGPNKMFPKVFFSKSRKAEFAPSEHIMDVYKKGSFKKGDTFNLQDCHDLIDFFKASILKHEDWRQFEFKFSETEQYDDISGFYREVEAQGYKVTFRQVSVSYIDRLVNEGKLYLFQIYNKDFSSYSKGTPNMHTLYWRALFDERNLSDVVYKLNGEAEVFYRKKSIEAHPTHPANRPIKNKNKLNDKEKSLFAYDLIKDRRYSEDKFSLHVPITMNFKSVGGPNINDDVVEFLRTNENLHFIGIDRGERHLLYLTVIDSHGHILEQRTLNDVVNNYQGKDYHTDYHDLLETRERQRQEARSSWKAIENIKDLKEGYLAQVVHQIAQLMVKYHAIVVLEDLNGGFMRGRQKVERSVYQQFEKKLIDKLNYLVDKKTDAHAPGGLMNAYQLANQFKSFKSMGRQSGFIFYIPAWNTSKIDPVTGFTNLFDTRYKNVHDAQQFFSAFKSIRYNETADRFEFKFSYSDFTRKAEGSRTDWTVCTYGTRIKTFRDPQKNNEWTSKEVVLTEEFKKFFAAYHVDIHSNLKDSIAAHDEKAFFEQLLALMRLTLQIRNSKSGTDVDYLLSPVADENGVFFDSRSCGNSLPQDADANGAYNIARKGLMLVRQMREAKDLKKFKADMTNRNWLKFAQEKPYLND

SEQ ID NO: 1538 - protein, 1274 aa, unidentified
  REGION 1..1274: note = Description of Unknown:uncultivated organism sequence
  REGION 1..1274: note = Category: MG75 effectors
  REGION 1..1274: note = Description: MG75-24 effector
MAKNFEDFKRLYSLSKTLRFEAKPIGATLDNIVKSGLLDEDEHRAASYVKVKKLIDEYHKVFIDRVLDDGCLPLENKGNNNSLAEYYESYVSRAQDEDAKKKFKEIQQNLRSVIAKKLTEDKAYANLFGNKLIESYKDKEDKKKIIDSDLIQFINTAESTQLDSMSQDEAKELVKEFWGFVTYFYGFFDNRKNMYTAEEKSTGIAYRLVNENLPKFIDNIEAFNRAITRPEIQENMGVLYSDFSEYLNVESIQEMFQLDYYNMLLTQKQIDVYNAIIGGKTDDEHDVKIKGINEYINLYNQKHKDDKLPKLKSLFKQILSDRNAISWLPEEFNSDQEVLNAIKDCYERLSENVLGDKVLKSMLGSLADYSLDGIFIRNDLQLTDISQKMFGNWSVIQNAIMQNIKHVAPARKHKESEEEYENRIAGIFKKADSFSISYIDACLNETDPNNAYFVENYFATLGAVDTPTMQRENLFALVQNAYTEITALLHSDYPTEKNLAQDKANVAKIKALLDAIKSLQHFVKPLLGKGDESDKDERFYGELASLWAELDTMTPLYNMIRNYMTRKPYSQKKIKLNFENPQLLGGWDANKEKDYATIILRRNGLYYLAIMNKDSKKLLGKAMPSDGECYEKMVYKLLPGANKMLPKVFFAKSRMEDFKPSKELVEKYNNGTHKKGKNFNIQDCHNLIDYFKQSIDKHEDWSKFGFKFSDTSTYEDLSGFYREAEQQGYKLSFARVSVSYINQLVEEGKMYLFQIYNKDFSEYSKGTPNMHTLYWKALFDERNLADVVYKLNGQAEMFYRKKSIENTHPTHPANHPILNKNKDNNKKESLFEYDLIKDRRYTVDKFMFHVPITMNFKSSGSENINQDVKAYLCHADDMHIIGIDRGERHLLYLVVIDLQGNIKEQFSLNEIVNDYNGNTYHTNYHDLLDVREDERLKARQSWQTIENIKELKEGYLSQVIHKITQLMVKYHAIVVLEDLNMGFMRGRQKVEKQVYQKFEKMLIEKLNYLVDKKADASVSGGLLNAYQLTSKFDSFQKLGKQSGFLFYIPAWNTSKIDPVTGFVNLLDTRYQNVEKAKSFFSKFDAIRYNKDKEWFEFNLDYDKFGKKAEGTRTKWTLCTRGMRIDTFRNKEKNSQWDNQEVDLTAEMKSLLEHYYIDIHGNLKDAISAQTDKAFFTGLLHILKLTLQMRNSITGTETDYLVSPVADENGIFYDSRSCGNQLPENADANGAYNIARKGLMLIEQIKNAEDLNNVKFDISNKAWLNFAQQKPYKNG

SEQ ID NO: 1539 - protein, 1274 aa, unidentified
  REGION 1..1274: note = Description of Unknown:uncultivated organism sequence
  REGION 1..1274: note = Category: MG75 effectors
  REGION 1..1274: note = Description: MG75-25 effector
MAKNFEDFKRLYPLSKTLRFEAKPIGATLDNIIKSGLLDEDEHRAASYVKMKKLIDEYHKVFIDRVLDNGCLPLEDKGDNNSLAEYYESYVSKAQDEDAIKKFKEIQQNLCSIIAKKLTDDKAYANLFGNKLIESYKDKADKTKIIDSDLIQFINTAESTQLVSMSQDEAKELVKEFWGFTTYFEGFFKNRKNMYTPEEKSTGIAYRLINENLPKFIDNMEAFKKAIARPEIQANMEELYSDFSEYLNVESIQEMFQLDYYNMLLTQKQIDVYNAIIGGKTDDEHDVKIKGINEYINLYNQQHKDDKLPKLKALFKQILSDRNAISWLPEEFNSDQEVLNAIKDCYERLAENVLGDKVLKSLLCSLSDYTLDGIFIRNDLQLTDISQKMFGNWGVIQNAIMQNIKRVAPARKHKESEEDYEKRIAGIFKKADSFSISYINDCLNEADPNNAYFVENYFATFGAVNTPTMQRENLFALVQNAYTEVASLLHSDYPTAKHLAQDKANVAKIKALLDAIKSLQHFVKPLLGKGDESDKDERFYGELASLWAELDTVTPLYNMIRNYITRKPYSQKKIKLNFENPQLLGGWDANKEKDYATIILRRNGLYYLAIMNKESKKLLGKAMPSDGECYEKMVYKLLPGANKMLPKVFFAKSRMEDFKPSKELVEKYNNGTHKKGKNFNIQDCHNLIDYFKQSISKHEDWGKFGFNFSDTSTYEDLSGFYREVEQQGYKLSFARVSVSYINQLVEEGKMYLFQIYNKDFSEYSKGTPNMHTLYWKALFDERNLADVVYKLNGQAEMFYRKKSIENTHPTHPANHPILNKNKDNKKKESLFEYDLIKDRRYTVDKFMFHVPITMNFKSVGSENINQGVKEYLHHADDMHIIGIDRGERHLLYLVVIDLQGNIKEQYSLNEIVNEYNGNTYHTNYHDLLDVREDERLKARQSWQTIENIKELKEGYLSQVIHKITQLMVKYHAIVVLEDLNMGFMRGRQKVEKQVYQKFEKMLIDKLNYLVDKKADASVSGGWLNAYQLTSKFDSFQKLGKQSGFLFYIPAWNTSKIDPVTGFVNLLDARYQNVEKAKAFFSKFDAIRYNKDKDWFEFNLDYDKFGKKAEGTRTKWTLCTRGMRIDTFRNKEKNSQWDNQEVDLTAEMKSLLEHYYIDIHGNLKDAISAQTDKAFFTGLLHILKLTLQMRNSITGTETDYLVSPVADENGIFYDSRSCGEELPENADANGAYNIARKGLMLIEQIKGAEDLGNLKFDMSNKAWLNFAQKKPYKNG

SEQ ID NO: 1540 - protein, 1274 aa, unidentified
  REGION 1..1274: note = Description of Unknown:uncultivated organism sequence
  REGION 1..1274: note = Category: MG75 effectors
  REGION 1..1274: note = Description: MG75-26 effector
MAKNFEDFKRLYPLSKTLRFEAKPIGATLDNIIKSGLLDEDEHRAASYVKMKKLIDEYHKVFIDRVLDNGCLPLKNEGQNNSLTEYYESYVSKSQNEDAKKAFEENQQNLRSIVAKKLTDDKAYANLFGKNLIESYKDKEDKKKIIDSDLIQFICTAEATQLDSMSQDEAKEIVKEFWGFTTYFVGFFDNRKNMYTAEEKSTGIAYRLINENLPKFIDNMEAFKKAIARPEIQANMEELYSNFSEYLNVESIQEMFLLDYYNMLLTQKQIDVYNAIIGGKTDDEHDVKIKGINEYINLYNQQHKDDKLPKLKALFKQILSDRNAISWLPEEFNSDQEVLNAIKDCYERLSENVLGDKVLKSLLGSLSDYTLDGIFIRNDLQLTDISQKMFGNWGVIQNAIMQNIKRVAPARKHKESEEDYEKRIAGIFKKADSFSISYINDCLNEADPNNAYFVENYFATFGAVNTPTMQRENLFALVQNAYTEVASLLHSDYPTAKHLAQDKANVAKIKALLDAIKSLQHFVKPLLGKGDESDKDERFYGELASLWAELDTVTPLYNMIRNYITRKPYSQKKIKLNFENPQLLGGWDANKEKDYATIILRRNGLYYLAIMNKDSKKLLGKAMPSDGECYEKMVYKLLPGANKMLPKVFFAKSRMEDFKPSKELVEKYNNGTHKKGKNFNIQDCHNLIDYFKQSINKHEDWGKFGFNFSDTSTYEDLSGFYREVEQQGYKLSFARVSVSYINQLVEEGKMYLFQIYNKDFSEYSKGTPNMHTLYWKALFDERNLADVVYKLNGQAEMFYRKKSIENTHPTHPANHPILNKNKDNKKKESLFDYDLIKDRRYTVDKFMFHVPITMNFKSSGSENINQDVKAYLRHADDMHIIGIDRGERHLLYLVVIDLQGNIKEQYSLNEIVNEYNGNTYHTNYHDLLDVREEERLKARQSWQTIENIKELKEGYLSQVIHKITQLMVKYHAIVVLEDLNMGFMRGRQKVEKQVYQKFEKMLIDKLNYLVDKKADASVSGGWLNAYQLTSKFDSFQKLGKQSGFLFYIPAWNTSKIDPVTGFVNLLDARYQNVEKAKAFFSKFDAIRYNKDKDWFEFNLDYDKFGKKAEGTRTKWTLCTRGMRIDTFRNKEKNSQWDNQEVDLTAEMKSLLEHYYIDIHGNLKDAISAQTDKAFFTGLLHILKLTLQMRNSITGTETDYLVSPVADENGIFYDSRSCGEELPENADANGAYNIARKGLMLIEQIKGAEDLGNLKFDISNKAWLNFAQQKPYKNG

SEQ ID NO: 1541 - protein, 1274 aa, unidentified
  REGION 1..1274: note = Description of Unknown:uncultivated organism sequence
  REGION 1..1274: note = Category: MG75 effectors
  REGION 1..1274: note = Description: MG75-27 effector
MAKNFEDFKRLYPLSKTLRFEAKPIGATLDNIIKSGLLDEDEHRAASYVKMKKLIDEYHKVFIDRVLDNGCLPLEDKGDNNSLAEYYESYVSKAQDEDAIKKFKEIQQNLCSIIAKKLTDDKAYANLFGNKLIESYKDKADKTKIIDSDLIQFINTAESTQLVSMSQDEAKELVKEFWGFTTYFEGFFKNRKNMYTPEEKSTGIAYRLINENLPKFIDNMEAFKKAITRPEIQANMEELYSDFSEYLNVESIQEMFQLDYYNMLLTQKQIDVYNAIIGGKTDDEHDVKIKGINEYINLYNQQHKDDKLPKLKALFKQILSDRNAISWLPEEFNSDQEVLNAIKDCYERLAENVLGDKVLKSLLGSLADYSLDGIFIRNDLQLTDISQKMFGNWGVIQNAIMQNIKHVAPARKHKESEEDYEKRIAGIFKKADSFSISYINDCLNEADPNNAYFVENYFATFGAVNTPTMQRENLFALIQNAYTEVAALLHSDYPTAKHLAQDKANVAKIKALLDAIKSLQHFVKPLLGKGDESDKDERFYGELASLWAELDMVTPLYNMIRNYMTRKPYSQKKIKLNFENPQLLGGWDANKEKDYATIILRRDGLYYLAIMNKESKKLLGKAMPSDGECYEKMVYKLLPGANKMLPKVFFAKSRMEDFKPSKELVEKYNNGTHKKGKNFNIQDCHNLIDYFKQSISKHEDWGKFGFNFSDTSTYEDLSGFYREVEQQGYKLSFARVSVSYISQLVEEGKMYLFQIYNKDFSEYSKGTPNMHTLYWKALFDERNLADVVYKLNGQAEMFYRKKSIENTHPTHPANHPILNKNKDNKKKESLFDYDLIKDRRYTVDKFMFHVPITMNFKSSGSENINQNVKTYLRHADDMHIIGIDRGERHLLYLVVIDLQGNIKEQYSLNEIVNEYNGNTYHTNYHDLLDVREEERLKARQSWQTIENIKELKEGYLSQVIHKITQLMVKYHAIVVLEDLNMGFMRGRQKVEKQVYQKFEKMLIDKLNYLVDKKADASVSGGLLNAYQLTSKFDSFQKLGKQSGFLFYIPAWNTSKIDPVTGFVNLLDTRYQNVEKAKVFFSKFDAIRYNKDKDWFEFNLDYDKFGKKAEGTRTKWTLCTRGMRIDTFRNKEKNSQWDNQEVDLTAEMKSLLEHYYIDIHGNLKDAISAQTDKAFFTGLLHILKLTLQMRNSITGTETDYLVSPVADENGIFYDSRSCGEELPENADANGAYNIARKGLMLIEQIKGAEDLGNLKFDISNKAWLNFAQKKPYKNG

SEQ ID NO: 1542 - protein, 1274 aa, unidentified
  REGION 1..1274: note = Description of Unknown:uncultivated organism sequence
  REGION 1..1274: note = Category: MG75 effectors
  REGION 1..1274: note = Description: MG75-28 effector
MAKNFEDFKRLYPLSKTLRFEAKPIGATLDNIVKSGLLDEDEHRAASYVKVKKLIDEYHKVFIDRVLDNGCLPLEDKGDNNSLAEYYDSYVSKSQNEDAKKAFKEIQQNLRSIIAKKLTDDKAYANLFSNKLIESYKDKADKTKIIDSDLIQFIHTAESTQLDSMSQDEAKELVKEFWGFTTYFVGFFDNRKNMYTAEEKSTGIAYRLINENLPKFIDNMEAFKKAIARPEIQANMEELYSIFSEYLNVESIQEMFLLDYYNMLLTQKQIDVYNAIIGGKTDEEHDVKIKGINEYINLYNQQHKDDKLPKLKALFKQILSDRNAISWLPEEFNSDQEVLNAIKDCYERLAENVLGDKVLKSLLGSLADYSLDGIFIRNDLQLTDISQKMFGNWGVIQNAIMQNIKHVAPARKHKESEEDYEKRIAGIFKKADSFSISYINDCLNEADPNNAYFVENYFATFGAINTPTMQRENLFALVQNAYTEVAVLLHSDYPTAKQLAQDKANVSKIKALLDAIKSLQHFVKPLLGKGDESDKDERFYGDLASLWAELDTVTPLYNMIRNYMTRKPYSQKKIKLNFENPQLLGGWDANKEKDYATIILRRNGLYYLAIMNKESKKLLGKSMPSDGECYEKMVYKLLPGANKMLPKVFFAKSRMDDFKPSKELIEKYNNGTHKKGKNFDIQDCHNLIDYFKQSIDKHEDWSKFGFNFSDTSTYEDLSGFYREVEQQGYKLSFARVSVSYINQLVEEGKMYLFQIYNKDFSEYSKGTPNMHTLYWKALFDERNLADVVYKLNGQAEMFYRKKSIENTHPTHPANHPILNKNKDNKKKESLFDYDLIKDRRYTVDKFMFHVPITMNFKSSGSENINQDVKAYLRHADDMHIIGIDRGERHLLYLVVIDLQGNIKEQFSLNEIVNDYNGNTYHTNYHDLLDVREDERLKARQSWQTIENIKELKEGYLSQVIHKITQLMVKYHAIVVLEDLNMGFMRGRQKVEKQVYQKFEKMLIDKLNYLVDKKADVSVSGGLLNAYQLTSKFDSFQKMGKQSGFLFYIPAWNTSKIDPITGFVNLLDTRYQNVEKAKVFFSKFDAIRYNKDKDWFEFNLDYDKFGKKAEGTRTKWALCTRGMRIDTFRNKEKNSQWDNQEVDLTAEMKSLLEHYYIDIHGNLKDAISAQTDKAFFTGLLHILKLTLQMRNSIIGTETDYLVSPVADENGIFYDSSSCGDELPENADANGAYNIARKGLMMIEQIKDAKDLDNLKFDISNKSWLNFAQQKPYKNG

SEQ ID NO: 1543 - protein, 1274 aa, unidentified
  REGION 1..1274: note = Description of Unknown:uncultivated organism sequence
  REGION 1..1274: note = Category: MG75 effectors
  REGION 1..1274: note = Description: MG75-29 effector
MAKNFEDFKRLYPLSKTLRFEAKPIGATLDNIIKSGLLDEDEHRAASYVKMKKLIDEYHKVFIDRVLDNGCLPLKNEGQNNSLTEYYESYVSKSQNEDAKKAFEENQQNLRSIVAKKLTDDKAYANLFGKNLIESYKDKEDKKKIIDSDLIQFICTAEATQLDSMSQDEAKEIVKEFWGFTTYFVGFFDNRKNMYTAEEKSTGIAYRLINENLPKFIDNMEAFKKAIARPEIQANMEELYSNFSEYLNVESIQEMFLLDYYNMLLTQKQIDVYNAIIGGKTDDEHDVKIKGINEYINLYNQQHKDDKLPKLKALFKQILSDRNAISWLPEEFNSDQEVLNAIKDCYERLSENVLGDKVLKSLLGSLSDYTLDGIFIRNDLQLTDISQKMFGNWGVIQNAIMQNIKRVAPARKHKESEEDYEKRIAGIFKKADSFSISYINDCLNEADPNNAYFVENYFATFGAVNTPTMQRENLFALVQNAYTEVASLLHSDYPTAKHLAQDKANVAKIKALLDAIKSLQHFVKPLLGKGDESDKDERLYGELASLWAELDTVTPLYNMIRNYITRKPYSQKKIKLNFENPQLLGGWDANKEKDYATIILRRNGLYYLAIMNKESKKLLGKAMPSDGECYEKMVYKLLPGANKMLPKVFFAKSRMEDFKPSKELVEKYNNGTHKKGKNFNIQDCHNLIDYFKQSINKHEDWGKFGFNFSDTSTYEDLSGFYREVEQQGYKLSFARVSVSYINQLVEEGKMYLFQIYNKDFSEYSKGAPNMHTLYWKALFDERNLADVVYKLNGQAEMFYRKKSIENTHPTHPANHPILNKNKDNKKKESLFDYDLIKDRRYTVDKFMFHVPITMNFKSSGSENINQDVKAYLRHADDMHIIGIDRGERHLLYLVVIDLQGNIKEQYSLNEIVNEYNGNTYHTNYHDLLDVREEERLKARQSWQTIENIKELKEGYLSQVIHKITQLMVKYHAIVVLEDLNMGFMRGRQKVEKQVYQKFEKMLIDKLNYLVDKKADASVSGGWLNAYQLTSKFDSFQKLGKQSGFLFYIPAWNTSKIDPVTGFVNLLDARYQNVEKAKAFFSKFDAIRYNKDKDWFEFNLDYDKFGKKAEGTRTKWTLCTRGMRIDTFRNKEKNSQWDNQEVDLTAEMKSLLEHYYIDIHGNLKDAISTQTDKAFFTGLLHILKLTLQMRNSITGTETDYLVSPVADENGIFYDSRSCGEELPENADANGAYNIARKGLMLIEQIKGAEDLGNLKFDISNKAWLNFAQQKPYKNG

SEQ ID NO: 1544 - protein, 1245 aa, unidentified
  REGION 1..1245: note = Description of Unknown:uncultivated organism sequence
  REGION 1..1245: note = Category: MG75 effectors
  REGION 1..1245: note = Description: MG75-30 effector
METFSGFTNLYPLSKTLRFRLIPVGETLKYFIGSGILEEDQHRAESYVKVKAIIDDYHRAYIENSLSGFELPLESTGKSNSLEEYYLYHNIRNKTEEIQNLSSKVRTNLRKQVVAQLTKNEIFKRIDKKELIQSDLIDFVKNEPDANEKIALISEFRNFTVYFKGFHENRRNMYSDEEKSTSIAFRLIHENLPKFIDNMEVFAKIQNTSISENFDAIQKELCPELVTLCEMFKLGYFNKTLSQKQIDAYNTVIGGKTTSEGKKIKGLNEYINLYNQQHKQEKLPKMKLLFKQILSDRESASWLPEKFENDSQVVGAIVNFWNTIHDTVLAEGGLKTIIASLGSYGLEGIFLKNDLQLTDISQKATGSWGKISSEIKQKIEVMNPQKKKESYETYQERIDKIFKSYKSFSLAFINECLRGEYKIEDYFLKLGAVNSSSLQKENHFSHILNTYTDVKEVIGLYSESTDTKLIQDNDSIQKIKQFLDAVKDLQAYVKPLLGNGDETGKDERFYGDLIEYWSLLDLITPLYNMVRNYVTQKPYSVDKIKINFQNPTLLNGWDLNKETDNTSVILRRDGKYYLAIMNNKSRKVFLKYPSGTDRNCYEKMEYKLLPGANKMLPKVFFSKSRINEFMPNERLLSNYEKGTHKKSGTCFSLDDCHTLIDFFKKSLDKHEDWKNFGFKFSDTSTYEDMSGFYKEVENQGYKLSFKPIDATYVDQLVDEGKIFLFQIYNKDFSEHSKGTPNMHTLYWKMLFDETNLGDVVYKLNGEAEVFFRKASINVSHPTHPANIPIKKKNLKHKDEERILKYDLIKDKRYTVDQFQFHVPITMNFKADGNGNINQKAIDYLRSASDTHIIGIDRGERNLLYLVVIDGNGKICEQFSLNEIEVEYNGEKYSTNYHDLLNVKENERKQARQSWQSIANIKDLKEGYLSQVIHKISELMVKYNAIVVLEDLNAGFMRGRQKVEKQVYQKFEKKLIEKLNYLVFKKQSSDLPGGLMHAYQLANKFESFNTLGKQSGFLFYIPAWNTSKMDPVTGFVNLFDVKYESVDKAKSFFSKFDSIRYNVERDMFEWKFNYGEFTKKAEGTKTDWTVCSYGNRIITFRNPDKNSQWDNKEINLTENIKLLFERFGIDLSSNLKDEIMQRTEKEFFIELISLFKLVLQMRNSWTGTDIDYLVSPVCNENGEFFDSRNVDETLPQNADANGAYNIARKGMILLDKIKKSNGEKKLALSITNREWLSFAQGCCKNG

SEQ ID NO: 1545 - protein, 1274 aa, unidentified
  REGION 1..1274: note = Description of Unknown:uncultivated organism sequence
  REGION 1..1274: note = Category: MG75 effectors
  REGION 1..1274: note = Description: MG75-31 effector
MAKNFEDFKRLYPLSKTLRFEAKPIGATLDNIIKSGLLDEDEHRAASYVKMKKLIDEYHKVFIDRVLDNGCLPLKNEGQNNSLTEYYESYVSKSQNEDAKKAFEENQQNLRSIVAKKLTDDKAYANLFGKNLIESYKDKEDKKKIIDSDLIQFICTAEATQLDSMSQDETKEIVKEFWGFTTYFVGFFDNRKNMYTAEEKSTGIAYRLINENLPKFIDNMEAFKKAIARPEIQANMEELYSNFSEYLNVESIQEMFLLDYYNMLLTQKQIDVYNAIIGGKTDDEHDVKIKGINEYINLYNQQHKDDKLPKLKALFKQILSDRNAISWLPEEFNSDQEVLNAIKDCYERLSENVLGDKVLKSLLGSLSDYTLDGIFIRNDLQLTDISQKMFGNWGVIQNAIMQNIKRVAPARKHKESEEDYEKRIAGIFKKADSFSISYINDCLNEADPNNAYFVENYFATFGAVNTPTMQRENLFALVQNAYTEVASLLHSDYPTAKHLAQDKANVAKIKALLDAIKSLQHFVKPLLGKGDESDKDERFYGELASLWAELDTVTPLYNMIRNYITRKPYSQKKIKLNFENPQLLGGWDANKEKDYATIILRRNGLYYLAIMNKESKKLLGKAMPSDGECYEKMVYKLLPGANKMLPKVFFAKSRMEDFKPSKELVEKYNNGTHKKGKNFNIQDCHNLIDYFKQSINKHEDWGKFGFNFSDTSTYEDLSGFYREVEQQGYKLSFARVSVSYINQLVEEGKMYLFQIYNKDFSEYSKGTPNMHTLYWKALFDERNLADVVYKLNGQAEMFYRKKSIENTHPTHPANHPILNKNKDNKKKESLFDYDLIKDRRYTVDKFMFHVPITMNFKSSGSENINQDVKAYLRHADDMHIIGIDRGERHLLYLVVIDLQGNIKEQYSLNEIVNEYNGNTYHTNYHDLLDVREEERLKARQSWQTIENIKELKEGYLSQVIHKITQLMVKYHAIVVLEDLNMGFMRGRQKVEKQVYQKFEKMLIDKLNYLVDKKADASVSGGWLNAYQLTSKFDSFQKLGKQSGFLFYIPAWNTSKIDPVTGFVNLLDARYQNVEKAKAFFSKFDAIRYNKDKDWFEFNLDYDKFGKKAEGTRTKWTLCTRGMRIDTFRNKEKNSQWDNQEVDLTAEMKSLLEHYYIDIHGNLKDAISAQTDKAFFTGLLHILKLTLQMRNSITGTETDYLVSPVADENGIFYDSRSCGEELPENADANGAYNIARKGLMLIEQIKGAEDLGNLKFDISNKAWLNFAQQKPYKNG

SEQ ID NO: 1546 - protein, 1252 aa, unidentified
  REGION 1..1252: note = Description of Unknown:uncultivated organism sequence
  REGION 1..1252: note = Category: MG75 effectors
  REGION 1..1252: note = Description: MG75-32 effector
MKFEDFTGLYPVSKTLRFEAKPVGATLENVIKSGVLEDDAHRARSYKKVKKLIDEYHKVFIDSVMSKFKFKEEILEEICSLYAAKSMDDKSKDRFVKLQGEMRKDVSVAFASDDRYKTINKKELVKEDLFEFVSHADNGQLAGLTKEEAEELILEFKDFTTYFSGFHKNRSNMYVADEKTTSVAYRLVNENLPRFLYNVSVFQKVVSVPEFENKIRAIYDSFREYLCVDNLASMFETSYYNDVLSQMQIDIYNSVIGGKTDKDSSTKIQGLNECINLYNQTHRNDKLPKFKILYKQIRSDRVAMSWLPDEFSDDKETLEAIRNCYDSLTDHILGERDLKTLLESLGQYDMSGVFIANGPYLADISQKLYGDWRAIEKAIRKQEAVNSPKKAKETEEEYFNRITKHIHNYDSFSIEYLNFCITESYPNDGRRVEDYFATLGAVNTDTSQRENLFSRIDNAYTNVSGLLSSEYPETKKLSQDTENVEKIKDLLDSIKELQRFVKPLMGNGDESDNDKRFYGELSPLWDELETFSLLYDKVRNYVTRKPYSQNKIKLNFNNATLFAGWDQNKEKDNACIILRRGGMYYLGIMNKSYRIVFENNFPCDGDCYEKMVYKLLPGANKMLPKVFFSKSRIREFNPSDRILKNYEEGTHKKGPKFKLEDCHELIDFFKASINLHEDWKKFKFKFSDTSSYEDISDFYKEVEQQGYKITFVNVSVSYIDSLVNDGKLYLFQLYNKDFSQYSKGVPNMHTLYWKALFDKANLADVVYKLNGEAELFFRKKSIDMERPTHRANISVANKNIHNIKKESIFKYDLTKDRRYTVDKFLFHVPITMNFKSEGNIAIEQQVRSYLQSAEDTHVIGIDRGERHLLYVSVIDRRGLIKEQFSLNEIINEHNGSTYATNYHDLLDAKESERRKARQSWQTIENIKDLKEGYLSQAVHKIAQLMVKYHAVVVLEDLNVGFMRGRQKVEKQVYQKFEKMLTDKLNYLVDKKLNANDPGGVFHAYQLSSVFKSAEKRGKQSGFIFYIPAWNTSKIDPVTGFVNLFDLKYENIDKAKSFFSKFQIIRYNSERDWFEFIFDYDSFNSKASGTKVGWTLTTHGDRILSFRNSEKNNQWDSRAVILTDEYKALFDKYGIDYNDNLKEAITNQTEKAFFEDLLKCLRLTLQMRNSVIGTDTDFLISPVADNNGVFYDSRICADSLPKNADANGAYNIARKGLMLIDQIKKASDVRNIKFDIANKSWLDFAQKKPYLDE

SEQ ID NO: 1547 - protein, 1274 aa, unidentified
  REGION 1..1274: note = Description of Unknown:uncultivated organism sequence
  REGION 1..1274: note = Category: MG75 effectors
  REGION 1..1274: note = Description: MG75-33 effector
MAKNFEDFKRLYPLSKTLRFEAKPIGATLDNIIKSGLLDEDEHRAASYVKMKKLIDEYHKVFIDRVLDNGCLPLEDKGDNNSLAEYYESYVSKAQDEDAIKKFKEIQQNLCSIIAKKLTDDKAYANLFGNKLIESYKDKADKTKIIDSDLIQFINTAESTQLVSMSQDEAKELVKEFWGFTTYFEGFFKNRKNMYTPEEKSTGIAYRLINENLPKFIDNMEAFKKAITRPEIQANMEELYSDFSEYLNVESIQEMFQLDYYNMLLTQKQIDVYNAIIGGKTDDEHDVKIKGINEYINLYNQQHKDDKLPKLKALFKQILSDRNAISWLPEEFNSDQEVLNAIKDCYERLAENVLGDKVLKSLLCSLSDYTLDGIFIRNDLQLTDISQKMFGNWGVIQNAIMQNIKRVAPARKHKESEEDYEKRIAGIFKKADSFSISYINDCLNEADSNNAYFVENYFATFGAVNTPTMQRENLFALVQNAYTEVASLLHSDYPTAKHLAQDKANVAKIKALLDAIKSLQHFVKPLLGKGDESDKDERFYGELASLWAELDTVTPLYNMIRNYITRKPYSQKKIKLNFENPQLLGGWDANKEKDYATIILRRNGLYYLAIMNKESKKLLGKAMPSDGECYEKMVYKLLPGANKMLPKVFFAKSRMEDFKPSKELVEKYNNGTHKKGKNFNIQDCHNLIDYFKQSISKHEDWGKFGFNFSDTSTYEDLSGFYREVEQQGYKLSFARVSVSYINQLVEEGKMYLFQIYNKDFSEYSKGTPNMHTLYWKALFDERNLADVVYKLNGQAEMFYRKKSIENTHPTHPANHPILNKNKDNKKKESLFEYDLIKDRRYTVDKFMFHVPITMNFKSVGSEIINQGVKEYLHHADDMHIIGIDRGERHLLYLVVIDLQGNIKEQYSLNEIVNEYNGNTYHTNYHDLLDAREDERLKARQSWQTIENIKELKEGYLSQVIHKITQLMVKYHAIVVLEDLNMGFMRGRQKVEKQVYQKFEKMLIDKLNYLVDKKADASVSGGWLNAYQLTSKFDSFQKLGKQSGFLFYIPAWNTSKIDPVTGFVNLLDARYQNVEKAKAFFSKFDAIRYNKDKDWFEFNLDYDKFGKKAEGTRTKWTLCTRGMRIDTFRNKEKNSQWDNQEVDLTAEMKSLLEHYYIDIHGNLKDAISAQTDKAFFTGLLHILKLTLQMRNSITGTETDYLVSPVADENGIFYDSRSCGEELPENADANGAYNIARKGLMLIEQIKGAEDLGNLKFDISNKAWLNFAQKKPYKNG

SEQ ID NO: 1548 - protein, 1274 aa, unidentified
  REGION 1..1274: note = Description of Unknown:uncultivated organism sequence
  REGION 1..1274: note = Category: MG75 effectors
  REGION 1..1274: note = Description: MG75-34 effector
MAKNFEDFKRLYPLSKTLRFEAKPIGATLDNIIKSGLLDEDEHRAASYVKMKKLIDEYHKVFIDRVLDNGCLPLEDKGDNNSLAEYYESYVSKAQDEDAIKKFKEIQQNLCSIIAKKLTDDKAYANLFGNKLIESYKDKADKTKIIDSDLIQFINTAESTQLVSMSQDEAKELVKEFWGFTTYFEGFFKNRKNMYTPEEKSTGIAYRLINENLPKFIDNMEAFKKAITRPEIQANMEELYSDFSEYLNVESIQEMFQLDYYNMLLTQKQIDVYNAIIGGKTDDEHDVKIKGINEYINLYNQQHKDDKLPKLKALFKQILSDRNAISWLPEEFNSDQEVLNAIKDCYERLAENVLGDKVLKSLLCSLSDYTLDGIFIRNDLQLTDISQKMFGNWGVIQNAIMQNIKRVAPARKHKESEEDYEKRIAGIFKKADSFSISYINDCLNEADPNNAYFVENYFATFGAVNTPTMKRENLFALVQNAYTEVASLLHSDYPTAKHLAQDKANVAKIKALLDAIKSLQHFVKPLLGKGDESDKDERFYGELASLWAELDTVTPLYNMIRNYITRKPYSQKKIKLNFENPQLLGGWDANKEKDYATIILRRNGLYYLAIMNKESKKLLGKAMPSDGECYEKMVYKLLPGANKMLPKVFFAKSRMEDFKPSKELVEKYNNGTHKKGKNFNIQDCHNLIDYFKQSISKHEDWGKFGFNFSDTSTYEDLSGFYREVEQQGYKLSFARVSVSYINQLVEEGKMYLFQIYNKDFSEYSKGTPNMHTLYWKALFDERNLADVVYKLNGQAEMFYRKKSIENTHPTHPANHPILNKNKDNKKKESLFEYDLIKDRRYTVDKFMFHVPITMNFKSVGSENINQGVKEYLHHADDMHIIGIDRGERHLLYLVVIDLQGNIKEQYSLNEIVNEYNGNTYHTNYHDLLDAREDERLKARQSWQTIENIKELKEGYLSQVIHKITQLMVKYHAIVVLEDLNMGFMRGRQKVEKQVYQKFEKMLIDKLNYLVDKKADASVSGGWLNAYQLTSKFDSFQKLGKQSGFLFYIPAWNTSKIDPVTGFVNLLDARYQNVEKAKAFFSKFDAIRYNKDKDWFEFNLDYDKFGKKAEGTRTKWTLCTRGMRIDTFRNKEKNSQWDNQEVDLTAEMKSLLEHYYIDIHGNLKDAISAQTDKAFFTGLLHILKLTLQMRNSITGTETDYLVSPVADENGIFYDSRSCGEELPENADANGAYNIARKGLMLIEQIKGAEDLGNLKFDISNKAWLNFAQKKPYKNG

SEQ ID NO: 1549 - protein, 1271 aa, unidentified
  REGION 1..1271: note = Description of Unknown:uncultivated organism sequence
  REGION 1..1271: note = Category: MG75 effectors
  REGION 1..1271: note = Description: MG75-35 effector
MEFNDFKRLYPLSKTLRFEAKPIGATLKNIIKSGLLEEDEHRTQSYVKVKKLIDEYHKVFIDRVLNDGCLTIENKGKKDSLEEYYESYMSKTNDENANKTYKEIQQNLRSVIVKKLTDDNAYANLFGNKLIESYKDKDDKNKIIDSDLIQFINTADPSQLDYMSQDEAKELVKEFWGFTTYFVGFFDNRKNMYTPEDKSTGIAYRLVNENLPKFIDNMEAFKKAVAKPEIQANMEELYSNFAGYLNVESIQEMFQLDYYNMLLSQKQIDVYNAIIGGKTDEEHDVKIKGINEYINLYNQQHKDEKLPKLKALFKQILSDRNAISWLPEEFNSDQDVLNAIDDCYKRLSENVLGDKVLKSLLCSLSDYNLNVIFVRNDLQLTDISQKMFGNWSVIQDAIMQNIKNVAPARKRKESEEDYEKRISDIFKKADSFSIQYINDCLNEMDDNNLHAVDGYFATLGAVNTPTMQRENLFALIQNAYTDISNLLETPYPEKKNLAQDKTNVAKVKALLDAIKSLQHFVKPLLGKGDESDKDERFYGELASLWTELDTVTPLYNMVRNYMTRKPYSEKKIKLNFENPQLLGGWDANKEKDYATIILRRNGMYYLAIMDKDSKKLLGKTMPSDGECYEKMVYKLLPGANKMLPKVFFAKSRINDFKPSKQIVENYNNGTHKKGKNFNINDCHNLIDYFKQSIGKHEDWSKFGFNFSDTSTYEDLSGFYREVEQQGYKLSFTNVSVSFIDKLVDEGKMYLFQIYNKDFSDYSKGTPNMHTLYWKALFDERNLADVVYKLNGQAEMFYRKKSINNTHPTHPANHPIQNKNKDNKKKESVFEYDLIKDRRYTVDKFLFHVPITMNFKSVGSENINQQVREYLQQADDTHIIGIDRGERHLLYLVVIDMQGEIKEQFTLNEIVNEYNGNTYRTNYHDLLDTREEERLKARQSWQTIENIKELKEGYLSQVIHKITQLMVKYHAVVVLEDLNKGFMRGRQKVEKQVYQKFEKMLIDKLNYLVDKKADAAQSGGLLNAYQLTSKFDSFQKLGKQSGFLFYIPAWNTSKIDPVTGFVNLLDTRYQNTEKAKAFFSKFDAIRYNANKDWFEFNLDYDKFGTKAEGTRTKWILCTQGNRICTFRNTEKNSQWDNQEVDLTREMKSLFEYYHINICGNLKEEICSQTDKAFFTGLLHMLKLTLQMRNSITGTETDYLVSPVADENGVFYDSRSCGDALPKNADANGAYNIARKGLMLIGQIKETKDLANFKYDISNKAWLNFAQQKPYKK

SEQ ID NO: 1550 - protein, 1275 aa, unidentified
  REGION 1..1275: note = Description of Unknown:uncultivated organism sequence
  REGION 1..1275: note = Category: MG75 effectors
  REGION 1..1275: note = Description: MG75-36 effector
MAKNFEDFKRLYYLSKTLRFEAKPIGATLDNIVKSGLLDEDEHRAASYVKVKKLIDEYHKVFIDRVLDDGCLPLENKGNNNSLAEYYESYVSRAQDEDAKKKFKEIQQNLRSVIAKKLTEDKAYANLFGNKLIESYKDKEDKKKIIDSDLIQFINTAESTQLDSMSQDEAKELVKEFWGFVTYFYGFFDNRKNMYTAEEKSTGIAYRLVNENLPKFIDNIEAFNRAITRPEIQENMGVLYSDFSEYLNVESIQEMFQLDYYNMLLTQKQIDVYNAIIGGKTDDEHDVKIKGINEYINLYNQKHKDDKLPKLKSLFKQILSDRNAISWLPEEFNSDQEVLNAIKDCYERLSENVLGDKVLKSMLGSLADYSLDGIFIRNDLQLTDISQKMFGNWSVIQNAIMQNIKHVAPARKHKESEEEYENRIAGIFKKADSFSISYIDACLNETDPNNAYFVENYFATLGAVDTPTMQRENLFALVQNAYTEITALLHSDYPTEKNLAQDKANVAKIKALLDAIKSLQHFVKPLLGKGDESDKDERFYGELASLWAELDTMTPLYNMIRNYMTRKPYSQKKIKLNFENPQLLGGWDANKEKDYATIILRRNGLYYLAIMNKDSKKLLGKAMPSDGECYEKMVYKLLPGANKMLPKVFFAKSRMEDFKPSKELVEKYNNGTHKKGKNFNIQDCHNLIDYFKQSIDKHEDWSKFGFKFSDTSTYEDLSGFYREVEQQGYKLSFARVSVSYINQLVEEGKMYLFQIYNKDFSEYSKGTPNMHTLYWKALFDERNLADVVYKLNGQAEMFYRKKSIENTHPTHPANHPILNKNKDNKKKESLFGYDLIKDRRYTVDKFLFHVPITMNFKSSGSENINQDVKAYLRHADDMHIIGIDRGERHLLYLVVIDLQGNIKEQFSLNEIVNDYNGNTYHTNYHDLLDVREEERLKARQSWQTIENIKELKEGYLSQVIHKITQLMVGYHAIVVLEDLSKGFMRSRQKVEKQVYQKFEKMLIDKLNYLVDKKTDVSTPGGLLNAYQLTCKSDSSQKLGKQSGFLFYIPAWNTSKIDPVTGFVNLLDTHSLNSKEKIKAFFSKFDAIRYNKDKKWFEFNLDYDKFGKKAEDTRTKWTLCTRGMRIDTFRNKEKNSQWDNQEVDLTTEMKSLLEHYYIDIHGNLKDAISTQTDKAFFTGLLHILKLTLQMRNSITGTETDYLVSPVADENGIFYDSRSCGDQLPENADANGAYNIARKGLMLIEQIKNAEDLNNVKFDISNKAWLNFAQQKPYKNG

SEQ ID NO: 1551 - protein, 1276 aa, unidentified
  REGION 1..1276: note = Description of Unknown:uncultivated organism sequence
  REGION 1..1276: note = Category: MG75 effectors
  REGION 1..1276: note = Description: MG75-37 effector
MAKKFEDFTKLYPLSKTLCFEARPIGATKSNIIKNGLLDEDKHRAESYVKVKKLIDEYHKAFIDRVLADGCLCYKNEGNEDSLEEYYEFYSLSSKDKSDDTRKHFATIQQNLRSKIAETLTKDKAYANLFGNKLIESHKDKEDKNNIIDSDLIQFVSTATPDQLDSQSKDDATKLIKEFWGFTTYFTGFFENRKNMYTSEEKSTGIAYRLINENLPKFIDNMESFKKIMEKPEMSANMEELRANLEEYLNVESISEMFELNYYNMLLTQKQIDVYNAVIGGKTDEEQDIKTKGINEYVNLYNQQHKDAKLPKLKTLFKQILSDRNAISWLPEEFDKDQNVLNAIKDCYVRLTANVLGNNVLNSLLSTLSEYNTESIFIRNDIQLTNISQKMAGSWNYIQDAIKQDIKNVAPARKRKESEEDYEERISKNFKKADSYSIKYIDDCLNRAYKNNTYTVEGYFATLGATNTPSLQRENLFAQIANAYTNISSLLSSDYSAEKNLAQDKENVAKIKTLLDCIKSLQHFVKPLLGKGDESDKDERFYGELSMLWKELDTVTPLYNMVRNYMTRKPYSQKKIKLNFENPQLLGGWDANKEKDYASILLRRDGKYYLGIMDKESKKLLGKSMPSDGACYQKMVYKLLPGANKMLPKVFFAKSRLADFNPSKEIIENYNNGTHKKGKNFNLKDCHALIDYFKESIKKHEDWSKFGFKFSESTTYEDLSGFYHEVEQQGYKLSFTNVSASYIDKMVDEGKMYLFQIYNKDFSEYSKGTPNMHTLYWKALFDERNLADVVYKLNGQAELFYREKSIDCTHPTHPANHPILNKNKDNEKKESIFEYDLIKDRRYTVDKFMFHVPITMNFKSTGADNINQLVREHLKDADAPHIIGIDRGERHLLYLVVIDMHGNIKEQFTLNDIVNEYNGNTYRTNYHDLLDAREDARLKARQSWQTIENIKELKEGYLSQVIHKITQLMVKYHAIVVLEDLNMGFMRGRQKVEKQVYQKFEKMLIDKLNYYVDKKANAEQAGGLLNAYQLTSKFDSFQKLGKQSGFLLYIPAWNTSKIDPVTGFVNLLDTRYQNVEKAKAFFCKFEAIRYNSNKNWFEFTIDYNNFGQKAEGTRTKWTLCTQGKRIRTFRNPEKNSEWDNQEIDLTSALKNLFAHYHIDINGNIKEAISAQSDKTFFTELLHLLKLTLQMRNSITGTETDYLISPVADDNGYFYDSRTCNDTLPKNADANGAYNIARKGLMLIEQIKKAKDIANIKFDISNKSWLNFAQQKPYKDE

SEQ ID NO: 1552 - protein, 1273 aa, unidentified
  REGION 1..1273: note = Description of Unknown:uncultivated organism sequence
  REGION 1..1273: note = Category: MG75 effectors
  REGION 1..1273: note = Description: MG75-38 effector
MTKKYNDFNRLYPLSKTLRFEARPIGATLDNIIKSGMLEEDEHRAQSYVKVKKLIDEYHKAFIDRVLNDGCLTIENKGRKDSLEEYYESYMSKFNDENVSKTFKEIQENLRSVIAKKLTDDKAYANLFCKNLIESYKDKDDKKIIIDSDLIQFINTAEPSQLDSMSQEEAKELVKEFWGFTTYFVGFFDNRKNMYTSEEKSTGIAYRLVNENLPKFIDNMQAFKKAVAKPEIQANMEELYSNFAEYLNVESIQEMFQLDYYNMLLTQKQIDVYNAIIGGKTDEDHDVKIKGINEYINLYNQQHKDEKLPKLKALFKQILSDRNAISWLPEEFNRDQEVLDAIKDCYGRLSENVLGDKVLKSLLCSLSDYNLNGIFVRNDQQLTDISQKIFGNWSVIQNAIMQNIKNVAPARKRKESEEDYEKRISDIFKKADSFSIQYINDCLNEMDDNNLHAVDGYFATLGAINTPMQRENLFALIQNAYTDISDLLDTPYPENKNLAQDKTNVAKVKALLDAIKSLQHFVKPLLGKGNESNKDERFYGELDSLWEELDTLTPLYNMTRNYMTRKPYSQKKIKLNFENTQLLAGWDANKEKDNATIILRRNGLYYLAIMNKDSKKFLGKAMPSDGECYEKMVYKLLPGANKMLPKVFFAKSRINDFKPSMQIIENYNNGTHKKGKTFNINDCHDLIDFFKRSIDKHEDWSQFGFNFSDTSTYEDLSGFYREVEQQGYKLSFTNVSAYFIDKLIEEGKMYLFQIYNKDFSNYSKGTPNMHTLYWKALFDERNLADVVYKLNGQAEMFYRKKSIDYTHPTHPANHPIQNKNKDNKKKESVFEYDLIKDRRYTVDKFLFHVPITMNFKSVGSENINQQVREYLQQADDTHIIGIDRGERHLLYLVVIDMQGNIKEQFTLNEIMNEYNGNTYRTNYHDLLDTREEERLTARQSWQTIENIKELKEGYLSQVIHKITQLMVKYHAIVVLEDLNKGFMRGRQKVEKQVYQKFEKMLIDKLNYLVDKKADATQSGGLLNAYQLTSKFDSFQKLGKQSGFLFYIPAWNTSKIDPVTGFVNLLDTRYQNTEKAKAFFSKFDAIRYNADKDWFEFNLDYDKFGTKAEGTRTKWALCTQGMRIDTFRNEEKNSQWDNQEVDLTTEMKSLFEHYHINMDGNLKEEICSQTDKAFFTKLLHILKLTLQMRNSITGTETDYLVSPVADENGRFYDSRSCGDKLPENADANGAYNIARKGLMLIEQIKDADDLGNLKFDISNKAWLNFAQQKPYKNE

SEQ ID NO: 1553 - protein, 1274 aa, unidentified
  REGION 1..1274: note = Description of Unknown:uncultivated organism sequence
  REGION 1..1274: note = Category: MG75 effectors
  REGION 1..1274: note = Description: MG75-39 effector
MAKNFEDFKRLYSLSKTLRFEAKPIGATLNNIVKSGLLDEDEHRAASYVKVKKLIDEYHKVFIDRVLADGCLPLENKGNNNSLAEYYESYVSRAQDEDAKKKFKEIQQNLRSIIAKKLTEDKAYANLFGKNLIESYKDKTDKTKIIDSDLIKFINTAESTQLDSMSQDEAKEIVKEFWGFTTYFVGFFDNRKNMYTAEEKSTGIAYRLINENLPKFIDNMEAFKKAIARPEIQANMEELYSNFSEYLNVESIQEMFLLDYYNMLLTQKQIDVYNAIIGGKTDDEHDFKIKGINEYINLYNQQHKDDKLPKLKALFKQILSDRNAISWLPEEFNSDQEVLNAIKDCYERLAENVLGDKVLKSLLGSLADYSLDGIFIRNDLQLTDISQKMFGNWGVIQNAIMQNIKHVAPARKHKESEEDYEKRIAGIFKKADSFSISYINDCLNEEDPNNAYFVENYFATFGAVNTPTMQRENLFALVQNAYTEVAALLHSDYPTVKNLAQDKANVSKIKALLDAIKSLQHFVKPLLGKGDESDKDERFYGELASLWAELDTVTPLYNMIRNYMTRKPYSQKKIKLNFENPQLLGGWDANKEKDYATIILRRNGLYYLAIMNKDSKKLLGKAMPSDGECYEKMVYKLLPGANKMLPKVFFAKSRMEDFKPSKELVEKYNNGTHKKGKNFCIQDCHNLIDYFKQSIDKHEDWSKFGFNFSETSTYEDLSGFYREVEQQGYKLSFARVSVSYINQLVEEGKMYLFQIYNKDFSEYSKGTPNMHTLYWKALFDERNLADVVYKLNGQAEMFYRKKSIENTHPTHPANHPILNKNKDNKKKESLFGYDLIKDRRYTVDKFMFHVPITMNFKSVGSENINQDVKAYLRHADDMHIIGIDRGERHLLYLVVIDLQGNIKEQFSLNEIVNDYNGNTYHTNYHDLLDVREDERLKARQSWQTIENIKELKEGYLSQVIHKITQLMVKYHAIVILEDLNMGFMRGRQKVEKQVYQKFEKMLIEKLNYLVDKKADASVSGGLLNAYQLTSKFDSFQKLGKQSGFLFYIPAWNTSKIDPVTGFVNLLDTRYQNVEKAKSFFSKFDAIRYNKDKDWFEFNLDYDKFGKKAEGTRTKWTLCTRGMRIDTFRNKEKNSQWDNQKVDLTAEMKSLLEHYYIDIYGNLKDAISAQTDKAFFTGLLHILKLTLQMRNSITGTEIDYLVSPVVDENGIFYDSRSCGDQLPENADANGAYNIARKGLMLVEQIKDAEDLDNVKFDISNKAWLNFAQQKPYKNG

SEQ ID NO: 1554 - protein, 1274 aa, unidentified
  REGION 1..1274: note = Description of Unknown:uncultivated organism sequence
  REGION 1..1274: note = Category: MG75 effectors
  REGION 1..1274: note = Description: MG75-40 effector
MAKIFEDFKRLYPLSKTLRFEAKPIGATLDNIIKSGLLDEDEHRAASYVRVKKLIDEYHKVFIDRVLDNGCLPLKNEGHNNSLTEYYESYVTKSQNEDAKKVFKEIQQNLRSIIAKKLTEDKAYANLFGKNLIESYKDKTDKTKIIDSDLIKFINTAESTQLDSMSQDEAKELVKEFWGFTTYFVGFYDNRKNMYTAEEKSTGIAYRLVNENLPKFIDNMEAFKKAIARPEIQANMEELYSDFSEYLNVESVQEMFQLDYYNMLLTQKQIDVYNAIIGGKTDDEHDVKIKGINEYINLYNQQHKDDKLPKLKALFKQILSDRNAISWLPEEFNGDQEVLNAIKDCYERLSENVLGDKVLKSLLGSLSDYSLDGIFIRNDLQLTDISQKMFGNWCVIQNAIMQNIKHVAPARKHKESEEDYEKRIAGIFKKVDSFSISFINDCLNEADPNNAYFVENYFATFGAVNTPTMQRENLFALVQNAYTEVAALLHSDYPTAKHLAQDKVNVAKIKALLDAIKSLQHFVKPLLGKGDESDKDERFYGELASLWAELDTVTPLYNMIRNYMTRKPYSQKKIKLNFENPQLLGGWDANKEKDYATIILRRDGLYYLAIMNKESKKLLGKAMPSDGECYEKMVYKLLPGANKMLPKVFFAKSRMEDFKPSKELVEKYNNGTHKKGKNFNIQDCHNLIDYFKQSISKHEDWGKFGFNFSDTSTYEDLSGFYREVEQQGYKLSFTRVSVSYISQLVEEGKMYLFQIYNKDFSEYSKGTPNMHTLYWKALFDERNLADVVYKLNGQAEMFYRKKSIENSHPTHPANHPILNKNKDNKKKESLFDYDLIKDRRYTVDKFMFHVPITMNFKSSSSENINQDVKAYLRHADDMHIIGIDRGERHLLYLVVIDLQGNIKEQYSLNEIVNEYNGNTYHTNYHDLLDVREEERLKARQSWQTIENIKELKEGYLSQVIHKITQLMVKYHAIVVLEDLNMGFMRGRQKVEKQVYQKFEKMLIDKLNYLVDKKADASVSGGLLNAYQLTSKFDSFQKLGKQSGFLFYIPAWNTSKIDPITGFVNLLDTRYQNVEKAKVFFSKFDAIRYNKDKDWFEFNLDYDKFGKKAEGTRTKWTLCTRGMRIDTFRNKEKNSQWDNQEVDLTAEMKSLLEHYYIDIHGNLKDAISAQTDKAFFTGLLHILKLTLQMRNSITGTETDYLVSPVADENGIFYDSRSCGDELPENADANGAYNIARKGLMMIEQIKEAKDLDNLKFDISNKSWLNFAQQKPYKNE

SEQ ID NO: 1555 - protein, 1177 aa, unidentified
  REGION 1..1177: note = Description of Unknown:uncultivated organism sequence
  REGION 1..1177: note = Category: MG75 effectors
  REGION 1..1177: note = Description: MG75-41 effector
MQKKAFEENQQNLRSIIAKKLTEDKAYANLFGKNLLESYKDKTDKTKIIDSDLIKFINTAESTQLDSMSQDEAKEIVKEFWGFTTYFVGFFDNRKNMYTAEEKSTGIAYRLINENLPKFIDNMEAFKKAIARPEIQADMEELYSNFSEYLNVESIQEMFLLDYYNMLLTQKQIDVYNAIIGGKTDDEHDVKIKGINEYINLYNQQHKDDKLPKLKALFKQILSDRNAISWLPEEFNSDQEVLNAIKDCYERLSENVLGDKVLKSMLGSLADYSLDGIFIRNDLQLTDISQKMFGNWSVIQNAIMQNIKHVAPARKHKESEEEYENRIAGIFKKADSFSISYIDACLNETDPNNAYFVENYFATLGAVDTPTMQRENLFALVQNAYTEITALLHSDYPTEKNLAQDKANVAKIKALLDAIKSLQHFVKPLLGKGDESDKDERFYGELASLWAELDTMTPLYNMIRNYMTRKPYSQKKIKLNFENPQLLGGWDANKEKDYATIILRRNGLYYLAIMNKDSKKLLGKAMPSDGECYEKMVYKLLPGANKMLPKVFFAKSRMEDFKPSKELVEKYNNGTHKKGKNFNIQDCHNLIDYFKQSIDKHEDWSKFGFKFSDTSTYEDLSGFYREVEQQGYKLSFARVSVSYINQLVEEGKMYLFQIYNKDFSEYSKGTPNMHTLYWKALFDERNLADVVYKLNGQAEMFYRKKSIENTHPTHPANHPILNKNKDNKKKESLFEYDLIKDRRYTVDKFMFHVPITMNFKSVGSENINQDVKAYLRHADDMHIIGIDRGERHLLYLVVIDLQGNIKEQFSLNEIVNDYNGNTYHTNYHDLLDVREDERLKARQSWQTIENIKELKEGYLSQVIHKITQLMVKYHAIVVLEDLNMGFMRGRQKVEKQVYQKFEKMLIEKLNYLVDKKADASVSGGLLNAYQLTSKFDSFQKLRKQSGFLFYIPAWNTSKIDPITGFVNLLDTRYQNVEKAKAFFSKFDAIRYNKDKEWFEFDLDYDKFGRKAEGTRTKWTLCTRGMRIDTFRNKEKNSQWDNQEIDLTAEMKSLLEHYYIDIQGNLKEAICTQTDKAFFTGLLHILKLTLQMRNSITGTQTDYLVSPVADENGIFYDSRSCGDSLPENADANGAYNIARKGLMLIEKIKNAEDLDTIKFDISNKAWLNFAQQKPYKNG

SEQ ID NO: 1556 - protein, 886 aa, unidentified
  REGION 1..886: note = Description of Unknown:uncultivated organism sequence
  REGION 1..886: note = Category: MG75 effectors
  REGION 1..886: note = Description: MG75-42 effector
MFGNWGVIQNAVMQNIKRVAPARKHKESEEDYEKRIAGIFKKADSFSISYINDCLNEADPNNAYFVENYFATFGAVNTPTMQRENLFALVQNAYTEITALLHSDYPTEKNLAQDKANVAKIKALLDAIKSLQHFVKPLLGKGDESDKDERFYGELASLWAELDTMTPLYNMIRNYMTRKPYSQKKIKLNFENPQLLGGWDANKEKDYATIILRRNGLYYLAIMNKDSKKLLGKAMPSDGECYEKMVYKLLPGANKMLPKVFFAKSRMEDFKPSKELVEKYNNGTHKKGKNFNIQDCHNLIDYFKQSIDKHEDWSKFGFKFSDTSTYEDLSGFYREVEQQGYKLSFARVSVSYINQLVEEGKMYLFQIYNKDFSEYSKGTPNMHTLYWKALFDERNLADVVYKLNGQAEMFYRKKSIENTHPTHPANHPILNKNKDNNKKESLFEYDLIKDRRYTVDKFMFHVPITMNFKSSGSENINQDVKAYLCHADDMHIIGIDRGERHLLYLVVIDLQGNIKEQFSLNEIVNDYNGNTYHTNYHDLLDVREDERLKARQSWQTIENIKELKEGYLSQVIHKITQLMVKYHAIVVLEDLNMGFMRGRQKVEKQVYQKFEKMLIEKLNYLVDKKADASVSGGLLNAYQLTSKFDSFQKLGKQSGFLFYIPAWNTSKIDPVTGFVNLLDTRYQNVEKAKSFFSKFDAIRYNKDKEWFEFNLDYDKFGKKAEGTRTKWTLCTRGMRIDTFRNKEKNSQWDNQEVDLTAEMKSLLEHYYIDIHSNLKDAISAQTDKAFFTGLLHILKLTLQMRNSITGTETDYLVSPVVDENGIFYDSRSCGDELPENADANGAYNIARKGLMMIEQIKDAKDLDNLKFDISNKAWLNFAQQKPYKNG

SEQ ID NO: 1557 - protein, 1321 aa, unidentified
  REGION 1..1321: note = Description of Unknown:uncultivated organism sequence
  REGION 1..1321: note = Category: MG75 effectors
  REGION 1..1321: note = Description: MG75-43 effector
MEFDDFKRLYPLSKTLRFEAKPIGATLNNIIKSGLLEEDEHRAQSYVKVKKLIDEYHKVFIDRVLDDGCLTIENKGKKDSLEEYYESYMSKSNDENVSKTFKEIQENLRSVIAKKLTDDNAYANLFGNKLIESYKDKDDKKKIIDSDLIQFINTAEPSKLDSMSQDEAKELVKEFWGFTTYFEGFHKNRKNMYTSEEKSTGIAYRLVNENLPKFIDNMEAFKKAIAKPEIQANMEELYSNFAEYLNVESIQEMFQLDYYNMLLTQKQIDDYNAIIGGKTDEDHDVKIKGINEYINLYNQQHKDEKLPKLKALFKQILSDRNAISWLPEEFNSDQDVLNAIKDCYERLSENVLGDKVLKSLLCSLSDYNLNGIFVRNDLQLTDISQKMFGNWNVIQNAIMQNFFFKKVAPARKRKESEEDYEKRISDIFKKTDSFSIQYINDCLNEMDDNNLHAVDGYFATLGAVNTPTMQRENLFALIQNAYTDISDLLDTPYPENKNLAQDKTNVAKVKALLDAIKSLQHFVKPLLGKGDESDKDERFYGELASLWTELDTVTLLFNMVHNYMTRKPYSQKKIKLNYKNTQLLAGWDANKEKEHAAIILRRNGMYYLAIMDKDSKNLLDKAMPSDGECYEKMVYKQFDISKQLPKCTTELKRVRKALVEDAKRSCLLSDSKDWNKPLNVTRKLWELNNYVWDKKKADWVLRKKENETRPKKFHKKYLELTSDKNGYNQAKNDWIKFTKEFLSSYKKVEDYDIHYKKRYNSVDELYKQLNSDFYTISFTYVSVSFIDKLVNEGKMYLFKIYNKDFSNYSKGTPNMHTLYWKALFDERNLADVVYKLNGEAEMFYRKKSINNTHPTHPANHPIQNKNKDNKKKESVFEYDLVKDYRYTEDKFLFHVPITMNFKSVGSENINQQVKEYLQQADDTHIIGIDRGERHLLYLVVIDMEGNIKEQFSLNEIVNEYNGNTYRTNYHDLLDVCADKRLKASQSWQTIENIKELKEGYLSQAIHKITQLMVKYHAVVVLEDLNKGFMRGRQKVEKQVYQKFEKMLIDKLNYLVDKKADAAQSGGLLNAYQLTSKFDSFQKLGKQSGFLFYIPAWNTSKIDPVTGFVNLFDTRYTNADKALEFFSKFDAIRYNEEKDWFEFEFDYDKFTQKAHGTRTKWTLCTYGMRLRSFKNPAKQYNWDSEVVALTDEFKRILEEAGIDIHENLKDAIRNLKGKKQKYLEPLMQFMKLLLQLRNSKAGTDEDYILSPVADENGIFYDSRSCGDELPENADANGAYNIARKGLMMIEQIKDAKDLDNLKFDISNKAWLNFAQQKPYKNG

SEQ ID NO: 1558 - protein, 1274 aa, unidentified
  REGION 1..1274: note = Description of Unknown:uncultivated organism sequence
  REGION 1..1274: note = Category: MG75 effectors
  REGION 1..1274: note = Description: MG75-44 effector
MAKNFEDFKRLYPLSKTLRFEAKPIGATLDNMVKSGLLDEDEHRAASYVKVKKLIDEYHKVFIDRVLDNGCLPLKNEGHNNSLTEYYESYVTKSQNEDAKKVFKEIQQNLRSIIAKKLTEDKAYANLFGKNLIESYKDKTDKTKIIDSDLIKFINTAESTQLDSMSQDEAKELVKEFWGFTTYFVGFYDNRKNMYTAEEKSTGIAYRLVNENLPKFIDNMEAFKKAIARSEIQANMEELYSDFSEYLNVESVQEMFQLDYYNMLLTQKQIDVYNAIIGGKTDDEHDVKIKGINEYINLYNQQHKDDKLPKLKALFKQILSDRNAISWLPEEFNGDQEVLNAIKDCYERLSENVLGDKVLKSLLGSLSDYSLDGIFIRNDLQLTDISQKMFGNWCVIQNAIMQNIKHVAPARKHKESEEDYEKRIAGIFKKVDSFSISFINDCLNEADPNNAYFVENYFATFGAVNTPTMQRENLFALVQNAYTEVAALLHSDYPTAKHLAQDKVNVAKIKALLDAIKSLQHFVKPLLGKGDESDKDERFYGELASLWAELDTVTPLYNMIRNYMTRKPYSQKKIKLNFENPQLLGGWDANKEKDYATIILRRDGLYYLAIMNKESKKLLGKAMPSDGECYEKMVYKLLPGANKMLPKVFFAKSRMEDFKPSKELVEKYNNGTHKKGKNFNIQDCHNLIDYFKQSISKHEDWGKFGFNFSDTSTYEDLSGFYREVEQQGYKLSFTRVSVSYISQLVEEGKMYLFQIYNKDFSEYSKGTPNMHTLYWKALFDERNLADVVYKLNGQAEMFYRKKSIENTHPTHPANHPILNKNKDNKKKESLFDYDLIKDRRYTVDKFMFHVPITMNFKSSGSENINQDVKAYLRHADDMHIIGIDRGERHLLYLVVIDLQGNIKEQYSLNEIVNEYNGNTYHTNYHDLLDVREEERLKARQSWQTIENIKELKEGYLSQVIHKITQLMVKYHAIVVLEDLNMGFMRGRQKVEKQVYQKFEKMLIDKLNYLVDKKADASVSGGLLNAYQLTSKFDSFQKLGKQSGFLFYIPAWNTSKIDPVTGFVNLLDTRYQNVEKAKVFFSKFDAIRYNKDKDWFEFNLDYDKFGKKAEGTRTKWTLCTRGMRIDTFRNKEKNSQWDNQKVDLTAEMKSLLEHYYIDIHGNLKDAISAQTDKAFFTGLLHILKLTLQMRNSITGTETDYLVSPVADENGIFYDSRSCGDELPENADANGAYNIARKGLMMIEQIKDAKDLDNLKFDISNKSWLNFAQQKPYKNE

SEQ ID NO: 1559 - protein, 1272 aa, unidentified
  REGION 1..1272: note = Description of Unknown:uncultivated organism sequence
  REGION 1..1272: note = Category: MG75 effectors
  REGION 1..1272: note = Description: MG75-45 effector
MKFDDFKKLYSLSKTLRFEAKPVGSTLKNIIESGLLEEDEHRAQSYVKVKKLIDEYHKVFIDRVLNDGCLTIENKGKKDSLEEYYESYMSKSNDENVSKTFKEIQENLRSVIAKKLTDDNAYANLFGNKLIESYKDKDEKNKIIDSDLIQFINTAEPSQLDSMSQDEAKELVKEFWGFTTYFVGFFDNRKNMYTSEEKSTGIAYRLVNENLPKFIDNMEAFKKAIAKPEIQASMEELYSNFAEYLNVESIQEMFQLDYYNMLLTQKQIDVYNAIIGGKTDEEHDVKIKGINEYINLYNQQHKDEKLPKLKALFKQILSDRNAISWLPEEFNSDQEVLNAIDDCYKRLSENVLGDKVLKSLLCSLDDYNLDGIFVRNDLQLTDISQKMFGNWSVIQSAIMQNIKNVAPARKRKESEEDYEKRISDIFKKADSFSIQYINDCLNEMDNNNLHAVDGYFATLGAVNTPTMQRENLFALIQNAYTDISNLLETPYPENKNLAQDKTNVAKVKALLDAIKSLQHFVKPLLGKGDESDKDERFYGELASLWTELDTVTPLYNMIRNYMTRKPYSEKKIKLNFENPQLLGGWDANKEKDYATIILRRNGMYYLAIMDKDSKKLLGKTMPSNGECYEKMVYKLLPGANKMLPKVFFAKSRINDFKPSKLIVENYNNGTHKKGKNFNINDCHNLIDYFKQSIDKHEDWSKFGFNFSDTSTYEDLSGFYREVEQQGYKLSFTNVSVSFIDKLVDEGKMYLFQIYNKDFSDFSKGTPNMHTLYWKALFDERNLADVVYKLNGQAEMFYRKKSINNTHPTHPANHPIQNKNKDNKKKESVFEYDLIKDRRYTVDKFLFHVPITMNFKSVGSENINQQVREYLQQADDTHIIGIDRGERHLLYLVVIDMQGNIKEQFTLNEIVNEYNGNTYRTNYHDLLDTREEERLTARQSWQTIENIKELKEGYLSQVVHKITQLMVKYHAVVVLEDLNKGFMRGRQKVEKQVYQKFEKMLIDKLNYLVDKKADAAQSGGLLNAYQLTSKFDSFQKLGKQSGFLFYIPAWNTSKIDPVTGFVNLLDTRYQNTEKAKAFFSRFDAIRYNANKDWFEFYLDYDKFCTKAEGTRTRWTLCTQGSRISTFRNAEKNSQWDNLEVDLTREMKSLFEHYHINICGNLKEEICLQTDKAFFTGLLHMLKLTLQMRNNITGTETDYLISPVADENGTFYDSRSCGDTLPKNADANGAYNIARKGLMFIGQIKETKDLANFKYDISNKAWLNFAQQKPYKNE

SEQ ID NO: 1560 - protein, 1307 aa, unidentified
  REGION 1..1307: note = Description of Unknown:uncultivated organism sequence
  REGION 1..1307: note = Category: MG75 effectors
  REGION 1..1307: note = Description: MG75-46 effector
MAKKFEDFTKLYPLSKTLCFEARPIGATKSNIIKNGLLDEDKHRAESYVKVKKLIDEYHKAFIDRVLADGCLCYKNEGNEDSLEEYYEFYSLSSKDKSDDTRKHFATIQQNLRSKIAETLTKDKAYANLFGNKLIESHKDKEDKNNIIDSDLIQFVSTATPDQLDSQSKDDATKLIKEFWGFTTYFTGFFENRKNMYTSEEKSTGIAYRLINENLPKFIDNMESFKKIMEKPEMSANMEELRANLEEYLNVESISEMFELNYYNMLLTQKQIDVYNAVIGGKTDEEQDIKTKGINEYVNLYNQQHKDAKLPKLKTLFKQILSDRNAISWLPEEFDKDQNVLNAIKDCYVRLTANVLGNNVLNSLLSTLSEYNTESIFIRNDIQLTNISQKMAGSWNYIQDAIKQDIKNVAPARKRKESEEDYEERISKNFKKADSYSIKYIDDCLNRAYKNNTYTVEGYFATLGATNTPSLQRENLFAQIANAYTNISSLLSSDYSAEKNLAQDKENVAKIKTLLDCIKSLQHFVKPLLGKGDESDKDERFYGELSMLWKELDTVTPLYNMVRNYMTRKPYSQKKIKLNFENPQLLGGWDANKEKDYASILLRRDGKYYLGIMDKESKKLLGKPMPSDGDYYEKMVYKFFKDITTMIPKCSTQLKAVKEHFSKSNADFVLSGKNFNTPLIISKEVFELNNVKYGQFKKFQKDYVATTNDIEGYAHAVKIWIKFCMDFLGTYDSTISYDLSSLASNEYTSLDTFYQDVNRLLYAVSFIKVSVSHIDSLVEEGKMYLFQIYNKDFSEYSKGTPNMHTLYWKALFDERNLADVVYKLNGQAELFYREKSIDCTHPTHPANHPILNKNKDNEKKESIFEYDLIKDRRYTVDKFMFHVPITMNFKSTGADNINQLVREHLKDADAPHIIGIDRGERHLLYLVVIDMHGNIKEQFTLNDIVNEYNGNTYRTNYHDLLDAREDARLKARQSWQTIENIKELKEGYLSQVIHKITQLMVKYHAIVVLEDLSMGFMRGRQKVEKQVYQKFEKMLIDKLNYYVDKKANAEQAGGLLNAYQLTSKFDSFQKLGKQSGFLLYIPAWNTSKIDPVTGFVNLLDTRYQNVEKAKAFFCKFEAIRYNSNKNWFEFTIDYNNFGQKAEGTRTKWTLCTQGKRIRTFRNPEKNSEWDNQEIDLTSALKNLFAHYHIDINGNIKEAISAQSDKTFFTELLHLLKLTLQMRNSITGTETDYLISPVADDNGYFYDSRTCNDTLPKNADANGAYNIARKGLMLIEQIKKAKDIANIKFDISNKSWLNFAQQKPYKDE

SEQ ID NO: 1561 - protein, 1270 aa, unidentified
  REGION 1..1270: note = Description of Unknown:uncultivated organism sequence
  REGION 1..1270: note = Category: MG75 effectors
  REGION 1..1270: note = Description: MG75-47 effector
MEFDDFKRLYPLLKTLRFEAKPIGATLKNIIKSGLLEEDEHRAQSYVKVKKLIDEYHKVFIDRVLNDGCLTIENKGKQDSLEEYFESYISKSNDENANKAFKEIQGNLRSLIANKLTKDKGYANLFGKNLIESYKDKDDTKKIIDSDLIQFINTAEPSKLDSMSQDEAKELVKEFRGFTTYFVGFFDNRKNMYTSEEKSTGIAYRLVNENLPKFIDNMEAFKKAIAKPEIQANMEELYSNFAEYLNVESIQEMFKLDYYNMLLTQKQIDVYNAIIGGKTDEDHDVKIKGINEYINLYNQQHKDEKLPKLKALFKQILSDRNAISWLPEEFNSDQDVLNAIKDCYERLSENVLGDKVLKSLLCSLSDYNLNGIFVRNDLQLTDISQKTFGNWSVIQNAIMQNIKNVAPARKRKESEEDYEKRISDIFKKADSFSIQYINDCLNEMDNNNLHAVDGYFATLGAVNTPTMQRENLFALIQNAYTDISDLLDTPYPENKNLAQDKTNVAKVKALLDAIKSLQHFVKPLLGMGDESDKDERFYGELASLWTELDTVTPLYNMIRNYMTRKPYSEKKIKLNFENPQLLGGWDANKEKDYATIILRRNGMYYLAIMDKDSKKLLGKTMPSDGECYEKMVYKLLPGANKMLPKVFFAKSRINDFKPSKKIVENYNNGTHKKGKNFNINDCHDLIDYFKQSIDKHEDWSKFGFNFSDTSTYEDLSGFYREVEQQGYKLSFTNISVSFIDKLVDEGKMYLFQIYNKDFSDYSKGTPNMHTLYWKALFDERNLADVVYKLNGQAEMFYRKKSIDYTHPTHPANHPIQNKNKDNKKKESVFEYDLVKDRRYTVDKFLFHVPINMNFKSVGSENINQQVREYLQQADDTHIIGIDRGERHLLYLVVIDMQGNIKEQFTLNEIVNEYNGNTYRTNYHDLLDTREEERLTARQSWQTIENIKELKEGYLSQVVHKITQLMVKYHAVVVLEDLNKGFMRGRQKVEKQVYQKFEKMLIDKLNYLVDKKADAAQSGGLLNAYQLTSKFDSFQKLGKQSGFLFYIPAWNTSKIDPVTGFVNLLDTRYQNTEKSKAFFSKFDAIRYNADKDWFEFNLDYDKFGTKAEGTRTKWILCTQGNRICRNADKNPQWDNPKIDLTRELKSLFEHYNINICGNLKEEICSQTDKAFFTGLLHILKLTLQMRNSITGTETDYLVSPVADENGVFYDSRSCGDRLPENADANGAYNIARKGLMLIGQIKETKDLANFKYDISNKAWLNFAQQKPYKNE

SEQ ID NO: 1562 - protein, 1274 aa, unidentified
  REGION 1..1274: note = Description of Unknown:uncultivated organism sequence
  REGION 1..1274: note = Category: MG75 effectors
  REGION 1..1274: note = Description: MG75-48 effector
MAKNFEDFKRLYPLSKTLRFEAKPIGATLDNIIKSGLLDEDEHRAASYVKMKKLIDEYHKVFIDRVLDNGCLPLKNEGQNNSLTEYYESYVSKSQNEDAKKAFEENQQNLRSIVAKKLTDDKAYANLFGKNLIESYKDKEDKKKIIDSDLIQFICTAEATQLDSMSQDEAKEIVKEFWGFTTYFVGFFDNRKNMYTAEEKSTGIAYRLINENLPKFIDNMEAFKKAIARPEIQANMEELYSNFSEYLNVESIQEMFLLDYYNMLLTQKQIDVYNAIIGGKTDDEHDVKIKGINEYINLYNQQHKDDKLPKLKALFKQILSDRNAISWLPEEFNSDQEVLNAIKDCYERLSENVLGDKVLKSLLGSLSDYTLDGIFIRNDLQLTDISQKMFGNWGVIQNAIMQNIKRVAPARKHKESEEDYEKRIAGIFKKADSFSISYINDCLNEADPNNAYFVENYFATFGAVNTPTMQRENLFALVQNAYTEVASLLHSDYPTAKHLAQDKANVAKIKALLDAIKSLQHFVKPLLGKGDESDKDERFYGELASLWAELDTVTPLYNMIRNYITRKPYSQKKIKLNFENPQLLGGWDANKEKDYATIILRRNGLYYLAIMNKESKKLLGKAMPSDGECYEKMVYKLLPGANKMLPKVFFAKSRMEDFKPSKELVEKYNNGTHKKGKNFNIQDCHNLIDYFKQSINKHEDWGKFGFNFSDTSTYEDLSGFYREVEQQGYKLSFARVSVSYINQLVEEGKMYLFQIYNKDFSEYSKGTPNMHTLYWKALFDERNLADVVYKLNGQAEMFYRKKSIENTHPTHPANHPILNKNKDNKKKESLFDYDLIKDRRYTVDKFMFHVPITMNFKSSGSENINQDVKAYLRHADDMHIIGIDRGERHLLYLVVIDLQGNIKEQYSLNEIVNEYNGNTYHTNYHDLLDVREEERLKARQSWQTIENIKELKEGYLSQVIHKITQLMVKYHAIVVLEDLNMGFMRGRQKVEKQVYQKFEKMLIDKLNYLVDKKADASVSGGWLNAYQLTSKFDSFQKLGKQSGFLFYIPAWNTSKIDPVTGFVNLLDARYQNVEKAKAFFSKFDAIRYNKDKDWFEFNLDYDKFGKKAEGTRTKWTLCTRGMRIDTFRNKEKNSQWDNQEVDLTAEMKSLLEHYYIDIHGNLKDAISAQTDKAFFTGLLHILKLTLQMRNSITGTETDYLVSPVADENGIFYDSRSCGEELPENADANGAYNIARKGLMLIEQIKGAEDLGNLKFDISNKAWLNFAQQKPYKNG

SEQ ID NO: 1563 - protein, 1274 aa, unidentified
  REGION 1..1274: note = Description of Unknown:uncultivated organism sequence
  REGION 1..1274: note = Category: MG75 effectors
  REGION 1..1274: note = Description: MG75-49 effector
MAKNFEDFKRLYPLSKTLRFEAKPIGATLDNIVKSGLLDEDEHRAASYVKVKKLIDEYHKVFIDRVLDDGCLPLENKGNNNSLAEYYESYVSRAQDEDAKKKFKEIQQNLRSVIAKKLTEDKAYANLFGNKLIESYKDKEDKKKIIDSDLIQFINTAESTQLDSMSQDEAKELVKEFWGFVTYFYGFFDNRKNMYTAEEKSTGIAYRLVNENLPKFIDNIEAFNRAITRPEIQENMGVLYSDFSEYLNVESIQEMFQLDYYNMLLTQKQIDVYNAIIGGKTDDEHDVKIKGINEYINLYNQKHKDDKLPKLKSLFKQILSDRNAISWLPEEFNSDQEVLNAIKDCYERLSENVLGDKVLKSMLGSLADYSLDGIFIRNDLQLTDISQKMFGNWSVIQNAIMQNIKHVAPARKHKESEEEYENRIAGIFKKADSFSISYIDACLNETDPNNAYFVENYFATLGAVDTPTMQRENLFALVQNAYTEITALLHSDYPTEKNLAQDKANVAKIKALLDAIKSLQHFVKPLLGKGDESDKDERFYGELASLWAELDTMTPLYNMIRNYMTRKPYSQKKIKLNFENPQLLGGWDANKEKDYATIILRRNGLYYLAIMNKDSKKLLGKAMPSDGECYEKMVYKLLPGANKMLPKVFFAKSRMEDFKPSKELVEKYNNGTHKKGKNFNIQDCHNLIDYFKQSIDKHEDWSKFGFKFSDTSTYEDLSGFYREVEQQGYKLSFARVSVSYINQLVEEGKMYLFQIYNKDFSEYSKGTPNMHTLYWKALFDERNLADVVYKLNGQAEMFYRKKSIENTHPTHPANHPILNKNKDNNKKESLFEYDLIKDRRYTVDKFMFHVPITMNFKSSGSENINQDVKAYLCHADDMHIIGIDRGERHLLYLVVIDLQGNIKEQFSLNEIVNDYNGNTYHTNYHDLLDVREDERLKARQSWQTIENIKELKEGYLSQVIHKITQLMVKYHAIVVLEDLNMGFMRGRQKVEKQVYQKFEKMLIEKLNYLVDKKADASVSGGLLNAYQLTSKFDSFQKLGKQSGFLFYIPAWNTSKIDPVTGFVNLLDTRYQNVEKAKSFFSKFDAIRYNKDKEWFEFNLDYDKFGKKAEGTRTKWTLCTRGMRIDTFRNKEKNSQWDNQEVDLTAEMKSLLEHYYIDIHSNLKDAISAQTDKAFFTGLLHILKLTLQMRNSITGTETDYLVSPVVDENGIFYDSRSCGDELPENADANGAYNIARKGLMMIEQIKDAKDLDNLKFDISNKAWLNFAQQKPYKNG

SEQ ID NO: 1564 - protein, 1271 aa, unidentified
  REGION 1..1271: note = Description of Unknown:uncultivated organism sequence
  REGION 1..1271: note = Category: MG75 effectors
  REGION 1..1271: note = Description: MG75-50 effector
MKFDDFKKLYSLSKTLRFESKPVGSTLKNIIESGLLEEDEHRAQSYVKVKKLIDEYHKVFIDRVLNDGCLTIENKGKKDSLEEYYESYMSKSNDENVSKTFKDIQENLRSVIAKKLTDDKAYANLFGKNLIESYKDKDDKNKIIDSDLIQFINTAEPSQLDSMSQDEAKELVKEFWGFTTYFVGFFDNRKNMYTSEEKSTGIAYRLVNENLPKFIDNMEAFKKAIAKPEIQANIEELYSNFAEYLNVESIQEMFQLDYYNMLLTQKQIDVYNAIIGGKTDEDHDVKIKGINEYINLYNQQHKDEKLPKLKALFKQILSDRNAISWLPEEFNSDQEVLDAIKDCYERLSENVLGDKVLKSLLCSLSDYNLNGIFVRNDLQLTDISQKMFGNWSVIQNAIMQNIKNVAPARKRKESEEDYEKRISDIFKKADSFSIQYINDCLNEMDDNNLHAVDGYFATLGAVNTPTMQRENLFALIQNAYTDISDLLDTPYPENKNLAQDKTNVAKVKALLDAIKSLQHFVKPLLGMGDESDKDERFYGELASLWTELDTVTPLYNMIRNYMTRKPYSEKKIKLNFENPQLLGGWDANKEKDYATIILRRNGMYYLAIMDKDSKKLLGKTMPSDGECYEKMVYKLLPGANKMLPKVFFAKSRINDFKPSKKIVENYNNGTHKKGKNFNINDCHDLIDYFKQSIDKHEDWSKFGFNFSDTSTYEDLSGFYREVEQQGYKLSFTNISVSFIDKLVDEGKMYLFQIYNKDFSDYSKGTPNMHTLYWKALFDERNLADVVYKLNGQAEMFYRKKSIDYTHPTHPANHPIQNKNKDNKKKESVFEYDLVKDRRYTVDKFLFHVPITMNFKSVGSENINQQVREYLQQADDTHIIGIDRGERHLLYLVVIDMQGNIKEQFTLNEIVNEYNGSTYRTNYHDLLDTREEERLTARQSWQTIENIKELKEGYLSQVIHKITQLMVKYHAVVVLEDLNKGFMRGRQKVEKQVYQKFEKMLIDKLNYLVDKKADAAQSGGLLNAYQLTSKFDSFQKLGKQSGFLFYIPAWNTSKIDPVTGFVNLLDTRYQNTEKAKAFFSKFDAIRYNADKDWFEFNLDYDKFGTKAEGTRTTWTLCTQGNRICTFRNAEKNSQWDNQEVDLTGELKSLFEHYNINICGNLKEEICSQTEKAFFTGLLHILKLTLQMRNSITGTETDYLVSPVADENGVFYDSRSCGDRLPENADANGAYNIARKGLMLIGQIKETKDLADFKYDISNKAWLNFAQQKPYKK

SEQ ID NO: 1565 - protein, 1219 aa, unidentified
  REGION 1..1219: note = Description of Unknown:uncultivated organism sequence
  REGION 1..1219: note = Category: MG75 effectors
  REGION 1..1219: note = Description: MG75-51 effector
MIDEYHKVFIDRVLNDGCLTIENKGKQDSLEEYFESYISKSNDENANKAFKEIQGNLRSLIANKLTKDKGYANLFGKNLIESYKDKDDTKKIIDSDLIQFINTAEPSKLDSMSQDEAKELVKEFRGFTTYFVGFFDNRKNMYTSEEKSTGIAYRLVNENLPKFIDNMEAFKKAIAKPEIQANMEELYSNFAEYLNVESIQEMFKLDYYNMLLTQKQIDVYNAIIGGKTDEDHDVKIKGINEYINLYNQQHKDEKLPKLKALFKQILSDRNAISWLPEEFNSDQDVLNAIKDCYERLSENVLGDKVLKSLLCSLSDYNLNGIFVRNDLQLTDISQKTFGNWSVIQNAIMQNIKNVAPARKRKESEEDYEKRISDIFKKADSFSIQYINDCLNEMDNNNLHAVDGYFATLGAVNTPTMQRENLFALIQNAYTDISDLLDTPYPENKNLAQDKTNVAKVKALLDAIKSLQHFVKPLLGMGDESDKDERFYGELASLWTELDTVTPLYNMIRNYMTRKPYSEKKIKLNFENPQLLGGWDANKEKDYATIILRRNGMYYLAIMDKDSKKLLGKTMPSDGECYEKMVYKLLPGANKMLPKVFFAKSRINDFKPSKKIVENYNNGTHKKGKNFNINDCHDLIDYFKQSIDKHEDWSKFGFNFSDTSTYEDLSGFYREVEQQGYKLSFTNISVSFIDKLVDEGKMYLFQIYNKDFSDYSKGTPNMHTLYWKALFDERNLADVVYKLNGQAEMFYRKKSIDYTHPTHPANHPIQNKNKDNKKKESVFEYDLVKDRRYTVDKFLFHVPINMNFKSVGSENINQQVREYLQQADDTHIIGIDRGERHLLYLVVIDMQGNIKEQFTLNEIVNEYNGNTYRTNYHDLLDTREEERLTARQSWQTIENIKELKEGYLSQVVHKITQLMVKYHAVVVLEDLNKGFMRGRQKVEKQVYQKFEKMLIDKLNYLVDKKADAAQSGGLLNAYQLTSKFDSFQKLGKQSGFLFYIPAWNTSKIDPVTGFVNLLDTRYQNTEKSKAFFSKFDAIRYNADKDWFEFNLDYDKFGTKAEGTRTKWILCTQGNRICRNADKNPQWDNPKIDLTRELKSLFEHYNINICGNLKEEICSQTDKAFFTGLLHILKLTLQMRNSITGTETDYLVSPVADENGVFYDSRSCGDRLPENADANGAYNIARKGLMLIGQIKETKDLANFKYDISNKAWLNFAQQKPYKNE

SEQ ID NO: 1566 - protein, 1235 aa, unidentified
  REGION 1..1235: note = Description of Unknown:uncultivated organism sequence
  REGION 1..1235: note = Category: MG75 effectors
  REGION 1..1235: note = Description: MG75-52 effector
METFSGFTNLYPLSKTLRFRLIPVGETLKHFIGSGILEEDQHRAESYVKVKAIIDDYHRAYIENSLSGFELPLESTGKFNSLEEYYLYHNIRNKTEKNQKSLSTVRFNLRKQIVKQLTKNELYKRIYKQNLIKKDLIDFVKNEPDANEKIALISEFRNFTVYFKGFHENRRNMYLDEEKSTSIAFRLIHENLPKFIDNMEVFAKIQNTSISENFDVIQKELCPELVTLCEMFKLGYFNKTLSQKQINAYNTVIGELNKYLNHYNQQHKQEKLPKMKLLFKQILSDRESTSWLPERFANDGQVIGAIVNFWNTIHDTVLAEGGLKTIIASLGSYSLEGIFLKNDLQLTDVSQKATGSWSKITAAIKQKLEDMNPQTKKESYETYQGRIDKLFKFYKSFSLAFINECLRGEYKIEDYFLKLGAVNSSSLQKENHFSHILNTYTDVKEVIGFYSESTDTKLIRDNGSIQKIKLFLDAVKDLQAYVKPLLGNGDETGKDERFYGDLIEYWSQLDLITPLYNMVRNYVTQKPYSVDKIKLNFRNPTLLDGWDLNQETANTSVILRRDGKYYLAIMNNKSRKVFLKPSGTGKDCYEKMEYKLIPGAYKMLPKVFFAKSKINKFMPDEYLLSNYKKGTHKKNNANFDLDDCHTLIDFFKRSLNKHEDWKNFDFKFSDTSTYTDINNFYKEIDNQAYKLSFRPVPSDFVDKLVEEGKIFLFWIYNKDFSGHSKGTPNMHTLYWRMLFDERNLEDVVYSLNGGAEVFFRKASINVSHPTHPANIPIKKKNLKHKGEERILKYDLIKDKRYTIDQFQFHVPITMNFKVAGNGNININQKAIDYLRSASDTHIIGIDRGERNLLYLVVIDGNGKICEQFSLNEIEVEYNGEKYSTNYHDLLNVKENERKQARQSWQSIANIKDLKEGYLSQVIHKISELIVKYNAIVVLEDLNAGFMRGRQKVEKQVYQKFEKKLIEKLNYLVFKKQSSDLPGGLMHAYQLANKFESFNTLGKQSGFLFYIPAWNTSKMDPVTGFVNLFDVKYESVDKAKSFFSKFDSIRYNVERDMFEWKFNYGEFTKKAEGAKTDWTVCSYGNRIITFRNPDKNSQWDNKEINLTENIKLLFERFGIDLSSNLKDEIMERTEKEFFIELISLFKLVLQMRNSWTGTDIDYLVSPVCNENGEFFDSRNVDETLPQNADANGAYNIARKGMILLDKIKKNNGEKKLALSITNREWLSFAQGCCKNG

SEQ ID NO: 1567 - protein, 1275 aa, unidentified
  REGION 1..1275: note = Description of Unknown:uncultivated organism sequence
  REGION 1..1275: note = Category: MG75 effectors
  REGION 1..1275: note = Description: MG75-53 effector
MAKNFEDFKRLYPLSKTLRFEAKPIGATLDNIVKSGLLDEDEHRAASYVKVKKLIDEYHKVFIDRVLADGCLPLENEGHNNSLTEYYDSYVSKSQNEDAKKVFEENQQNLRSIIAKKLTEDKAYSNLFGTKLIESYKDKADKAKIIDSELIQFINTAESTQLDSMSQDEAKKLVKEFWGFTTYFVGFFDNRKNMYTAEEKSTGIAYRLVNENLPKFIDNMEAFKKAIARPEIQANMGELYSNFSEYLNVESVPEMFQLDYYNMLLTQKQIDVYNAIIGGKTDDEHDVKIKGINEYINLYNQQHKDDKLPKLKALFKQILSDRNAISWLPEEFNSDQEVLNAIKDCYERLSENVLGDKVLKSLLGSLADYSLDGIFIRNDLQLTDISQKMFGNWGVIQNAIMQNIKHVAPARKHKESEEDYEKRIAGIFKKADSFSISYINDCLNEADPNNAYFVENYFATLGAVDTPTMQRENLFALVQNAYTEMTALLHSDYPTEKKLAQDKANVAKIKALLDAIKSLQHFVKPLLGKGDESDKDERFYGELALLWAELETVTPLYNMIRNYMTRKPYSQKKIKLNFENPQLLGGWDANKEKDYATIILRRNGLYYLAIMNKDSKKLLGKAMPSDGECYEKMVYKLLPGANKMLPKVFFAKSRMEDFKPSKELVEKYNNGTHKKGKNFNIQDCHNLIDYFKQSIDKHEDWSKFGFNFSDTSTYEDLSGFYREVEQQGYKLSFTRVSVSFIDQLVEEGKMYLFQIYNKDFSEYSKGTPNMHTLYWKALFDERNLADVVYKLNGQAEMFYRKKSIENTHPTHPANHPILNKNKDNKKKESLFGYDLIKDRRYTVDKFMFHVPITMNFKSSGSENINQDVKAYLRHADDMHIIGIDRGERHLLYLVVIDLQGNIKDQFSLNEIVNDYNGNTYHTNYHDLLDVREEERLKARQSWQTIENIKELKEGYLSQVIHKITQLMVRYHAIVVLEDLSKGFMRSRQKVEKQVYQKFEKMLIDKLNYLVDKKTDVSTPGGLLNAYQLTCKSDSSQKLGKQSGFLFYIPAWNTSKIDPVTGFVNLLDTHSLNSKEKIKAFFSKFDAIRYNKDKKWFEFNLDYDKFGKKAEDTRTKWTLCTRGMRIDTFRNKEKNSQWDNQEVDLTTEMKSLLEHYYIDIHGNLKDAISTQTDKAFFTGLLHILKLTLQMRNSITGTETDYLVSPVADENGIFYDSRSCGDQLPENADANGAYNIARKGLMLIEQIKNAEDLNNVKFDISNKAWLNFAQQKPYKNG

SEQ ID NO: 1568 - protein, 1274 aa, unidentified
  REGION 1..1274: note = Description of Unknown:uncultivated organism sequence
  REGION 1..1274: note = Category: MG75 effectors
  REGION 1..1274: note = Description: MG75-54 effector
MIKEFEDFKRLYPIQKTLRFEAKPIGSTLEHLVKSGILDEDEHRAASYVRVKKLIDEYHKAFIDRVLNDGCLPFKNKGEKNSIEEYYESYTSKDKEEDSKKRFKEIQQNLRSIIVNKLTKDKAYANLFGNYLIESHKDKEDKKTMIDSDLIQFIKDADSLELGSMSKDEAIELVKEFWSFTTYFVGFYDNRKNMYSAEEKSTAIAYRLINENLPKFIDNMEAFKKIISRPEIQANTEQLYSDFAEYLNVESIQEMFQLDYYDLLLTQKQIDVYNAIIGGKTDEKHDIKTKGINEYINLYNQQHKEDKLPKLKVLFKQILSDRNAISWLPEEFNSDQEMLISIKDCYERLCINVLGDKVLKSLLSSLDDYELEGIFLQNDQQLTNISQKIFGSWSVIQEAITRNIKNTAPARKHKETEEDYEKRIFSIFKQASSFSIKYIDDCLYDLDKNNINTIENYFATLGAENTPEIQRENLFAIIKNAYTDVAGLLCSAYPTEKNLSQDENHVAKIKALLDAIKSLQHFVKPLLGNGDEHDKDERFYGELVSLWTELDTVTPLYNMVRNRITQKPYSQKKIKLNFENPQLLGGWDANKEKDYSCIILRREGMYYLAIMDKDSRKLLGKEMPSDGECYEKMVYKLLPGANKMLPKVFFAKSRIEEFMPSEQIIEKYNNGTHKKGKDFNITDCHNLIDYFKQSINKHEDWSKFGFTFSETSTYEDLSGFYREVEQQGYKLSFTNVSASYINSLVDEGKMYLFQIYNKDFSEYSKGTPNMHTLYWKALFDEQNLADVIYKLNGQAEIFYRKKSIDATHPTHPANRPVQNKNKDNKKKESLFEYDLIKDRRYSVDKFMFHVPITMNFKSSGSENINQQVKEYLQLANDTHIIGIDRGERHLLYLVVIDMHGNIKEQFSLNEIVNTYKGNIYHTNYHDLLEAREEERLKARQSWQTIENIKELKEGYLSQVVHKITQLMVKYHAIVVLEDLNMGFMRGRQKVEKQVYQKFEKMLIDKLNYLVNKQANITEAGGLLNAYQLTSKFDSFQKLGKQSGFLFYIPAWNTSKIDPVTGFVNLLDTRYQNVEKAKAFFSKFDAIRFNQDKDWFEFNLDYNKFGEKAEGTRTRWTLCTQGKRIYTFRNEDKNSQWDNIEIDLTSEMKSLLELYHIDIQGNLKEAINSQTDKSFFTKLIHLLKLTLQIRNSITRTETDYLISPVADEDGEFYDSRSCGPELPKNADANGAYNIARKGLMLIRQIKEAKELDKIKFDISNKAWLNFAQQKPYKND

SEQ ID NO: 1569 - protein, 957 aa, unidentified
  REGION 1..957: note = Description of Unknown:uncultivated organism sequence
  REGION 1..957: note = Category: MG75 effectors
  REGION 1..957: note = Description: MG75-55 effector
MAKNFEDFKRLYSLSKTLRFEAKPIGATLDNIVKSGLLDEDEHRAASYVKVKKLIDEYHKVFIDRVLANGCLPLKNEGHNNSLTEYYDNYVSKSQNEDAKKTFEENQQNLRSIIAKKLTEDKAYANLFGKNLLESYKDKTDKTKIIDSDLFKFINTAESTQLDSMSQDEAKELVKEFWGFITYFYGFFDNRKNMYTSEDKSTGIAYRLINENLPKFIDNMEAFNTAVTRPEIQANMDELYSNFSEYLNVESIQEMFQLDYYNMLLTQKQIDVYNAIIGGKTDDEHDVKIKGINEYINLYNQKHKDDKLPKLKALFKQILSDRNAISWLPEEFNSDQEVLNAIKDCYERLSENVLGDKVLKSLLGSLADYSLDGIFIRNDLQLTDISQKMFGNWGVIQNAIMQDIKHVAPARKHKESEEDYEKRIAGIFKKADSFSISYINDCLNEADPNNAYFVENYFATLGAVDTPTMQRENLFALVQNAYTEITALLHSDYPTEKNLAQDKANVAKIKALLDAIKSLQHFVKPLLGKGDESDKDERFYGELASLWTELDTVTPLYNMIRNYMTRKPYSQKKIKLNFENPQLLGGWDVNKEKDYATIILRRNGLYYLAIMNKDSKKLLGKAMPSDGECYEKMVYKLLPGANKMLPKVFFAKSRMEDFKPSKELVEKYNNGTHKKGKNFNIQDCHNLIDYFKQSIDKHEDWSKFGFKFSDTSTYEDFSGFYREVEQQGYKLSFARVSVSYINQLVEEGKMYLFQIYNKDFSEYSKGTPNMHTLYWKALFDERNLADVVYKLNGQAEMFYRKKSIENTHPTHPANHPILNKNKDNKKKESLFDYDLIKDRRYTVDKFMFHVPITMNFKSVGSENINQDVKAYLRHADDMHIIGIDRGERHLLYLVVIDLQGNIKEQYSLNEIVNEYNGNTYHTNYHDLLDVREEERLKARQSWQTIENIKELKEGYLS

SEQ ID NO: 1570 - protein, 1270 aa, unidentified
  REGION 1..1270: note = Description of Unknown:uncultivated organism sequence
  REGION 1..1270: note = Category: MG75 effectors
  REGION 1..1270: note = Description: MG75-56 effector
MEFDDFKRLYPLSKTLRFEAKPIGATLKNIIKSGLLEEDEHRAQSYVKVKKLIDEYHKVFIDRVLNDGCLTIENKGKQDSLEEYFESYISKSNDENANKAFKEIQGNLRSLIANKLTKDKGYANLFGNKLIESYKDKDDTKKIIDSDLIQFINTAEPSKLDSMSQDEAKELVKEFRGFTTYFVGFFDNRKNMYTSEEKSTGIAYRLVNENLPKFIDNMEAFKKAIAKPEIQANMEELYSNFAEYLNVESIQEMFKLDYYNMLLTQKQIDVYNAIIGGKTDEDHDVKIKGINEYINLYNQQHKDEKLPKLKALFKQILSDRNAISWLPEEFNSDQDVLNAIKDCYERLSENVLGDKVLKSLLCSLSDYNLNGIFVRNDLQLTDISQKTFGNWSVIQNAIMQNIKNVAPARKRKESEEDYEKRISDILKKADSFSIQYINDCLNEMDNNNLHAVDGYFATLGAVNTPTMQRENLFALIQNAYTDISDLLDTPYPENKNLAQDKTNVAKVKALLDAIKSLQHFVKPLLGMGDESDKDERFYGELASLWTELDTVTPLYNMIRNYMTRKPYSEKKIKLNFENPQLLGGWDANKEKDYATIILRRNGMYYLAIMDKDSKKLLGKTMPSDGECYEKMVYKLLPGANKMLPKVFFAKSRINDFKPSKKIVENYNNGTHKKGKNFNINDCHNLIDYFKQSIDKHEDWSKFGFNFSDTSTYEDLSGFYREVEQQGYKLSFTNISVSFIDKLVDEGKMYLFQIYNKDFSDYSKGTPNMHTLYWKALFDERNLADVVYKLNGQAEMFYRKKSIDYTHPTHPANHPIQNKNKDNKKKESVFEYDLVKDRRYTVDKFLFHVPITMNFKSVGSENINQQVREYLQQADDTHIIGIDRGERHLLYLVVIDMQGNIKEQFTLNEIVNEYNGNTYRTNYHDLLDTREEKRLTARQSWQTIENIKELKEGYLSQVVHKITQLMVKYHAVVVLEDLNKGFMRGRQKVEKQVYQKFEKMLIDKLNYLVDKKADAAQSGGLLNAYQLTSKFDSFQKLGKQSGFLFYIPAWNTSKIDPVTGFVNLLDTRYQNTEKSKAFFSKFDAIRYNADKDWFEFNLDYDKFGTKAEGTRTKWILCTQGNRICRNADKNPQWDNPKIDLTRELKSLFEHYNINICGNLKEEICSQTDKAFFTGLLHILKLTLQMRNSITGTETDYLVSPVADENGVFYDSRSCGDRLPENADANGAYNIARKGLMLIGQIKETKDLANFKYDISNKAWLNFAQQKPYKNE

SEQ ID NO: 1571 - protein, 1292 aa, unidentified
  REGION 1..1292: note = Description of Unknown:uncultivated organism sequence
  REGION 1..1292: note = Category: MG75 effectors
  REGION 1..1292: note = Description: MG75-57 effector
MNRKTKYQKPKTESKIKSMIKEFEDFKRLYPIQKTLRFEAKPIGSTLEHLVKSGILDEDEHRAASYVRVKKLIDEYHKAFIDRVLNDGCLPFKNKGEKNSIEEYYESYTSKDKEEDSKKRFKEIQQNLRSIIVNKLTKDKAYANLFGNYLIESHKDKEDKKTMIDSDLIQFIKDADSLELGSMSKDEAIELVKEFWSFTTYFVGFYDNRKNMYSAEEKSTAIAYRLINENLPKFIDNMEAFKKIISRPEIQANTEQLYSDFAEYLNVESIQEMFQLDYYDLLLTQKQIDVYNAIIGGKTDEKHDIKTKGINEYINLYNQQHKEDKLPKLKVLFKQILSDRNAISWLPEEFNSDQEMLISIKDCYERLCINVLGDKVLKSLLSSLDDYELEGIFLQNDQQLTNISQKIFGSWSVIQEAITRNIKNTAPARKHKETEEDYEKRIFSIFKQASSFSIKYIDDCLYDLDKNNINTIENYFATLGAENTPEIQRENLFAIIKNAYTDVAGLLCSAYPTEKNLSQDENHVAKIKALLDAIKSLQHFVKPLLGNGDEHDKDERFYGELVSLWTELDTVTPLYNMVRNRITQKPYSQKKIKLNFENPQLLGGWDANKEKDYSCIILRREGMYYLAIMDKDSRKLLGKEMPSDGECYEKMVYKLLPGANKMLPKVFFAKSRIEEFMPSEQIIEKYNNGTHKKGKDFNITDCHNLIDYFKQSINKHEDWSKFGFTFSETSTYEDLSGFYREVEQQGYKLSFTNVSASYINSLVDEGKMYLFQIYNKDFSEYSKGTPNMHTLYWKAPFDEQNLADVIYKLNGQAEIFYRKKSIDATHPTHPANRPVQNKNKDNKKKESLFEYDLIKDRRYSVDKFMFHVPITMNFKSSGSENINQQVKEYLQLANDTHIIGIDRGERHLLYLVVIDMHGNIKEQFSLNEIVNTYKGNIYHTNYHDLLEAREEERLKARQSWQTIENIKELKEGYLSQVVHKITQLMVKYHAIVVLEDLNMGFMRGRQKVEKQVYQKFEKMLIDKLNYLVNKQANITEAGGLLNAYQLTSKFDSFQKLGKQSGFLFYIPAWNTSKIDPVTGFVNLLDTRYQNVEKAKAFFSKFDAIRFNQDKDWFEFNLDYNKFGEKAEGTRTRWTLCTQGKRIYTFRNEDKNSQWDNIEIDLTSEMKSLLELYHIDIQGNLKEAINSQTDKSFFTKLIHLLKLTLQIRNSITRTETDYLISPVADEDGEFYDSRSCGPELPKNADANGAYNIARKGLMLIRQIKEAKELDKIKFDISNKAWLNFAQQKPYKND

SEQ ID NO: 1572 - protein, 1272 aa, unidentified
  REGION 1..1272: note = Description of Unknown:uncultivated organism sequence
  REGION 1..1272: note = Category: MG75 effectors
  REGION 1..1272: note = Description: MG75-58 effector
MKFDDFKKLYSLSKTLRFEAKPVGSTLKNIIESGLLEEDEHRAQSYVKVKKLIDEYHKVFIDRVLNDGCLTIENKGKKDSLEEYYESYMSKSNDENVSKTFKEIQENLRSVIAKKLTDNNAYANLFGNKLIESYKDKDEKNKIIDSDLIQFINTAEPSQLDSMSQDEAKELVKEFWGFTTYFVGFFDNRKNMYTSEEKSTGIAYRLVNENLPKFIDNMEAFKKAIAKPEIQANMEELYSNFAEYLNVESIQEMFQLDYYNMLLTQKQIDVYNAIIGGKTDEEHDVKIKGINEYINLYNQQHKDEKLPKLKALFKQILSDRNAISWLPEEFNSDQEVLNAIDDCYKRLSENVLGDKVLKSLLCSLDDYNLDGIFVRNDLQLTDISQKMFGNWSVIQNAIMQNIKNVAPARKRKESEEDYEKRISDIFKKADSFSIQYINDCLNEMDDNNLHAVDGYFATLGAVNTPAMQRENLFALIQNAYTDISNLLETPYPENKNLAQDKTNVAKVKALLDAIKSLQHFVKPLLGKGDESDKDERFYGELASLWTELDTVTPLYNMIRNYMTRKPYSEKKIKLNFENPQLLGGWDANKEKDYATIILRRNGMYYLAIMDKDSKKLLGKTMPSDGECYEKMVYKLLPGANKMLPKVFFAKSRINDFKPSKLIVENYNNGTHKKGKNFNINDCHNLIDYFKQSIDKHEDWSKFGFNFSDTSTYEDLSGFYREVEQQGYKLSFTNVSVSFIDKLVDEGKMYLFQIYNKDFSDFSKGTPNMHTLYWKALFDERNLADVVYKLNGQAEMFYRKKSINNTHPTHPANHPIQNKNKDNKKKESVFEYDLIKDRRYTVDKFLFHVPITMNFKSVGSENINQQVREYLQQADDTHIIGIDRGERHLLYLVVIDMQGNIKEQFTLNEIVNEYNGNTYRTNYHDLLDTREEERLTARQSWQTIENIKELKEGYLSQVVHKITQLMVKYHAVVVLEDLNKGFMRGRQKVEKQVYQKFEKMLIDKLNYLVDKKADAAQSGGLLNAYQLTSKFDSFQKLGKQSGFLFYIPAWNTSKIDPVTGFVNLLDTRYQNTEKAKAFFSRFDAIRYNANKDWFEFYLDYDKFCTKAEGTRTRWTLCTQGSRISTFRNADKNSQWDNQKVDLTREIKSLFNYYHINICGNLKEEICSQTDKAFFTGLLHMLKLTLQMRNSITGTETDYLISPVADENGTFYDSRSCGDTLPKNADANGAYNIARKGLMFIGQIKKTKDLANFKYDISNKAWLNFAQQKPYKNE

SEQ ID NO: 1573 - protein, 1274 aa, unidentified
  REGION 1..1274: note = Description of Unknown:uncultivated organism sequence
  REGION 1..1274: note = Category: MG75 effectors
  REGION 1..1274: note = Description: MG75-59 effector
MAKNFEDFKRLYPLSKTLRFEAKPIGATLDNIIKSGLLDEDEHRAASYVKMKKLIDEYHKVFIDRVLDNGCLPLEDKGDNNSLAEYYESYVSKAQDEDAIKKFKEIQQNLCSIIAKKLTDDKAYANLFGNKLIESYKDKADKTKIIDSDLIQFINTAESTQLVSMSQDEAKELVKEFWGFTTYFEGFFKNRKNMYTPEEKSTGIAYRLINENLPKFIDNMEAFKKAITRPEIQANMEELYSDFSEYLNVESIQEMFQLDYYNMLLTQKQIDVYNAIIGGKTDDEHDVKIKGINEYINLYNQQHKDDKLPKLKALFKQILSDRNAISWLPEEFNSDQEVLNAIKDCYERLAENVLGDKVLKSLLCSLSDYTLDGIFIRNDLQLTDISQKMFGNWGVIQNAIMQNIKRVAPARKHKESEEDYEKRIAGIFKKADSFSISYINDCLNEADSNNAYFVENYFATFGAVNTPTMQRENLFALVQNAYTEVASLLHSDYPTAKHLAQDKANVAKIKALLDAIKSLQHFVKPLLGKGDESDKDERFYGELASLWAELDTVTPLYNMIRNYITRKPYSQKKIKLNFENPQLLGGWDANKEKDYATIILRRNGLYYLAIMNKESKKLLGKAMPSDGECYEKMVYKLLPGANKMLPKVFFAKSRMEDFKPSKELVEKYNNGTHKKGKNFNIQDCHNLIDYFKQSISKHEDWGKFGFNFSDTSTYEDLSGFYREVEQQGYKLSFARVSVSYINQLVEEGKMYLFQIYNKDFSEYSKGTPNMHTLYWKALFDERNLADVVYKLNGQAEMFYRKKSIENTHPTHPANHPILNKNKDNKKKESLFEYDLIKDRRYTVDKFMFHVPITMNFKSVGSENINQGVKEYLHHADDMHIIGIDRGERHLLYLVVIDLQGNIKEQYSLNEIVNEYNGNTYHTNYHDLLDAREDERLKARQSWQTIENIKELKEGYLSQVIHKITQLMVKYHAIVVLEDLNMGFMRGRQKVEKQVYQKFEKMLIDKLNYLVDKKADASVSGGWLNAYQLTSKFDSFQKLGKQSGFLFYIPAWNTSKIDPVTGFVNLLDARYQNVEKAKAFFSKFDAIRYNKDKDWFEFNLDYDKFGKKAEGTRTKWTLCTRGMRIDTFRNKEKNSQWDNQEVDLTAEMKSLLEHYYIDIHGNLKDAISAQTDKAFFTGLLHILKLTLQMRNSITGTETDYLVSPVADENGIFYDSRSCGEELPENADANGAYNIARKGLMLIEQIKGAEDLGNLKFDISNKAWLNFAQKKPYKNG

SEQ ID NO: 1574 - protein, 1275 aa, unidentified
  REGION 1..1275: note = Description of Unknown:uncultivated organism sequence
  REGION 1..1275: note = Category: MG75 effectors
  REGION 1..1275: note = Description: MG75-60 effector
MAKNFEDFKRLYSLSKTLRFEAKPIGATLDNIVKSGLLDEDEHRAASYVKVKKLIDEYHKVFIDRVLANGCLPLKNEGHNNSLTEYYDNYVSKSQNEDAKKTFEENQQNLRSIIAKKLTEDKAYANLFGKNLLESYKDKTDKTKIIDSDLFKFINTAESTQLDSMSQDEAKELVKEFWGFITYFYGFFDNRKNMYTSEDKSTGIAYRLINENLPKFIDNMEAFNTAVTRPEIQANMDELYSNFSEYLNVESIQEMFQLDYYNMLLTQKQIDVYNAIIGGKTDDEHDVKIKGINEYINLYNQKHKDDKLPKLKALFKQILSDRNAIFWLPEEFNSDQEVLNAIKDCYERLSENVLGDKVLKSLLGSLADYSLDGIFIRNDLQLTDISQKMFGNWGVIQNAIMQDIKHVAPARKHKESEEDYEKRIAGIFKKADSFSISYINDCLNEADPNNAYFVENYFATLGAVDTPTMQRENLFALVQNAYTEITALLHSDYPTEKNLAQDKANVAKIKALLDAIKSLQHFVKPLLGKGDESDKDERFYGELASLWTELDTVTPLYNMIRNYMTRKPYSQKKIKLNFENPQLLGGWDVNKEKDYATIILRRNGLYYLAIMNKDSKKLLGKAMPSDGECYEKMVYKLLPGANKMLPKVFFAKSRMEDFKPSKELVEKYNNGTHKKGKNFNIQDCHNLIDYFKQSIDKHEDWSKFGFKFSDTSTYEDFSGFYREVEQQGYKLSFARVSVSYINQLVEEGKMYLFQIYNKDFSEYSKGTPNMYTLYWKALFDERNLADVVYKLNGQAEMFYRKKSIENTHPTHPANHPILNKNKDNKKKESLFDYDLIKDRRYTVDKFMFHVPITMNFKSVGSENINQDVKAYLRHADDMHIIGIDRGERHLLYLVVIDLQGNIKEQYSLNEIVNEYNGNTYHTNYHDLLDVREEERLKARQSWQTIENIKELKEGYLSQVIHKITQLMVGYHAIVVLEDLSKGFMRSRQKVEKQVYQKFEKMLIDKLNYLVDKKTDVSTPGGLLNAYQLTCKSDSSQKLGKQSGFLFYIPAWNTSKIDPVTGFVNLLDTHSLNSKEKIKAFFSKFDAIRYNKDKKWFEFNLDYDKFGKKAEDTRTKWTLCTRGMRIGTFRNKEKNSQWDNQEVDLTTEMKSLLEHYYIDIHGNLKDAISTQTDKAFFTGLLHILKLTLQMRNSITGTETDYLVSPVADENGIFYDSRSCGDQLPENADANGAYNIARKGLMLIEQIKNAEDLNNVKFDISNKAWLNFAQQKPYKNG

SEQ ID NO: 1575 - protein, 1245 aa, unidentified
  REGION 1..1245: note = Description of Unknown:uncultivated organism sequence
  REGION 1..1245: note = Category: MG75 effectors
  REGION 1..1245: note = Description: MG75-61 effector
METFSGFTNLYPLSKTLRFRLIPVGETLKHFIDSGILEEDQHRAESYVKVKAIIDDYHRAYIENSLSGFELPLESTGKFNSLEEYYLYHNIRNKTEEIQNLSSKVRTNLRKQVVVQLTKNEIFKRIDKKELIQSDLIDFVKNEPDANEKIALISEFRNFTVYFKGFHENRRNMYSDEEKSTSIAFRLIHENLPKFIDNMEVFAKIQNTSILENFDAIQKELCPELVTLCEMFKLGYFNKTLSQKQIDAYNTVIGGKTTSEGKKIKGLNEYINLYNQQHKQEKLPKMKLLFKQILSDRESASWLPEKFENDSQVVGAMVNFWNTIHDTVLAEGGLKTIIASLGSYGLEGIFLKNDLQLTDISQKATGSWSKISSEIKQKIEVMNPQKKKESYESYQERIDKLFKSYKSFSLAFINECLRGEYKIEDYFLKLGAVNSSSLQKENHFSHILNAYTDVKEAIGFYSESTDTKLIQDNDSIQKIKQFLDAVKDLQAYVKPLLGNGDETGKDERFYGDLIEYWSLLDLITPLYNMVRNYVTQKPYSVDKIKINFQNPTLLNGWDLNKETDNTSVILRRDGKYYLAIMNNKSRKVFLKYPSGTDGNCYEKMEYKLLPGANKMLPKVFFSKSRINEFMPNERLLSNYEKGTHKKSGICFSLDDCHTLIDFFKKSLDKHEDWKNFGFKFSDTSTYEDMSGFYKEVENQGYKLSFKPIDATYVDQLVDEGKIFLFQIYNKDFSEHSKGTPNMHTLYWKMLFDETNLGDVVYKLNGEAEVFFRKASINVSHPTHPANIPIKKKNLKHKDEERILKYDLIKDKRYTVDQFQFHVPITMNFKADGNGNINQKAIDYLCSASDTHIIGIDRGERNLLYLVVIDGNGKICEQFSLNEIEVEYNGEKYSTNYHDLLNVKENERKQARQSWQSIANIKDLKEGYLSQVIHKISELMVKYNAIVVLEDLNAGFMRGRQKVEKQVYQKFEKKLIEKLNYLVFKKQSSDLPGGLMHAYQLANKFESFNALGKQSGFLFYIPAWNTSKMDPVTGFVNLFDVKYESVDKAKSFFSKFDSMRYNVERDMFEWKFNYGEFTKKAEGTKTDWTVCSYGNRIITFRNPDKNSQWDNKEINLTENIKLLFERFGIDLSSNLKDEIMQRTEKEFFIELISLFKLVLQMRNSWTGTDIDYLVSPVCNENGEFFDSRNVDETLPQNADANGAYNIARKGMILLDKIKKSNGEKKLALSITNREWLSFAQGCCKNG

SEQ ID NO: 1576 - protein, 1274 aa, unidentified
  REGION 1..1274: note = Description of Unknown:uncultivated organism sequence
  REGION 1..1274: note = Category: MG75 effectors
  REGION 1..1274: note = Description: MG75-62 effector
MDKKFEDFKRLYPLSKTLRFEAKPIGSTLDNIIKSGLLDEDEHRAVSYVKVKKLIDEYHKSFIDRVLDEGCLPFENNGEKDSLEEYYESYKLKSNDENANKTFKEIQQNLRSVIANKLTDDKAYANLFGNKLIESYKDKEDKKKTIDSDLIQFINTAEPSQLDSMSQDEAKELVKEFWGFTTYFVGFFDNRKNMYTSEEKSTGIAYRLVNENLPKFIDNMEAFKKVIAKSEIQANIEELYSNFAEYLNVESIQEMFQLDYYNMLLTQKQIDVYNAIIGGKTDEKHDVKIKGINEYINLYNQQHKDEKLPKLKALFKQILSDRNAISWLPEEFNDDQEVLNAIKDCYERLSENVLGNKVLKSLLCSLADYNLDDIFIRNDLQLTDISQKMFGNWSVIQDAIIQNIKNVAPARKRKESEEDYEKRISGIFKKADSFSILYINSCLNEMDDNSLHAVDGYFATLGAVNTPTMQRENLFALIQNAYTDISDLLNTKYPANKNLAQDKTNVAKVKALLDAIKSLQHFVKPLLGKGDESDKDERFYGELASLWTELDTVTPLYNMIRNYMTRKPYSEKKIKLNFENPQLLGGWDANKEKDYSTIILRRNGMYYLAIMNKDSRRLLGKAMPSDGECYEKMVYKLLPGANKMLPKVFFAKSRIDDFKPNIQIVENYNNGTHKKRKNFNIQDCHDLIDFFKQSIKKHEDWSKFSFNFSDTSTYEDLSGFYREVEQQGYKLSFMNVSVSFIDKLVDEGKMYLFQIYNKDFSEYSKGTPNMHTLYWKALFDERNLADVVYKLNGQAEMFYRKKSIDYTHPTHPANHPILNKNKDNKKKESLFEYDLIKDRRYTVDKFLFHVPITMNFKSVGSENINQQVREYLQQADDTHIIGIDRGERHLLYLVVIDMQGNIKEQFTLNEIVNEYNGNTYRTNYHDLLDIREEERLAARQSWQTIENIKELKEGYLSQVIHKITQLMVKYHAIVVLEDLNMGFMRGRQKVEKQVYQKFEKMLIDKLNYLVDKKADATQPGGILNAYQLTSKFDSFQKLGKQSGFLFYIPAWNTSKIDSVTGFVNLLDTRYQNTEKAKVFFSKFDAIRYNEEKDWFEFYLDYDKFGSKAEGTRTKWTLCTQGKRIRTFRNPDKNSQWDNQEVDLTREMKSLFEHYHINICGNLKEEICSQTDKAFFTGLLHVLKLTLQMRNSITGTETDYLVSPVADEEGNFYDSRYCNITLPKNADANGAYNIARKGLMLVKQIKAATDLANFKYDISNKAWLNFAQQKPYKNE

SEQ ID NO: 1577 - protein, 1321 aa, unidentified
  REGION 1..1321: note = Description of Unknown:uncultivated organism sequence
  REGION 1..1321: note = Category: MG75 effectors
  REGION 1..1321: note = Description: MG75-63 effector
MEFDDFKRLYPLSKTLRFEAKPIGATLNNIIKSGLLEEDEHRAQSYVKVKKLIDEYHKVFIDRVLDDGCLTIENKGKKDSLEEYYESYMSKSNDENVSKTFKEIQENLRSVIAKKLTDDNAYANLFGNKLIESYKDKDDKKKIIDSDLIQFINTAEPSKLDSMSQDEAKELVKEFWGFTTYFEGFHKNRKNMYTSEEKSTGIAYRLVNENLPKFIDNMEAFKKAIAKPEIQANMEELYSNFAEYLNVESIQEMFQLDYYNMLLTQKQIDDYNAIIGGKTDEDHDVKIKGINEYINLYNQQHKDEKLPKLKALFKQILSDRNAISWLPEEFNSDQDVLNAIKDCYERLSENVLGDKVLKSLLCSLSDYNLNGIFVRNDLQLTDISQKMFGNWNVIQNAIMQNFFFKKVAPARKRKESEEDYEKRISDIFKKTDSFSIQYINDCLNEMDDNNLHAVDGYFATLGAVNTPTMQRENLFALIQNAYTDISDLLDTPYPENKNLAQDKTNVAKVKALLDAIKSLQHFVKPLLGKGDESDKDERFYGELASLWTELDTVTLLFNMVHNYMTRKPYSQKKIKLNYKNTQLLAGWDANKEKEHAAIILRRNGMYYLAIMDKDSKNLLDKAMPSDGECYEKMVYKQFDISKQLPKCTTELKRVRKALVEDAKRSCLLSDSKDWNKPLNVTRKLWELNNYVWDKKKADWVLRKKENETRPKKFHKKYLELTSDKNGYNQAKNDWIKFTKEFLSSYKKVEDYDIHYKKRYNSVDELYKQLNSDFYTISFTYVSVSFIDKLVNEGKMYLFKIYNKDFSNYSKGTPNMHTLYWKALFDERNLADVVYKLNGEAEMFYRKKSINNTHPTHPANHPIQNKNKDNKKKESVFEYDLVKDYRYTEDKFLFHVPITMNFKSVGSENINQQVKEYLQQADDTHIIGIDRGERHLLYLVVIDMEGNIKEQFSLNEIVNEYNGNTYRTNYHDLLDVCADKRLKASQSWQTIENIKELKEGYLSQAIHKITQLMVKYHAVVVLEDLNKGFMRGRQKVEKQVYQKFEKMLIDKLNYLVDKKADAAQSGGLLNAYQLTSKFDSFQKLGKQSGFLFYIPAWNTSKIDPVTGFVNLFDTRYTNADKALEFFSKFDAIRYNEEKDWFEFEFDYDKFTQKAHGTRTKWTLCTYGMRLRSFKNPAKQYNWDFEVVVLTDEFKRILGEAGIDIHENLKDAIRNLEGKRRKYLEPLMQFMKLLLQLRNSRKNPEEDYILSPVADENGVFYDSRSCGDKLPENADANGAYNIARKGLMLIRQIKEAKELDKVKFDISNKAWLNFAQQKPYKNE

SEQ ID NO: 1578 - protein, 1275 aa, unidentified
  REGION 1..1275: note = Description of Unknown:uncultivated organism sequence
  REGION 1..1275: note = Category: MG75 effectors
  REGION 1..1275: note = Description: MG75-64 effector
MAKNFEDFKRLYSLSKTLRFEAKPIGATLDNIVKSGLLDEDEHRAASYVKVKKLIDEYHKVFIDRVLANGCLPLKNEGHNNSLTEYYDNYVSKSQNEDAKKTFEENQQNLRSIIAKKLTEDKAYANLFGKNLLESYKDKTDKTKIIDSDLFKFINTAESTQLDSMSQDEAKELVKEFWGFITYFYGFFDNRKNMYTSEDKSTGIAYRLINENLPKFIDNMEAFNTAITRPEIQANMDELYSNFSEYLNVESIQEMFQLDYYNMLLTQKQIDVYNAIIGGKTDDEHDVKIKGINEYINLYNQKHKDDKLPKLKALFKQILSDRNAISWLPEEFNSDQEVLNAIKDCYERLSENVLGDKVLKSLLGSLADYSLDGIFIRNDLQLTDISQKMFGNWGVIQNAIMQDIKHVAPARKHKESEEDYEKRIAGIFKKADSFSISYINDCLNEADPNNAYFVENYFATLGAVDTPTMQRENLFALVQNAYTEITALLHSDYPTEKNLAQDKANVAKIKALLDAIKSLQHFVKPLLGKGDESDKDERFYGELASLWTELDTVTPLYNMIRNYMTRKPYSQKKIKLNFENPQLLGGWDVNKEKDYATIILRRNGLYYLAIMNKDSKKLLGKAMPSDGECYEKMVYKLLPGANKMLPKVFFAKSRMEDFKPSKELVEKYNNGTHKKGKNFNIQDCHNLIDYFKQSIDKHEDWSKFGFKFSDTSTYEDLSGFYREVEQQGYKLSFARVSVSYINQLVEEGKMYLFQIYNKDFSEYSKGTPNMHTLYWKALFDERNLADVVYKLNGQAEMFYRKKSIENTHPTHPANHPILNKNKDNKKKESLFEYDLIKDRRYTVDKFMFHVPITMNFKSVGSENINQDVKAYLRHADDMHIIGIDRGERHLLYLVVIDLQGNIKEQYSLNEIVNEYNGNTYHTNYHDLLDVREEERLKARQSWQTIENIKELKEGYLSQVIHKITQLMVGYHAIVVLEDLSKGFMRSRQKVEKQVYQKFEKMLIDKLNYLVDKKTDVSTPGGLLNAYQLTCKSDSSQKLGKQSGFLFYIPAWNTSKIDPVTGFVNLLDTHSLNSKEKIKAFFSKFDAIRYNKDKKWFEFNLDYDKFGKKAEDTRTKWTLCTRGMRIDTFRNKEKNSQWDNQEVDLTTEMKSLLEHYYIDIHGNLKDAISTQTDKAFFTGLLHILKLTLQMRNSITGTETDYLVSPVADENGIFYDSRSCGDQLPENADANGAYNIARKGLMLIEQIKNAEDLNNVKFDISNKAWLNFAQQKPYKNG

SEQ ID NO: 1579 - protein, 1274 aa, unidentified
  REGION 1..1274: note = Description of Unknown:uncultivated organism sequence
  REGION 1..1274: note = Category: MG75 effectors
  REGION 1..1274: note = Description: MG75-65 effector
MAKNFEDFKRLYPLSKTLRFEAKPIGATLDNIVKSGLLDEDEHRAASYVKVKKLIDEYHKVFIDRVLADGCLPLKNEGHNNSLTEYYDSYVSKSQNEDAKKAFEENQQNLRSIIAKKLIEDKAYANLFGKNLIESYKDKEDKKKIIDSELIQFICTAEATQLDSMSQDEAKEIVKEFWGFTTYFVGFFDNRKNMYTAEEKSTGIAYRLINENLPKFIDNMEAFKKAIARPEIQANMEELYSNFSEYLNVESIQEMFQLDYYNMLLTQKQIDVYNAIIGGKTDDEHDVKIKGINEYINLYNQQHKDDKLPKLKSLFKQILSDRNAISWLPEEFNSDQEVLNAIKDCYERLAENVLGDKVLKSLLGSLADYSLDGIFIRNDLQLTDISQKMFGNWGVIQNAIMQNIKHVAPARKHKESEEDYEKRIAGIFKKADSFSISYINDCLNEADSNNAYFVENYFAAFGAVNTPTMQRENLFSLVQNAYTEVAALLHSDYPTAKHLAQDKANVAKIKALLDAIKSLQHFVKPLLGKGDESDKDERFYGELASLWAELDTVTPLYNMIRNYMTRKPYSQKKIKLNFENPQLLGGWDANKEKDYATIILRRDGLYYLAIMNKESKKLLGKAMPSDGECYEKMVYKLLPGANKMLPKVFFAKSRMEDFKPSKELVEKYNNGTHKKGKNFNIQDCHNLIDYFKQSISKHEDWGKFGFNFSDTSTYEDLSGFYREVEQQGYKLSFARVSVSYISQLVEEGKMYLFQIYNKDFSEYSKGTPNMHTLYWKALFDERNLADVVYKLNGQAEMFYRKKSIENTYPTHPANHPILNKNKDNKKKESLFDYDLIKDRRYTVDKFMFHVPITMNFKSSGSENINQDVKAYLRHADDMHIIGIDRGERHLLYLVVIDLQGNIKEQYSLNEIVNEYNGNTYHTNYHDLLDVREEERLKARQSWQTIENIKELKEGYLSQVIHKITQLMVKYHAIVVLEDLNMGFMRGRQKVEKQVYQKFEKMLIDKLNYLVDKKADASVSGGLLNAYQLTSKFDSFQKLGKQSGFLFYIPAWNTSKIDPVTGFVNLLDTRYQNVEKAKVFFSKFDAIRYNKDKDWFEFNLDYDKFGKKAEGTRTKWALCTRGMRIDTFRNKEKNSQWDNQEVDLTAEMKSLLEHYYIDIHGNLKDAISAQTDKAFFTGLLHILKLTLQMRNSITGTETDYLVSPVADENGIFYDSRSCGDELPENADANGAYNIARKGLMMIEQIKDAKDLDNLKFDISNKSWLNFAQQKPYKNE

SEQ ID NO: 1580 - protein, 1089 aa, unidentified
  REGION 1..1089: note = Description of Unknown:uncultivated organism sequence
  REGION 1..1089: note = Category: MG75 effectors
  REGION 1..1089: note = Description: MG75-66 effector
MAKNFEDFKRLYPLSKTLRFEAKPIGATLDNIVKSGLLDEDEHRAASYVKVKKLIDEYHKVFIDRVLADGCLPLKNEGHNNSLTEYYDSYVSKSQNEDAKKAFEENQQNLRSIIAKKLIEDKAYANLFGKNLIESYKDKEDKKKIIDSELIQFICTAEATQLDSMSQDEAKEIVKEFWGFTTYFVGFFDNRKNMYTAEEKSTGIAYRLINENLPKFIDNMEAFKKAIARPEIQANMEELYSNFSEYLNVESIQEMFQLDYYNMLLTQKQIDVYNAIIGGKTDDEHDVKIKGINEYINLYNQQHKDDKLPKLKSLFKQILSDRNAISWLPEEFNSDQEVLNAIKDCYERLAENVLGDKVLKSLLGSLADYSLDGIFIRNDLQLTDISQKMFGNWGVIQNAIMQNIKHVAPARKHKESEEDYEKRIAGIFKKADSFSISYINDCLNEADSNNAYFVENYFAAFGAVNTPTMQRENLFSLVQNAYTEVAALLHSDYPTAKHLAQDKANVAKIKALLDAIKSLQHFVKPLLGKGDESDKDERFYGELASLWAELDTVTPLYNMIRNYMTRKPYSQKKIKLNFENPQLLGGWDANKEKDYATIILRRDGLYYLAIMNKESKKLLGKAMPSDGECYEKMVYKLLPGANKMLPKVFFAKSRMEDFKPSKELVEKYNNGTHKKGKNFNIQDCHNLIDYFKQSISKHEDWGKFGFNFSDTSTYEDLSGFYREVEQQGYKLSFARVSVSYISQLVEEGKMYLFQIYNKDFSEYSKGTPNMHTLYWKALFDERNLADVVYKLNGQAEMFYRKKSIENTHPTHPANHPILNKNKDNKKKESLFDYDLIKDRRYTVDKFMFHVPITMNFKSSGSENINQDVKAYLRHADDMHIIGIDRGERHLLYLVVIDLQGNIKEQYSLNEIVNEYNGNTYHTNYHDLLDVREEERLKARQSWQTIENIKELKEGYLSQVIHKITQLMVKYHAIVVLEDLNMGFMRGRQKVEKQVYQKFEKMLMDKLNYLVDKKADASVSGGLLNAYQLTSKFDSFQKLGKQSGFLFYIPAWNTSKIDPVTGFVNLLDTRYQNVEKAKVFFSKFDAIRYN

SEQ ID NO: 1581 - protein, 1250 aa, unidentified
  REGION 1..1250: note = Description of Unknown:uncultivated organism sequence
  REGION 1..1250: note = Category: MG75 effectors
  REGION 1..1250: note = Description: MG75-67 effector
MISLNYFQNQYAVAKTLCLELRPIGKTMEYIISSGILKEDEHRNESYKLVKKIIDDYHKAYIELSLSRFELKITSCSKNDALEDFYCQYLANSQEEKDKNIFKKTQDNLRKQIAKHLTQGEAYKRIDKKELIQEDLLEFVAADPDAANKKILINEFRDFTTYFTGFYENRKNMYSEEAQSTAIAYRIIHENLPKFIDNMGTFKQLMQSSITDILPQIFDNFKKDLEVSSIQEIFDLNYFNKVLTQKQIDIYNAIIGGKSLNENSRIQGLNEYINLYNQQHKENKLPLLKLLFKQILSDRNSLSWLPEAFETDKQVLHAVRKCYANLKESVLHEAGLVQLLSSLPSYDSTRIYIRNDQALTTISQKLFGDWGIIPHAIKERLKKDISAKRKETEEAYLERIEKAFKQADSYTIAYINDSLKEIGVDKKNIEDYFIHLGAICAEGQEQENILQRIASAYSQAQPLLEEKVPVHKNLMQDKDSVELIKSLLDELKNLQHFIKPLLGKGSESDKDERFYGEFVGLWNELDQITTLYNKVRNYVTRKPYSTEKFKINFQNATLLKGWDRNKERDNTSIILRKNGLYYLAIMRKEYNKVFEKYPAGTEGNCYEKMEYKLLPGANKMLPKVFFSKSRINEFNPSPQLLQNYQMGTHKKGDQFKKEDCHALIDFFKTSIEKHEDWKNFNFQFSPTSVYEDMSGFYREVEQQGYKLVFRSIDAEYIDKLVEEGKIFLFQIYNKDFSPFSKGTPNLHTLYWKMLFDERNLNNVVYKLNGEAEIFFRKKSITYTNPTHPAEIPIKNKNVQNKKKESVFRYDLIKNHRFTIDSFQFHVPITMNFKNAGLSNLNEQVYTYLRENKDAHIIGIDRGERHLLYLVVIDRYGRIVKQFSLNEIVNEYHGNTYTTNYHDLLDKREEARQQARQSWQSIENIKELKEGYLSQVVHKIANLMVEYHAIVVLEDLNIGFMRGRQKVEKQVYQKFEKMLIDKLNYLVDKKKAPEADGGLLKAFQLTNQFESFQKLGKQSGFLFYVPAWNTSKIDPCTGFTNLLDTRYENIAKAQKFFRTFDAIRYNAVKDYFELELDYDKFHKRAEGTQTKWTLCTYGTRIKTFRNPENNNQWDNVEINLTEEFKKLFKQFEINLSGDLQQAICAQTEKSFFESLLRLLKLTLQMRNSITGTDVDYLLSPVQNAEGYFYDSRKGDKSLPANADANGAYNIARKGLWVIQQIKQTPQGQKAKLSISNKEWLKFAQEKPYLKD

SEQ ID NO: 1582 - protein, 1245 aa, unidentified
  REGION 1..1245: note = Description of Unknown:uncultivated organism sequence
  REGION 1..1245: note = Category: MG75 effectors
  REGION 1..1245: note = Description: MG75-68 effector
METFSGFTNLYPLSKTLRFRLIPVGETLKHFIGSGILEEDQHRAESYVKVKAIIDDYHRTYIENSLSGFELPLESTGKFNSLEEYYLYHNIRNKTEEIQNLSSKVRTNLRKQVVTQLTKNEIFKRIDKKELIQSDLIDFVKNEPDANEKIALISEFRNFTVYFKGFHENRRNMYSDEEKSTSIAFRLIHENLPKFIDNMEVFAKIQNTSISENFDAIQKELCPELVTLCEMFKLGYFNKTLSQKQIDAYNTVIGGKTTSEGKKIKGLNEYINLYNQQHKQEKLPKMKLLFKQILSDRESASWLLEKFENDSQVVGAMVNFWNTIHDTVLAEGGLKTIIASLGSYGLEGIFLKNDLQLTDISQKATGSWSKISSEIKQKIEAMNPQKKKESYESYQERIDKLFKSYKSFSLAFVNECLRGEYKIEDYFLKLGAVNSSLLQKENHFSHILNTYTDVKEVIGFYSESTDTKLIQDNDSIQKIKQFLDAVKDLQAYVKPLLGNSDETGKDERFYGDLIEYWSLLDLITPLYNMVRNYVTQKPYSVDKIKINFQNPTLLNGWDLNKEMDNTSVILRRDGKYYLAIMNNKSRKVFLKYPSGTDRNCYEKMEYKLLPGANKMLPKVFFSKSRINEFMPNERLLSNYEKGTHKKSGTCFSLDDCHTLIDFFKKSLNKHEDWKNFGFKFSDTSTYEDMSGFYKEVENQGYKLSFKPIDATYVDQLVDEGKIFLFQIYNKDFSEHSKGTPNMHTLYWKMLFDETNLGDVVYKLNGEAEVFFRKASINVSHPTHPANIPIKKKNLKHKDEERILKYDLIKDKRYTVDQFQFHVPITMNFKANGNGNINQKAIDYLRSASDTHIIGIDRGERNLLYLVVIDGNGKICEQFSLNEIEVEYNGEKYSTNYHDLLNVKENERKQARQSWQSIANIKDLKEGYLSQVIHKISELMVKYNAIVVLEDLNAGFMRGRQKVEKQVYQKFEKKLIEKLNYLVFKKQSSDLPGGLMHAYQLANKFESFNTLGKQSGFLFYIPAWNTSKMDPVTGFVNLFDVKYESVDKAKSFFSKFDSIRYNVERDMFEWKFNYDEFTKKAEGTKTDWTVCSYGNRIITFRNPDKNSQWDNKEINLTENIKLLFERFGIDLSSNLKDEIMERTEKEFFIELISLFKLVLQMRNSWTGTDIDYLVSPVCNENGEFFDSRNVDETLPQNADANGAYNIARKGMILLDKIKKNNGEKKLTLSITNREWLSFAQGCCKNG

SEQ ID NO: 1583 - protein, 1274 aa, unidentified
  REGION 1..1274: note = Description of Unknown:uncultivated organism sequence
  REGION 1..1274: note = Category: MG75 effectors
  REGION 1..1274: note = Description: MG75-69 effector
MAKIFEDFKRLYPLSKTLRFEAKPIGATLDNIIKSGLLDEDEHRAASYVRVKKLIDEYHKVFIDRVLDNGCLPLKNEGHNNSLTEYYESYVTKSQNEDAKKVFKEIQQNLRSIIAKKLTEDKAYANLFGKNLIESYKDKTDKTKIIDSDLIKFINTAESTQLDSMSQDEAKELVKEFWGFTTYFVGFYDNRKNMYTAEEKSTGIAYRLVNENLPKFIDNMEAFKKAIARPEIQANMEELYSDFSEYLNVESVQEMFQLDYYNMLLTQKQIDVYNAIIGGKTDDEHDVKIKGINEYINLYNQQHKDDKLPKLKALFKQILSDRNAISWLPEEFNGDQEVLNAIKDCYERLSENVLGDKVLKSLLGSLSDYSLDGIFIRNDLQLTDISQKMFGNWCVIQNAIMQNIKHVAPARKHKESEEDYEKRIAGIFKKVDSFSISFINDCLNEADPNNAYFVENYFATFGAVNTPTMQRENLFALVQNAYTEVAALLHSDYLTAKHLAQDKVNVAKIKALLDAIKSLQHFVKPLLGKGDESDKDERFYGELASLWAELDTVTPLYNMIRNYMTRKPYSQKKIKLNFENPQLLGGWDANKEKDYATIILRRDGLYYLAIMNKDSKKLLGKAMPSDGECYEKMVYKLLPGANKMLPKVFFAKSRMEDFKPSKELVEKYNNGTHKKGKNFNIQDCHNLIDYFKQSISKHEDWGKFGFNFSDTSTYEDLSGFYREVEQQGYKLSFTRVSVSYISQLVEEGKMYLFQIYNKDFSEYSKGTPNMHTLYWKALFDERNLADVVYKLNGQAEMFYRKKSIENTHPTHPANHPILNKNKDNKKKESLFDYDLIKDRRYTVDKFMFHVPITMNFKSSGSENINQDVKAYLRHADDMHIIGIDRGERHLLYLVVIDLQGNIKEQYSLNEIVNEYNGNTYHTNYHDLLDVREEERLKARQSWQTIENIKELKEGYLSQVIHKITQLMVKYHAIVVLEDLNMGFMRGRQKVEKQVYQKFEKMLIDKLNYLVDKKADASVSGGLLNAYQLTSKFDSFQKLGKQSGFLFYIPAWNTSKIDPITGFVNLLDTRYQNVEKAKVFFSKFDAIRYNKDKDWFEFNLDYDKFGKKAEGTRTKWTLCTRGMRIDTFRNKEKNSQWDNQEVDLTAEMKSLLEHYYIDIYGNLKDAISAQTDKAFFTGLLHILKLTLQMRNSITGTETDYLVSPVADENGIFYDSRSCGDELPENADANGAYNIARKGLMMIEQIKDAKDLDNLKFDISNKSWLNFAQQKPYKNE

SEQ ID NO: 1584 - protein, 1264 aa, unidentified
  REGION 1..1264: note = Description of Unknown:uncultivated organism sequence
  REGION 1..1264: note = Category: MG75 effectors
  REGION 1..1264: note = Description: MG75-70 effector
MNFEQFTHLYPLSKTLRFELRPVGATLARIKEGGFLENDNHRAESYKKVKKLIDEYHKHFIEQALGDFSLTENETEGSKCLNSYLETYIQLYRSSRIEDAEKKAFEKVQAEMRKLIAKTLKGSEAYKRLFKQELIKEDLITFLRTHGGTVADEELVEEFKNFTTYFTGFYENRENMYSEEEKSTAISYRLVNENLPIFVDNMAAFAIIAQVPEVRAKLDVLQKDLGVELDGTTIDELFTLPFFNKVLTQKQIVVYNAAIGGKVSDSHSKGESHIKGINQIVNLYNQQHKDARLPKLKMLYKQILSDREALSWLPEKFDKDADLLKAIHDGYERLVSDGVLENLRTLLESIADYQTEGIFITNDQQLTRISQKMFGEWSFISEAILCALKKKVPQKRNECDEKYEERIDKMLKNYGGFSIRFIDDCVAAYVNTLDDEERKKRFIPTMEAYFATLGAFDTEEGQTINFFSRIQNARDALQGLLDSAYPERRALIQDKENGALLKELLDAILALMHFVKPLLGKNENGKDERFYGELMQIWDEFDSFVPLYNMSRNYLTQKPYSEEKYKLNFENSQLLKGWDLNKEADNTSIILRKDGLFYLAIMNKKHNKLFARELPADGDCYDKMDYKLLPGPNKMFPKVFFSKSRIAEFAPSEHIMDVYRKGSFKKGDTFNLQDCHDLIDFFKASILKHEDWRQFEFKFSETEQYDDISGFYREVEAQGYKVTFRQVSVSYIDRLVNEGKLYLFQIYNKDFSSYSKGTPNMHTLYWRALFDERNLSDVVYKLNGEAEVFYRKKSIEAHPTHPANRPIKNKNKLNDKEESLFAYDLIKDRRYSKDKFSLHVPITMNFKSVGGPNINDDVVEFLRTNENLHFIGIDRGERHLLYLTVIDSHGHILEQRTLNDVVNNYQGKDYHTDYHDLLETRERQRQEARSSWKAIENIKDLKEGYLAQVVHQIAQLMVKYHAIVVLEDLNGGFMRGRQKVERSVYQQFEKKLIDKLNYLVDKKSDAHAPGGLMNAYQLANQFKSFKSMGRQSGFIFYIPAWNTSKIDPVTGFTNLFDTRYKNVHDAQQFFSKFKSIRYNETADRFEFKFSYSDFTRKAEGSRTDWTVCTYGTRIKTFRDPQKNNEWTSKEVVLTEEFKKFFAAYGMDIHSNLKDSIAAHDEKAFFEQLLVLMRLTLQIRNSKSGTDVDYLLSPVADENGVFFDSRSCGNSLPQDADANGAYNIARKGLMLVRQMREAKDLKKFKADMTNRNWLKFAQEKPYLND

SEQ ID NO: 1585 - protein, 1275 aa, unidentified
  REGION 1..1275: note = Description of Unknown:uncultivated organism sequence
  REGION 1..1275: note = Category: MG75 effectors
  REGION 1..1275: note = Description: MG75-71 effector
MAKNFEDFKRLYPLSKTLRFEAKPIGATLDNIIKSGLLDEDEHRAASYVKMKKLIDEYHKVFIDRVLDNGCLPLEDKGDNNSLAEYYESYVSKAQDEDAIKKFKEIQQNLCSIIAKKLTDDKAYANLFGNKLIESYKDKADKTKIIDSDLIQFINTAESTQLVSMSQDEAKELVKEFWGFTTYFEGFFKNRKNMYTPEEKSTGIAYRLINENLPKFIDNMEAFKKAITRPEIQANMEELYSDFSEYLNVESIQEMFQLDYYNMLLTQKQIDVYNAIIGGKTDDEHDVKIKGINEYINLYNQQHKDDKLPKLKALFKQILSDRNAISWLPEEFNSDQEVLNAIKDCYERLAENVLGDKVLKSLLCSLSDYTLDGIFIRNDLQLTDISQKMFGNWGVIQNAIMQNIKRVAPARKHKESEEDYEKRIAGIFKKADSFSISYINDCLNEADPNNAYFVENYFATFGAVNTPTMKRENLFALVQNAYTEVASLLHSDYPTAKHLAQDKANVAKIKALLDAIKSLQHFVKPLLGKGDESDKDERFYGELASLWAELDTVTPLYNMIRNYITRKPYSQKKIKLNFENPQLLGGWDANKEKDYATIILRRNGLYYLAIMNKESKKLLGKAMPSDGECYEKMVYKLLPGANKMLPKVFFAKSRMEDFKPSKELVEKYNTGTHKKGKNFNIQDCHNLIDYFKQSISKHEDWGKFGFNFSDTSTYEDLSGFYREVEQQGYKLSFARVSVSYINQLVEEGKMYLFQIYNKDFSEYSKGTPNMHTLYWKALFDERNLADVVYKLNGQAEMFYRKKSIENTHPTHPANHPILNKNKDNKKKESLFEYDLIKDRRYTVDKFMFHVPITMNFKSSGSENINQDVKAYLRHADDMHIIGVDRGERHLLYLVVIDLQGNIKEQYSLNEIVNEYNGNTYHTNYHDLLDVREDERLKARQSWQTIENIKELKEGYLSQVIHKITQLMVKYHAIVVLEDLNKGFMRGRQKVEKQVYQKFEKMLIDKLNYLVDKKADASVSGGLLNAYQLTSKFDSFQKLGKQSGFLFYIPAWNTSKIDPVTGFVNLLDTHSLNSKEKIKAFFSKFDAIRYNKDKDWFEFNLDYDKFGKKAEGTRTKWTLCTRGMRIDTFRNKEKNSQWDNQEVDLTAEMKSLLEHYYIDIHGNLKDAISAQTDKAFFTGLLHILKLTLQMRNSITGTETDYLVSPVADENGIFYDSRSCGDELPENADANGAYNIARKGLMMIEQIKEVKDLDNLKFDISNKSWLNFAQQKPYKNE

SEQ ID NO: 1586 - protein, 439 aa, unidentified
  REGION 1..439: note = Description of Unknown:uncultivated organism sequence
  REGION 1..439: note = Category: MG75 effectors
  REGION 1..439: note = Description: MG75-72 effector
MIKDKRYTVDQFQFHVPITMNFKADGNGNINQKAIDYLCSASDTHIIGIDRGERNLLYLVVIDGNGKICEQFSLNEIEVEYNGEKYSTNYHDLLNVKENERKQARQSWQSIANIKDLKEGYLSQVIHKISELMVKYNAIVVLEDLNAGFMRGRQKVEKQVYQKFEKKLIEKLNYLVFKKQSSDLPGGLMHAYQLANKFESFNALGKQSGFLFYIPAWNTSKMDPVTGFVNLFDVKYESVDKAKSFFSKFDSMRYNVERDMFEWKFNYGEFTKKAEGTKTDWTVCSYGNRIITFRNPDKNSQWDNKEINLTENIKLLFERFGIDLSSNLKDEIMQRTEKEFFIELISLFKLVLQMRNSWTGTDIDYLVSPVCNENGEFFDSRNVDETLPQNADANGAYNIARKGMILLDKIKKSNGEKKLALSITNREWLSFAQGCCKNG

SEQ ID NO: 1587 - protein, 1274 aa, unidentified
  REGION 1..1274: note = Description of Unknown:uncultivated organism sequence
  REGION 1..1274: note = Category: MG75 effectors
  REGION 1..1274: note = Description: MG75-73 effector
MARIFEDFKRLYPLSKTLRFEAKPIGATLDNIVKSGLLDEDEHRAESYVKVKKLIDEYHKVFIDRVLDNGCLPLKNEGHNNSLTEYYDSYVSKSQNEDAKKAFEENQQNLRSIIAKKLTEDKAYANLFGKNLIESYKDKTDKTKIIDSDLIQFINTAESTQLNSMSQDEAKELVKEFWGFTTYFVGFFDNCKNMYTAEEKSTGIAYRLINENLPKFIDNMEAFKKAIARPEIQANMEELYSNFSEYLNVESIQEMFLLDYYNMLLTQKQIDVYNAIIGGKTDDEHDVKIKGINEYINLYNQQHKDDKLPKLKALFKQILSDRNAISWLPEEFNSDQEVLNAIKDCYERLSENVLGDKVLKSLLGSLADYSLDGIFIRNDLQLTDISQKMFGNWGVIQNAIMQNIKRVAPARKHKESEEDYEKRIAGIFKKADSFSISYINDCLNEADPNNAYFVENYFATFGAVNTPTMQRENLFALVQNAYTEVASLLHSYYPAEKKLAQDKANVAKIKALLDAIKSLQHFVKPLLGKGDESDKDERFYGELASLWAELDTVTPLYNMIRNYITRKPYSQKKIKLNFENPQLLGGWDANKEKDYATIILRRNGLYYLAIMDKDSRKLLGKAMPSDGECYEKMVYKLLPGANKMLPKVFFAKSRMDDFKPSKELIEKYNNGTHKKGKNFDIQDCHNLIDYFKQSIDKHEDWSKFGFNFSDTSTYEDLSGFYREVEQQGYKLSFARVSVSYINQLVEEGKMYLFQIYNKDFSEYSKGTPNMHTLYWKALFDERNLADVVYKLNGQAEMFYRKKSIENTHPTHPANHPILNKNKDNKKKESLFEYDLIKDRRYTVDKFMFHVPITMNFKSVGSENINQGVKEYLHHADDMHIIGIDRGERHLLYLVVIDLQGNIKEQYSLNEIVNEYNGNTYHTNYHDLLDAREDERLKARQSWQTIENIKELKEGYLSQVIHKITQLMVKYHAIVVLEDLNMGFMRGRQKVEKQVYQKFEKMLIDKLNYLVDKKADASVSGGLLNAYQLTSKFDSFQKLGKQSGFLFYIPAWNTSKIDPVTGFVNLLDARYQNVEKAKAFFSKFDAIRYNKDKDWFEFNLDYDKFGKKAEGTRTKWILCTRGMRIDTFRNKEKNSQWDNQEVDLTAELKSLLEHYYIDIHGNLKEAISAQTDKAFFTGLLHILKLTLQMRNSITGTETDYLVSPVADENGIFYDSRSCGEQLPENADANGAYNIARKGLMMIEQIKNAEDLGNLKFDISNKAWLNFAQQKPYKNG

SEQ ID NO: 1588 - protein, 1203 aa, unidentified
  REGION 1..1203: note = Description of Unknown:uncultivated organism sequence
  REGION 1..1203: note = Category: MG75 effectors
  REGION 1..1203: note = Description: MG75-74 effector
MTIENKGKKDSLEEYYESYMSKSNDENVSKTFKEIQENLRSVIAKKLTDDNAYANLFGNKLIESYKDKDEKNKIIDSDLIQFINTAEPSQLDSMSQDEAKELVKEFWGFTTYFVGFFDNRKNMYTSEEKSTGIAYRLVNENLPKFIDNMEAFKKAIAKPEIQASMEELYSNFAEYLNVESIQEMFQLDYYNMLLTQKQIDVYNAIIGGKTDEEHDVKIKGINEYINLYNQQHKDEKLPKLKALFKQILSDRNAISWLPEEFNSDQEVLNAIDDCYKRLSENVLGDKVLKSLLCSLDDYNLDGIFVRNDLQLTDISQKMFGNWSVIQSAIMQNIKNVAPARKRKESEEDYEKRISDIFKKADSFSIQYINDCLNEMDNNNLHAVDGYFATLGAVNTPTMQRENLFALIQNAYTDISNLLETPYPENKNLAQDKTNVAKVKALLDAIKSLQHFVKPLLGKGDESDKDERFYGELASLWTELDTVTPLYNMIRNYMTRKPYSEKKIKLNFENPQLLGGWDANKEKDYATIILRRNGMYYLAIMDKDSKKLLGKTMPSNGECYEKMVYKLLPGANKMLPKVFFAKSRINDFKPSKLIVENYNNGTHKKGKNFNINDCHNLIDYFKQSIDKHEDWSKFGFNFSDTSTYEDLSGFYREVEQQGYKLSFTNVSVSFIDKLVDEGKMYLFQIYNKDFSDFSKGTPNMHTLYWKALFDERNLADVVYKLNGQAEMFYRKKSINNTHPTHPANHPIQNKNKDNKKKESVFEYDLIKDRRYTVDKFLFHVPITMNFKSVGSENINQQVREYLQQADDTHIIGIDRGERHLLYLVVIDMQGNIKEQFTLNEIVNEYNGNTYRTNYHDLLDTREEERLTARQSWQTIENIKELKEGYLSQVVHKITQLMVKYHAVVVLEDLNKGFMRGRQKVEKQVYQKFEKMLIDKLNYLVDKKADAAQSGGLLNAYQLTSKFDSFQKLGKQSGFLFYIPAWNTSKIDPVTGFVNLLDTRYQNTEKAKAFFSRFDAIRYNANKDWFEFYLDYDKFCTKAEGTRTRWTLCTQGSRISTFRNAEKNSQWDNLEVDLTREMKSLFEHYHINICGNLKEEICLQTDKAFFTGLLHMLKLTLQMRNNITGTETDYLISPVADENGTFYDSRSCGDTLPKNADANGAYNIARKGLMFIGQIKETKDLANFKYDISNKAWLNFAQQKPYKNE

SEQ ID NO: 1589 - protein, 1245 aa, unidentified
  REGION 1..1245: note = Description of Unknown:uncultivated organism sequence
  REGION 1..1245: note = Category: MG75 effectors
  REGION 1..1245: note = Description: MG75-75 effector
METFSGFTNLYPLSKTLRFRLIPVGETLKHFIDSGILEEDQHRAESYVKVKAIIDDYHRAYIENSLSGFELPLESMGKFNSLEEYYLYHNIRNKTEEIQNLSSKVRTNLRKQVVTQLTKNEIFKRIDKKELIQSDLIDFVKNEPDANEKIALISEFRNFTVYFKGFHENRKNMYSDEEKSTSIAFRLIHENLPKFIDNMEVFAKIQNTSISENFDAIQKELCPELVTLCEMFKLGYFNKTLSQKQIDAYNTVIGGKTTSEGKKIKGLNEYINLYNQQHKQEKLPKMKLLFKQILSDRESVSWLPEKFENDSQVVGAMVNFWNTIHDTVLAEGGLKTIIASLGSYGLEGIFLKNDLQLTDISQKATGSWGKISSEIKQKIEVMNPQKKKESYETYQERIDKIFKSYKSFSLAFINECLRGEYKIEDYFLKLGAVNSSSLQKENHFSHILNAYTDVKEAIGFYSESTDTKLIQDNDSIQKIKQFLDAVKDLQAYVKPLLGNGDETGKDERFYGDLIEYWSLLDLITPLYNMVRNYVTQKPYSIDKIKINFQNPTLLNGWDLNKETDNTSVILRRDGKYYLAIMNNKSRKVFLKYPSGTDRNCYEKMEYKLLPGANKMLPKVFFSKSRINEFMPNERLLSNYEKGTHKKSGTCFSLDDCHTLIDFFKKSLDKHEDWKNFGFKFSDTSIYEDMSGFYKEVENQGYKLSFKPIDATYVDQLVDEGKIFLFQIYNKDFSEHSKGTPNMHTLYWKMLFDETNLGDVVYKLNGEAEVFFRKASINVSHPTHPANIPIKKKNLKHKDEERILKYDLIKDKRYTVDQFQFHVPITMNFKADGNGNINQKAIDYLRSASDTHIIGIDRGERNLLYLVVIDGNGKICEQFSLNEIEVEYNGEKYSTNYHDLLNVKENERRQARQSWQSIANIKDLKEGYLSQVIHKISELMVKYNAIVVLEDLNAGFMRGRQKVEKQVYQKFEKKLIEKLNYLVFKKQSFDLPGGLMHAYQLANKFESFNTLGKQSGFLFYIPAWNTSKMDPVTGFVNLFDVKYESVDKAKSFFSKFDSIRYNVERDMFEWKFNYGEFTKKAEGTKTDWTVCSYGNRIITFRNPDKNSQWDNKEINLTENIKLLFERFGIDFSSNLKDEIMQRTEKEFFIELISLFKLVLQMRNSWTGTDIDYLVSPVCNENGEFFDSRNVDETLPQNADANGAYNIARKGMILLDKIKKGNGEKKLALSITNREWLSFAQGCCKNG

SEQ ID NO: 1590 - protein, 1274 aa, unidentified
  REGION 1..1274: note = Description of Unknown:uncultivated organism sequence
  REGION 1..1274: note = Category: MG75 effectors
  REGION 1..1274: note = Description: MG75-76 effector
MAKNFEDFKRLYPLSKTLRFEAKPIGATLDNIIKSGLLDEDEHRAASYVKMKKLIDEYHKVFIDRVLDNGCLPLKNEGQNNSLTEYYESYVSKSQNEDAKKAFEENQQNLRSIVAKKLTDDKAYANLFGKNLIESYKDKEDKKKIIDSDLIQFICTAEATQLDSMSQDEAKEIVKEFWDFTTYFVGFFDNRKNMYTAEEKSTGIAYRLINENLPKFIDNMEAFKKAIARPEIQANMEELYSNFSEYLNVESIQEMFLLDYYNMLLTQKQIDVYNAIIGGKTDDEHDVKIKGINEYINLYNQQHKDDKLPKLKDLFKQILSDRNAISWLPEEFNSDQEVLNAIKDCYERLSENVLGDKVLKSLLGSLSDYTLDGIFIRNDLQLTDISQKMFGNWGVIQNAIMQNIKRVAPARKHKESEEDYEKRIAGIFKKADSFSISYINDCLNEADPNNAYFVENYFATFGAVNTPTMQRENLFALVQNAYTEVASLLHSDYPTAKHLAQDKANVAKIKALLDAIKSLQHFVKPLLGKGDESDKDERFYGELASLWAELDTVTPLYNMIRNYITRKPYSQKKIKLNFENPQLLGGWDANKEKDYATIILRRNGLYYLAIMNKESKKLLGKAMPSDGECYEKMVYKLLPGANKMLPKVFFAKSRMEDFKPSKELVEKYNNGTHKKGKNFNIQDCHNLIDYFKQSINKHEDWGKFGFNFSDTSTYEDLSGFYREVEQQGYKLSFARVSVSYINQLVEEGKMYLFQIYNKDFSEYSKGTPNMHTLYWKALFDERNLADVVYKLNGQAEMFYRKKSIEKTHPTHPANHPILNKNKDNKKKESLFDYDLIKDRRYTVDKFMFHVPITMNFKSVGSENINQGVKEYLHHADDMHIIGIDRGERHLLYLVVIDLQGNIKEQYSLNEIVNEYNGNTYHTNYHDLLDAREDERLKARQSWQTIENIKELKEGYLSQVIHKITQLMVKYHAIVVLEDLNMGFMRGRQKVEKQVYQKFEKMLIDKLNYLVDKKADASVSGGWLNAYQLTSKFDSFQKLGKQSGFLFYIPAWNTSKIDPVTGFVNLLDARYQNVEKAKAFFSKFDAIRYNKDKDWFEFNLDYDKFGKKTEGTRTKWTLCTRGMRIDTFRNKEKNSQWDNQEVDLTAEMKSLLEHYYIDIHGNLKDAISAQTDKAFFTGLLHILKLTLQMRNSITGTETDYLVSPVADENGIFYDSRSCGEELPENADANGAYNIARKGLMLIEQIKGAEDLGNLKFDISNKAWLNFAQKKPYKNG

SEQ ID NO: 1591 - protein, 1272 aa, unidentified
  REGION 1..1272: note = Description of Unknown:uncultivated organism sequence
  REGION 1..1272: note = Category: MG75 effectors
  REGION 1..1272: note = Description: MG75-77 effector
MEFDDFKRLYPLSKTLRFEAKPIGATLKNIIKSGLLEEDEHRAQSYVKVKKLIDEYHKAFIDRVLNEGCLTIENKGNKDSLEEYYESYMSKSNDENVSKTFKEIQENLRSVIAKRLTDDKAYANLFGKNLIESYKDKEEKNKIIDSDLIQFINTAEPSQIDSMSQDEAKELVKEFWGFTTYFVGFFDNRKNMYTSEEKSTGIAYRLVNENLPKFIDNMEAFKKAIAKPEIQANMEELYSNFAEYLNVESIQEMFQLDYYDMLLTQKQIDVYNAIIGGKTDEDHDVKIKGINEYINLYNQQHKDEKLPKLKALFKQILSDRNAISWLPEEFNSDQEVLDAIKDCYERLSENVLGYKVLKSLLCSLSDYNLNGIFVRNDLQLTDISQKMFGNWSVIQNAIMQNIKNIAPARKRKESEEDYEKRISDIFKKADSFSIQYINDCLNEMDNNNLHAVDGYFATLGAVNTPTMQRENLFALIQNAYTDISDLLDTPYPQNKNLAQDKTNVAKVKVLLDAIKSLQHFVKPLLGMGDESDKDERFYGELASLWTELDTVTPLYNMIRNYMTRKPYSEKKIKLNFENPQLLGGWDANKEKDYATIILRRNGMYYLAIMDKDSKKLLGKTMPSDGECYEKMVYKLLPGANKMLPKVFFAKSRINDFKPSKKIVENYNNGTHKKGKNFNINDCHDLIDYFKQSIDKHEDWSKFGFNFSDTSTYEDLSGFYREVEQQGYKLSFTNISVSFIDKLVDEGKMYLFQIYNKDFSDYSKGTPNMHTLYWKALFDERNLADVVYKLNGQAEMFYRKKSIDYTYPTHPANHPIQNKNKDNKKKESVFEYDLVKDRRYTVDKFLFHVPITINFKSVGSENINQQVREYLQQADDTHIIGIDRGERHLLYLVVIDMQGNIKEQFTLNEIVNEYNGNTYRTNYHDLLDTREEERLTARQSWQTIENIKELKEGYLSQVIHKITQLMVKYHAVVVLEDLNKGFMRGRQKVEKQVYQKFEKMLIDKLNYLVDKKADATQSGGLLNAYQLTSKFDSFQKLGKQSGFLFYIPAWNTSKIDPVTGFVNLLDTRYQNTEKAKAFFSKFDAIRYNADKDWFEFNLDYDKFGTKAEGTRTTWTLCTQGNRICTFRNAEKNSQWDNQEVDLTGELKSLFEHYNINICGNLKEEICSQTDKAFFTGLLHILKLTLQMRNSITGTETDYLVSPVADENGVFYDSRSCGDQLPENADANGAYNIARKGLMLIREIKKAKELGKVKYDISNKAWLNFAQQKPYKNE

SEQ ID NO: 1592 - protein, 1274 aa, unidentified
  REGION 1..1274: note = Description of Unknown:uncultivated organism sequence
  REGION 1..1274: note = Category: MG75 effectors
  REGION 1..1274: note = Description: MG75-78 effector
MAKNFEDFKRLYPLSKTLRFEAKPIGVTLDNIVKSGLLDEDEHRAASYVKVKKLIDEYHKVFIDRVLADGCLPLKNEGHNNSLTEYYDNYVSKSQNEDAKKAFEENQQNLRSIIAKKLTEDKAYANLFGKNLIESYKDKTDKTKIIDSDLFNFINTAESTQLDSMSQDAAKEIVKEFWGFTTYFVGFFDNRKNMYTAEEKSTGIAYRLINENLPKFIDNMEAFKKAIARPEIQANMDELYSNFSEYLNVESIQEMFQLDYYNMLLTQKQIDVYNAIIGGKTDDEHDVKIKGINEYINLYNQKHKDDKLPKLKALFKQILSDRNAISWLPEEFNSDQEVLNAIKDCYERLSENVLGDKVLRSLLGSLADYSLDGIFIRNDLQLTDISQKMFGNWGVIQNAIMQNIKRIAPARKHKESEEDYEKRIAGIFKKADSFSISYINDCLNEADPNNAYFVENYFATFGAVNTPTMQRENLFALVQNAYTEVAALLHSDYPTVKNLAQDKANVSKIKVLLDAIKSLQHFVKPLLGKGDESDKDERFYGELASLWAELDTVTPLYNMIRNYMTRKPYSQKKIKLNFENPQLLGGWDANKEKDYATIILRRNGLYYLAIMNKDSKKLLGKAMPSDGECYEKMVYKLLPGANKMLPKVFFAKSRMEDFKPSKELVEKYNNGTHKKGKNFCIQDCHNLIDYFKQSIDKHEDWSKFGFNFSETSTYEDLSGFYREVEQQGYKLSFARVSVSYINQLVEEGKMYLFQIYNKDFSEYSKGTPNMHTLYWKALFDERNLADVVYKLNGQAEMFYRKKSIENTHPTHPANHPILNKNKDNKKKESLFEYDLIKDRRYTVDKFMFHVPITMNFKSSGSENINQDVKAYLRHADDMHIIGIDRGERHLLYLVVIDLQGNIKEQFSLNEIVNDYNGNTYHTNYHDLLDVREDERLKARQSWQTIENIKELKEGYLSQVIHKITQLMVKYHAIVVLEDLNMGFMRGRQKVEKQVYQKFEKMLIEKLNYLVDKKADASASGGLLNAYQLTSKFDSFQKLGKQSGFLFYIPAWNTSKIDPVTGFVNLLDTRYQNVEKAKSFFSKFDAIRYNKDKEWFEFNLDYDKFSKKAEGTRTKWTLCTRGMRIDTFRNKEKNSQWDNQKVDLTAEMKSLLEHYYIDIHGNLKDAISAQTDKAFFTGLLHILKLTLQMRNSITGTETDYLVSPVVDENGIFYDSRSCGDELPENADANGAYNIARKGLMMIEQIKDAKDLDNLKFDISNKAWLNFAQQKPYKNG

SEQ ID NO: 1593 - protein, 1274 aa, unidentified
  REGION 1..1274: note = Description of Unknown:uncultivated organism sequence
  REGION 1..1274: note = Category: MG75 effectors
  REGION 1..1274: note = Description: MG75-79 effector
MAKIFEDFKRLYPLSKTLRFEAKPIGATLDNIIKSGLLDEDEHRAASYVRVKKLIDEYHKVFIDRVLDNGCLPLKNEGHNNSLTEYYESYVTKSQNEDAKKVFKEIQQNLRSIIAKKLTEDKAYANLFGKNLIESYKDKTDKTKIIDSDLIKFINTAESTQLDSMSQDEAKELVKEFWGFTTYFVGFYDNRKNMYTAEEKSTGIAYRLVNENLPKFIDNMEAFKKAIARPEIQANMEELYSDFSEYLNVESVQEMFQLDYYNMLLTQKQIDVYNAIIGGKTDDEHDVKIKGINEYINLYNQQHKDDKLPKLKALFKQILSDRNAISWLPEEFNGDQEVLNAIKDCYERLSENVLGDKVLKSLLGSLSDYSLDGIFIRNDLQLTDISQKMFGNWCVIQNAIMQNIKHVAPARKHKESEEDYEKRIAGIFKKVDSFSISFINDCLNEADPNNAYFVENYFATFGAVNTPTMQRENLFALVQNAYTEVAALLHSDYPTAKHLAQDKVNVAKIKALLDAIKSLQHFVKPLLGKGDESDKDERFYGELASLWAELDTVTPLYNMIRNYMTRKPYSQKKIKLNFENPQLLGGWDANKEKDYATIILRRDGLYYLAIMNKESKKLLGKAMPSDGECYEKMVYKLLPGANKMLPKVFFAKSRMEDFKPSKELVEKYNNGTHKKGKNFNIQDCHNLIDYFKQSISKHEDWGKFGFNFSDTSTYEDLSGFYREVEQQGYKLSFTRVSVSYISQLVEEGKMYLFQIYNKDFSEYSKGTPNMHTLYWKALFDERNLADVVYKLNGQAEMFYRKKSIENTHPTHPANHPILNKNKDNKKKESLFDYDLIKDRRYTVDKFMFHVPVTMNFKSSGSENINQDVKAYLRHADDMHIIGIDRGERHLLYLVVIDLQGNIKEQYSLNEIVNEYNGNTYHTNYHDLLDVREEERLKARQSWQTIENIKELKEGYLSQVIHKITQLMVKYHAIVVLEDLNMGFMRGRQKVEKQVYQKFEKMLIDKLNYLVDKKADASVSGGLLNAYQLTSKFDSFQKLGKQSGFLFYIPAWNTSKIDPVTGFVNLLDTRYQNVEKAKVFFSKFDAIRYNKDKDWFEFNLDYDKFGKKAEGTRTKWTLCTRGMRIDTFRNKEKNSQWDNQKVDLTAEMKSLLEHYYIDIHGNLKDAISAQTDKAFFTGLLHILKLTLQMRNSITGTETDYLVSPVADENGIFYDSRSCGDELPENADANGAYNIARKGLMLIEQIKEAKDLDNLKFDISNKSWLNFAQQKPYKNG

SEQ ID NO: 1594 - protein, 1274 aa, unidentified
  REGION 1..1274: note = Description of Unknown:uncultivated organism sequence
  REGION 1..1274: note = Category: MG75 effectors
  REGION 1..1274: note = Description: MG75-80 effector
MAKNFEDFKRLYPLSKTLRFEAKPIGATLDNIVKSGLLDEDEHRAASYVKVKKLIDEYHKVFIDRVLADGCLPLENEGHNNSLAEYYDSYVSKSQNEDAKKAFEENQQNLRSIIAKKLTEDKAYANLFGKNLIESYKDKEDKKKIIDSDLIQFICTAEATQLDSMSQDEAKEIVKEFWGFTTYFVGFFDNRKNMYTVEEKSTGIAYRLINENLPKFIDNMEAFKKAIARPEIQANMEELYSNFSEYLNVESIQEMFLLDYYNMLLTQKQIDVYNAIIGGKTDDEHDVKIKGINEYINLYNQQHKDNKLPKFKALFKQILSDRNAISWLPEEFNSDQEVLNAIKDCYERLSENVLGDKVLKSLLGSLSDYTLDGIFIRNDLQLTDISQKMFGNWCVIQNAIMQNIKHVAPARKHKESEEDYEKRIAGIFKKADSFSISYINDCLNEADSNNAYFVENYFATFGAVNTPTMQRENLFSLVQNAYTEVAALLHSDYPTAKHLAQDKANVAKIKALLDAIKALQHFVKPLLGKGDESDKDERFYGELALLWAELDTVTPLYNMIRNYMTRKPYSQKKIKLNFENPQLLGGWDANKEKDYATIILRRDGLYYLAIMNKESKKLLGKAMPSDGECYEKMVYKLLPGANKMLPKVFFAKSRMEDFKPSKELVEKYNNGTHKKGKNFNIQDCHNLIDYFKQSISKHEDWGKFGFNFSDTSTYEDLSVFYREVEQQGYKLSFARVSVSYISQLVEEGKMYLFQIYNKDFSEYSKGTPNMHTLYWKALFDERNLADVVYKLNGQAEMFYRKKSIENTHPTHPANHPILNKNKDNKKKESLFDYDLIKDRRYTVDKFMFHVPITMNFKSSGSENINQDVKAYLRHADDMHIIGIDRGERHLLYLVVIDLQGNIKEQYSLNEIVNEYNGNTYHTNYHDLLDVREEERLKARQSWQTIENIKELKEGYLSQVIHKITQLMVKYHAIVVLEDLNMGFMRGRQKVEKQVYQKFEKMLIDKLNYLVDKKADAFVSGGLLNAYQLTSKFDSFQKLGKQSGFLFYIPAWNTSKIDPVTGFVNLLDTRYQNVEKAKVFFSKFDAIRYNKDKDWFEFNLDYDKFGKKAEGTKTKWTLCTRGMRIDTFRNKEKNSQWDNHEVDLTAEMKSLLEHYYIDIHGNLKDAISAQTDKVFFTGLLHILKLTLQMRNSITGTETDYLISPVADENGIFYDSRSCGDELPENADANGAYNIARKGLMMIEQIKDAKDLDNLKFDISNKSWLNFAQQKPYKNE

SEQ ID NO: 1595 - protein, 1222 aa, unidentified
  REGION 1..1222: note = Description of Unknown:uncultivated organism sequence
  REGION 1..1222: note = Category: MG75 effectors
  REGION 1..1222: note = Description: MG75-81 effector
MKKLIDEYHKVFIDRVLNDGCLTIENKGKQDSLEEYFESYISKSNDENANKAFKEIQGNLRSLIANKLTKDKGYANLFGKNLIESYKDKDDTKKIIDSDLIQFINTAEPSKLDSMSQDEAKELVKEFRGFTTYFVGFFDNRKNMYTSEEKSTGIAYRLVNENLPKFIDNMEAFKKAIAKPEIQANMEELYSNFAEYLNVESIQEMFKLDYYNMLLTQKQIDVYNAIIGGKTDEDHDVKIKGINEYINLYNQQHKDEKLPKLKALFKQILSDRNAISWLPEEFNSDQDVLNAIKDCYERLSENVLGDKVLKSLLCSLSDYNLNGIFVRNDLQLTDISQKTFGNWSVIQNAIMQNIKNVAPARKRKESEEDYEKRISDIFKKADSFSIQYINDCLNEMDNNNLHAVDGYFATLGAVNTPTMQRENLFALIQNAYTDISDLLDTPYPENKNLAQDKTNVAKVKALLDAIKSLQHFVKPLLGMGDESDKDERFYGELASLWTELDTVTPLYNMIRNYMTRKPYSEKKIKLNFENPQLLGGWDANKEKDYATIILRRNGMYYLAIMDKDSKKLLGKTMPSDGECYEKMVYKLLPGANKMLPKVFFAKSRINDFKPSKKIVENYNNGTHKKGKNFNINDCHDLIDYFKQSIDKHEDWSKFGFNFSDTSTYEDLSGFYREVEQQGYKLSFTNISVSFIDKLVDEGKMYLFQIYNKDFSDYSKGTPNMHTLYWKALFDERNLADVVYKLNGQAEMFYRKKSIDYTHPTHPANHPIQNKNKDNKKKESVFEYDLVKDRRYTVDKFLFHVPINMNFKSVGSENINQQVREYLQQADDTHIIGIDRGERHLLYLVVIDMQGNIKEQFTLNEIVNEYNGNTYRTNYHDLLDTREEERLTARQSWQTIENIKELKEGYLSQVVHKITQLMVKYHAVVVLEDLNKGFMRGRQKVEKQVYQKFEKMLIDKLNYLVDKKADAAQSGGLLNAYQLTSKFDSFQKLGKQSGFLFYIPAWNTSKIDPVTGFVNLLDTRYQNTEKSKAFFSKFDAIRYNADKDWFEFNLDYDKFGTKAEGTRTKWILCTQGNRICRNADKNPQWDNPKIDLTRELKSLFEHYNINICGNLKEEICSQTDKAFFTGLLHILKLTLQMRNSITGTETDYLVSPVADENGVFYDSRSCGDRLPENADANGAYNIARKGLMLIGQIKETKDLANFKYDISNKAWLNFAQQKPYKNE

SEQ ID NO: 1596 - protein, 1245 aa, unidentified
  REGION 1..1245: note = Description of Unknown:uncultivated organism sequence
  REGION 1..1245: note = Category: MG75 effectors
  REGION 1..1245: note = Description: MG75-82 effector
METFSGFTNLYPLSKTLRFRLIPVGETLKYFIGSGILEEDQHRAESYVKVKAIIDDYHRAYIENSLSGFELPLESTGKFNSLEEYYLYHNIRNKTEEIQNLSSKVRTNLRKQVVAQLTKNEIFKRIDKKELIQSDLIDFVKNEPDANEKIALISEFRNFTVYFKGFHENCRNMYSDEEKSTSIAFRLIHENLPKFIDNMEVFAKIQNTSISENFDAIQKELCPELVTLCEMFKLGYFNKTLSQKQIDAYNTVIGGKTTSEGKKIKGLNEYINLYNQQHKQEKLPKMKLLFKQILSDRESASWLPEKFENDSQVVGAIVNFWNTIHDTVLAEGGLKTIIASLGSYGLEGIFLKNDLQLTDISQKATGSWGKISSEIKQKIEVMNPQKKKESYETYQERIDKIFKSYKSFSLAFINECLRGEYKIEDYFLKLGAVNSSSLQKENHFSHILNTYTDVKEVIGLYSESTDTKLIQDNDSIQKIKQFLDAVKDLQAYVKPLLGNGDETGKDERFYGDLIEYWSLLDLITPLYNMVRNYVTQKPYSVDKIKINFQNPTLLNGWDLNKETDNTSVILRRDGKYYLAIMNNKSRKVFLKYPSGTDRNCYEKMEYKLLPGANKMLPKVFFSKSRINEFMPNERLLSNYEKGTHKKSGTCFSLDDCHTLIDFFKKSLDKHEDWKNFGFKFSDTSTYEDMSGFYKEVENQGYKLSFKPIDATYVDQLVDEGKIFLFQIYNKDFSEHSKGTPNMHTLYWKMLFDETNLGDVVYKLNGEAEVFFRKASINVSHPTHPANIPIKKKNLKHKDEERILKYDLIKDKRYTVDQFQFHVPITMNFKADGNGNINQKAIDYLRSASDTHIIGIDRGERNLLYLVVIDGNGKICEQFSLNEIEVEYNGEKYSTNYHDLLNVKENERKQARQSWQSIANIKDLKEGYLSQVIHKISELMVKYNAIVVLEDLNAGFMRGRQKVEKQVYQKFEKKLIEKLNYLVFKKQSSDLPGGLMHAYQLANKFESFNTLGKQSGFLFYIPAWNTSKMDPVTGFVNLFDVKYESVDKAKSFFSKFDSIRYNVERDMFEWKFNYGEFTKKAEGTKTDWTVCSYGNRIITFRNPDKNSQWDNKEINLTENIKLLFERFGIDLSSNLKDEIMQRTEKEFFIELISLFKLVLQMRNSWTGTDIDYLVSPVCNENGEFFDSRNVDETLPQNADANGAYNIARKGMILLDKIKKSNGEKKLALSITNREWLSFAQGCCKNG

SEQ ID NO: 1597 - protein, 1245 aa, unidentified
  REGION 1..1245: note = Description of Unknown:uncultivated organism sequence
  REGION 1..1245: note = Category: MG75 effectors
  REGION 1..1245: note = Description: MG75-83 effector
MGIFSDFTNLYPLSKTLRFKLIPVGETLKHFMDSGILEEDQHRAESYVKVKAIIDDYHRAYIESALAGFELPLESTGKYNSLEEYYMYHSIRNKTEEIQNTLSKIRASLRKQIVGQLVKNEKFKRIDKKELIQDDLIDFVRNDADADEKIGLISEFRNFTVYFKGFHENRKNMYSDEEKSTSIAFRLIHENLPKFIDNMEVFAKIANTSISDDFVAVQKELCPESVTLCEMFKLGYFNKTLSQKQIDAYNTIIGGKTTSDGDKIKGLNEYINLYNQQHRQEKLPKMKLLFKQILSDKESASWLPEKFENDSQVARAILDFWNTIRDTVLAEGGLRTVVSSLGSYCLEGVFLKNDLQLADISQKATGDWGKIAAEIKVKIESTNPQKKKESYEVYQERIDKLFKSYKSFSLAFVNDCLRGEYKIEDYFVRLGAVNTDTLQKENHFARIFNAYTDVKEVLESYANSSDTQLIQDNVSIQKLKQFLDAVKELQAYVKPLLGCGDESGKDERFYGDFVEYWNQLDLITPLYNMVRNYVTRKPYSVEKIKINFQNPTLLNGWDLNKETDNTSVILRRGGKYYLAIMNSKFRKVFLEYPSGVNRDCYEKMEYKLLPGANKMLPKVFFSKSRINEFMPDDELLSNYEKGTHKKSGNCFSLDDCHALIDFFKKSLNKHEDWKNFGFKFSDTSTYTDMSGFYKEVEHQGYKLSFKPVDAGYVDGLVDEGKIFLFQIYNKDFSESSKGTPNLHTLYWRMLFDETNLGDVVYKLNGEAELFFRKASIKVSHPTHPANVPIRKKNPMHKDEERTLKYDLIKDKRYTVDQFQFHVPITMNFKSDGSGNINQKVLEYLRAASDTHIIGIDRGERNLLYLVVIDGNGKICEQFSLNEVKVEYNGEVYSTDYHELLDVKEAERKQARQSWQSIANIKELKEGYLSQVIHKIAEMIVKYHAIVVLEDLNAGFMRGRQKVEKQVYQKFEKMLIEKLNYLVFKKQPSDLPGGLMHAYQLTNKFESFSSLGKQCGFLFYIPAWNTSKMDPVTGFVNLFDVKYESVDKAKSFFSKFESIRYNAERDLFEWKFNYGDFTKKAEGSKSDWTACSYGNRIITYRNPDKNAQWDSKEINLTACIKTLFEKFGIDLSSNLKEAIMQRDEKEFFVELISLFKLVLQIRNSLTGKDIDYLMSPVCNANGDFFDSRKVDESLPQNADANGAYNIARKGMILLDKIRECVGDKKLNLAITNKEWLSFAQGYCKNG

SEQ ID NO: 1598 - protein, 1274 aa, unidentified
  REGION 1..1274: note = Description of Unknown:uncultivated organism sequence
  REGION 1..1274: note = Category: MG75 effectors
  REGION 1..1274: note = Description: MG75-84 effector
MAKNFEDFKRLYPLSKTLRFEAKPIGATLDNIVKSGLLDEDEHRAASYVKVKKLIDEYHKVFIDRVLDNGCLPLEDKGDNNSLAEYYDSYVSKSQNEDAKKAFKEIQQNLRSIIAKKLTDDKAYANLFGNKLIESYKDKADKTKIIDSDLIQFIHTAESTQLDSMSQDEAKELVKEFWGFTTYFVGFFDNRKNMYTAEEKSTGIAYRLINENLPKFIDNMEAFKKAIARPEIQANMEELYSNFSEYLNVESIQEMFLLDYYNMLLTQKQIDVYNAIIGGKTDDEHDVKIKGINEYINLYNQQHKDDKLPKLKALFKQILSDRNAISWLPEEFNSDQEVLNAIKDCYERLAENVLGDKVLKSLLGSLADYSLDGIFIRNDLQLTDISQKMFGNWGVIQNAIMQNIKHVAPARKHKESEEDYEKRIAGIFKKADSFSISYINDCLNEADPNNAYFVENYFATFGAINTPTMQRENLFALVQNAYTEVAALLHSDYPTVKHLAQDKANVSKIKALLDAIKSLQHFVKPLLGKGDESDKDERFYGELASLWAELDTVTPLYNMIRNYMTRKPYSQKKIKLNFENPQLLGGWDANKEKDYATIILRRNGLYYLAIMNKDSKKLLGKAMPSDGECYEKMVYKLLPGANKMLPKVFFAKSRMEDFKPSKELVEKYNNGTHKKGKNFCIQDCHNLIDYFKQSIDKHEDWSKFGFNFSETSTYEDLSGFYREVEQQGYKLSFARVSVSYINQLVEEGKMYLFQIYNKDFSEYSKGTPNMHTLYWKALFAERNLADVVYKLNGQAEMFYRKKSIENTHPTHPANHPILNKNKDNKKKESLFEYNLIKDRRYTVDKFMFHVPITMNFKSSGSENINQDVKAYLRYADDMHIIGIDRGERHLLYLVVIDLQGNIKEQVSLNEIVNDYNGNTYHTNYHDLLDVREDERLKARQSWQAIENIKELKEGYLSQVIHKITQLMVKYHAIVVLEDLNMGFMRGRQKVEKQVYQKFEKMLIDKLNYLVDKKADVSVSGGLLNAYQLTSKFDSFQKMGKQSGFLFYIPAWNTSKIDPITGFVNLLDTRYQNVEKAKVFFSKFDAIRYNKDKDWFEFNLDYDKFGKKAEGTRTKWALCTRGMRIDTFRNKEKNSQWDNQEVDLTAEMKSLLEHYYIDIHGNLKDAISAQTDKAFFTGLLHILKLTLQMRNSITGTETDYLVSPVADENGIFYDSRSCGDELPENADANGAYNIARKGLMMIEQIKEAKDLDNLKFDISNKSWLNFAQQKPYKNG

SEQ ID NO: 1599 - protein, 1272 aa, unidentified
  REGION 1..1272: note = Description of Unknown:uncultivated organism sequence
  REGION 1..1272: note = Category: MG75 effectors
  REGION 1..1272: note = Description: MG75-85 effector
MKFDDFKKLYSLSKTLRFEAKPVGSTLKNIIESGLLEEDEHRAQSYVKVKKLIDEYHKVFIDRVLNDGCLTIENKGKKDSLEEYYESYMSKSNDENVSKTFKEIQENLRSVIAKKLTDNNAYANLFGNKLIESYKDKDEKNKIIDSDLIQFINTAEPSQLDSMSQDEAKELVKEFWGFTTYFVGFFDNRKNMYTSEEKSTGIAYRLVNENLPKFIDNMEAFKKAIAKPEIQTNMEELYSNFAEYLNVESIQEMFQLDYYNMLLTQKQIDVYNAIIGGKTDEEHDIKIKGINEYINLYNQQHKDEKLPKLKALFKQILSDRNAISWLPEEFNSDQEVLNAINDCYKRLSENVLGDKVLKSLLCSLDDYNLDGIFVRNDLQLTDISQKMFGNWSVIQSAIMQNIKNVAPARKRKESEEDYEKRISDIFKKADSFSIQYINDCLNEMDNNNLHAVDGYFATLGAVNTPTMQRENLFALIQNAYTDISNLLETPYPENKNLAQDKTNVAKVKALLDAIKSLQHFVKPLLGKGDESDKDERFYGELASLWTELDTVTPLYNMIRNYMTRKPYSEKKIKLNFENPQLLGGWDANKEKDYATIILRRNGMYYLAIMDKDSKKLLGKTMPSDGECYEKMVYKLLPGANKMLPKVFFAKSRINDFKPSKLIVENYNNGTHKKGKNFNINDCHNLIDYFKQSIDKHEDWSKFGFNFSDTSTYEDLSGFYREVEQQGYKLSFTNVSVSFIDKLVDDGKMYLFQIYNKDFSDFSKGTPNMHTLYWKALFDERNLADVVYKLNGQAEMFYRKKSINNTHPTHPANHPIQNKNKDNKKKESVFEYDLIKDRRYTVDKFLFHVPITMNFKSVGSENINQQVREYLQQADDTHIIGIDRGERHLLYLVVIDMQGNIKEQFTLNEIVNEYNGNTYRTNYHDLLDTREEERLTARQSWQTIENIKELKEGYLSQVIHKITQLMVKYHAVVVLEDLNKGFMRGRQKVEKQVYQKFEKMLIDKLNYLVDKKADAAQSGGLLNAYQLTSKFDSFQKLGKQSGFLFYIPAWNTSKIDPVTGFVNLLDTRYQNTEKAKAFFSRFDAIRYNANKDWFEFYLDYDKFCTKAEGTRTRWTLCTQGSRISTFRNAEKNSQWDNLEVDLTREMKSLFEHYHINICGNLKEEICLQTDKAFFTGLLHMLKLTLQMRNSITGTETDYLISPVADENGTFYDSRSCDATLPKNADANGAYNIARKGLMFIGQIKETKDLANFKYDISNKAWLNFAQQKPYKNE

SEQ ID NO: 1600 - protein, 1319 aa, unidentified
  REGION 1..1319: note = Description of Unknown:uncultivated organism sequence
  REGION 1..1319: note = Category: MG75 effectors
  REGION 1..1319: note = Description: MG75-86 effector
MAKIFEDFKRLYPLSKTLRFDAKPVGATLDNIVKSGLLEEDEHRAASYVRVKKLIDEYHKVFIDRVLDNGCLPLENKGENNSLAEYYDSYVSKSQNEDAKKAFEENQQNLRSIIAKKLTGDKAYANLFGKNLIESYKDKKDKKKIIDSDLIQFINTADSTQLDSMTQVEAKELVKEFWGFVTYFYGFFDNRKNMYTAEKKSTGIAYRLINENLPKFIDNMEAFKKVIARPEIQANMEELYSDFSEYLNVESIQEMFQLDYYDMLLTQKQIDVYNAIIGGKTDDEHDVKIKGINEYINLYNQQHKDTRLPKLKALFKQILSDRNAISWLPEEFNSDQEVLNAIKDCYERLSENVLGDKVLKSLLGSLADYSLEGIFIRNDLQLTDVSQKMFGNWGVIQNAIMQNIKHVAPARKHKESEEEYEKRIAGIFKKADSFSISYLNDCLNEADPNNAYFVENYFATFGAVNTPTMQRENLFALVQNKYTEVAALLHSDYPTAKHLAQDKANVAKIKALLDAIKSLQHFVKPLLGKGDESDKDERFYGELASLWAELETVTPLYNMIRNYMTRKPYSQKKIKLNFENPQLLDGWDANKEKDYATIILRRNGLYYLAIMGKDSKNLLGKAMPSDGECYEKMVYKQFDISKQLPKCTTELKHVRKALVEDAKRSCLLSDFNNWNKPLNVTRKLWELNNFVWDKKKEDWVLRKKDNETRPKKFHKKYLELTSDKKGYNQAKNDWIKFIKEFLSSYKKVEAYDIHYKKRYNSVDELYKQLNGDLYAISFTYVSASFIEQLVSEGKMYLFQIYNKDFSEYSKGTPNMHTLYWKALFDERNLADVVYKLNGQAEMFYRKKSIENTHPTHPANHPILNKNKDNKKKESLFDYDLIKDRRYTVDKFMFHVPITMNFKSSGSENINQDVKAYLRHADDMHIIGIDRGERHLLYLVVIDLQGNIKEQYSLNEIVNEYNGNTYHTNYHDLLDVREEERLKARQSWQTIENIKELKEGYLSQVIHKITQLMVKYHAIVVLEDLNMGFMRGRQKVEKQVYQKFEKMLIDKLNYLVDKKADASVSGGLLNAYQLTSKFDSFQKMGKQSGFLFYIPAWNTSKIDPVTGFVNLLDTRYQNVEKAKVFFSKFDAIRYNKDKDWFEFNLDYDKFGKKAEGTRTKWALCTRGMRIDTFRNKEKNSQWDNQEVDLTAEMKSLLEHYYIDIHGNLKDAISAQTDKTFFTGLLHILKLTLQMRNSITGTETDYLVSPVADENGIFYDSRSCGDELPENADANGAYNIARKGLMMIEQIKDAKDLNNLKFDISNKAWLNFAQQKPYKNG

SEQ ID NO: 1601 - protein, 1274 aa, unidentified
  REGION 1..1274: note = Description of Unknown:uncultivated organism sequence
  REGION 1..1274: note = Category: MG75 effectors
  REGION 1..1274: note = Description: MG75-87 effector
MAKIFEDFKRLYPLSKTLRFEAKPIGATLDNMVKSGLLDEDEHRAASYVKVKKLIDEYHKVFIDRVLDNGCLPLKNEGHNNSLTEYYESYVTKSQNEDAKKVFKEIQQNLRSIIAKKLTEDKAYANLFGKNLIESYKDKTDKTKIIDSDLIKFINTAESTQLDSMSQDEAKELVKEFWGFTTYFVGFYDNRKNMYTAEEKSTGIAYRLVNENLPKFIDNMEAFKKAIARPEIQANMEELYSDFSEYLNVESVQEMFQLDYYNMLLTQKQIDVYNAIIGGKTDDEHDVKIKGINEYINLYNQQHKDDKLPKLKALFKQILSDRNAISWLPEEFNGDQEVLNAIKDCYERLSENVLGDKVLKSLLGSLADYSLEGIFIRNDLQLTDVSQKMFGNWGVIQNAIIQNIKHVAPARKHKESEEEYEKRIAGIFKKADSFSISYINDCLNEADPNNAYFVENYFATQGAVDTPTMQRENLFALVQNAYTEVAALLHSDYPTAKNLAQDKADVAKIKALLDAIKSLQHFVKPLLGKGDESDKDERFYGELTSLWSELDTVTPLYNMIRNYMTRKPYSQKKIKLNFENPQLLGGWDANKEKDYATIILRRNGLYYLAIMNKDSKKLLGKAMPSDGECYEKMVYKLLPGANKMLPKVFFTKSRMGDFKPSKELIEKYNNGTHKKGKNFNIQDCHNLIDYFKQSISKHEDWGKFGFNFSDTSTYEDLSGFYREVEQQGYKLSFARVSVSYISQLVEEGKMYLFQIYNKDFSEYSKGTPNMHTLYWKALFDECNLADVVYKLNGQAEMFYRKKSIENTHPTHPANHPIQNKNKDNKKKESLFDYDLIKDRRYTVDKFMFHVPITMNFKSSGSENINQDVKAYLRHADDMHIIGIDRGERHLLYLVVIDLQGNIKEQFSLNEIVNEYNGNTYHTNYHDLLDVREEERLKARQSWQTIENIKELKEGYLSQVIHKITQLMVKYHAIVVLEDLNMGFMRGRQKVEKQVYQKFEKMLIDKLNYLVDKKADASVSGGLLNAYQLTSKFDSFQKLGKQSGFLFYIPAWNTSKIDPITGFVNLLDTRYQNVEKAKVFFSKFDAIRYNKDKDWFEFNLDYDKFGKKAEGTRTKWTLCTRGMRIDTFRNKEKNSQWDNQEVDLTAEMKSLLEHYYIDIHGNLKDAISAQTDKAFFTGLLHILKLTLQMRNSITGTETDYLVSPVADENGIFYDSRSCGDELPENADANGAYNIARKGLMMIEQIKDAKDLDNLKFDISNKSWLNFAQQKPYKNE

SEQ ID NO: 1602 - protein, 1274 aa, unidentified
  REGION 1..1274: note = Description of Unknown:uncultivated organism sequence
  REGION 1..1274: note = Category: MG75 effectors
  REGION 1..1274: note = Description: MG75-88 effector
MAKIFEDFKRLYPLSKTLRFEAKPIGATLDNMVKSGLLDEDEHRAASYVKVKKLIDEYHKVFIDRVLDNGCLPLKNEGHNNSLTEYYESYVTKSQNEDAKKVFKEIQQNLRSIIAKKLTEDKAYANLFGKNLIESYKDKTDKTKIIDSDLIKFINTAESTQLDSMSQDEAKELVKEFWGFTTYFVGFYDNRKNMYTAEEKSTGIAYRLVNENLPKFIDNMEAFKKAIARPEIQANMEELYSDFSEYLNVESVQEMFQLDYYNMLLTQKQIDVYNAIIGGKTDDEHDVKIKGINEYINLYNQQHKDDKLPKLKALFKQILSDRNAISWLPEEFNGDQEVLNAIKDCYERLSENVLGDKVLKSLLGSLADYSLEGIFIRNDLQLTDVSQKMFGNWGVIQNAIIQNIKHVAPARKHKESEEEYEKRIAGIFKKADSFSISYINDCLNEADPNNAYFVENYFATQGAVDTPTMQRENLFALVQNAYTEVAALLHSDYPTAKNLAQDKADVAKIKALLDAIKSLQHFVKPLLGKGDESDKDERFYGELTSLWSELDTVTPLYNMIRNYMTRKPYSQKKIKLNFENPQLLGGWDANKEKDYATIILRRNGLYYLAIMNKDSKKLLGKAMPSDGECYEKMVYKLLPGANKMLPKVFFAKSRMGDFKPSKELIEKYNNGTHKKGKNFNIQDCHNLIDYFKQSISKHEDWGKFGFNFSDTSTYEDLSGFYREVEQQGYKLSFARVSVSYISQLVEEGKMYLFQIYNKDFSEYSKGTPNMHTLYWKALFDECNLADVVYKLNGQAEMFYRKKSIENTHPTHPANHPIQNKNKDNKKKESLFDYDLIKDRRYTVDKFMFHVPITMNFKSSGSENINQDVKAYLRHADDMHIIGIDRGERHLLYLVVIDLQGNIKEQFSLNEIVNEYNGNTYHTNYHDLLDVREEERLKARQSWQTIENIKELKEGYLSQVIHKITQLMVKYHAIVVLEDLNMGFMRGRQKVEKQVYQKFEKMLIDKLNYLVDKKADASVSGGLLNAYQLTSKFDSFQKLGKQSGFLFYIPAWNTSKIDPITGFVNLLDTRYQNVEKAKVFFSKFDAIRYNKDKDWFEFNLDYDKFGKKAEGTRTKWTLCTRGMRIDTFRNKEKNSQWDNQEVDLTAEMKSLLEHYYIDIHGNLKDAISAQTDKAFFTGLLHILKLTLQMRNSITGTETDYLVSPVADENGIFYDSRSCGDELPENADANGAYNIARKGLMMIEQIKDAKDLDNLKFDISNKSWLNFAQQKPYKNE

SEQ ID NO: 1603 - protein, 1271 aa, unidentified
  REGION 1..1271: note = Description of Unknown:uncultivated organism sequence
  REGION 1..1271: note = Category: MG75 effectors
  REGION 1..1271: note = Description: MG75-89 effector
MEFNDFKRLYPLSKTLRFEAKPIGSTLNNIIKSGLLEEDEHRAQSYVKVKKLIDEYHKVFIDRVLDDGCLTIENKDKKNSLEEYYESYMSKSNDENVSKTFKEIQENLRSVIAKKLTDDNAYANLFGNKLIESYKDKDDKKKIIDSDLIQFINTAEPSQLDSMSQDEAKELVKEFWGFTTYFVGFFDNRKNMYTSEEKSTGIAYRLVNENLPKFIDNMEAFKKAIAKPEIQANMGELYSNFAEYLNVESIQEMFQLDYYNMLLTQKQIDVYNAIIGGKTDEDHDVKIKGINEYINLYNQQHKDEKLPKLKALFKQILSDRNAISWLPEEFNSDKEVLNAIKDCYERLSENVLGDKVLKSLLCSLSDYNLNGIFVRNDLQLTDISQKMFGNWSVIQNAIMQNIKNVAPARKRKESEEDYEKRISDIFKKADSFSIQYINDCLNEMDNNNLHAVDGYFATLGAVNTPTMQRENLFALIQNAYTDISDLLDTPYPENKNLAQDKTNVAKVKALLDAIKSLQHFVKPLLGMGDESDKDERFYGELASLWTELDTVTPLYNMIRNYMTRKPYSEKKIKLNFENPQLLGGWDANKEKDYATIILRRNGMYYLAIMDKDSKKLLGKTMPSDGECYEKMVYKLLPGANKMLPKVFFAKSRINDFKPSKKIVENYNNGTHKKGKNFNINDCHDLIDYFKQSIDKHEDWSKFGFNFSDTSTYEDLSGFYREVEQQGYKLSFTNVSASFIDKLVDEGKMYLFQIYNKDFSDYSKGTPNMHTLYWKALFDERNLADVVYKLNGQAEMFYRKKSIDYTHPTHPANHPIQNKNKDNKKKESVFEYDLVKDRRYTVDKFLFHVPITMNFKSVGSENINQQVREYLQQADDTHIIGIDRGERHLLYLVVIDMQGNIKEQFTLNEIVNEYNGNTYRTNYHDLLDTREEERLTARQSWQTIENIKELKEGYLSQVVHKITQLMVKYHAVVVLEDLNKGFMRGRQKVEKQVYQKFEKMLIDKLNYLVDKKADATQSGGLLNAYQLTSKFDSFQKLGKQSGFLFYIPAWNTSKIDPVTGFVNLLDTRYLNTEKAKAFFSKFDAIRYNADKDWFEFNLDYDKFGTKAEGTRTTWTLCTQGNRICTFRNAEKNSQWDNQEIDLTREMKSLFEHYHINICGNLKEEICSQTDKAFFTGLLHILKLTLQMRNSITGTETDYLVSPVADENGVFYDSRSCGDTLPKNADANGAYNIARKGLMLIGQIKETKDLANFKYDISNKAWLNFAQQKPYKK

SEQ ID NO: 1604 - protein, 1264 aa, unidentified
  REGION 1..1264: note = Description of Unknown:uncultivated organism sequence
  REGION 1..1264: note = Category: MG75 effectors
  REGION 1..1264: note = Description: MG75-90 effector
MNFEQFTHLYPLSKTLRFELRPVGATLARIKEGGFLENDNHRAESYKKVKKLIDEYHKHFIEQALGDFSLTENETEGSKCLNSYLETYIQLYRSSRIEDAEKKAFEKVQAEMRKLIAKTLKGSEAYKRLFKQELIKEDLTAFLRTHGGTVADEELVEEFKNFTTYFTGFYENRENMYSEEEKSTAISNRLVNENLPKFVDNMAAFAIIAQVPEVRAMLDVMQKDLGAELDGTTIDELFTLPFFNKVLTQKQIAVYNAVIGGKVRDSHSKGESHIKGINQIVNLYNQQHKDARLPKLKMLYKQILSDREALSWLPEKFDKDADLLKAIHDGYERLASDGVLENLRTLLESMADYQAEGIFITNDQQLTRISQKMFGEWSFISEAILCVLKKEVPQKRNECDEKYEERIDKMLKNHGGFSIRFIDDCVAAYVNTLDDEEQKKRFIPTVEAYFATLGAFDTEEEQTVNFFSRIQNARDALQGLLDSAYPEGRALIQDKENGALLKELLDAILALMHFVKPLLGKNENGKDERFYGELMQIWDEFDSFVPLYNMSRNYLTQKPYSEEKYKLNFENSQLLKGWDLNKEADNTSIILRKDGLFYLAIMNKKHNKLFARELPADGDCYDKMDYKLLPGPNKMFPKVFFSKSRIAEFAPSEHIMDVYRKGSFKKGDTFNLQDCHDLIDFFKASILKHEDWRQFEFKFSETEQYDDISGFYREVEAQGYKVTFRQVSVSYIDRLVNEGKLYLFQIYNKDFSSYSKGTPNMHTLYWRALFDERNLSDVVYKLNGEAEVFYRKKSIEAHPTHPANRPIKNKNKLNDKVESLFAYDLIKDRRYSEDKFSLHVPITMNFKSIGGPNINDDVVEFLRTNENLHFIGIDRGERHLLYLTVIDSHGHILEQRTLNDVVNNYQGKDYHTDYHDLLETRERQRQEARSSWKAIENIKDLKEGYLAQVVHQIAQLMVKYHAIVVLEDLNGGFMRGRQKVERSVYQQFEKKLIDKLNYLVDKKTDAHAPGGLMNAYQLANQFKSFKSMGRQSGFIFYIPAWNTSKIDPVTGFTNLFDTRYKNVHDAQQFFSMFKSIRYNETADRFEFRFSYSDFTRKAEGSRTDWTVCTYGTRIKTFRDPQKNNEWTSKEVVLTEEFKKFFASYGVDIHSNLKDSIAAHDEKAFFEQLLALMRLTLQIRNSKSGTDVDYLLSPVADENGVFFDSRSCGNSLPQDADANGAYNIARKGLMLVRQMREAKDLKKFKADMTNRNWLKFAQEKPYLND

SEQ ID NO: 1605 - protein, 1246 aa, unidentified
  REGION 1..1246: note = Description of Unknown:uncultivated organism sequence
  REGION 1..1246: note = Category: MG75 effectors
  REGION 1..1246: note = Description: MG75-91 effector
MMETFSDFTNLYPLSKTLRFRLIPVGKTLRHFIDSGILEEDQHRAESYVKVKAIIDDYHRSYIESSLSAFELPVESMGKSNSLEEYYLYHNIRNKTEDIQNALSKVRNNLRKQIVAQLTKNEMFKRIDKKELIQNDLIDFVKNEPDANEKIALISEFRNFTVYFKGFHENRKNMYSDEEKSTSIAFRLIHENLPKFIDNMEVFAKIQNTSISEKFDAIQKELCPDSVAFVDMFKLGYFNRTLSQRQIDAYNTVISGRTTAEGEKIKGLNEYINLYNQQHKQEKLPKMKLLFKQILSDRESASWLPEKLENDKQVVGALVDFWNAIHDTVLAEGGLKTVISSLVSYSLEGIFLKNDLQLTDVSQKATGSWSKIPAAIKQKLEAMNPQKKKESYEGYQERIDKIFKSYKSFSLAFINECLHGEYKIEDYFIKLGAINTDLLQKENHFSHILNTYTDIKEVIESYSESTDTKLIRDNGSIQKIKQFLDAVKDLQSYVKPLLGNGDETGKDERFYGDFVEYWNQLDLITPLYNMVRNYVTQKNYSIEKIKINFQNPTLLNGWDLNKETDNTSVILRRDGKYYLAIMNSKFRKVFLKYPSGSDRNCYEKMEYKLLPGANKMLPKVFFSKSRIQEFMPDERLLSNYEKGTHKKTGNCFSLTDCHALIDFFKKSLNKHEDWKNFGFKFSNTSTYTDMSGFYKEVENQGYKLSFKPVDAVYVDQLVDEGKIFLFQIYNKDFSEHSKGTPNMHTLYWKMLFDETNLGDVVYKLNGEAEVFFRKASIKVSSPTHPANVPIKKKNPKHKDEERLLKYDLIKDKRYTVDQFQFHVPITMNFKSDGNGNINQKVVEYLRSASNIHIIGIDRGERNLLYLVVIDGSGKICEQFSLNEIKVEHNGETYSTNYHDLLDIKENERKQARQSWQSIANIKELKEGYLSQVIHKISELMVKYNAIVVLEDLNTGFMRGRQKVEKQVYQKFEKMLIEKLNYLVFKKQPSDSCGGLMHAYQLTNKFEGFNKLGKQSGFLFYIPAWNTSKMDPMTGFVNLFDLKYESIDKAKSFFSKFDSIRYNVERDMFEWKFNYDEFTKKAEGTKTNWTVCSYGNRIITFRNPNKNSQWDNKEINLTENIKLLFERFGIDLSSNLKDEIMQRTEKEFFIELISLFKLVLQMRNSWTGTDIDYLVSPVCNEKGEFFDSRNVDKALPQNADANGAYNIARKGLILLDRIKESTSDKKLNFSITNKEWLSFVQGCCKNG

SEQ ID NO: 1606 - protein, 1274 aa, unidentified
  REGION 1..1274: note = Description of Unknown:uncultivated organism sequence
  REGION 1..1274: note = Category: MG75 effectors
  REGION 1..1274: note = Description: MG75-92 effector
MAKIFEDFKRLYPLSKTLRFEAKPIGATLDNIIKSGLLDEDEHRAASYVRVKKLIDEYHKVFIDRVLDNGCLPLKNEGHNNSLTEYYESYVTKSQNEDAKKVFKEIQQNLRSIIAKKLTEDKAYANLFGKNLIESYKDKTDKTKIIDSDLIKFINTAESTQLDSMSQDEAKELVKEFWGFTTYFVGFYDNRKNMYTAEEKSTGIAYRLVNENLPKFIDNMEAFKKAIARPEIQANMEELYSDFSEYLNVESVQEMFQLDYYNMLLTQKQIDVYNAIIGGKTDDEHDVKIKGINEYINLYNQQHKDDKLPKLKALFKQILSDRNAISWLPEEFNGDQEVLNAIKDCYERLSENVLGDKVLKSLLGSLADYSLDGIFIRNDLQLTDISQKMFGNWGVIQNAIMQNIKHVAPARKHKESEEDYEKRIAGIFKKADSFSISYINDCLNEADPNNAYFVENYFATFGAVNTPTMQRENLFALIQNAYTEVAALLHSDYPIAKHLAQDKANVAKIKALLDAIKSLQHFVKPLLGKGDESDKDERFYGELASLWAELDMVTPLYNMIRNYMTRKPYSQKKIKLNFENPQLLGGWDANKEKDYATIILRRDGLYYLAIMNKESKKLLGKAMPSDGECYEKMVYKLLPGANKMLPKVFFAKSRMEDFKPSKELVEKYNNGTHKKGKNFNIQDCHNLIDYFKQSISKHEDWGKFGFNFSDTSTYEDLSGFYREVEQQGYKLSFARVSVSYISQLVEEGKMYLFQIYNKDFSEYSKGTPNMHTLYWKALFDERNLADVVYKLNGQAEMFYRKKSIENTHPTHPANHPILNKNKDNKKKESLFDYDLIKDRRYTVDKFMFHVPITMNFKSSGSENINQDVKAYLRHTDDMHIIGIDRGERHLLYLVVIDLQGNIKEQYSLNEIVNEYNGNTYHTNYHDLLDVREEERLKARQSWQTIENIKELKEGYLSQVIHKITQLMVKYHAIVVLEDLNMGFMRGRQKVEKQVYQKFEKMLIDKLNYLVDKKADASVSGGLLNAYQLTSKFDSFQKLGKQSGFLFYIPAWNTSKIDPVTGFVNLLDTRYQNVEKAKVFFSKFDAIRYNKDKDWFEFNLDYDKFGKKAEGTRTKWTLCTRGMRIDTFRNKEKNSQWDNQEVDLTAEMKSLLEHYYIDIHGNLKDAISAQTDKAFFTGLLHILKLTLQMRNSITGTETDYLVSPVADENGIFYDSRSCGDELPENADANGAYNIARKGLMLIEQIKEAKDLDNLKFDISNKSWLNFAQQKPYKNE

SEQ ID NO: 1607 - protein, 1264 aa, unidentified
  REGION 1..1264: note = Description of Unknown:uncultivated organism sequence
  REGION 1..1264: note = Category: MG75 effectors
  REGION 1..1264: note = Description: MG75-93 effector
MNFEQFTHLYPLSKTLRFELRPVGATLAKIKEGGFLENDNHRAESYKKVKKLIDEYHKHFIEQALGDFSLTENETEGSKCLNSYLETYIQLYRSSRIEDAEKKAFEKVQAEMRKFIAKTLKGSEAYKRLFKQELIKEDLTAFLRTHGGTVADEELVEEFKNFTTYFTGFYENRENMYSEEEKSTAISYRLVNENLPKFVDNMAAFAIIAQVPEVRAMLDVMQKDLGAELDGTTIDELFTLPFFNKVLTQKQIAVYNAVIGGKVSDSHSKGESHIKGINQIVNLYNQQHKDARLPKLKMLYKQILSDREALSWLPEKFDKDADLLKAIHDGYERLASDGVLENLRTLLESMADYQAEGIFITNDQQLTRISQKMFGEWSFISEAILCALKKDVPQKRNECDEKYEERIDKMLKNHGGFSIRFIDDCVAAYVNTLDDEEQKKRFIPTVEAYFATLGAFDTEEEQTVNFFSRIQNARDALQGLLDSAYPEGRALIQDKENGALLKELLDAILALMHFVKPLLGKNENGKDERFYGELMQIWDEFDSFVPLYNMSRNYLTQKPYSEEKYKLNFENSQLLKGWDLNKEADNTSIILRKDGLFYLAIMNKKHNKLFARELPTDGDCYEKMDYKLLPGPNKMFPKVFFSKSRKAEFAPSEHIMDIYKKGSFKKGETFNLQDCHDLIDFFKASILKHEDWRQFEFKFSETEQYDDISGFYREVEAQGYKVTFRQVSVSYIDRLVNEGKLYLFQIYNKDFSSYSKGTPNMHTLYWRALFDERNLSDVVYKLNGEAEVFYRKKSIEAHPTHPANRPIKNKNKLNDKEKSLFAYDLIKDRRYSEDKFSLHVPITMNFKSVGGPNINDDVVEFLRTNENLHFIGIDRGERHLLYLTVIDSHGHILEQRTLNDVVNNYQGKDYHTDYHDLLETRERQRQEARSSWKAIENIKDLKEGYLAQVVHQIAQLMVKYHAIVVLEDLNGGFMRGRQKVERSVYQQFEKKLIDKLNYLVDKKTDAHAPGGLMNAYQLANQFKSFKSMGRQSGFIFYIPAWNTSKIDPVTGFTNLFDTRYKNVHDAQQFFSAFKSIRYNETADRFEFKFSYSDFTRKAEGSRTDWTVCTYGTRIKTFRDPQKNNEWTSKEVVLTEEFKKFFAAYHVDIHSNLKDSIAAHDEKAFFEQLLALMRLTLQIRNSKSGTDVDYLLSPVADENGVFFDSRSCGNSLPQDADANGAYNIARKGLMLVRQMREAKDLKKFKADMTNRNWLKFAQEKPYLND

SEQ ID NO: 1608 - protein, 1321 aa, unidentified
  REGION 1..1321: note = Description of Unknown:uncultivated organism sequence
  REGION 1..1321: note = Category: MG75 effectors
  REGION 1..1321: note = Description: MG75-94 effector
MEFDDFKRLYPLSKTLRFEAKPIGATLKNIIKSGLLEEDEHRAQSYVKVKKLIDEYHKAFIDRVLNEGCLTIENKGNKDSLEEYYESYMSKSNDENVSKTFKDIQENLRSVIANKLTKDKGYANLFGNKLIESYKDKDDTKKIIDSDLIQFINTAEPSKLDSMSQDEAKELVKEFWGFTTYFEGFHKNRKNMYTSEEKSTGIAYRLVNENLPKFIDNMEAFKKAIAKPEIQANMEELYSNFAEYLNVESIQEMFQLDYYNMLLTQKQIDVYNAIIGGKTDEENDVNIKGINQYINIYNQHHKDEKLPKLKALFKQILSDRNAISWLPEEFNSDQDVLNAIKDCYERLSENVLGDKVLKSLLCSLSDYNLNGIFVRNDLQLTDISQKMFGNWNVIQNAIMQNFFFKKVAPARKRKESEEDYEKRISDIFKKTDSFSIQYINDCLNEMDDNNLHAVDGYFATLGAVNTPTMQRENLFALIQNAYTDISDLLDTPYPENKNLAQDKTNVAKVKALLDAIKSLQHFVKPLLGKGDESDKDERFYGELASLWTELDTVTLLFNMVHNYMTRKPYSQKKIKLNYKNTQLLAGWDANKEKEHAAIILRRNGMYYLAIMDKDSKNLLDKAMPSDGECYEKMVYKQFDISKQLPKCTTELKRVRKALVEDAKRSCLLSDSKDWNKPLNVTRKLWELNNYVWDKKKADWVLRKKENETRPKKFHKKYLELTSDKKGYNQAKNDWIKFTKEFLSSYKKVEDYDIHYKKRYNSVDELYKQLNSDFYTISFTYVSVSFIDKLVNEGKMYLFKIYNKDFSNYSKGTPNMHTLYWKALFDERNLADVVYKLNGEAEMFYRKKSINNTHPTHPANHPIQNKNKDNKKKESVFEYDLVKDYRYTEDKFLFHVPITMNFKSVGSENINQQVKEYLQQADDTHIIGIDRGERHLLYLVVIDMEGNIKEQFSLNEIVNEYNGNTYRTNYHDLLDVCADKRLKASQSWQTIENIKELKEGYLSQAIHKITQLMVKYHAVVVLEDLNKGFMRGRQKVEKQVYQKFEKMLIDKLNYLVDKKADAAQSGGLLNAYQLTSKFDSFQKLGKQSGFLFYIPAWNTSKIDPVTGFVNLFDTRYTNADKALEFFSKFDAIRYNEEKDWFEFEFDYDKFTQKAHGTRTKWTLCTYGMRLRSFKNPAKQYNWDSEVVALTDEFKRILGEAGIDIHENLKDAICNLEGKRRKYLEPLMQFMKLLLQLRNSRKNPEEDYILSPVADENGVFYDSRSCGDKLPENADANGAYNIARKGLMLIRQIKEAKEFGKVKYDISNKAWLNFAQQKPYKNE

SEQ ID NO: 1609 - protein, 1027 aa, unidentified
  REGION 1..1027: note = Description of Unknown:uncultivated organism sequence
  REGION 1..1027: note = Category: MG75 effectors
  REGION 1..1027: note = Description: MG75-95 effector
MAKNFEDFKRLYSLSKTLRFEAKPIGATLDNIVKSGLLDEDEHRAASYVKVKKLIDEYHKVFIDRVLDDGCLPLENKGNNNSLAEYYESYVSRAQDEDAKKKFKEIQQNLRSVIAKKLTEDKAYANLFGNKLIESYKDKEDKKKIIDSDLIQFINTAESTQLDSMSQDEAKELVKEFWGFVTYFYGFFDNRKNMYTAEEKSTGIAYRLVNENLPKFIDNIEAFNRAITRPEIQENMGVLYSDFSEYLNVESIQEMFQLDYYNMLLTQKQIDVYNAIIGGKTDDEHDVKIKGINEYINLYNQKHKDDKLPKLKSLFKQILSDRNAISWLPEEFNSDQEVLNAIKDCYERLSENVLGDKVLKSMLGSLADYSLDGIFIRNDLQLTDISQKMFGNWSVIQNAIMQNIKHVAPARKHKESEEEYENRIAGIFKKADSFSISYIDACLNETDPNNAYFVENYFATLGAVDTPTMQRENLFALVQNAYTEITALLHSDYPTEKTLAQDKANVAKIKALLDAIKSLQHFVKPLLGKGDESDKDERFYGELASLWAELDTMTPLYNMIRNYMTRKPYSQKKIKLNFENPQLLGGWDANKEKDYATIILRRNGLYYLAIMNKDSKKLLGKAMPSDGECYEKMVYKLLPGANKMLPKVFFAKSRMEDFKPSKELVEKYNNGTHKKGKNFNIQDCHNLIDYFKQSIDKHEDWSKFGFKFSDTSTYEDLSGFYREAEQQGYKLSFARVSVSYINQLVEEGKMYLFQIYNKDFSEYSKGTPNMHTLYWKALFDERNLADVVYKLNGQAEMFYRKKSIENTHPTHPANHPILNKNKDNNKKESLFEYDLIKDRRYTVDKFMFHVPITMNFKSSGSENINQDVKAYLCHADDMHIIGIDRGERHLLYLVVIDLQGNIKEQFSLNEIVNDYNGNTYHTNYHDLLDVREDERLKARQSWQTIENIKELKEGYLSQVIHKITQLMVKYHAIVVLEDLNMGFMRGRQKVEKQVYQKFEKMLIEKLNYLVDKKADASVSGGLLNAYQ

SEQ ID NO: 1610 - protein, 1274 aa, unidentified
  REGION 1..1274: note = Description of Unknown:uncultivated organism sequence
  REGION 1..1274: note = Category: MG75 effectors
  REGION 1..1274: note = Description: MG75-96 effector
MAKNFEDFKRLYPLSKTLRFEAKPIGATLDNIVKSGLLEEDEHRAASYVKVKKLIDEYHKVFIDRVLADGCLPLENEGHNNSLAEYYDSYVSKSQNEDAKKAFEENQQNLRSIIAKKLTEDKAYANLFGKNLIESYKDKTDKTKIIDSDLIQFINTAESTQLNSMSQDEAKELVKEFWGFTTYFVGFFDNRKNMYTAEEKSTGIAYRLINENLPKFIDNMEAFKKAIARPEIQANMEELYSNFSEYLNVESIQEMFLLDYYNMLLTQKQIDVYNAIIGGKTDDEHDVKIKGINEYINLYNQQHKDDKLPKLKALFKQILSDRNVISWLPEEFNSDQEVLNAIKDCYERLSDNVLGDKVLKSLLGSLADYSLDGIFIRNDLQLTDISQKMFGNWGVIQNAIMQNIKHVAPARKHKESEEDYEKRIAGIFKKADSFSISYINDCLNEADSNNAYFVENYFATFGAVNTPTMQRENLFSLVQNAYTEVAALLHSDYPTAKHLAQDKANVAKIKALLDAIKSLLHFVKPLLGKGDESNKDERFYGELASLWAELDTVTPLYNMIRNYMTRKPYSQKKIKLNFENPQLLGGWDANKEKDYATIILRRDGLYYLAIMNKESKKLLGKAMPSDGECYEKMVYKLLPGANKMLPKVFFAKSRMEDFKPSKELVEKYNNGTHKKGKNFNIQDCHNLIDYFKQSISKHEDWGKFGFNFSDTSTYEDLSGFYREVEQQGYKLSFARVSVSYISQLVEEGKMYLFQIYNKDFSEYSKGTPNMHTLYWKALFDERNLADVVYKLNGQAEMFYRKKSIENTHPTHPANHPILNKNKDNKKKESLFDYDLIKDRRYTVDKFMFHVPITMNFKSSGSENINQDVKAYLRHADDMHIIGIDRGERHLLYLVVIDLQGNIKEQYSLNEIVNEYNGNTYHTNYHDLLDVREDERLKARQSWQTIENIKELKEGYLSQVIHKITQLMVKYHAIVVLEDLNKGFMRGRQKVEKQVYQKFEKMLIDKLNYLVDKKADASVSGGLLNAYQLTSKFDSFQKLGKQSGFLFYIPAWNTSKIDPITGFVNLLDTRYQNVEKAKVFFSKFDAIRYNKDKDWFEFNLDYDKFGKKAEGTRTKWTLCTRGMRIDTFRNKEKNSQWDNHEVDLTAEMKSLLEHYYIDIHGNLKDAISAQTDKAFFTGLLHILKLTLQMRNSITGTETDYLVSPVADENGIFYDSRSCGDELPENADANGAYNIARKGLMMIEQIKEAKDLDNLKFDISNKSWLNFAQQKPYKNG

SEQ ID NO: 1611 - protein, 772 aa, unidentified
  REGION 1..772: note = Description of Unknown:uncultivated organism sequence
  REGION 1..772: note = Category: MG75 effectors
  REGION 1..772: note = Description: MG75-97 effector
MEFNDFKRLYPLSKTLRFEAKPIGSTLNNIIKSGLLEEDEHRAQSYVKVKKLIDEYHKVFIDRVLDDGCLTIENKDKKNSLEEYYESYMSKSNDENVSKTFKEIQENLRSVIAKKLTDDNAYANLFGNKLIESYKDKDDKKKIIDSDLIQFINTAEPSQLDSMSQDEAKELVKEFWGFTTYFVGFFDNRKNMYTSEEKSTGIAYRLVNENLPKFIDNMEAFKKAIAKPEIQANMGELYSNFAEYLNVESIQEMFQLDYYNMLLTQKQIDVYNAIIGGKTDEDHDVKIKGINEYINLYNQQHKDEKLPKLKALFKQILSDRNAISWLPEEFNSDKEVLNAIKDCYERLSENVLGDKVLKSLLCSLSDYNLNGIFVRNDLQLTDISQKMFGNWSVIQNAIMQNIKNVAPARKRKESEEDYEKRISDIFKKADSFSIQYINDCLNEMDNNNLHAVDGYFATLGAVNTPTMQRENLFALIQNAYTDISDLLDTPYPENKNLAQDKTNVAKVKALLDAIKSLQHFVKPLLGMGDESDKDERFYGELASLWTELDTVTPLYNMIRNYMTRKPYSEKKIKLNFENPQLLGGWDANKEKDYATIILRRNGMYYLAIMDKDSKKLLGKTMPSDGECYEKMVYKLLPGANKMLPKVFFAKSRINDFKPSKKIVENYNNGTHKKGKNFNINDCHDLIDYFKQSIDKHEDWSKFGFNFSDTSTYEDLSGFYREVEQQGYKLSFTNVSASFIDKLVDEGKMYLFQIYNKDFSDYSKGTPNMHTLY

SEQ ID NO: 1612 - protein, 1272 aa, unidentified
  REGION 1..1272: note = Description of Unknown:uncultivated organism sequence
  REGION 1..1272: note = Category: MG75 effectors
  REGION 1..1272: note = Description: MG75-98 effector
MEFNDFKRLYPLSKTLRFEAKPIGSTLNNIIKSGLLEEDEHRAQSYVKVKKLIDEYHKVFIDRVLDDGCLTIENKDKKNSLEEYYESYMSKSNDENVSKTFKEIQENLRSVIAKKLTDDNAYANLFGNKLIESYKDKDDKKKIIDSDLIQFINTAEPSQLDSMSQDEAKELVKEFWGFTTYFVGFFDNRKNMYTSEEKSTGIAYRLVNENLPKFIDNMEAFKKAIAKPEIQANMGELYSNFAEYLNVESIQEMFQLDYYNMLLTQKQIDVYNAIIGGKTDEDHDVKIKGINEYINLYNQQHKDEKLPKLKALFKQILSDRNAISWLPEEFNSDKEVLNAIKDCYERLSENVLGDKVLKSLLCSLSDYNLNGIFVRNDLQLTDISQKMFGNWSVIQNAIMQNIKNVAPARKRKESEEDYEKRISDIFKKADSFSIQYINDCLNEMDNNNLHAVDGYFATLGAVNTPTMQRENLFALIQNAYTDISDLLDTPYPENKNLAQDKTNVAKVKALLDAIKSLQHFVKPLLGMGDESDKDERFYGELASLWTELDTVTPLYNMIRNYMTRKPYSEKKIKLNFENPQLLGGWDANKEKDYATIILRRNGMYYLAIMDKDSKKLLGKTMPSDGECYEKMVYKLLPGANKMLPKVFFAKSRINDFKPSKKIVENYNNGTHKKGKNFNINDCHDLIDYFKQSIDKHEDWSKFGFNFSDTSTYEDLSGFYREVEQQGYKLSFTNVSASFIDKLVDEGKMYLFQIYNKDFSDYSKGTPNMHTLYWKALFDERNLADVVYKLNGQAEMFYRKKSIDYTHPTHPANHPIQNKNKDNKKKESVFEYDLVKDRRYTVDKFLFHVPITMNFKSVGSENINQQVREYLQQADDTHIIGIDRGERHLLYLVVIDMQGNIKEQFTLNEIVNEYNGNTYRTNYHDLLDTREEERLTARQSWQTIENIKELKEGYLSQVVHKITQLMVKYHAVVVLEDLNKGFMRGRQKVEKQVYQKFEKMLIDKLNYLVDKKADATQSGGLLNAYQLTSKFDSFQKLGKQSGFLFYIPAWNTSKIDPVTGFVNLLDTRYLNTEKAKAFFSKFDAIRYNADKDWFEFNLDYDKFGTKAEDTRTTWTLCTQGNRICTFRNAEKNSQWDNQEIDLTREMKSLFEHYHINICGNLKEEICSQTDKAFFTGLLHILKLTLQMRNSITGTETDYLVSPVADENGVFYDSRSCGDMLPKNADANGAYNIARKGLMLIGQIKETKDLANFKYDISNKAWLNFAQQKPYKNE

SEQ ID NO: 1613 - protein, 1211 aa, unidentified
  REGION 1..1211: note = Description of Unknown:uncultivated organism sequence
  REGION 1..1211: note = Category: MG75 effectors
  REGION 1..1211: note = Description: MG75-99 effector
MLICLVSRCSKLFYTISRCYFHIESTFSGASISFVLSHIARYAPSPEENSCIPITHFQCKNNFEHLLNKLIESYKDKEDKKKIIDSDLIQFINCANSSQLNGMSEDEAKELVKEFWGFTTYFEGFHTNRKNMYTAEEESTAIAHRLVNENLPKFIDNMDVFKKAVAKPEIQANIEELYANFAAYLNVESIQEMFQLDYYNMLLTQKQIDVYNAIIGGKTDEDHDVKIKGINEYINLYNQQHKNEKLPKLKVLFKQILSDRNAISWLPEEFNDDQEVLNAIKHCYERLSENVLGDKVLKSLLCSLGDYNLDGIFVRNDAQLTDISQKMFGDWGVIQNAIIQNIKNVAPARKRKESEEDYEKRISDIFKKADSFSLRYINDCLNEMDEKNPYTVQWYFSTLGAVNTPTMQRENLFALIQNAYTDISDLLNSQYPTDKNLSQDKTNVAKVKALLDAIKSLQHFVKPLLGRGDESDKDERFYGELASLWTELDTVTPLYNMVRNYMTRKPYSEKKIKLNFENPQLLGGWDANKEKDYASIILRRNGLYYLAIMNKESKKLLGKTMPSDGECYEKMVYKLLPGANKMLPKVFFSKSKIDYFKPSKQIVENYNNDTHKKGKNFNINDCHDLIDFFKQSIDIHEDWSKFGFKFSDTSTYKDLSGFYREVEQQGYKLSFTKVSVSFIDKLVDDGKMYLFQIYNKDFSKYSKGTPNMHTLYWKALFDERNLADVVYKLNGQAEMFYRKKSIVYTHPTHPANHPILNKNKENKKKESVFEYDLVKDRRYTVDKFLLHVPITMNFKSVGSENINQQVREYLQQAEDTHIIGIDRGERHLLYLVVIDMQGNIKEQYTLNEIVNEYNGNTYRTNYYDLLNTREEERLTARQSWQTIENIKELKEGYLSQVIHKITQLMVKYHAVVVLEDLNKGFMRGRQKVEKQVYQKFEKMLIDKLNYLVDKKADAAQLGGLLNAYQLTSKFDSFQKLGKQSGFLFYIPAWNTSKIDPVTGFVNLLDTRYQNTEKAKAFFSKFDAIRYNADKDWFEFYLDYDKFGTKAEGTRTKWTLCTQGYRIRTFRNADKNSQWDNQDVDLTKELKALFEIYHINIGGNLKEGICSQTDKAFFTGLLHILKLTLQMRNSITGTETDYLVSPVADENGVFYDSRSCGDTLPKNADANGAYNIARKGLMLIEQIKETKDLANFKYDISNKAWLNFAQQKPYEK

SEQ ID NO: 1614 - protein, 1254 aa, unidentified
  REGION 1..1254: note = Description of Unknown:uncultivated organism sequence
  REGION 1..1254: note = Category: MG75 effectors
  REGION 1..1254: note = Description: MG75-100 effector
MKKNMKRKFDDFIHLYSLSKTLRFEARPIGDTLRNFKKNGLLERDKHRAESYVKVKKLIDEYHKAFIDRVLNGSVLNYVNKGKYDSLTEYYDLYSVPRKDEASQKHFKAIQQHLRQQIVKKLTDDKDYKHLFGKELLESYKDKGDKKKLNEADLVQFINAANPKQLHTLSKKEAIDLVQEFSGFTTYFNEFHKNRKNMYSAEEKSTGIAYRLINENLPKFIDNMKSFKKIVDIPEMKDNLKQIHEYFVDYLNVENIHEMFQLDYYNQLLTQKQIDVYNAIIGGKTDNEHKEKIKGINEYVNLYNQTHKDAKLPKLKVLFKQILSDRNAISWLPEEFKDDQEVLNAIKDCYARLSKNVLGDNILKELLCSLAEYDTKGIFLRNDLQLTDISQKMFGNWSVIPSAIKNDKDVAFKKQDSFSIDYIDACLDKFVDNNTHTIEGYFATLGAVDTQTTQLENIFAQIKNAYTGIESLLNSAYPEDKNLSQDKDNVAKIKLFLDALMSLMHFVKPLLGKGDESNKDEKFYGDFTLLWTELETVVPLYNMVRNYMTRKPYSKSKIKLNFDNSQLLGGWDANKESDYASILLRRDGKYYLAIVDKDSKKLLGKSMPSDGECYEKMVYKLLPGANKMLPKVFFATSRIKDFKPSEQLLENYNKGTHKKGVNFSISDCHALIDYFKQSINKHEDWKNFNFNFSETSTYEDLSAFYREVEQQGYKITFTNVSVAFIDKLVKEGKMYLFQIYNKDFSEYSKGTPNMHTLYWKALFDDRNLKDVVYKLNGQAEMFFREKSIKVSTIHPANCPIQNKNKDNKKKESIFEYSLIKDRRYTVDKFMFHVPITMNFKSADTENINLPVREYLQTSDDTHIIGIDRGERHLIYLVVIDLQGNIVEQYTLNDIVNEYNGNTYRTNYHDLLDAREHDQLKARQNWQTIENIKELKEGYLSQVIHKITQLMIKYHAIVVLEDLNKGFMRGRQKVGKQVYQKFEKMLIDKLNFLVDKKADIESVGGLLNAYQLTNKLESFKNLGKQSGFLFYIPACNTSNIDPVTGFVNLLDTRSQNAKAFFDKFDSIRYNKEKDWFEFALDYNNFGNKAEGTRTKWTLCTQGKRIKTFRNAEKNSNWDYQIIDLTIELKQLFAHYNIDINGNLKKAISNQTEKTFFVELMQLLKLTLQMRNSITNTETDYLVSPVADENGNFYDSRKCGSSLPENADANGAFNIARKGLMIIEQIKASDDLSKLKFDISNKSWLNFAQQKPYKHE

SEQ ID NO: 1615 - protein, 1250 aa, unidentified
  REGION 1..1250: note = Description of Unknown:uncultivated organism sequence
  REGION 1..1250: note = Category: MG75 effectors
  REGION 1..1250: note = Description: MG75-101 effector
MKRKFDDFIHLYSLSKTLRFEARPIGDTLRNFKKNGLLERDKHRAESYVKVKKLIDEYHKVFIDRVLNGSVLNYVNKGKYDSLTEYYDLYSVPRKDEASQKHFKAIQQHLRQQIVKKLTDDKDYKHLFGKELLESYKDKGDKKKLNEADLVQFINAANPKQLHTLSKKEAIDLVQEFSGFTTYFNEFHKNRKNMYSAEEKSTGIAYRLINENLPKFIDNMKSFKKIVDIPEMKDNLKQIHEYFVDYLNVENIHEMFQLDYYNQLLTQKQIDVYNAIIGGKTDNEHKEKIKGINEYVNLYNQTHKDAKLPKLKVLFKQILSDRNAISWLPEEFKDDQEVLNAIKDCYARLSKNVLGDNILKELLCSLAEYDTKGIFLRNDLQLTDISQKMFGNWSVIPSAIKNDKDVAFKKQDSFSIDYIDACLDKFVDNNTHTIEGYFATLGAVDTQTTQLENIFAQIKNAYTGIESLLNSAYPEDKNLSQDKDNVAKIKLFLDALMSLMHFVKPLLGKGDESNKDEKFYGDFTLLWTELETVVPLYNMVRNYMTRKPYSKSKIKLNFDNSQLLGGWDANKESDYASILLRRDGKYYLAIVDKDSKKLLGKSMPSDGECYEKMVYKLLPGANKMLPKVFFATSRIKDFKPSEQLLENYNKGTHKKGVNFSISDCHALIDYFKQSINKHEDWKNFNFNFSETSTYEDLSAFYREVEQQGYKITFTNVSVAFIDKLVKEGKMYLFQIYNKDFSEYSKGTPNMHTLYWKALFDDRNLKDVVYKLNGQAEMFFREKSIKVSTIHPANCPIQNKNKDNKKKESIFEYSLIKDRRYTVDKFMFHVPITMNFKSADTENINLPVREYLQTSDDTHIIGIDRGERHLIYLVVIDLQGNIVEQYTLNDIVNEYNGNTYRTNYHDLLDAREHDQLKARQNWQTIENIKEVKEGYLSQVIHKITQLMIKYHAIVVLEDLNKGFMRGRQKVGKQVYQKFEKMLIDKLNFLVDKKADIESVGGLLNAYQLTNKLESFKNLGKQSGFLFYIPAWKTSNIDPVTGFVNLLDTRSQNAKAFFDKFDSIRYNKEKDWFEFALDYNNFGNKAEGTRTKWTLCTQGKRIKTFRNAEKNSNWDYQIIDLTIELKQLFAHYNIDINGNLKKAISNQTEKTFFVELMQLLKLTLQMRNSITNTETDYLVSPVADENGNFYDSRKCGSSLPENADANGAFNIARKGLMIIEQIKASDDLSKLKFDISNKSWLNFAQQKPYKHE

SEQ ID NO: 1616 - protein, 1274 aa, unidentified
  REGION 1..1274: note = Description of Unknown:uncultivated organism sequence
  REGION 1..1274: note = Category: MG75 effectors
  REGION 1..1274: note = Description: MG75-102 effector
MAKNFEDFKRLYPLSKTLRFEAKPIGATLDNIVKSGLLEEDEHRAASYVKVKKLIDEYHKVFIDRVLADGCLPLENEGHNNSLAEYYDSYVSKSQNEDAKKAFEENQQNLRSIIAKKLTEDKAYANLFGKNLIESYKDKTDKTKIIDSDLIQFINTAESTQLNSMSQDEAKELVKEFWGFTTYFVGFFDNRKNMYTAEEKSTSIAYRLINENLPKFIDNMEAFKKAIARPEIQANMGELYSNFSEYLNVESVPEMFQLDYYNMLLTQKQIDVYNAIIGGKTDDEHDVKIKGINEYINLYNQQHKDDKLPKLKALFKQILSDRNAISWLPEEFNSDQEVLNAIKDCYERLSENVLGDKVLKSLLDSLADYSLDGIFIRNDLQLTDISQKMFGNWGVIQNAIMQNIKHVAPARKHKESEEDYEKRIAGIFKKADSFSISYINDCLNEADSNNAYFVENYFATFGAVNTPTMQRENLFSLVQNAYTEVAALLHSDYPTAKHLAQDKANVAKIKALLDAIKSLLHFVKPLLGKGDESNKDERFYGELASLWAELDTVTPLYNMIRNYMTRKPYSQKKIKLNFENPQLLGGWDANKEKDYATIILRRDGLYYLAIMNKESKKLLGKAMPSDGECYEKMVYKLLPGANKMLPKVFFAKSRMEDFKPSKELVEKYNNGTHKKGKNFNIQDCHNLIDYFKQSISKHEDWGKFGFNFSDTSTYEDLSGFYREVEQQGYKLSFARVSVSYISQLVEEGKMYLFQIYNKDFSEYSKGTPNMHTLYWKALFDERNLADVVYKLNGQAEMFYRKKSIENTHPTHPANHPILNKNKDNKKKESLFDYDLIKDRRYTVDKFMFHVPITMNFKSSGSENINQDVKAYLRHADDMHIIGIDRGERHLLYLVVIDLQGNIKEQYSLNEIVNEYNGNTYHTNYHDLLDVREDERLKARQSWQTIENIKELKEGYLSQVIHKITQLMVKYHAIVVLEDLNKGFMRGRQKVEKQVYQKFEKMLIDKLNYLVDKKADASVSGGLLNAYQLTSKFDSFQKLGKQSGFLFYIPAWNTSKIDPITGFVNLLDTRYQNVEKAKVFFSKFDAIRYNKDKDWFEFNLDYDKFGKKAEGTRTKWTLCTRGMRIDTFRNKEKNSQWDNHEVDLTAEMKSLLEHYYIDIHGNLKDAISAQTDKAFFTGLLHILKLTLQMRNSITGTETDYLVSPVADENGIFYDSRSCGDELPENADANGAYNIARKGLMMIEQIKEAKDLDNLKFDISNKSWLNFAQQKPYKNG

SEQ ID NO: 1617 - protein, 1254 aa, unidentified
  REGION 1..1254: note = Description of Unknown:uncultivated organism sequence
  REGION 1..1254: note = Category: MG75 effectors
  REGION 1..1254: note = Description: MG75-103 effector
MKFEDFTGLYPVSKTLRFEARPVGDTLKNIIKRGILEQDTHRAESYQKVKKLMDEYHKAFIDSVMSNFRFSCEDLEEYFVLYANKSDNDESKNKYTELQKKMRESVSKALKGDERFKKINKKELIKEDLYAFIREAGESQLVGLTREQAEELLLEFKDFSTYFGGFYQNRANMYVPDEKSTSIAYRLVNENLPRFVDNIDVFNKITSIPELRDNVKTIYDAFKEYLNVVELSNIFDVTFYSEVLTQKHIDLYNSIIGGRTDNESSKKIHGLNEYINLYNQTHKDEKLPKFKVLYKQILSDRVAVSWLPEAFSNDKETLCAIRDCYSGLEEHILGEKDLKILLESLDKFDLCGVFISNNKQLLSEISQKLYGNWKTIENAVRRHFEETSPQNVKKENEEKYRERISKIIKRYESFSIADLNEWVKKSDPDESRRIEDYFASLGVVNSENEQKEDLFSRVANVYIDVADLLFSDYPDGKRLAQDSKDVEKIKNLLDAIKELQWFVKPLNGSGDENNKDERFYGEFSMLWAELESFSLLYDKVRNYMTKKTYSQDKIKLNFANATLLKGWDRNKEVDNACVILRRNGLYYLGIMDKKYRRSFEGNYLCEGDVYEKMVYKLLPDPKKMLPKVFFSKSREKDFNPSDSILRIHKGETYKAGPQFKIEDCRELIDFYKKSISLHEDWKNFGFEFSDTSTYDDLNGFYREVEQQGYKITFKNVSVSYVEKLVGEGKLYLFQLYNKDFSSYSKGTPNIHTLYWKALFDEKNLLNVVYKLNGEAELFFRKKSINITNPTHPANVSVANKNKLNQKRESLFDYDLIKDRRYTIDKFLFHVPITMNFKSKGRPQIEQLVRGYLHSAENTHIIGIDRGERHLLYVSVIDSHGNIKEQFSLNEIINENAGNVYVTDYHALLDTKETERKEARQSWQTIENIKELKEGYLSQAVHKVTQLMIKYNAVIVLEDLNMGFMRGRQKVEKQVYQKFEKMLIDKLNYLVDKKVCVDAPGGVFHAYQLTSKFESFAKLGKQSGFLFYIPAWNTSKIDPITGFVNLFELKCDSIDRTKLFFSKFKSIRYNQRSDWFEFAFDYNDFTSKAAGTKTEWIITTHGTRIINFRNPQKNNQWDSNEVVLTDEFKSLFARYSIDFSGNLKEGITMQTDKSFFEGLLNYFKLTLQMRNSVTGTDVDYLISPVADGNGMFYDSRNCADSLPKNADANGAYNIARKGLMLIKQIKMSNDFKTVKLDITNKAWLEFAQKKPYLND

SEQ ID NO: 1618 - protein, 1274 aa, unidentified
  REGION 1..1274: note = Description of Unknown:uncultivated organism sequence
  REGION 1..1274: note = Category: MG75 effectors
  REGION 1..1274: note = Description: MG75-104 effector
MAKNFEDFKRLYPLSKTLRFEAKPIGATLDNIVKSGLLDEDEHRAESYVKVKKLIDEYHKVFIDRVLDNGCLPLKNEGHNNSLTEYYDSYVSKSQNEDAKKAFEENQQNLRSIIAKKLAEDKAYANLFGKNLIESYKDKTDKTKIIDSDLIQFINTAESTQLNSMSQDEAKELVKEFWGFTTYFVGFFDNRKNMYTAEEKSTGIAYRLINENLPKFIDNMEAFKKAIARPEIQANMEELYSNFSEYLNVESIQEMFLLDYYNMLLTQKQIDVYNAIIGGKTDDEHDVKIKGINEYINLYNQQHKDDKLPKLKALFKQILSDRNAISWLPEEFNSDQEVLNAIKDCYERLSENVLGDKVLKSLLGSLADYSLDGIFIRNDLQLTDISQKMFGNWGVIQNAIMQNIKRVAPARKHKESEEDYEKRIAGIFKKADSFSISYINDCLNEADPNNAYFVENYFATFGAVNTPTMQRENLFALVQNAYTEVASLLHSYYPAEKKLAQDKANVAKIKALLDAIKSLQHFVKPLLGKGDESDKDERFYGELASLWAELDTVTPLYNMIRNYITRKPYSQKKIKLNFENPQLLGGWDANKEKDYATIILRRNGLYYLAIMDKDSRKLLGKAMPSDGECYEKMVYKLLPGANKMLPKVFFAKSRMDDFKPSKELIEKYNNGTHKKGKNFDIQDCHNLIDYFKQSIDKHEDWSKFGFNFSDTSTYEDLSGFYREVEQQGYKLSFARVSVSYINQLVEEGKMYLFQIYNKDFSEYSKGTPNMHTLYWKALFDERNLADVVYKLNGQAEMFYRKKSIENTHPTHPANHPILNKNKDNKKKESLFEYDLIKDRRYTVDKFMFHVPITMNFKSVGSENINQGVKEYLHHADDMHIIGIDRGERHLLYLVVIDLQGNIKEQYSLNEIVNEYNGNTYHTNYHDLLDAREDERLKARQSWQTIENIKELKEGYLSQVIHKITQLMVKYHAIVVLEDLNMGFMRGRQKVEKQVYQKFEKMLIDKLNYLVDKKADASVSGGLLNAYQLTSKFDSFQKLGKQSGFLFYIPAWNTSKIDPVTGFVNLLDARYQNVEKAKAFFSKFDAIRYNKDKDWFEFNLDYDKFGKKAEGTRTKWTLCTRGMRIDTFRNKEKNSQWDNQEVDLTAELKSLLEHYYIDIHGNLKEAISAQTDKAFFTGLLHILKLTLQMRNSITGTETDYLVSPVADENGIFYDSRSCGDELPENADANGAYNIARKGLMMIEQIKNAEDLGNLKFDISNKAWLNFAQQKPYKNG

SEQ ID NO: 1619 - protein, 1257 aa, unidentified
  REGION 1..1257: note = Description of Unknown:uncultivated organism sequence
  REGION 1..1257: note = Category: MG75 effectors
  REGION 1..1257: note = Description: MG75-105 effector
MKYTDFTGIYSVSKTLRFELIPQGSTVENMKREGILNNDMHRADSYKEMKKLIDEYHKAFIERCLSDFSLKYDDTGKHDSLEEYFFYYEQKRNDKTKKIFEDIQVALRKQISKRFTGDTAFKRLFKKELIKEDLPSFVKNDPVKTELIKEFSDFTTYFQEFHKNRKNMYTSDAKSTAIAYRIINENLPKFIDNINAFDIVAKVPEMQEHFKTIADELRSHLQVGNDIDKMFNLQFFNKVLTQSQLDVYNAVIGGKSEGNKKIQGINEYINLYNQQHKKARLPMLKLLYKQILSDRVAISWLQDEFDNDQDMLDTIEAFYNKLNSNETGVLGEGKLKQILMGLDGYNLDGVFMRNDLQLSEVSQRLCGGWNIIKDAMTSDLKRSVQKKKKETDADFEERVSKLFSAQNSFSIAYINQCLGQAGIRCKIQDYFACLGAKEGENEAETTPDIFDQIAEAYHGAAPILNARPSSHNLAQDIEKVKAIKALLDALKRLQRFVKPLLGRGDEGDKDNFFYGDFMPIWEVLDQLTPLYNKVRNRMTRKPYSQEKIKLNFENSTLLNGWDLNKEHDNTSVILRREGLYYLGIMNKNYNKIFDANNVETIGDCYEKMIYKLLPGPNKMLPKVFFSKSRVQEFSPSKKILEIWESKSFKKGDNFNLDDCHALIDFYKDSIAKHPDWNKFNFKFSDTQSYTNISDFYRDVNQQGYSLSFTKVSVDYVNRMVDEGKLYLFQIYNKDFSPQSKGTPNMHTLYWRMLFDERNLHNVIYKLNGEAEVFYRKASLRCDRPTHPAHQPITCKNENDSKRVCVFDYDIIKNRRYTVDKFMFHVPITINYKCTGSDNINQQVCDYLRSAGDDTHIIGIDRGERNLLYLVIIDQHGTIKEQFSLNEIVNEYKGNTYCTNYHSLLEEKEAGNKKARQDWQTIESIKELKEGYLSQVIHKISMLMQRYHAIVVLEDLNGSFMRSRQKVEKQVYQKFEHMLINKLNYLVNKQYDATEPGGLLHALQLTSRMDSFKKLGKQSGFLFYIPAWNTSKIDPVTGFVNLFDTRYCNEAKAKEFFEKFDDISYNDERDWFEFSFDYRHFTNKPTGTRTQWTLCTQGTRVRTFRNPEKSNHWDNEEFDLTQAFKDLFNKYGIDIASGLKARIVNGQLTKETSAVKDFYESLLKLLKLTLQMRNSVTGTDIDYLVSPVADKDGIFFDSRTCGSLLPANADANGAFNIARKGLMLLRQIQQSSIDAEKIQLAPIKNEDWLEFAQEKPYL

SEQ ID NO: 1620 - protein, 1142 aa, unidentified
  REGION 1..1142: note = Description of Unknown:uncultivated organism sequence
  REGION 1..1142: note = Category: MG75 effectors
  REGION 1..1142: note = Description: MG75-106 effector
MARIFEDFKRLYPLSKTLRFEAKPIGATLDNIVKSGLLDEDEHRAESYVKVKKLIDEYHKVFIDRVLDNGCLPLKNEGHNNSLTEYYDSYVSKSQNEDAKKAFEENQQNLRSIIAKKLTEDKAYANLFGKNLIESYKDKTDKTKIIDSDLIQFINTAESTQLNSMSQDEAKELVKEFWGFTTYFVGFFDNCKNMYTAEEKSTGIAYRLINENLPKFIDNMEAFKKAIARPEIQANMEELYSNFSEYLNVESIQEMFLLDYYNMLLTQKQIDVYNAIIGGKTDDEHDVKIKGINEYINLYNQQHKDDKLPKLKALFKQILSDRNAISWLPEEFNSDQEVLNAIKDCYERLSENVLGDKVLKSLLGSLADYSLDGIFIRNDLQLTDISQKMFGNWGVIQNAIMQNIKRVAPARKHKESEEDYEKRIAGIFKKADSFSISYINDCLNEADPNNAYFVENYFATFGAVNTPTMQRENLFALVQNAYTEVASLLHSYYPAEKKLAQDKANVAKIKALLDAIKSLQHFVKPLLGKGDESDKDERFYGELASLWAELDTVTPLYNMIRNYITRKPYSQKKIKLNFENPQLLGGWDANKEKDYATIILRRNGLYYLAIMDKDSRKLLGKAMPSDGECYEKMVYKLLPGANKMLPKVFFAKSRMDDFKPSKELIEKYNNGTHKKGKNFDIQDCHNLIDYFKQSIDKHEDWSKFGFNFSDTSTYEDLSGFYREVEQQGYKLSFARVSVSYINQLVEEGKMYLFQIYNKDFSEYSKGTPNMHTLYWKALFDERNLADVVYKLNGQAEMFYRKKSIENTHPTHPANHPILNKNKDNKKKESLFEYDLIKDRRYTVDKFMFHVPITMNFKSVGSENINQGVKEYLHHADDMHIIGIDRGERHLLYLVVIDLQGNIKEQYSLNEIVNEYNGNTYHTNYHDLLDAREDERLKARQSWQTIENIKELKEGYLSQVIHKITQLMVKYHAIVVLEDLNMGFMRGRQKVEKQVYQKFEKMLIDKLNYLVDKKADASVSGGLLNAYQLTSKFDSFQKLGKQSGFLFYIPAWNTSKIDPVTGFVNLLDARYQNVEKAKAFFSKFDAIRYKRIRTGLSLISTMTSLVKKQKVQGLSGFYAPEECVLILSEIKKKTHNGIIRKLT

SEQ ID NO: 1621 - protein, 506 aa, unidentified
  REGION 1..506: note = Description of Unknown:uncultivated organism sequence
  REGION 1..506: note = Category: MG75 effectors
  REGION 1..506: note = Description: MG75-107 effector
MHTLYWRMLFDERNLEDVVYSLNGGAEVFFRKASINVSHPTHPANIPIKKKNLKHKDEERILKYDLIKDKRYTIDQFQFHVPITMNFKVAGNGNININQKAIDYLRSASDTHIIGIDRGERNLLYLVVIDGNGKICEQFSLNEIEVEYNGEKYSTNYHDLLNVKENERKQARQSWQSIANIKDLKEGYLSQVIYKISELIVKYNAIVVLEDLNAGFMRGRQKVEKQVYQKFEKKLIEKLNYLVFKKQSSDLPGGLMHAYQLANKFESFNTLGKQSGFLFYIPAWNTSKMDPVTGFVNLFDVKYESVDKAKSFFSKFDSIRYNVERDMFEWKFNYGEFTKKAEGAKTDWTVCSYGNRIITFRNPDKNSQWDNKEINLTENVKLLFERFGIDLSSNLKDEIMERTEKEFFIELISLFKLVLQMRNSWTGTDIDYLVSPVCNENGEFFDSRNVDETLPQNADANGAYNIARKGMILLDKIKKNNGEKKLALSITNREWLSFAQGCCKNG

SEQ ID NO: 1622 - protein, 1274 aa, unidentified
  REGION 1..1274: note = Description of Unknown:uncultivated organism sequence
  REGION 1..1274: note = Category: MG75 effectors
  REGION 1..1274: note = Description: MG75-108 effector
MAKIFEDFKRLYPLSKTLRFDAKPVGATLDNIVKSGLLEEDEHRAASYVRVKKLIDEYHKVFIDRVLDNGCLPLENKGENNSLAEYYDSYVSKSQNEDAKKAFEENQQNLRSIIAKKLTGDKAYANLFGKNLIESYKDKKDKKKIIDSDLIQFICTAEATQLDSMSQDEAKEIVKEFWGFTTYFVGFFDNRKNMYTAEEKSTGIAYRLINENLPKFIDNMEAFKKAIARPEIQANMGELYSNFSEYLNVESVPEMFQLDYYNMLLTQKQIDVYNAIIGGKTDDEHDVKIKGINEYINLYNQQHKDDKLPKLKALFKQILSDRNVISWLPEEFNSDQEVLNAIKDCYERLSENVLGDKVLKSLLGSLADYSLDGIFIRNDLQLTDISQKMFGNWGVIQNAIMQNIKHVAPARKHKESEEDYEKRIADIFKKADSFSISYINDCLNEADPNNAYFVENYFATLGAVDTPTMQRENLFALVQNAYTEVAALLHSDYPTAKNLAQDKANVSKIKALLDAIKSLQHFVKPLLGKGDESDKDERFYGELASLWAELDTVTPLYNMIRNYMTRKPYSQKKIKLNFENPQLLGGWDANKEKDYATIILRRDGLYYLAIMNKESKKLLGKAMPSDGECYEKMVYKLLPGANKMLPKVFFAKSRMEDFKPSKELVEKYNNGTHKKGKNFNIQDCHNLIDYFKQSISKHEDWGKFGFNFSDTSTYEDLSGFYREVEQQGYKLSFARVSVSYISQLVEEGKMYLFQIYNKDFSEYSKGTPNMHTLYWKALFDERNLADVVYKLNGQAEMFYRKKSIENTHPTHPANHPILNKNKDNKKKESLFDYDLIKDRRYTVDKFMFHVPITMNFKSSGSENINQDVKAYLRHADDMHIIGIDRGERHLLYLVVIDLQGNIKEQYSLNEIVNEYNGNTYHTNYHDLLDVREEERLKARQSWQTIENIKELKEGYLSQVIHKITQLMVKYHAIVVLENLNMGFMRGRQKVEKQVYQKFEKMLIDKLNYLVDKKADASVSGGLLNAYQLTSKFDSFQKLGKQSGFLFYIPAWNTSKIDPVTGFVNLLDTRYQNVEKAKVFFSKFDAIRYNKDKDWFEFNLDYDKFGKKAEGTKTKWTLCTRGMRIDTFRNKEKNSQWDNHEVDLTAEMKSLLEHYYIDIHGNLKDAISAQTDKVFFTGLLHILKLTLQMRNSITGTETDYLISPVADENGIFYDSRSCGDELPENADANGAYNIARKGLMLVEQIKGAENLDNVKFDISNKAWLNFAQQKPYKNG

SEQ ID NO: 1623 - protein, 1319 aa, unidentified
  REGION 1..1319: note = Description of Unknown:uncultivated organism sequence
  REGION 1..1319: note = Category: MG75 effectors
  REGION 1..1319: note = Description: MG75-109 effector
MAKIFEDFKRLYPLSKTLRFDAKPVGATLDNIVKSGLLEEDEHRAASYVRVKKLIDEYHKVFIDRVLDNGCLPLENKGENNSLAEYYDSYVSKSQNEDAKKAFEENQQNLRSIIAKKLTGDKAYANLFGKNLIESYKDKKDKKKIIDSDLIQFINTADSTQLDSMTQVEAKELVKEFWGFVTYFYGFFDNRKNMYTAEKKSTGIAYRLINENLPKFIDNMEAFKKVIARPEIQANMEELYSDFSEYLNVESIQEMFQLDYYDMLLTQKQIDVYNAIIGGKTDDEHDVKIKGINEYINLYNQQHKDTRLPKLKALFKQILSDRNAISWLPEEFNSDQEVLNAIKDCYERLSENVLGDKVLKSLLGSLADYSLEGIFIRNDLQLTDVSQKMFGNWGVIQNAIMQNIKHVAPARKHKESEEEYEKRIAGIFKKADSFSISYLNDCLNEADPNNAYFVENYFATFGAVNTPTMQRENLFALVQNKYTEVAALLHSDYPTAKHLAQDKANVAKIKALLDAIKSLQHFVKPLLGKGDESDKDERFYGELASLWAELETVTPLYNMIRNYMTRKPYSQKKIKLNFENPQLLDGWDANKEKDYATIILRRNGLYYLAIMGKDSKNLLGKAMPSDGECYEKMVYKQFDISKQLPKCTTELKHVRKALVEDAKRSCLLSDFNNWNKPLNVTRKLWELNNFVWDKKKEDWVLRKKDNETRPKKFHKKYLELTSDKKGYNQAKNDWIKFIKEFLSSYKKVEAYDIHYKKRYNSVDELYKQLNGDLYAISFTYVSASFIEQLVSEGKMYLFQIYNKDFSEYSKGTPNMHTLYWKALFDERNLADVVYKLNGQAEMFYRKKSLENTHPTHPANHPILNKNKDNKKKESLFDYDLIKDRRYTVDKFMFHVPITMNFKSSGSENINQDVKAYLRHADDMHIIGIDRGERHLLYLVVIDLQGNIKEQYSLNEIVNEYNGNTYHTNYHDLLDVREEERLKARQSWQTIENIKELKEGYLSQVIHKITQLMVKYHAIVVLEDLNMGFMRGRQKVEKQVYQKFEKMLIDKLNYLVDKKADASVSGGLLNAYQLTSKFDSFQKMGKQSGFLFYIPAWNTSKIDPVTGFVNLLDTRYQNVEKAKVFFSKFDAIRYNKDKDWFEFNLDYDKFGKKAEGTRTKWALCTRGMRIDTFRNKEKNSQWDNQEVDLTAEMKSLLEHYYIDIHGNLKDAISAQTDKTFFTGLLHILKLTLQMRNSITGTETDYLVSPVADENGIFYDSRSCGDELPENADANGAYNIARKGLMMIEQIKDAKDLNNLKFDISNKAWLNFAQQKPYKNG

SEQ ID NO: 1624 - protein, 807 aa, unidentified
  REGION 1..807: note = Description of Unknown:uncultivated organism sequence
  REGION 1..807: note = Category: MG75 effectors
  REGION 1..807: note = Description: MG75-110 effector
METFSGFTNLYPLSKTLRFRLIPVGETLKHFIDSGILEEDQHRAESYVKVKAIIDDYHRAYIENSLSGFELPLESTGKFNSLEEYYLYHNIRNKTEEIQNLSSKVRTNLRKQVVVQLTKNEIFKRIDKKELIQSDLIDFVKNEPDANEKIALISEFRNFTVYFKGFHENRRNMYSDEEKSTSIAFRLIHENLPKFIDNMEVFAKIQNTSISENFDAIQKELCPELVTLCEMFKLGYFNKTLSQKQIDAYNTVIGGKTTSEGKKIKGLNEYINLYNQQHKQEKLPKMKLLFKQILSDRESASWLPEKFENDSQVVGAMVNFWNTIHDTVLAEGGLKTIIASLGSYGLEGIFLKNDLQLTDISQKATGSWSKISSEIKQKIEVMNPQKKKESYESYQERIDKLFKSYKSFSLAFINECLRGEYKIEDYFLKLGAVNSSSLQKENHFSHILNAYTDVKEAIGFYSESTDTKLIQDNDSIQKIKQFLDAVKDLQAYVKPLLGNGDETGKDERFYGDLIEYWSLLDLITPLYNMVRNYVTQKPYSVDKIKINFQNPTLLNGWDLNKETDNTSVILRRDGKYYLAIMNNKSRKVFLKYPSGTDGNCYEKMEYKLLPGANKMLPKVFFSKSRINEFMPNERLLSNYEKGTHKKSGICFSLDDCHTLIDFFKKSLDKHEDWKNFGFKFSDTSTYEDMSGFYKEVENQGYKLSFKPIDATYVDQLVDEGKIFLFQIYNKDFSEHSKGTPNMHTLYWKMLFDETNLGDVVYKLNGEAEVFFRKASINVSHPTHPANIPIKKKNLKHKEMKKEFLNMT

SEQ ID NO: 1625 - protein, 347 aa, unidentified
  REGION 1..347: note = Description of Unknown:uncultivated organism sequence
  REGION 1..347: note = Category: MG75 effectors
  REGION 1..347: note = Description: MG75-111 effector
MLNVKENERKQARQSWQSIANIKDLKEGYLSQVIHKISELMVKYNAIVVLEDLNAGFMRGRQKVEKQVYQKFEKKLIEKLNYLVFKKQSSDLPGGLMHAYQLANKFESFNTLGKQSGFLFYIPAWNTSKMDPVTGFVNLFDVKYESVDKAKSFFSKFDSIRYNVERDMFEWKFNYGEFTKKAEGTKTDWTVCSYGNRIITFRNPDKNSQWDNKEINLTENIKLLFERFGIDLSSNLKDEIMQRTEKEFFIELISLFKLVLQMRNSWTGTDIDYLVSPVCNENGEFFDSRNVDETLPQNADANGAYNIARKGMILLDKIKKSNGEKKLALSITNREWLSFAQGCCKNG

SEQ ID NO: 1626 - protein, 1125 aa, unidentified
  REGION 1..1125: note = Description of Unknown:uncultivated organism sequence
  REGION 1..1125: note = Category: MG75 effectors
  REGION 1..1125: note = Description: MG75-112 effector
MIQFINTAEPSQLDSMSQDEAKELVKEFWGFTTYFVGFFDNRKNMYTSEEKSTGIAYRLVNENLPKFIDNMEAFKKAIAKPEIQANMEELYSNFAEYLNVESIQEMFQLDYYNMLLTQKQIDVYNAIIGGKTDEEHDVKIKGINEYINLYNQQHKDEKLPKLKALFKQILSDRNAISWLPEEFNSDQEVLNAIDDCYKRLSENVLGDKVLKSLLCSLDDYNLDGIFVRNDLQLTDISQKMFGNWSVIQNAIMQNIKNVAPARKRKESEEDYEKRISDIFKKADSFSIQYINDCLNEMDNNNLHAVDGYFATLGAVNTPTMQRENLFALIQNAYTDISNLLETPYPENKNLAQDKTNVAKVKALLDAIKSLQHFVKPLLGKGDESDKDERFYGELASLWTELDTVTPLYNMIRNYMTRKPYSEKKIKLNFENPQLLGGWDANKEKDYATIILRRNGMYYLAIMDKDSKKLLGKTMPSDGECYEKMVYKLLPGANKMLPKVFFAKSRINDFKPSKLIVENYNNGTHKKGKNFNINDCHNLIDYFKQSIDKHEDWSKFGFNFSDTSTYEDLSGFYREVEQQGYKLSFTNVSVSFIDKLVDEGKMYLFQIYNKDFSDFSKGTPNMHTLYWKALFDERNLADVVYKLNGQAEMFYRKKSINNTHPTHPANNPIQNKNKDNKKKESVFEYDLIKDRRYTVDKFLFHVPITMNFKSVGSENINQQVREYLQQADDTHIIGIDRGERHLLYLVVIDMQGNIKEQFTLNEIVNEYNGNTYRTNYHDLLDTREEERLTARQSWQTIENIKELKEGYLSQVVHKITQLMVKYHAVVVLEDLNKGFMRGRQKVEKQVYQKFEKMLIDKLNYLVDKKADAAQSGGLLNAYQLTSKFDSFQKLGKQSGFLFYIPAWNTSKIDPVTGFVNLLDTRYQNTEKAKAFFSRFDAIRYNANKDWFEFYLDYDKFCTKAEGTRTRWTLCTQGSRISTFRNAEKNSQWDNLEVDLTREMKSLFEHYHINICGNLKEEICLQTDKAFFTGLLHMLKLTLQMRNSITGTETDYLISPVADENGTFYDSRSCGDTLPKNADANGAYNIARKGLMFIGQIKETKDLANFKYDISNKAWLNFAQQKPYKNE

SEQ ID NO: 1627 - protein, 1254 aa, unidentified
  REGION 1..1254: note = Description of Unknown:uncultivated organism sequence
  REGION 1..1254: note = Category: MG75 effectors
  REGION 1..1254: note = Description: MG75-113 effector
MKFEDFTGLYPVSKTLRFEAKPVGATLENIIKSGVLEDDAHRARSYKKVKKLIDEYHKVFIDSVMSKFKFKEEILEDICSLYAAKSMDDKSKDRFVKLQGEMRKDVSVAFASDDRYKTINKKELVKEDLFEFVSHADNGQLAGLTKEEAEELILEFKDFTTYFSGFHKNRSNMYVADEKTTSVAYRLVNENLPRFLYNVSVFQKVVSVPEFENKIRAIYDSFREYLCVDNLASMFETPYYNDVLSQMQIDIYNSVIGGKTDKDSSTKIQGLNECINLYNQTHRNDKLPKFKILYKQILSDRVAMSWLPDEFSDDKETLEAIRNCYDSLTDHILGERDLKTLLESLGQYDMSGVFIANGPYLADISQKLYGDWRAIEKAIRKQEAVNSPKKAKETEEEYFNRITKHIHNYDSFSIEYLNFCITESYPNDGRRVEDYFATLGAVNTDTSQRENLFSRIDNAYTNVSGLLSSEYPETKKLSQDTENVEKIKDLLDSIKELQRFVKPLMGNGNESDNDNDKRFYGELSPLWDELETFSLLYDKVRNYVTRKPYSQNKIKLNFNNATLFAGWDQNKEKDNACIILRRGGMYYLGIMNKSYRIVFENNFPCDGDCYEKMVYKLLPGANKMLPKVFFSKSRIREFNPSDRILKNYEEGTHKKGPKFKLEDCHELIDFFKASINLHEDWKKFKFKFSDTSSYEDISDFYKEVEQQGYKITFVNVSVSYIDSLVNDGKLYLFQLYNKDFSQYSKGVPNMHTLYWKALFDKANLADVVYKLNGEAELFFRKKSIDMERPTHRANISVANKNIHNIKKESIFKYDLTKDRRYTVDKFLFHVPITMNFRSEGNIAIEQQVRSYLQSAEDTHVIGIDRGERHLLYVSVIDRRGLIKEQFSLNEIINEHNGSTYATNYHDLLDAKESERRKARQSWQTIENIKDLKEGYLSQAVHKIAQLMVKYHAVVVLEDLNVGFMRGRQKVEKQVYQKFEKMLTDKLNYLVDKKLNANDPGGVFHAYQLSSVFKSAEKRGKQSGFIFYIPAWNTSKIDPVTGFVNLFDLKYENIDKAKSFFSKFQIIRYNSERDWFEFIFDYDSFNSKASGTKVGWTLTTHGDRILSFRNSEKNNQWDSRAVILTDEYKALFDKYGIDYNDNLKEAITNQTEKAFFEDLLKCLRLTLQMRNSVIGTDTDFLISPVADNNGVFYDSRICADSLPKNADANGAYNIARKGLMLIDQIKKASDVRNIKFDIANKSWLDFAQKKPYLDE

SEQ ID NO: 1628 - protein, 1269 aa, unidentified
  REGION 1..1269: note = Description of Unknown:uncultivated organism sequence
  REGION 1..1269: note = Category: MG75 effectors
  REGION 1..1269: note = Description: MG75-114 effector
MYFDDFKKLYPLSKTLRFEAKPVGPTFKHIKERGLLEEDEHRAISYVKVKKLIDEYHKAFVGKALNNGCLLYESCGNKNSLIEYYETYKSKEGEARKTMKEIQKNLREMIVGAFEKEEDYANLFKGGLIEPYKSGGKHKEPDILRLINTAGFSQLAGMSQEEAKSLIKEFWRFTTYFVGFFDNRGNMYTSEEKSTGIAYRLINENLPRFIDNMEIFNKIIGKSEIQARVTELYSDFEGYLNVGSIQEMFKLDYYNALLTQKQIDVYNAIISGRTTTGPESKKIKGLNEYINLYNQQHKDGKLPKFKPLFKQILSDREALSWLPDEFVNDQEMLNAIKNCYEKLTGNILGESALKVLLGSLADYDLGGIFVRNDSQLTNISQRMFGRWDAIQNAILQDIRKTAPMRKRRESEEDYENRIDKMFKKADSFSIKYINDCIREIAVDDTLFVEDYFATLGAVNTPTIQRENLFLLVQNAFTDVADLLNSEYSAEKSLAQDSVNVSKIKALLDAIKSLQQFVRPLLGNGDENEKDERFYGEFTSLWAELDEVTLLYDMVRNRMTRKPYSQKKIKLNFANPKLLNGWDENKEKDNSCIILRRDGKYYLAVMDKKSKNLLGKPMPSDGECYEKMVYKLLPGAQKMFPKVFFAKSRIDEFKPSEHILNIYSNGTHKKGNKNFNIEDCHDLIDFFKESIRRHKDWNKFGFEFSDTSTYENVNEFYREADEQGYKLSFVNVSVAYIDKLVNEGEMYLFQIYNKDFSEYSKGTPNMHTLYWKALFDDRNLVDMVYKLNGQAELFYRKKSLDSIRPTHPANQPIKNKNKNNKKKESLFEYDLVKDRRYTVDKFMFHVPITMNFKNAGLEKINQQVREYLQQADDTHIIGIDRGERHLLYLVVIDMHGNIKEQFSLNEIVNECSGNTYHTNYHALLDAREEERLNARRSWQTIESIKELKEGYLSQVIHRITQLMVKYHAIVVLEDLSMGFMRGRQKVEKQVYQKFEKMLIDKLNYLVDKKVDVSQPGGLLNAYQLTNKFESFQSSEKQSGFVFYIPAWNTSKIDPVTGFVNLLDTRYQNVEKARAFFSKFDAIRYNKDKDWFEFGVDYDNFNKKAEGTMTKWTLCTQGVRICTFRNVEKNSQWDTQEVDLTTEMKSLFGQSQIDVNGNLKEAICSQSDKTFFMRLLHLLKLMLQMRNSITGTEIDYLVSPVADGNGNFYDSRKCDSTLPKNADANGAYNIARKGLMLLRQMKTADNLTDVKFDMTNRTWLKFAQQKPYKDE

SEQ ID NO: 1629 - protein, 1252 aa, unidentified
  REGION 1..1252: note = Description of Unknown:uncultivated organism sequence
  REGION 1..1252: note = Category: MG75 effectors
  REGION 1..1252: note = Description: MG75-115 effector
MKFEDFTGLYPVSKTLRFEAKPVGATLENVIKSGVLEDDAHRARSYKKVKKLIDEYHKVFIDSVMSKFKFKEEILEDICSLYAAKSMDDKSKDRFVKLQGEMRKDVSVAFASDDRYKTINKKELVKEDLFEFVSHADNGQLAGLTKEEAEELILEFKDFTTYFSGFHKNRSNMYVADEKTTSVAYRLVNENLPRFLYNVSVFQKVVSVPEFENKIRAIYDSFREYLCVDNLASMFETSYYNDVLSQMQIDIYNSVIGGKTDKDSSTKIQGLNECINLYNQTHRNDKLPKFKILYKQILSDRVAMSWLPDEFSDDKETLEAIRNCYDSLTDHILGERDLKTLLESLGQYDMSGVFIANGPYLADISQKLYGDWRAIEKAIRKQEAVNSPKKAKETEEEYFNRITKHIHNYDSFSIEYLNFCITESYPNDGRRVEDYFATLGAVNTDTSQRENLFSRIDNAYTNVSGLLSSEYPETKKLSQDTENVEKIKDLLDSIKELQRFVKPLMGNGDESDNDKRFYGELSPLWDELETFSLLYDKVRNYVTRKPYSQNKIKLNFNNATLFAGWDQNKEKDNACIILRRGGMYYLGIMNKSYRIVFENNFPCDGDCYEKMVYKLLPGANKMLPKVFFSKSRIREFNPSDRILKNYEEGTHKKGPKFKLEDCHELIDFFKASINLHEDWKKFKFKFSDTSSYEDISDFYKEVEQQGYKITFVNVSVSYIDSLVNDGKLYLFQLYNKDFSQYSKGVPNMHTLYWKALFDKANLADVVYKLNGEAELFFRKKSIDMERPTHRANISVANKNIHNIKKESIFKYDLTKDRRYTVDKFLFHVPITMNFKSEGNIAIEQQVRSYLQSAEDTHVIGIDRGERHLLYVSVIDRRGLIKEQFSLNEIINEHNGSTYATNYHDLLDAKESERRKARQSWQTIENIKDLKEGYLSQAVHKIAQLMVKYHAVVVLEDLNVGFMRGRQKVEKQVYQKFEKMLTDKLNYLVDKKLNANDPGGVFHAYQLSSVFKSAEKRGKQSGFIFYIPAWNTSKIDPVTGFVNLFDLKYENIDKAKSFFSKFQIIRYNSERDWFEFIFDYDSFNSKASGTKVGWTLTTHGDRILSFRNSEKNNQWDSRAVILTDEYKALFDKYGIDYNDNLKEAITNQTEKAFFEDLLKCLRLTLQMRNSVIGTDTDFLISPVADNNGVFYDSRICADSLPKNADANGAYNIARKGLMLIDQIKKASDVRNIKFDIANKSWLDFAQKKPYLDE

SEQ ID NO: 1630 - protein, 762 aa, unidentified
  REGION 1..762: note = Description of Unknown:uncultivated organism sequence
  REGION 1..762: note = Category: MG75 effectors
  REGION 1..762: note = Description: MG75-116 effector
METFSGFTNLYPLSKTLRFRLIPVGETLKHFIGSGILEEDQHRAESYVKVKAIIDDYHRAYIENSLSGFELPLESTGKFNSLEEYYLYHNIRNKTEEIQNLSSKVRTNLRKQVVTQLTKNEIFKRIDKKELIQSDLIDFVKNEPDANEKIALISEFRNFTVYFKGFHENRRNMYSDEEKSTSIAFRLIHENLPKFIDNMEVFAKIQNTSISENFDAIQKELCPELVTLCEMFKLGYFNKTLSQKQIDAYNTVIGGKTTSEGKKIKGLNEYINLYNQQHKQEKLPKMKLLFKQILSDRESASWLPEKFENDSQVVGAMVNFWNTIHDTVLAEGGLKTIIASLGSYGLEGIFLKNDLQLTDISQKATGSWSKISSEIKQKIEVMNPQKKKESYESYQERIDKLFKFYKSFSLAFINECLRGEYKIEDYFLKLGAVNSSSLQKENHFSHILNTYTDVKEVIGFYSESTDTKLIRDNGSIQKIKLFLDAVKDLQAYVKPLLGNGDETGKDERFYGDLIEYWSLLDLITPLYNMVRNYVTQKPYSIDKIKINFQNPTLLNGWDLNKETDNTSVILRRDGKYYLAIMNNKSRKVFLKYPSGTDRNCYEKMEYKLLPGANKMLPKVFFSKSRINEFMPNERLLSNYEKGTHKKSGTCFSLDDCHTLIDFFKKSLDKHEDWKNFGFKFSDTSTYEDMSGFYKEVENQGYKLSFKPIDATYVDQLVDEGNIFYFRFITRIFLSIAKVRLICIPCIGKCYLMKQILGMWYIN

SEQ ID NO: 1631 - protein, 1274 aa, unidentified
  REGION 1..1274: note = Description of Unknown:uncultivated organism sequence
  REGION 1..1274: note = Category: MG75 effectors
  REGION 1..1274: note = Description: MG75-117 effector
MAKNFEDFKRLYPLSKTLRFEAKPIGATLDNIIKSGLLDEDEHRAASYVKMKKLIDEYHKVFIDRVLDNGCLPLEDKGDNNSLAEYYESYVSKAQDEDAIKKFKEIQQNLCSIIAKKLTDDKAYANLFGNKLIESYKDKADKTKIIDSDLIQFINTAESTQLVSMSQDEAKELVKEFWGFTTYFEGFFKNRKNMYTPEEKSTGIAYRLINENLPKFIDNMEAFKKAITRPEIQANMEELYSDFSEYLNVESIQEMFQLDYYNMLLTQKQIDVYNAIIGGKTDDEHDVKIKGINEYINLYNQQHKDDKLPKLKALFKQILSDRNAISWLPEEFNSDQEVLNAIKDCYERLAENVLGDKVLKSLLCSLSDYTLDGIFIRNDLQLTDISQKMFGNWGVIQNAIMQNIKRVAPARKHKESEEDYEKRIAGIFKKADSFSISYINDCLNEADSNNAYFVENYFATFGAVNTPTMQRENLFALVQNAYTEVASLLHSDYPTAKHLAQDKANVAKIKALLDAIKSLQHFVKPLLGKGDESDKDERFYGELASLWAELDTVTPLYNMIRNYITRKPYSQKKIKLNFENPQLLGGWDANKEKDYATIILRRNGLYYLAIMNKESKKLLGKAMPSDGECYEKMVYKLLPGANKMLPKVFFAKSRMEDFKPSKELVEKYNNGTHKKGKNFNIQDCHNLIDYFKQSISKHEDWGKFGFNFSDTSTYEDLSGFYREVEQQGYKLSFARVSVSYINQLVEEGKMYLFQIYNKDFSEYSKGTPNMHTLYWKALFDERNLADVVYKLNGQAEMFYRKKSIENTHPTHPANHPILNKNKDNKKKESLFEYDLIKDRRYTVDKFMFHVPITMNFKSVGSENINQGVKEYLHHADDMHIIGIDRGERHLLYLVVIDLQGNIKEQYSLNEIVNEYNGNTYHTNYHDLLDAREDERLKARQSWQTIENIKELKEGYLSQVIHKITQLMVKYHAIVVLEDLNMGFMRGRQKVEKQVYQKFEKMLIDKLNYLVDKKADASVSGGWLNAYQLTSKFDSFQKLGKQSGFLFYIPAWNTSKIDPVTGFVNLLDARYQNVEKAKAFFSKFDAIRYNKDKDWFEFNLDYDKFGKKAEGTRTKWTLCTRGMRFDTFRNKEKNSQWDNQEVDLTAEMKSLLEHYYIDIHGNLKDAISAQTDKAFFTGLLHILKLTLQMRNSITGTETDYLVSPVADENGIFYDSRSCGEELPENADANGAYNIARKGLMLIEQIKGAEDLGNLKFDISNKAWLNFAQKKPYKNG

SEQ ID NO: 1632 - protein, 1271 aa, unidentified
  REGION 1..1271: note = Description of Unknown:uncultivated organism sequence
  REGION 1..1271: note = Category: MG75 effectors
  REGION 1..1271: note = Description: MG75-118 effector
MEFDDFKRLYPLSKTLRFEAKPIGATLKNIIKSGVLEEDEHRAQSYVKVKKLIDEYHKVFIDRVLNEGCLTIENKGNKDSLEEYYESYMSKSNDENVSKTFKEIQENLRSVIAKKLTDDKAYANLFGKNLIESYKDKEDKNKIIDSDLIQFINTAEPSQIDSMSQDEAKELVKEFWGFTTYFVGFFDNRKNMYTSEEKSTGIAYRLVNENLPKFIDNMEAFKKAIAKPEIQANMEELYSNFAEYLNIESIQEMFQLDYYDMLLTQKQIDVYNAIIGGKTDEDHDVKIKGINEYINLYNQQHKDEKLPKLKALFKQILSDRNAISWLPEEFNSDQEVLDAIKDCYERLSENVLGDKVLKSLLCSLSDYNLNGIFVRNDLQLTDISQKTFGNWSVIQNAIMQNIKNVAPARKRKESEEDYEKRISDIFKKADSFSIQYINDCLNEMDDNNLHAVDGYFATLGAVNTPTMQRENLFALIQNAYTDISDLLDTPYPQNKNLAQDKTNVAKVKVLLDAIKSLQHFVKPLLGMGDESDKDERFYGELASLWTELDTVTPLYNMIRNYMTRKPYSEKKIKLNFENPQLLGGWDANKEKDYATIILRRNGMYYLAIMDKDSKKLLGKTMPSDGECYEKMVYKLLPGANKMLPKVFFAKSRINDFKPSKKIVENYNNGTHKKGKNFNINDCHDLIDYFKQSIDKHEDWSKFGFNFSDTSTYEDLSGFYREVEQQGYKLSFTNISVSFIDKLVDEGKMYLFQIYNKDFSDYSKGTPNMHTLYWKALFDERNLADVVYKLNGQAEMFYRKKSIDYTYPTHPANHPIQNKNKDNKKKESVFEYDLVKDRRYTVDKFLFHVPITINFKSVGSENINQQVREYLQQADDTHIIGIDRGERHLLYLVVIDMQGNIKEQFTLNEIVNEYNGNTYRTNYHDLLDTREEERLTARQSWQTIENIKELKEGYLSQVVHKITQLMVKYHAVVVLEDLNKGFMRGRQKVEKQVYQKFEKMLIDKLNYLVDKKADATQSGGLLNAYQLTSKFDSFQKLGKQSGFLFYIPAWNTSKIDPVTGFVNLLDTRYQNTEKAKAFFSKFDAIRYNADKDWFEFNLDYDKFGTKAEGTRTTWTLCTQGNRICTFRNAEKNSQWDNQEVDLTGELKSLFEHYNINISGNLKEEICSQTDKAFFTGLLHILKLTLQMRNSITGTETDYLVSPVADENGVFYDSRSCGDRLPENADANGAYNIARKGLMLIGQIKGTKDLANFKYDISNKSWLNFAQQKPYKK

SEQ ID NO: 1633 - protein, 1272 aa, unidentified
  REGION 1..1272: note = Description of Unknown:uncultivated organism sequence
  REGION 1..1272: note = Category: MG75 effectors
  REGION 1..1272: note = Description: MG75-119 effector
MKFDDFKKLYSLSKTLRFEAKPVGSTLKNIIESGLLEEDEHRAQSYVKVKKLIDEYHKVFIDRVLNEGCLTIENKGKKDSLEEYYESYMSKSNDENVSKTFKEIQENLRSVIAKKLTDNNAYANLFGNKLIESYKDKDEKNKIIDSDLIQFINTAEPSQLDSMSQDEAKELVKEFWGFTTYFVGFFDNRKNMYTSEEKSTGIAYRLVNENLPKFIDNMEAFKKAIAKPEIQANMEELYSNFAEYLNVESIQEMFQLDYYNMLLTQKQIDVYNAIIGGKTDEEHDVKIKGINEYINLYNQQHKDEKLPKLKALFKQILSDRNAISWLPEEFNSDQEVLNAINDCYKRLSENVLGDKVLKSLLCSLDDYNLDGIFVRNDLQLTDISQKMFGNWSVIQNAIMQNIKNVAPARKRKESEEDYEKRISDIFKKADSFSIQYINDCLNEMDDNNLYAVDGYFATLGAVNTPTMQRENLFALIQNAYTDISNLLETPYPENKNLAQDKTNVAKVKALLDAIKSLQHFVKPLLGKGDESNKDERFYGELASLWTELDTVTPLYNMIRNYMTRKPYSEKKIKLNFENPQLLGGWDANKEKDYATIILRRNGMYYLAIMDKDSKKLLGKTMPSDGECYEKMVYKLLPGANKMLPKVFFAKSRINDFKPSKQIVENYNNGTHKKGKNFNINDCHNLIDYFKQSIDKHEDWSKFGFNFSDTSTYEDLSGFYREVEQQGYKLSFTNVSVSFIDKLVDEGKMYLFQIYNKDFSDFSKGTPNMHTLYWKALFDERNLADVVYKLNGQAEMFYRKKSINNTHPTHPANHPIQNKNKDNKKKESVFEYDLIKDRRYTVDKFLFHVPITMNFKSVGSENINQQVREYLQKADDTHIIGIDRGERHLLYLVVIDMQGNIKEQFTLNEIVNEYNGNTYHTNYHDLLDTREEERLTARQSWQTIENIKELKEGYLSQVIHKITQLMVKYHAVVVLEDLNKGFMRGRQKVEKQVYQKFEKMLIDKLNYLVDKKADAAQSGGLLNAYQLTSKFDSFQKLGKQSGFLFYIPAWNTSKIDPVTGFVNLLDTRYQNTEKAKAFFSRFDAIRYNANKDWFEFYLDYDKFCTKAEGTRTRWTLCTQGSRISTFRNAEKNSQWDNLEVDLTREMKSLFEHYHINICGNLKEEICLQTDKAFFTGLLHMLKLTLQMRNSITGTETDYLISPVADENGTFYDSRSCGDTLPKNADANGAYNIARKGLMFIGQIKETKDLANFKYDISNKAWLNFAQQKPYKNE

SEQ ID NO: 1634 - protein, 880 aa, unidentified
  REGION 1..880: note = Description of Unknown:uncultivated organism sequence
  REGION 1..880: note = Category: MG75 effectors
  REGION 1..880: note = Description: MG75-120 effector
MIQNAIMQNIKRVAPARKHKESEEDYEKRIAGIFKKADSFSISYINDCLNEADPNNAYFVENYFATFGAVNTPTMQRENLFALVQNAYTEVASLLHSYYPAEKKLAQDKANVAKIKALLDAIKSLQHFVKPLLGKGDESDKDERFYGELASLWAELDTVTPLYNMIRNYITRKPYSQKKIKLNFENPQLLGGWDANKEKDYATIILRRNGLYYLAIMDKDSRKLLGKAMPSDGECYEKMVYKLLPGANKMLPKVFFAKSRMDDFKPSKELIEKYNNGTHKKGKNFDIQDCHNLIDYFKQSIDKHEDWSKFGFNFSDTSTYEDLSGFYREVEQQGYKLSFARVSVSYINQLVEEGKMYLFQIYNKDFSEYSKGTPNMHTLYWKALFDERNLADVVYKLNGQAEMFYRKKSIENSHPTHPANHPILNKNKDNKKKESLFDYDLIKDRRYTVDKFMFHVPITMNFKSSSSENINQDVKAYLRHADDMHIIGIDRGERHLLYLVVIDLQGNIKEQYSLNEIVNEYNGNTYHTNYHDLLDVREEERLKARQSWQTIENIKELKEGYLSQVIHKITQLMVKYHAIVVLEDLNMGFMRGRQKVEKQVYQKFEKMLIDKLNYLVDKKADASVSGGLLNAYQLTSKFDSFQKLGKQSGFLFYIPAWNTSKIDPITGFVNLLDTRYQNVEKAKVFFSKFDAIRYNKDKDWFEFNLDYDKFGKKAEGTRTKWILCTRGMRIDTFRNKEKNSQWDNQEVDLTAELKSLLEHYYIDIHGNLKEAISAQTDKAFFTGLLHILKLTLQMRNSITGTETDYLVSPVADENGIFYDSRSCGEQLPENADANGAYNIARKGLMMIEQIKNAEDLGNLKFDISNKAWLNFAQQKPYKNG

SEQ ID NO: 1635 - protein, 1276 aa, unidentified
  REGION 1..1276: note = Description of Unknown:uncultivated organism sequence
  REGION 1..1276: note = Category: MG75 effectors
  REGION 1..1276: note = Description: MG75-121 effector
MAKKFEDFTKLYPLSKTLCFEARPIGATKSNIIKNGLLDEDKHRAESYVKVKKLIDEYHKAFIDRVLADGCLCYKNEGNEDSLEEYYEFYSLSSKDKSDDTRKHFATIQQNLRSKIAETLTKDKAYANLFGNKLIESHKDKEDKNNIIDSDLIQFVSTATPDQLDSQSKDDATKLIKEFWGFTTYFTGFFENRKNMYTSEEKSTGIAYRLINENLPKFIDNMESFKKIMEKPEMSANMEELRANLEEYLNVESISEMFELNYYNMLLTQKQIDVYNAVIGGKTDEEQDIKTKGINEYVNLYNQQHKDAKLPKLKTLFKQILSDRNAISWLPEEFDKDQNVLNAIKDCYVRLTANVLGNNVLNSLLSTLSEYNTESIFIRNDIQLTNISQKMAGSWNYIQDAIKQDIKNVAPARKRKESEEDYEERISKNFKKADSYSIKYIDDCLNRAYKNNTYTVEGYFATLGATNTPSLQRENLFAQIANAYTNISSLLSSDYSAEKNLAQDKENVAKIKTLLDCIKSLQHFVKPLLGKGDESDKDERFYGELSMLWKELDTVTPLYNMVRNYMTRKPYSQKKIKLNFENPQLLGGWDANKEKDYASILLRRDGKYYLGIMDKESKKLLGKSMPSDGACYQKMVYKLLPGANKMLPKVFFAKSRLADFNPSKEIIENYNNGTHKKGKNFNLKDCHALIDYFKESIKKHEDWSKFGFKFSESTTYEDLSGFYHEVEQQGYKLSFTNVSASYIDKMVDEGKMYLFQIYNKDFSEYSKGTPNMHTLYWKALFDERNLADVVYKLNGQAELFYREKSIDCTHPTHPANHPILNKNKDNEKKESIFEYDLIKDRRYTVDKFMFHVPITMNFKSTGADNINQLVREHLKDADAPHIIGIDRGERHLLYLVVIDMHGNIKEQFTLNDIVNEYNGNTYRTNYHDLLDAREDVRLKARQSWQTIENIKELKEGYLSQVIHKITQLMVKYHAIVVLEDLNMGFMRGRQKVEKQVYQKFEKMLIDKLNYYVDKKANAEQAGGLLNAYQLTSKFDSFQKLGKQSGFLLYIPAWNTSKIDPVTGFVNLLDTRYQNVEKAKAFFCKFEAIRYNSNKNWFEFTIDYNNFGQKAEGTRTKWTLCTQGKRIRTFRNPEKNSEWDNQEIDLTAALKNLFAHYHIDINGNIKEAISAQSDKTFFTELLHLLKLTLQMRNSITGTETDYLISPVADDNGYFYDSRTCNDTLPKNADANGAYNIARKGLMLIEQIKKAKDIANIKFDISNKSWLNFAQQKPYKDE

SEQ ID NO: 1636 - protein, 1274 aa, unidentified
  REGION 1..1274: note = Description of Unknown:uncultivated organism sequence
  REGION 1..1274: note = Category: MG75 effectors
  REGION 1..1274: note = Description: MG75-122 effector
MAKNFEDFKRLYPLSKTLRFEAKPIGATLDNIVKSGLLDEDEHRAASYVKVKKLIDEYHKVFIDRVLADGCLPLKNEGHNNSLTEYYDNYVSKSQNEDAKKAFEENQQNLRSIIAKKLTEDKAYANLFGKNLIESYKDKTDKTKIIDSDLIKFINTAESTQLDSMSQDEAKEIVKEFWGFTTYFVGFFDNRKNMYTAEEKSTGIAYRLINENLPKFIDNMEAFKKAIARPEIQANMEELYSNFSEYLNVESIQEMFLLDYYNMLLTQKQIDVYNAIIGGKTDDEHDVKIKGINEYINLYNQQHKDDKLPKLKALFKQILSDRNAISWLPEEFNSDQEVLNAIKDCYERLSENVLGDKVLKSLLGSLADYSLDGIFIRNDLQLTDISQKMFGNWGVIQNAIMQNIKHVAPARKHKESEEDYEKRIAGIFKKADSFSISYINDCLNEADPNNAYFVENYFATFGAVNTPTMQRENLFALVQNAYTEVAALLHSDYPTVKHLAQDKANVAKIKALLDAIKSLQHFVKPLLGKGDESDKDERFYGELASLWAELDTVTPLYNMIRNYMTRKPYSQKKIKLNFENPQLLGGWDANKEKDYATIILRRNGLYYLAIMDKDSRKLLGKAMPSDGECYEKMVYKLLPGANKMLPKVFFAKSRMEDFKPSKELVEKYNNGTHKKGKNFCIQDCHNLIDYFKQSIDKHEDWSKFGFNFSETSTYEDLSGFYREVEQQGYKLSFARVSVSYINQLVEEGKMYLFQIYNKDFSEYSKGTPNMHTLYWKALFDERNLADVVYKLNGQAEMFYRKKSIENTHPTHPANHPILNKNKDNKKKESLFKYDLIKDRRYTVDKFMFHVPITMNFKSSGSENINQDVKAYLRYADDMHIIGIDRGERHLLYLVVIDLQGNIKEQFSLNEIVNDYNGNTYHTNYHDLLDVREDERLKARQSWQTIENIKELKEGYLSQVIHKITQLMVKYHAIVVLEDLNMGFMRGRQKVEKQVYQKFEKMLIEKLNYLVDKKADASVSGGLLNAYQLTSKFDSFQKLGKQSGFLFYIPAWNTSKIDPVTGFVNLLDTRYQNVEKAKSFFSKFDAIRYNKDKDWFEFNLDYDKFGKKAEGTRTKWTLCTRGMRIDTFRNKEKNSQWDNQEVDLTAEMKSLLEHYYIDIHGNLKDAISAQTDKAFFTGLLHILKLTLQMRNSITGTETDYLVSPVVDENGIFYDSRSCGDTLPENADANGAYNIARKGLMMIEQLKDAKDLDNLKFDISNKAWLNFAQQKPYKNG

SEQ ID NO: 1637 - protein, 1252 aa, unidentified
  REGION 1..1252: note = Description of Unknown:uncultivated organism sequence
  REGION 1..1252: note = Category: MG75 effectors
  REGION 1..1252: note = Description: MG75-123 effector
MKFEDFTGLYPVSKTLRFEAKPVGATLENVIKSGVLEDDAHRARSYKKVKKLIDEYHKVFIDSVMSKFKFKEEILEEICSLYAAKSMDDKSKDRFVKLQGEMRKDVSVAFASDDRYKTINKKELVKEDLFEFVSHADNGQLAGLTKEEAEELILEFKDFTTYFSGFHKNRSNMYVADEKTTSVAYRLVNENLPRFLYNVSVFQKVVSVPEFENKIRAIYDSFREYLCVDNLASMFETSYYNDVLSQMQIDIYNSVIGGKTDKDSSTKIQGLNECINLYNQTHRNDKLPKFKILYKQILSDRVAMSWLPDEFSDDKETLEAIRNCYDSLTDHILGERDLKTLLESLGQYDMSGVFIANGPYLADISQKLYGDWRAIEKAIRKQEAVNSPKKAKETEEEYFNRITKHIHNYDSFSIEYLNFCITESYPNDGRRVEDYFATLGAVNTDTSQRENLFSRIDNAYTNVSGLLSSEYPETKKLSQDTENVEKIKDLLDSIKELQRFVKPLMGNGDESDNDKRFYGELSPLWDELETFSLLYDKVRNYVTRKPYSQNKIKLNFNNATLFAGWDQNKEKDNACIILRRGGMYYLGIMNKSYRIVFENNFPCDGDCYEKMVYKLLPGANKMLPKVFFSKSRIREFNPSDRILKNYEEGTHKKGPKFKLEDCHELIDFFKASINLHEDWKKFKFKFSDTSSYEDISDFYKEVEQQGYKITFVNVSVSYIDSLVNDGKLYLFQLYNKDFSQYSKGVPNMHTLYWKALFDKANLADVVYKLNGEAELFFRKKSIDMERPTHRANISVANKNIHNIKKESIFKYDLTKDRRYTVDKFLFHVPITMNFKSEGNIAIEQQVRSYLQSAEDTHVIGIDRGERHLLYVSVIDRRGLIKEQFSLNEIINEHNGSTYATNYHDLLDAKESERRKARQSWQTIENIKDLKEGYLSQAVHKIAQLMVKYHAVVVLEDLNVGFMRGRQKVEKQVYQKFEKMLTDKLNYLVDKKLNANDPGGVFHAYQLSSVFKSAEKRGKQSGFIFYIPAWNTSKIDPVTGFVNLFDLKYENIDKAKSFFSKFQIIRYNSERDWFEFIFDYDSFNSKASGTKVGWTLTTHGDRILSFRNSEKNNQWDSRAVILTDEYKALFDKYGIDYNDNLKEAITNQTEKAFFEDLLKCLRLTLQMRNSVIGTDTDFLISPVADNNGVFYDSRICADSLPKNADANGAYNIARKGLMLIDQIKKASDVRNIKFDIANKSWLDFAQKKPYLDE

SEQ ID NO: 1638 - protein, 1271 aa, unidentified
  REGION 1..1271: note = Description of Unknown:uncultivated organism sequence
  REGION 1..1271: note = Category: MG75 effectors
  REGION 1..1271: note = Description: MG75-124 effector
MEYENFKKIYPLSKTLRFEAKPVGSTLKNFIESGLLEEDEHRAQSYVKVKKLIDEYHKVFIDRVLNDGCLPLENKGNKNSLEEYYESYLSKNRDENANNTFKEIQQNLRSVIAKKLTDDKAYANLFGNKLIESYKDKEDKKKIIDSDLIQFINCANSSQLNGMSEDEAKELVKEFWGFTTYFEGFHTNRKNMYTAEEESTAIAHRLINENLPKFIDNMDVFKKAVAKPEIQANIEELYANFAAYLNVESIQEMFQLDYYNMLLTQKQIDVYNAIIGGKTDEDHDVKIKGINEYINLYNQQHKNEKLPKLKVLFKQILSDRNAISWLPEEFNDDQEVLNAIKDCYERLSENVLGDKVLKSLLCSLGDYNLDGIFVRNDAQLTDISQKMFGDWGVIQNAIIQNIKNVAPARKRKESEEDYEKRISDIFKKADSFSLRYINDCLNEMDEKNPYTVQWYFSTLGAVNTPTMQRENLFALIQNAYTDISDLLNSQYPTDKNLSQDKTNVAKVKALLDAIKSLQHFVKPLLGRGDESDKDERFYGELASLWTELDTVTPLYNMVRNYMTRKPYSEKKIKLNFENPQLLGGWDANKEKDYASIILRRNGLYYLAIMNKESKKLLGKTMPSDGECYEKMVYKLLPGANKMLPKVFFSKSKIDYFKPSKQIVENYNNDTHKKGKNFNINDCHDLIDFFKQSIDIHEDWSKFGFKFSDTSTYKDLSGFYREVEQQGYKLSFTKVSVSFIDKLVDDGKMYLFQIYNKDFSKYSKGTPNMHTLYWKALFDERNLADVVYKLNGQAEMFYRKKSIVYTHPTHPANHPILNKNKENKKKESVFEYDLVKDRRYTVDKFLLHVPITMNFKSVGSENINQQVREYLQQAEDTHIIGIDRGERHLLYLVVIDMQGNIKEQYTLNEIVNEYNGNTYRTNYHDLLNTREEERLTARQSWQTIENIKELKEGYLSQVIHKITQLMVKYHAVVVLEDLNKGFMRGRQKVEKQVYQKFEKMLIDKLNYLVDKKADAAQLGGLLNAYQLTSKFDSFQKLGKQSGFLFYIPAWNTSKIDPVTGFVNLLDTRYQNTEKAKAFFSKFDAIRYNTDKDWFEFYLDYDKFGTKAEGTRTKWTLCTQGCRIRIFRNADKNSQWDNQDVDLTKELKALFEIYHINIGGNLKEGICSQTDKAFFTGLLHILKLTLQMRNSITGTETDYLVSPVADENGVFYDSRSCGDTLPKNADANGAYNIARKGLMLIEQIKETKDLANFKYDISNKAWLNFAQQKPYEK

SEQ ID NO: 1639 - protein, 1080 aa, unidentified
  REGION 1..1080: note = Description of Unknown:uncultivated organism sequence
  REGION 1..1080: note = Category: MG75 effectors
  REGION 1..1080: note = Description: MG75-125 effector
MYTSEEKSTGIAYRLINENLPKFIDNMEAFKKAIAIPEIQANIGELYSDFSEYLNVESIQEMFQLDYYNMLLTQKQIDVYNAIIGGKTDEDHDVNIKGINQYINIYNQHHKDEKLPKLKALFKQILSDRNAISWLPEEFNSDQEVLNAIDDCYKRLSENVLGDKVLKSLLCSLSDYNLNGIFVRNDLQLTDISQKMFGNWSVIQNAIMQNIKNVAPARKRKESEEDYEKRISDIFKKADSFSIQYINDCLNEMDDNNLHTVDGYFAKLGAVNTPTMQRENLFALIQNAYTDISDLLDTPYPENKNLAQDKTNVAKVKALLDAIKSLQHFVKPLLGKGDESDKDERFYGELASLWTELDTVTPLYNMIRNYMTRKPYSEKKIKLNFENPQLLGGWDANKEKDYATIILRRNGMYYLAIMDKDSKKLLGKTMPYDGECYEKMVYKLLPGANKMLPKVFFAKSRINDFKPSKKIVENYNNGTHKKGKNFNINDCHDLIDYFKQSIDKHEDWSKFGFNFSDTSTYEDLSGFYREVEQQGYKLSFTNISVSFIDKLVDEGKMYLFQIYNKDFSDYSKGTPNMHTLYWKALFDERNLADVVYKLNGQAEMFYRKKSIDYTHPTHPANHPIQNKNKDNKKKESVFEYDLVKDRRYTVDKFLFHVPITMNFKSVGSENINQQVREYLQQADDTHIIGIDRGERHLLYLVVIDMQGNIKEQFTLNEIVNEYNGNTYRTNYHDLLDTREEERLTARQSWQTIENIKELKEGYLSQVIHKITQLMVKYHAVVVLEDLNKGFMRGRQKVEKQVYQKFEKMLIDKLNYLVDKKVDATQSGGLLNAYQLTSKFDSFQKLGKQSGFLFYIPAWNTSKIDPVTGFVNLLDTRYQNTEKAKAFFSKFDAIRYNADKDWFEFNLDYDKFGTKAEDTRTTWTLCTQGNRICTFRNAEKNSQWDNQEVDLTRELKSLFEHYNINICGNLKEEICSQTDKAFFTGLLHILKLTLQMRNSITGTETDYLVSPVADENGVFYDSRSCGDTLPKNADANGAYNIARKGLMLIGQIKETKDLANFKYDISNKAWLNFAQQKPYKK

SEQ ID NO: 1640 - protein, 1236 aa, unidentified
  REGION 1..1236: note = Description of Unknown:uncultivated organism sequence
  REGION 1..1236: note = Category: MG75 effectors
  REGION 1..1236: note = Description: MG75-126 effector
MEEYYESYMSKSNDENVSKTFKEIQENLRSVIAKKLTDNNAYANLFGNKLIESYKDKDEKNKIIDSDLIQFINTAEPSQLDSMSQDEAKELVKEFWGFTTYFVGFFDNRKNMYTSEEKSTGIAYRLINENLPKFIDNMEAFKKAVAKPEIQANIEELYSNFAEYLNVESIQEMFQLDYYNMLLTQKQIDVYNAIIGGKTDEEHDVKIKGINEYINLYNQQHKDEKLPKLKALFKQILSDRNAISWLPEEFNSDQEVLNAIKDCYERLSENVLGDKVLKSLLCSLSDYNLNGIFVRNDLQLTDISQKMFGNWSVVQDAIMQNIKNVAPARKRKESEEDYEKRISDIFKKADSFSIQYINDCLNEMDDNNLHAVDGYFATLGAVNTPTMQRENLFALIQNAYTDISNLLETPYPENKNLAQDKTNVAKVKALLDAIKSLQHFVKPLLGKGDESDKDERFYGELASLWTELDTVTPLYNMVRNYMTRKPYSEKKIKLNFENPQLLGGWDANKEKDYATIILRRNGMYYLVIMDKDSKKLLGKTMPSDGECYEKMVYKQFDISKQLPKCTTELKRVRKALVEDAKRSCLLSDSKDWNKPLNVTRKLWELNNYVWDKKKADWVLRKKENETRPKKFHKKYLELTSDKKGYNQAKNDWIKFTKEFLSSYKKVEAYDIHYKKRYNSVDELYKQLNGDFYTISFSYVSVSFIEKLVDEGKMYLFQIYNKDFSDYSKGTPNMHTLYWKALFDERNLADVVYKLNGQAEMFYRKKSINNTPPTHPANHPIQNKNKDNKKKESVFEYNLIKDRRYTVDKFLFHVPITMNFKSVGSENINQQVREYLQQADDTHIIGIDRGERHLLYLVVIDMQGEIKEQFTLNEIVNEYNGNTYRTNYHDLLDTREEERLKARQSWQTIENIKELKEGYLSQVIHKITQLMVKYHAVVVLEDLNKGFIRGRQKVEKQVYQKFEKMLIDKLNYLVDKKADAVQSGGLLNAYQLTSKFDSFQKLGKQSGFLFYIPAWNTSKIDPVTGFVNLLDTRQNTEKAKAFFSKFDVIRYNANKDWFEFNLDYDKFGTKAEGTRTKWILCTQGNRICTFRNTEKNSQWDNQEVDLTREMKSLFNYYHINICGNLKEEICSQTDKAFFTGLLHMLKLTLQMRNSITGTETDYLVSPVADENGVFYDSRSCGDTLPKNADANGAYNIARKGLMLIRQIKETKDLANFKYDISNKAWLNFAQQKPYKNE

SEQ ID NO: 1641 - protein, 1274 aa, unidentified
  REGION 1..1274: note = Description of Unknown:uncultivated organism sequence
  REGION 1..1274: note = Category: MG75 effectors
  REGION 1..1274: note = Description: MG75-127 effector
MAKIFEDFKRLYPLSKTLRFEAKPIGATLDNIIKSGLLDEDEHRAASYVRVKKLIDEYHKVFIDRVLDNGCLPLKNEGHNNSLTEYYESYVTKSQNEDAKKVFKEIQQNLRSIIAKKLTEDKAYANLFGKNLIESYKDKTDKTKIIDSDLIKFINTAESTQLDSMSQDEAKELVKEFWGFTTYFVGFYDNRKNMYTAEEKSTGIAYRLVNENLPKFIDNMEAFKKAIARPEIQANMEELYSDFSEYLNVESVQEMFQLDYYNMLLTQKQIDVYNAIIGGKTDDEHDVKIKGINEYINLYNQQHKDDKLPKLKALFKQILSDRNAISWLPEEFNGDQEVLNAIKDCYERLSENVLGDKVLKSLLGSLSDYSLDGIFIRNDLQLTDISQKMFGNWCVIQNAIMQNIKHVAPARKHKESEEDYEKRIAGIFKKVDSFSISFINDCLNEADPNNAYFVENYFATFGAVNTPTMQRENLFALVQNAYTEVAALLHSDYPTAKHLAQDKVNVAKIKALLDAIKSLQHFVKPLLGKGDESDKDERFYGELASLWAELDTVTPLYNMIRNYMTRKPYSQKKIKLNFENPQLLGGWDANKEKDYATIILRRDGLYYLAIMNKESKKLLGKAMPSDGECYEKMVYKLLPGANKMLPKVFFAKSRMEDFKPSKELVEKYNNGTHKKGKNFNIQDCHNLIDYFKQSISKHEDWGKFGFNFSDTSTYEDLSGFYREVEQQGYKLSFVRVSVSYINQLVEEGKMYLFQIYNKDFSEYSKGTPNMHTLYWKALFDERNLADVVYKLNGQAEMFYRKKSIENTYPTHPANHPILNKNKDNKKKESLFDYDLIKDRRYTVGKFMFHVPITMNFKSSGSENINQDVKAYLRHADDMHIIGIDRGERHLLYLVVIDLQGNIKEQYSLNEIVNEYNGNTYHTNYHDLLDVREEERLKARQSWQTIENIKELKEGYLSQVIHKITQLMVKYHAIVVLEDLNMGFMRGRQKVEKQVYQKFEKMLIDKLNYLVDKKADASVSGGLLNAYQLTSKFDSFQKLGKQSGFLFYIPAWNTSKIDPVTGFVNLLDTRYQNVEKAKVFFSKFDAIRYNKDKDWFEFNLDYDKFGKKAEGTRTKWALCTRGMRIDTFRNKEKNSQWDNQEVDLTAEMKSLLEHYYIDIHGNLKDAISAQTDKAFFTGLLHILKLTLQMRNSITGTETDYLVSPVADENGIFYDSRSCGDELPENADANGAYNIARKGLMMIEQIKDAKDLDNLKFDISNKSWLNFAQQKPYKNE

SEQ ID NO: 1642 - protein, 1272 aa, unidentified
  REGION 1..1272: note = Description of Unknown:uncultivated organism sequence
  REGION 1..1272: note = Category: MG75 effectors
  REGION 1..1272: note = Description: MG75-128 effector
MKFDDFKKLYSLSKTLRFEAKPVGSTLKNIIESGLLEEDEHRAQSYVKVKKLIDEYHKVFIDRVLNDGCLTIENKGKKDSLEEYYESYMSKSNDENVSKTFKEIQENLRSVIAKKLTDDNAYANLFGNKLIESYKDKDEKNKIIDSDLIQFINTAEPSQLDSMSQDEANELVKEFWGFTTYFVGFFDNRKNMYTSEEKSTGIAYRLINENLPKFIDNMEAFKKAVAKPEIQANIEELYSNFAEYLNVESIQEMFQLDYYNMLLTQKQIDVYNAIIGGKTDEEHDVKIKGINEYINLYNQQHKDEKLPKLKALFKQILSDRNAISWLPEEFNSDQKVLNAIDDCYKRLSENVLGDKVLKSLLCSLDDYNLDGIFVRNDLQLTDISQKMFGNWSVIQNAIMQNIKNVAPARKRKESEEDYEKRISDIFKKADSFSIQYINDCLNEMDDNNLHAVDGYFATLGAVNTPAMQRENLFALIQNAYTDISNLLETPYPENKNLAQDKTNVAKVKALLDAIKSLQHFVKPLLGKGDESDKDERFYGELASLWTELDTVTPLYNMIRNYMTRKPYSEKKIKLNFENPQLLGGWDANKEKDYATIILRRNGMYYLAIMDKDSKKLLGKTMPSDGECYEKMVYKLLPGANKMLPKVFFAKSRINDFKPSKLIVENYNNGTHKKGKNFNINDCHNLIDYFKQSIDKHEDWSKFGFNFSDTSTYEDLSGFYREVEQQGYKLSFTNVSVSFIDKLVDEGKMYLFQIYNKDFSDFSKGTPNMHTLYWKALFDERNLADVVYKLNGQAEMFYRKKSINNTHPTHPANHPIQNKNKDNKKKESVFEYDLIKDRRYTVDKFLFHVPITMNFKSVGSENINQQVREYLQQADDTHIIGIDRGERHLLYLVVIDMQGNIKEQFTLNEIVNEYNGNTYHTNYHDLLDTREEERLTARQSWQTIENIKELKEGYLSQVIHKITQLMVKYHAVVVLEDLNKGFMRGRQKVEKQVYQKFEKMLIDKLNYLVDKKADAAQSGGLLNAYQLTSKFDSFQKLGKQSGFLFYIPAWNTSKIDPVTGFVNLLDTRYQNTEKAKAFFSRFDAIRYNANKDWFEFYLDYDKFCTKAEGTRTRWTLCTQGSRISTFRNAEKNSQWDNLEVDLTREMKSLFEHYHINICGNLKEEICLQTDKAFFTGLLHMLKLTLQMRNSITGTETDYLISPVADENGTFYDSRSCGDTLPKNADANGAYNIARKGLMFIGQIKETKDLANFKYDISNKAWLNFAQQKPYKNE

SEQ ID NO: 1643 - protein, 1245 aa, unidentified
  REGION 1..1245: note = Description of Unknown:uncultivated organism sequence
  REGION 1..1245: note = Category: MG75 effectors
  REGION 1..1245: note = Description: MG75-129 effector
METFSDFTNLYPLSKTLRFRLIPVGETLRHFIDSGILEEDQHRAESYVKVKAIIDDYHRAYIESSLSGFELPVESMGKSNSLEEYYQYHNIRNKTEDIQNTLSKVRDNLRKQIVNQLIKSEMFKRIDKKELIQTDLIDFVKNDPDENEKITLISEFRNFTVYFKGFHENRKNMYSDEEKSTSIAFRLIHENLPKFIDNMEVFAKIQNTSISEEFDAIQKELCPDSVAFADMFKLGYFNRTLSQKQIDAYNTVISGRMTAEGGKIKGLNEYINLYNQQHKQEKLPKMKLLFKQILSDRESASWLPEKLENDKQVVGALVDFWNTIHDTVLAEGGLKTVISSLVSYSLEGIFLKNDLQLTDVSQKATGSWSKIPAAIKQNLEAMNPQKKKESYEGYQERIDKIFKSYKSFSLAFINECLHGEYKIEDYFIELGAINTDSLQKENHFSHIFNTYTDIKEVIEFYSESIDTKLIRDNDSIQKIKQFLDAVKDLQAYVKPLLGNGDETGKDERFYGDFVEYWNQLDLITPLYNMVRNYVTQKPYSIEKIKINFQNPTLLNGWDLNKETDNTSVILRRDGKYYLAIMNNKCRKVFLKYPSGSDRSCYEKMEYKLLPGANKMLPKVFLSKSRINEFMPDERLLSNYEKGTHKKTGNSFSLTDCHALIDFFKKSLNKHEDWKNFGFKFSDTSTYTDMSGFYKEVENQGYKLSFKPIDAVYVDQLVDEGKIFLFQIYNKDFSEHSKGTPNLHTLYWKMLFDETNLGDVVYKLNGEAEVFFRKASIKVSSPTHPANVPIKKKNPKHKDEERILKYDLIKDKRYTVDQFQFHVPITMNFKSDGNGNINQRVIEYLRSVSDIHIIGIDRGERNLLYLVVIDGSGKICEQFSLNEIKVEYNGETYSTNYHDLLDIKEDERKQARQSWQSIANIKDLKEGYLSQVIHKISELMVKYNAIVVLEDLNTGFMRGRQKVEKQVYQKFEKMLIEKLNYLVFKKQPSNLCGGLMHAYQLTNKFEGFNKLGKQSGFLFYIPAWNTSKMDPVTGFVNLFDLKYESIDKAKSFFSKFDSIRYNVERDMFEWKFNYDEFTKKAEGTKTNWTVCSYGNRIITFRNPNKNSQWDNKEINLTENIKLLFERFGIDLSSNLKDEIMQRTEKEFFIELISLFKLVLQMRSSWTGTDIDYLISPVCNENGEFFDSRNVDETLPQNADANGAYNIARKGMILLDKIKKSNGEKKLVLSITNREWLSFAQGCCKNG

SEQ ID NO: 1644 - protein, 1058 aa, unidentified
  REGION 1..1058: note = Description of Unknown:uncultivated organism sequence
  REGION 1..1058: note = Category: MG75 effectors
  REGION 1..1058: note = Description: MG75-130 effector
MAKNFEDFKRLYSLSKTLRFEAKPIGATLDNIVKSGLLDEDEHRAASYVKVKKLIDEYHKVFIDRVLDDGCLPLENKGNNNSLAEYYESYVSRAQDEDAKKKFKEIQQNLRSVIAKKLTEDKAYANLFGNKLIESYKDKEDKKKIIDSDLIQFINTAESTQLDSMSQDEAKELVKEFWGFVTYFYGFFDNRKNMYTAEEKSTGIAYRLVNENLPKFIDNIEAFNRAITRPEIQENMGVLYSDFSEYLNVESIQEMFQLDYYNMLLTQKQIDVYNAIIGGKTDDEHDVKIKGINEYINLYNQKHKDDKLPKLKALFKQILSDRNAISWLPEEFNSDQEVLNAIKDCYERLSENVLGDKVLKSMLGSLADYSLDGIFIRNDLQLTDISQKMFGNWSVIQNAIMQNIKHVAPARKHKESEEEYENRIAGIFKKADSFSISYIDACLNETDPNNAYFVENYFATLGAVDTPTMQRENLFALVQNAYTEITALLHSDYPTEKNLAQDKANVAKIKALLDAIKSLQHFVKPLLGKGDESDKDERFYGELASLWAELDTMTPLYNMIRNYMTRKPYSQKKIKLNFENPQLLGGWDANKEKDYATIILRRNGLYYLAIMNKDSKKLLGKAMPSDGECYEKMVYKLLPGANKMLPKVFFAKSRMEDFKPSKELVEKYNNGTHKKGKNFNIQDCHNLIDYFKQSIDKHEDWSKFGFKFSDTSTYEDLSGFYREVEQQGYKLSFARVSVSYINQLVEEGKMYLFQIYNKDFSEYSKGTPNMHTLYWKALFDERNLADVVYKLNGQAEMFYRKKSIENTHPTHPANHPILNKNKDNNKKESLFEYDLIKDRRYTVDKFMFHVPITMNFKSSGSENINQDVKAYLCHADDMHIIGIDRGERHLLYLVVIDLQGNIKEQFSLNEIVNDYNGNTYHTNYHDLLDVREDERLKARQSWQTIENIKELKDGYLSQVIHKITQLMVKYHAIVVLEDLNMGFMRGRQKVEKQVYQKFEKMLIEKLNYLVDKKADASVSGGLLNAYQLTSKFDSFQKLGKQSGFLFYRECKLNCVKLQ

SEQ ID NO: 1645 - protein, 897 aa, unidentified
  REGION 1..897: note = Description of Unknown:uncultivated organism sequence
  REGION 1..897: note = Category: MG75 effectors
  REGION 1..897: note = Description: MG75-131 effector
MAKIFEDFKRLYPLSKTLRFEAKPIGATLDNIIKSGLLDEDEHRAASYVRVKKLIDEYHKVFIDRVLDNGCLPLKNEGHNNSLTEYYESYVTKSQNEDAKKVFKEIQQNLRSIIAKKLTEDKAYANLFGKNLIESYKDKTDKTKIIDSDLIKFINTAESTQLDSMSQDEAKELVKEFWGFTTYFVGFYDNRKNMYTAEEKSTGIAYRLVNENLPKFIDNMEAFKKAIARPEIQANMEELYSDFSEYLNVESVQEMFQLDYYNMLLTQKQIDVYNAIIGGKTDDEHDVKIKGINEYINLYNQQHKDDKLPKLKALFKQILSDRNAISWLPEEFNGDQEVLNAIKDCYERLSENVLGDKVLKSLLGSLSDYSLDGIFIRNDLQLTDISQKMFGNWCVIQNAIMQNIKHVAPARKHKESEEDYEKRIAGIFKKVDSFSISFINDCLNEADPNNAYFVENYFATFGAVNTPTMQRENLFALVQNAYTEVAALLHSDYLTAKHLAQDKVNVAKIKALLDAIKSLQHFVKPLLGKGDESDKDERFYGELASLWAELDTVTPLYNMIRNYMTRKPYSQKKIKLNFENPQLLGGWDANKEKDYATIILRRDGLYYLAIMNKDSKKLLGKAMPSDGECYEKMVYKLLPGANKMLPKVFFAKSRMEDFKPSKELVEKYNNGTHKKGKNFNIQDCHNLIDYFKQSISKHEDWGKFGFNFSDTSTYEDLSGFYREVEQQGYKLSFTRVSVSYISQLVEEGKMYLFQIYNKDFSEYSKGTPNMHTLYWKALFDERNLADVVYKLNGQAEMFYRKKSIENTHPTHPATHPILNKNKDNKKKESLFDYDLIKDRRYTVDKFMFHVPITMNFKSSGSENINQDVKAYLRHADDMHIIGIDRGERHLLYLVVID

SEQ ID NO: 1646 - protein, 910 aa, unidentified
  REGION 1..910: note = Description of Unknown:uncultivated organism sequence
  REGION 1..910: note = Category: MG75 effectors
  REGION 1..910: note = Description: MG75-132 effector
MYFDDFKKLYPLSKTLRFEAKPVGPTFKHIKERGLLEEDEHRAISYVKVKKLIDEYHKAFVGKALNNGCLLYESCGNKNSLIEYYETYKSKEGEARKTMKEIQKNLREMIVGAFEKEEDYANLFKGGLIEPYKSGGKHKEPDILRLINTAGFSQLAGMSQEEAKSLIKEFWRFTTYFVGFFDNRGNMYTSEEKSTGIAYRLINENLPRFIDNMEIFNKIIGKSEIQARVTELYSDFEGYLNVGSIQEMFKLDYYNALLTQKQIDVYNAIISGRTTTGPESKKIKGLNEYINLYNQQHKDGKLPKFKPLFKQILSDREALSWLPDEFVNDQEMLNAIKNCYEKLTGNILGESALKVLLGSLADYDLGGIFVRNDSQLTNISQRMFGRWDAIQNAILQDIRKTAPMRKRRESEEDYENRIDKMFKKADSFSIKYINDCIREIAVDDTLFVEDYFATLGAVNTPTIQRENLFLLVQNAFTDVADLLNSEYSAEKSLAQDSVNVSKIKALLDAIKSLQQFVRPLLGNGDENEKDERFYGEFTSLWAELDEVTLLYDMVRNRMTRKPYSQKKIKLNFANPKLLNGWDENKEKDNSCIILRRDGKYYLAVMDKKSKNLLGKPMPSDGECYEKMVYKLLPGAQKMFPKVFFAKSRIDEFKPSEHILNIYSNGTHKKGNKNFNIEDCHDLIDFFKESIRRHKDWNKFGFEFSDTSTYENVNEFYREADEQGYKLSFVNVSVAYIDKLVNEGEMYLFQIYNKDFSEYSKGTPNMHTLYWKALFDDRNLVDMVYKLNGQAELFYRKKSLDSIRPTHPANQPIKNKNKNNKKKESLFEYDLVKDRRYTVDKFMFHVPITMNFKNAGLEKINQQVREYLQQADDTHIIGIDRGERHLLYLVVIDMHGNIKEQFSLNEIVNEC

SEQ ID NO: 1647 - protein, 1269 aa, unidentified
  REGION 1..1269: note = Description of Unknown:uncultivated organism sequence
  REGION 1..1269: note = Category: MG75 effectors
  REGION 1..1269: note = Description: MG75-133 effector
MYFDDFKKLYPLSKTLRFEAKPVGPTFKHIKERGLLEEDEHRAISYVKVKKLIDEYHKAFVGKALNNGCLLYESCGNKNSLIEYYETYKSKEGEARKTMKEIQKNLREMIVGAFEKEEDYANLFKGGLIEPYKSGGKHKEPDILRLINTAGFSQLAGMSQEEAKSLIKEFWRFTTYFVGFFDNRGNMYTSEEKSTGIAYRLINENLPRFIDNMEIFNKIIGKSEIQARVTELYSDFEGYLNVGSIQEMFKLDYYNALLTQKQIDVYNAIISGRTTTGPESKKIKGLNEYINLYNQQHKDGKLPKFKPLFKQILSDREALSWLPDEFVNDQEMLNAIKNCYEKLTGNILGESALKVLLGSLADYDLGGIFVRNDSQLTNISQRMFGRWDAIQNAILQDIRKTAPMRKRRESEEDYENRIDKMFKKADSFSIKYINDCIREIAVDDTLFVEDYFATLGAVNTPTIQRENLFLLVQNAFTDVADLLNSEYSAEKSLAQDSVNVSKIKALLDAIKSLQQFVRPLLGNGDENEKDERFYGEFTSLWAELDEVTLLYDMVRNRMTRKPYSQKKIKLNFANPKLLNGWDENKEKDNSCIILRRDGKYYLAVMDKKSKNLLGKPMPSDGECYEKMVYKLLPGAQKMFPKVFFAKSRIDEFKPSEHILNIYSNGTHKKGNKNFNIEDCHDLIDFFKESIRRHKDWNKFGFEFSDTSTYENVNEFYREADEQGYKLSFVNVSVAYIDKLVNEGEMYLFQIYNKDFSEYSKGTPNMHTLYWKALFDDRNLVDMVYKLNGQAELFYRKKSLDSIRPTHPANQPIKNKNKNNKKKESLFEYDLVKDRRYTVDKFMFHVPITMNFKNAGLEKINQQVREYLQQADDTHIIGIDRGERHLLYLVVIDMHGNIKEQFSLNEIVNECSGNTYHTNYHALLDAREEERLNARRSWQTIESIKELKEGYLSQVIHRITQLMVKYHAIVVLEDLSMGFMRGRQKVEKQVYQKFEKMLIDKLNYLVDKKVDVSQPGGLLNAYQLTNKFESFQSSEKQSGFVFYIPAWNTSKIDPVTGFVNLLDTRYQNVEKARAFFSKFDAIRYNKDKDWFEFGVDYDNFNKKAEGTMTKWTLCTQGVRICTFRNAEKNSQWDTQEVDLTTEMKSLFGQSQIDVNGNLKEAICSQSDKTFFMRLLHLLKLMLQMRNSITGTEIDYLVSPVADGNGNFYDSRKCDSTLPKNADANGAYNIARKGLMLLRQMKTADNLTDVKFDMTNRTWLKFAQQKPYKDE

SEQ ID NO: 1648 - protein, 848 aa, unidentified
  REGION 1..848: note = Description of Unknown:uncultivated organism sequence
  REGION 1..848: note = Category: MG75 effectors
  REGION 1..848: note = Description: MG75-134 effector
MAKIFEDFKRLYPLSKTLRFDAKPVGATLDNIVKSGLLEEDEHRAASYVRVKKLIDEYHKVFIDRVLDNGCLPLENKGENNSLAEYYDSYVSKSQNEDAKKAFEENQQNLRSIIAKKLTGDKAYANLFGKNLIESYKDKKDKKKIIDSDLIQFINTADSTQLDSMTQVEAKELVKEFWGFVTYFYGFFDNRKNMYTAEKKSTGIAYRLINENLPKFIDNMEAFKKVIARPEIQANMEELYSDFSEYLNVESIQEMFQLDYYDMLLTQKQIDVYNAIIGGKTDDEHDVKIKGINEYINLYNQQHKDTRLPKLKALFKQILSDRNAISWLPEEFNSDQEVLNAIKDCYERLSENVLGDKVLKSLLGSLADYSLEGIFIRNDLQLTDVSQKMFGNWGVIQNAIMQNIKHVAPARKHKESEENYEKRIAGIFKKADSFSISYINDCLNEADPNNAYFVENYFATFGAVNTPTMQRENLFALVQNAYTEVAALLHSDYPTVKHLAQDKANVSKIKALLDAIKSLQHFVKPLLGNGDESGKDDRFYGELASLWAELDTVTPLYNMIRNYMTRKPYSQKKIKLNFENPQLLGGWDANKEKDYATIILRRNGLYYLAIMGKDSKNLLGKAMPSDGECYEKMVYKQFDISKQLPKCTTELKHVKKALVENAKRSCLLSDINNWNKPLNVTRKLWELNNFVWDKKKEDWVLRKKDNETRPKKFHKKYLELTSDKKGYNQAINDWIKFTKEFLSSYKKVEAYEIHYKKRYNSVDELYKQLNGDLYAISFTYVSVSFIEQLVSEGKMYLFQIYNKDFSKYSKGTPNMHTLYWKALFDERNLADVVYKLNGQAEMFYRKGV

SEQ ID NO: 1649 - protein, 1304 aa, unidentified
  REGION 1..1304: note = Description of Unknown:uncultivated organism sequence
  REGION 1..1304: note = Category: MG75 effectors
  REGION 1..1304: note = Description: MG75-135 effector
MFPACFQEQRTGHPNNIVKSGLLEEDEHRAASYVRVKKLIDEYHKVFIDRVLDNGCLPLENKGENNSLAEYYDSYVSKSQNEDAKKAFEENQQNLRSIIAKKLTGDKAYANLFGKNLIESYKDKKDKKKIIDSDLILFINTADSTQLDSMTQVEAKELVKEFWGFVTYFYGFFDNRKNMYTAEKKSTGIAYRLINENLPKFIDNMEAFKKVIARPEIQANMEELYSDFSEYLNVESIQEMFQLDYYDMLLTQKQIDVYNAIIGGKTDDEHDVKIKGINEYINLYNQQHKDTRLPKLKALFKQILSDRNAISWLPEEFNSDQEVLNAIKDCYERLSENVLGDKVLKSLLGSLADYSLEGIFIRNDLQLTDVSQKMFGNWGVIQNAIMQNIKHVAPARKHKESEEEYEKRIAGIFKKADSFSISYLNDCLNEADPNNAYFVENYFATFGAVNTPTMQRENLFALVQNKYTEVAALLHSDYPTAKHLAQDKANVAKIKALLDAIKSLQHFVKPLLGKGDESDKDERFYGELASLWAELETVTPLYNMIRNYMTRKPYSQKKIKLNFENPQLLDGWDANKEKDYATIILRRNGLYYLAIMGKDSKNLLGKAMPSDGECYEKMVYKQFDISKQLPKCTTELKHVRKALVEDAKRSCLLSDFNNWNKPLNVTRKLWELNNFVWDKKKEDWVLRKKDNETRPKKFHKKYLELTSDKKGYNQAKNDWIKFIKEFLSSYKKVEAYDIHYKKRYNSVDELYKQLNGDLYAISFTYVSASFIEQLVSEGKMYLFQIYNKDFSEYSKGTPNMHTLYWKALFDERNLADVVYKLNGQAEMFYRKKSLENTHPTHPANHPILNKNKDNKKKESLFDYDLIKDRRYTVDKFMFHVPITMNFKSSGSENINQDVKAYLRHADDMHIIGIDRGERHLLYLVVIDLQGNIKEQYSLNEIVNEYNGNTYHTNYHDLLDVREEERLKARQSWQTIENIKELKEGYLSQVIHKITQLMVKYHAIVVLEDLNMGFMRGRQKVEKQVYQKFEKMLIDKLNYLVDKKADASVSGGLLNAYQLTSKFDSFQKMGKQSGFLFYIPAWNTSKIDPVTGFVNLLDTRYQNVEKAKVFFSKFDAIRYNKDKDWFEFNLDYDKFGKKAEGTRTKWALCTRGMRIDTFRNKEKNSQWDNQEVDLTAEMKSLLEHYYIDIHGNLKDAISAQTDKTFFTGLLHILKLTLQMRNSITGTETDYLVSPVADENGIFYDSRSCGDELPENADANGAYNIARKGLMMIEQIKDAKDLNNLKFDISNKAWLNFAQQKPYKNG

SEQ ID NO: 1650 - protein, 870 aa, unidentified
  REGION 1..870: note = Description of Unknown:uncultivated organism sequence
  REGION 1..870: note = Category: MG75 effectors
  REGION 1..870: note = Description: MG75-136 effector
MAKIFEDFKRLYPLSKTLRFEAKPIGATLDNIIKSGLLDEDEHRAASYVRVKKLIDEYHKVFIDRVLDNGCLPLKNEGHNNSLTEYYESYVTKSQNEDAKKVFKEIQQNLRSIIAKKLTEDKAYANLFGKNLIESYKDKTDKTKIIDSDLIKFINTAESTQLDSMSQDEAKELVKEFWGFTTYFVGFYDNRKNMYTAEEKSTGIAYRLVNENLPKFIDNMEAFKKAIARPEIQANMEELYSDFSEYLNVESVQEMFQLDYYNMLLTQKQIDVYNAIIGGKTDDEHDVKIKGINEYINLYNQQHKDDKLPKLKALFKQILSDRNAISWLPEEFNGDQEVLNAIKDCYERLSENVLGDKVLKSLLGSLSDYSLDGIFIRNDLQLTDISQKMFGNWCVIQNAIMQNIKHVAPARKHKESEEDYEKRIAGIFKKVDSFSISFINDCLNEADPNNAYFVENYFATFGAVNTPTMQRENLFALVQNAYTEVAALLHSDYPTAKHLAQDKVNVAKIKALLDAIKSLQHFVKPLLGKGDESDKDERFYGELASLWAELDTVTPLYNMIRNYMTRKPYSQKKIKLNFENPQLLGGWDANKEKDYATIILRRDGLYYLAIMNKESKKLLGKAMPSDGECYEKMVYKLLPGANKMLPKVFFAKSRMEDFKPSKELVEKYNNGTHKKGKNFNIQDCHNLIDYFKQSISKHEDWGKFGFNFSDTSTYEDLSGFYREVEQQGYKLSFTRVSVSYISQLVEEGKMYLFQIYNKDFSEYSKGTPNMHTLYWKALFDERNLADVVYKLNGQAEMFYRKKSIENTHPTHPANHPILNKNKDNKKKESLFDYDLIKDRRYTVDKFMFHVPVTMNFKSSGSENINQDVKA

SEQ ID NO: 1651 - protein, 1304 aa, unidentified
  REGION 1..1304: note = Description of Unknown:uncultivated organism sequence
  REGION 1..1304: note = Category: MG75 effectors
  REGION 1..1304: note = Description: MG75-137 effector
MFPASFQEQRTGHPNNIVKSGLLEEDEHRAASYVRVKKLIDEYHKVFIDRVLDNGCLPLENKGENNSLAEYYDSYVSKSQNEDAKKAFEENQQNLRSIIAKKLTGDKAYANLFGKNLIESYKDKKDKKKIIDSDLIQFINTADSTQLDSMTQVEAKELVKEFWGFVTYFYGFFDNRKNMYTAEKKSTGIAYRLINENLPKFIDNMEAFKKVIARPEIQANMEELYSDFSEYLNVESIQEMFQLDYYDMLLTQKQIDVYNAIIGGKTDDEHDVKIKGINEYINLYNQQHKDTRLPKLKALFKQILSDRNAISWLPEEFNSDQEVLNAIKDCYERLSENVLGDKVLKSLLGSLADYSLEGIFIRNDLQLTDVSQKMFGNWGVIQNAIMQNIKHVAPARKHKESEEEYEKRIAGIFKKADSFSISYLNDCLNEADPNNAYFVENYFATFGAVNTPTMQRENLFALVQNKYTEVAALLHSDYPTAKHLAQDKANVAKIKALLDAIKSLQHFVKPLLGKGDESDKDERFYGELASLWAELETVTPLYNMIRNYMTRKPYSQKKIKLNFENPQLLDGWDANKEKDYATIILRRNGLYYLAIMGKDSKNLLGKAMPSDGECYEKMVYKQFDISKQLPKCTTELKHVRKALVEDAKRSCLLSDFNNWNKPLNVTRKLWELNNFVWDKKKEDWVLRKKDNETRPKKFHKKYLELTSDKKGYNQAKNDWIKFIKEFLSSYKKVEAYDIHYKKRYNSVDELYKQLNGDLYAISFTYVSASFIEQLVSEGKMYLFQIYNKDFSEYSKGTPNMHTLYWKALFDERNLADVVYKLNGQAEMFYRKKSIENTHPTHPANHPILNKNKDNKKKESLFDYDLIKDRRYTVDKFMFHVPITMNFKSSGSENINQDVKAYLRHADDMHIIGIDRGERHLLYLVVIDLQGNIKEQYSLNEIVNEYNGNTYHTNYHDLLDVREEERLKARQSWQTIENIKELKEGYLSQVIHKITQLMVKYHAIVVLEDLNMGFMRGRQKVEKQVYQKFEKMLIDKLNYLVDKKADASVSGGLLNAYQLTSKFDSFQKMGKQSGFLFYIPAWNTSKIDPVTGFVNLLDTRYQNVEKAKVFFSKFDAIRYNKDKDWFEFNLDYDKFGKKAEGTRTKWALCTRGMRIDTFRNKEKNSQWDNQEVDLTAEMKSLLEHYYIDIHGNLKDAISAQTDKTFFTGLLHILKLTLQMRNSITGTETDYLVSPVADENGIFYDSRSCGDELPENADANGAYNIARKGLMMIEQIKDAKDLNNLKFDISNKAWLNFAQQKPYKNG

SEQ ID NO: 1652 - protein, 886 aa, unidentified
  REGION 1..886: note = Description of Unknown:uncultivated organism sequence
  REGION 1..886: note = Category: MG75 effectors
  REGION 1..886: note = Description: MG75-138 effector
METFSGFTNLYPLSKTLRFRLIPVGETLKYFIGSGILEEDQHRAESYVKVKAIIDDYHRAYIENSLSGFELPLESTGKFNSLEEYYLYHNIRNKTEEIQNLSSKVRTNLRKQVVAQLTKNEIFKRIDKKELIQSDLIDFVKNEPDANEKIALISEFRNFTVYFKGFHENRRNMYSDEEKSTSIAFRLIHENLPKFIDNMEVFAKIQNTSISENFDAIQKELCPELVTLCEMFKLGYFNKTLSQKQIDAYNTVIGGKTTSEGKKIKGLNEYINLYNQQHKQEKLPKMKLLFKQILSDRESASWLPEKFENDSQVVGAIVNFWNTIHDTVLAEGGLKTIIASLGSYGLEGIFLKNDLQLTDISQKATGSWGKISSEIKQKIEVMNPQKKKESYETYQERIDKIFKSYKSFSLAFINECLRGEYKIEDYFLKLGAVNSSSLQKENHFSHILNTYTDVKEVIGLYSESTDTKLIQDNDSIQKIKQFLDAVKDLQAYVKPLLGNGDETGKDERFYGDLIEYWSLLDLITPLYNMVRNYVTQKPYSVDKIKINFQNPTLLNGWDLNKETDNTSVILRRDGKYYLAIMNNKSRKVFLKYPSGTDRNCYEKMEYKLLPGANKMLPKVFFSKSRINEFMPNERLLSNYEKGTHKKSGTCFSLDDCHTLIDFFKKSLDKHEDWKNFGFKFSDTSTYEDMSGFYKEVENQGYKLSFKPIDATYVDQLVDEGKIFLFQIYNKDFSEHSKGTPNMHTLYWKMLFDETNLGDVVYKLNGEAEVFFRKASINVSHPTHPANIPIKKKNLKHKDEERILKYDLIKDKRYTVDQFQFHVPITMNFKADGNGNINQKAIDYLRSASDTHIIGIDRGERNLLYLVVIDGNGKICEQFSLNEIPMR

SEQ ID NO: 1653 - protein, 886 aa, unidentified
  REGION 1..886: note = Description of Unknown:uncultivated organism sequence
  REGION 1..886: note = Category: MG75 effectors
  REGION 1..886: note = Description: MG75-139 effector
METFSGFTNLYPLSKTLRFRLIPVGETLKHFIGSGILEEDQHRAESYVKVKAIIDDYHRTYIENSLSGFELPLESTGKFNSLEEYYLYHNIRNKTEEIQNLSSKVRTNLRKQVVTQLTKNEIFKRIDKKELIQSDLIDFVKNEPDANEKIALISEFRNFTVYFKGFHENRRNMYSDEEKSTSIAFRLIHENLPKFIDNMEVFAKIQNTSISENFDAIQKELCPELVTLCEMFKLGYFNKTLSQKQIDAYNTVIGGKTTSEGKKIKGLNEYINLYNQQHKQEKLPKMKLLFKQILSDRESASWLLEKFENDSQVVGAMVNFWNTIHDTVLAEGGLKTIIASLGSYGLEGIFLKNDLQLTDISQKATGSWSKISSEIKQKIEAMNPQKKKESYESYQERIDKLFKSYKSFSLAFVNECLRGEYKIEDYFLKLGAVNSSLLQKENHFSHILNTYTDVKEVIGFYSESTDTKLIQDNDSIQKIKQFLDAVKDLQAYVKPLLGNSDETGKDERFYGDLIEYWSLLDLITPLYNMVRNYVTQKPYSVDKIKINFQNPTLLNGWDLNKEMDNTSVILRRDGKYYLAIMNNKSRKVFLKYPSGTDRNCYEKMEYKLLPGANKMLPKVFFSKSRINEFMPNERLLSNYEKGTHKKSGTCFSLDDCHTLIDFFKKSLNKHEDWKNFGFKFSDTSTYEDMSGFYKEVENQGYKLSFKPIDATYVDQLVDEGKIFLFQIYNKDFSEHSKGTPNMHTLYWKMLFDETNLGDVVYKLNGEAEVFFRKASINVSHPTHPANIPIKKKNLKHKDEERILKYDLIKDKRYTVDQFQFHVPITMNFKANGNGNINQKAIDYLRSASDTHIIGIDRGERNLLYLVVIDGNGKICEQFSLNEIPMR

SEQ ID NO: 1654 - protein, 1012 aa, unidentified
  REGION 1..1012: note = Description of Unknown:uncultivated organism sequence
  REGION 1..1012: note = Category: MG75 effectors
  REGION 1..1012: note = Description: MG75-140 effector
METFSGFTNLYPLSKTLRFRLIPVGETLKYFIGSGILEEDQHRAESYVKVKAIIDDYHRAYIENSLSGFELPLESTGKFNSLEEYYLYHNIRNKTEEIQNLSSKVRTNLRKQVVAQLTKNEIFKRIDKKELIQSDLIDFVKNEPDANEKIALISEFRNFTVYFKGFHENRRNMYSDEEKSTSIAFRLIHENLPKFIDNMEVFAKIQNTSISENFDAIQKELCPELVTLCEMFKLGYFNKTLSQKQIDAYNTVIGGKTTSEGKKIKGLNEYINLYNQQHKQEKLPKMKLLFKQILSDRESASWLPEKFENDSQVVGAIVNFWNTIHDTVLAEGGLKTIIASLGSYGLEGIFLKNDLQLTDISQKATGSWGKISSEIKQKIEVMNPQKKKESYETYQERIDKIFKSYKSFSLAFINECLRGEYKIEDYFLKLGAVNSSSLQKENHFSHILNTYTDVKEVIGLYSESTDTKLIQDNDSIQKIKQFLDAVKDLQAYVKPLLGNGDETGKDERFYGDLIEYWSLLDLITPLYNMVRNYVTQKPYSVDKIKINFQNPTLLNGWDLNKETDNTSVILRRDGKYYLAIMNNKSRKVFLKYPSGTDRNCYEKMEYKLLPGANKMLPKVFFSKSRINEFMPNERLLSNYEKGTHKKSGTCFSLDDCHTLIDFFKKSLDKHEDWKNFGFKFSDTSTYEDMSGFYKEVENQGYKLSFKPIDATYVDQLVDEGKIFLFQIYNKDFSEHSKGTPNMHTLYWKMLFDETNLGDVVYKLNGEAEVFFRKASINVSHPTHPANIPIKKKNLKHKDEERILKYDLIKDKRYTVDQFQFHVPITMNFKADGNGNINQKAIDYLRSASDTHIIGIDRGERNLLYLVVIDGNGKICEQFSLNEIEVEYNGEKYSTNYHDLLNVKENERKQARQSWQSIANIKDLKEGYLSQVIHKISELMVKYNAIVVLEDLNAGFMRGRQKVEKQVYQKFEKKLIEKLNYLVFKKQSSDLPGGLMHAYQLANKFESLVDDKI

SEQ ID NO: 1655 - protein, 982 aa, unidentified
  REGION 1..982: note = Description of Unknown:uncultivated organism sequence
  REGION 1..982: note = Category: MG75 effectors
  REGION 1..982: note = Description: MG75-141 effector
MIKEFEDFKRLYPIQKTLRFEAKPIGSTLEHLVKSGILDEDEHRAASYVRVKKLIDEYHKAFIDRVLNDGCLPFKNKGEKNSIEEYYESYTSKDKEEDSKKRFKEIQQNLRSIIVNKLTKDKAYANLFGNYLIESHKDKEDKKTMIDSDLIQFIKDADSLELGSMSKDEAIELVKEFWSFTTYFVGFYDNRKNMYSAEEKSTAIAYRLINENLPKFIDNMEAFKKIISRPEIQANTEQLYSDFAEYLNVESIQEMFQLDYYDILLTQKQIDVYNAIIGGKTDEKHDIKTKGINEYINLYNQQHKEDKLPKLKVLFKQILSDRNAISWLPEEFNSDQEMLISIKDCYEKLCVNVLGDKVLKSLLSSLDDYELEGIFLQNDQQLTNISQKIFGSWSVIQEAIIRNIKNTAPARKHKETEEDYEKRIFSIFKQAGSFSIKYIDDCLYDLDKNNINTIENYFATLGAENTPEIQRENLFALIKNAYTDVAGLLCSEYPTEKNLSQDENHVAKIKALLDAIKSLQHFVKPLLGNGDEHDKDERFYGELVSLWTELDTVTPLYNMVRNRITQKPYSQKKIKLNFENPQLLGGWDANKEKDYSCIILRREGMYYLAIMDKDSRKLLGKEMPSDGECYEKMVYKLLPGANKMLPKVFFAKSRIEEFMPSEQIIEKYNNGTHKKGKDFNITDCHNLIDYFKQSINKHEDWSKFGFTFSETSTYEDLSGFYREVEQQGYKLSFTNVSASYINSLVDEGKMYLFQIYNKDFSEYSKGTPNMHTLYWKALFDEQNLADVVYKLNGQAEIFYRKKSIDATHPTHPANRPVQNKNKDNKKKESLFEYDLIKDRRYSVDKFMFHVPITMNFKSNGSENINQQVKEYLQLANDTHIIGIDRGERHLLYLVVIDMHGNIKEQFSLNEIVNTYKGNIYHTNYHDLLEAREEERLKARQSWQTIENIKELKEGYLSQVVHKITQLMVKYHAIVVLEDLRVT

SEQ ID NO: 1656 - protein, 1228 aa, unidentified
  REGION 1..1228: note = Description of Unknown:uncultivated organism sequence
  REGION 1..1228: note = Category: MG75 effectors
  REGION 1..1228: note = Description: MG75-142 effector
MSNLYSKCHKLYSLSKTLRFELKPIGKTNENFENYILTSDKEKSEKFKKVKLYCDEYHKKFINDCLENFQNEKFVEVLNKYYELYVKNNRSDKENNEFEKIQELLRKIIAETFTKNKKYNGLFGKELFKNYLPEYYKNDEEKLSEIKLFSEFTTYFAGYNKNRENMYSAEEKTTAISYRLINQNLPTYIKNIQNYNKIKEYIPTINETISHKLQVDIEKYFNLEYFENILTQDAIDKYNYIIGGKALGDGTKIQGINEFINLYNQTNPDKKLPKLKVLYKQILSDKTNVSFKIDKIENDNELISLINNYYNILSPLLYSNDNNDTEFIKTIKDINQFDTNKIWVMTDNLTYLSQQVYKDWNYINHLIEEKYNQENLKNNKKINEKFLEKRDKELKKIKEYSLHDIEQLIIQNDKNLKIKNQGKLYKYITEKTIEIINNIKLSHSECEYILNTNYEPNSKQLLNDADKITKIKTLLDNVKLLQTTIKFLIPKSVGIQVDDTFYNAINYDILSEIIPIYNKTRNYVTQKPYSIEKFPLTFNCPTLLDGWDLNKEESNLSILLEKDGYYYLGIMNKKDNKIFRKLSEPQSNEQIYKKYEYKLLPGPNKMLPKVFFSNSRIDEFNPSEELLRKYQEGCHKKGNNFDIIFCRELIDFYKKSLFIHNDWKQFNFKFNNTNSYEDISQFYKQVEEQGYKISTQNISVQYIDELVENGKLFLFKIYNKDFSTYSKGTPNLHTMYWKALFDEDNLKDVVYKLNGGAEIFYRKKSIEYKITHPKNQAIKNKNELNHKKESLFQYDLIKDKRFTMDKFLFHVPITLNFKNQRLEYINELINSEIQRKTDINIIGVDRGERNLIYITVIDSNGKLLEQLSLNEIINEYKNETYKTDYHSLLDKKEKERNEARKSWGTIKNIKELKEGYMSQVIHKITDLMLKYNAIIVLEDLNSGFKNSRKKVEKQVYDKFETMLTNKLSYLINKKLDKNNDGGILNAYQLVNKETKGRQSGVLFYIPAWNTSKIDPVTGFVNLFYIKNMSIDKSKEFFNKFEDIRYNTKEDFFEFDIDYSKFTDKVYGIRKNWTICTYGERIRTFKNKDKNNEWDNEEINLTEKFKNLFNQYSINLSNIQEDIQKQTDRNFFNEIIYLFKLTLQMRNSVTNSDIDYILSPIKDKNGNFYDSRNKIDTLPKDADANGAYNIARKGLMLVNQIKQANDITKFKCKPITNAEWLEFVQKKDT

SEQ ID NO: 1657 - protein, 1238 aa, unidentified
  REGION 1..1238: note = Description of Unknown:uncultivated organism sequence
  REGION 1..1238: note = Category: MG75 effectors
  REGION 1..1238: note = Description: MG75-143 effector
MSNLYSNLHNLYQVQKTLRFELKPQGKTKENMEKVGILKADEHRAEIYSKVKKYCDEYHKLFIDKSLSNIELNGIDRYYELYSINNRDDKQKEELDQLEASLRKQISDAFKKSAEYKGLFQKDIITSYLVTMYKENQEKMQDIGEFNRFTTYFTGYNKNRENMYSEEDKSTAISYRLINENLPTFIDNIKIYKKIVSLMPEDIEKIYKDLEEYIQVDSIDEIFNISYYNDVLTQRGIECYNILISGRTKNDGDKIKGLNEYINEFNQTHNEKIPKLQELYKQILSDAESASFKIDVIKNDKELMNLIEVYYANILPILNKIEDLFTRISNYNLELILVNNDGTLSTLSNMVFNEWSYIKGAISEKYDEEYSGKEKYGTEKYAQKKQEYLKKQKIYSLKFLNDCIGNNAICEYLKNYIIQNKNIETIKEDYNEVQNIKVEDDTKELIKDEKSIEKIKKFLDDVKSLQEFVKLVIPKDRTVEKDAKFYSELTPYYEKIKEIIPLYNKVRNYVTQKPYSTEKIKLNFECPTLLKGWDANKEEANLGVILLKEGKYYLGIINPYCKKIFEVDEKDSNEQNNYKKMEYKLLPGPNKMLPKVFFSNSRIEEFNPSKELQEKYNKGYHKKGKDFDINFCHELIDFYKQSVNKHEDWKKFNFKFKDTSEYNDISEFYREVEKQGYKIEYTEYSEKYINELVDRGELYLFQIYNKDFSEYSKGKENLHTLYWKAVFDPDNIMNPVYKLNGNAEVFYRKKSLEMKVTHPANQPIANKNISTIEAGRSTSTFKYDLIKDKRYTMDKFQFHVPITMNFKSERLFNINQIVNKYLKYNDDIHVIGIDRGERNLLYVCVIDKNEKIVYQKSLNEIVSEYNNNRYTTDYHGLLDRKEKEREIAREDWKNIENIKELKEGYMSQVIHILVELMKKYNAIIVIEDLNKGFKNSRIKVEKQVYQKFEKMFIDKLNYLVFKDEDKMNEGGVLNAYQLTNKFESFTKLGKQSGILYYIPAWCTSKIDPTTGFINRFYLKYENFDKSKEFVNRIDDIRYNEKENLFEFDIDYSKFTDRLNDTKNKWTLCSYGERILTQKNANGEWLDRRIQLSIEFKKLFEKYGINLNNIKDSILKLDKDNLEFYKGNGESLGFIQLFKLMVQMRNSLTGKEEDNLISPVKNQHGKFFNTSEKIEGLPIDADANGAYNIARKGFMLVEQMKNVEDEKLNKIKYNITEKEWLNYVQNRGMWWKRQYLYHI

SEQ ID NO: 1658 - protein, 1286 aa, unidentified
  REGION 1..1286: note = Description of Unknown:uncultivated organism sequence
  REGION 1..1286: note = Category: MG75 effectors
  REGION 1..1286: note = Description: MG75-144 effector
MKQKKTQNPFNQFIGLYPLSKTLRFELRPYNEKTKNNIISAGILAEDNHRAESYKKVKKIIDEYHKAFIERVLKDLVLEEKPLQAFYECYKKSSKEEALQEIGNNLRTQISNAFEKDPKYSTLTSKDLINKELPSIVTTEEERTLLEEFHGFSTYFVGFHQNRENMYSDEEKATSIAYRLINENLPKFIDNIRSFQKIADSPIADKLESIYDEYAKEGYMNVNTLNEMFEISFYNRVLTQTQIDLYNAIIGGKTEKDGHKTQGINEYINLYNQRGEVQKKDRLPLLKPLFKQILSDREHISWFEEGFADDQAMLNAIKDFYLELTETGPTTTESILDRTKSLLRTIADYDLTKIYLGYNSLSKISQQIFGEWDRIQRALEAEYDQREKTKTYEEKEKHFKSLKSVSIGFIDDCLKAFETDKQLSLSIKEYIAQLGKKNDDPDLIDRITASYKAVKAILTTEWPKERNIAQEKDIVALIKDLLDRIKDLQSFIKPLLGSGKESDKDNLFYGELASIWETINTVTPLYDKVRNRMTRKPYSTQKFKVNFRNSQLLKGWDLNKEKDYMGIILRKKDLYFLAIMNKKNTKVFSSKVPSQGECFEKMIYKQFDATKQVPKCSTELKRVKEAIEIDDKPYYELFDKQKFSKPLTITREIWQLNNLVWDKKTNSFVRRKKDETRPKKFQQEYLDITEDREGYCEALRKWIDFVKDFLASYKSTSIYNIKYKDSSEYASIKEFYNFLDQELYHIEFSNVSVDYINELIEEGKIYLFQIYNKDFSPHSKGTPNMHTLYWKTLFDERNLANVAYKLNGEAEIFFRKASLERKVTHPAHDPIKTKNPKTSIKEKAFAYDLIKDKRYTEDKFQLHVPITMNFKSPMEKKGINSRVNNYIKTAEDLHFIGIDRGERNLLYVCVIDSQGNIKDQYSLNEIVNQYNRTDYKYLLEKREEERDKERKSWQTIENIKDLKQGYLSQVVHKIAQLMVQYHAIVVLEDLNSGFKRSRQKVEKSVYQQFEKSLIDKLNYLIDKRLPIDEEGGVLRAYQLTNKFESFKTMKMQNGFLFYIPAWNTSKMDPTTGFVNLFDTRYTNIDKSKEFFDKFEAIRYNEGKDWFELEFDYEHFTTKAEGTQTQWTLCTWGERINTFRNKSKNSSWDYKKINLTEEYKTLFEQFSINYRGNLKKEILEQNSKDFFERLLSLLHLTLQMRNSIPNTDTDYLISPVADANGHFYYSEQCGDNLPKNADANGAYNIARKGMWMAEQIRRSNEGEELKLAISNKEWLRFAQEKPYLEDK

SEQ ID NO: 1659 - protein, 1228 aa, unidentified
  REGION 1..1228: note = Description of Unknown:uncultivated organism sequence
  REGION 1..1228: note = Category: MG75 effectors
  REGION 1..1228: note = Description: MG75-145 effector
MSNLYSKCHKLYSLSKTLRFELKPIGKTKENFENYILTSDEEKSEKFKKVKLYCDEYHKKFINDCLENFQNDKFIEVLNKYYELYIKNNRSDKENNEFEKTQELLRKIIAETFTKNKKYSGLFGKELFKNYLPEYYKNDKEKLSEIKLFSEFTTYFAGYNKNRENMYSAEEKTTAISYRLINQNLPTYIKNIQNYNKIKEHIPTINETISHKLQVDIEKYFNLEYFENILTQDAIDKYNYIIGGKSLDDGTKIQGINEFINLYNQTNPDKKLPKLKILYKQILSDKTNISFKIDKIENDSELIYLINNYYNILSPLIYSNDNKDTGFIKTIKDITQFDTNKIWVMTDNLTYLSQQVYKDWNYINHLIEEKYNQENLKNNKKINEKFLEKRDKELKKIKEYSLHDIEQLIIQNDKNLKIKNQGKLYKYITEKTIEIINNIKLSHSECEYILNTNYEPNSKQLLNDTDKITKIKTLLDNIKLLQTTIKFLIPKSVGIQIDDTFYNAINYDILSEIIPIYNKTRNYVTQKPYSIEKFPLTFNCPTLLDGWDLNKEESNLSILLEKDGYYYLGIMNKKDNKIFRKLPEPQSNEQIYKKYEYKLLPGPNKMLPKVFFSNSRIDEFNPSEELLRKYQEGRHKKGNNFDIIFCRELIDFYKKSLFIHNDWKLFNFKFNDTNSYEDISQFYKQVEEQGYKISTQNISTRYIDELVENGKLFLFQIYNKDFSTYSKGTPNLHTMYWKELFDEDNLKDVVYKLNGGAEIFYRKKSIEDKITHPKNQTIKNKNELNHKKESLFQYDLIKDKRFTMDKFLFHVPITLNFKNQKLEYINELINSEIQRKTDINIIGVDRGERNLIYITVIDSNGKLLEQLSLNEIINEYKNETYKTDYHSLLDKKEKERNEARKSWGTIKNIKELKEGYMSQVIHKITDLMIKYNAIIVLEDLNSGFKNSRKKVEKQVYDKFETMLTNKLSYLIDKKLDKNNDGGILNAYQLVNKETKGRQSGVLFYIPAWNTSKIDPVTGFVNLFYIKNMSIDKSKEFFNKFEDIRYNTKEDFFEFDIDYSKFTDKVYGIRKNWTICTYGERIRTFRNKDKNNEWDNEEINLTEKFKNLFNQYSINLSNIQEDIQKQTDRNFFNEIIYLFKLTLQMRNSVTNSEIDYILSPIKDKNGNFYDSRNRIDTLPKDADANGAYNIARKGLMLVNQIKQANDITKFKCKPITNAEWLEFVQKKDI

SEQ ID NO: 1660 - protein, 1250 aa, unidentified
  REGION 1..1250: note = Description of Unknown:uncultivated organism sequence
  REGION 1..1250: note = Category: MG75 effectors
  REGION 1..1250: note = Description: MG75-146 effector
MQFQDFTNQYAVSKTLSFELIPQGRTLEHVEAKGLLSEDEHRSESYKTVKTVIDRYHKQFIEEALSGFELDELETYQTLYNIANKTSEDQKCFIAIQDTMRKSIVKHIKQHPKFSILDKKELIRDELFTYCENDAEKAMVLEFYKFTTYFSGFNDNRKNMYSDEEKSTAIAYRIVHQNLPKFIDNLKTFSLISNVLSENIKTLNTELQNVLGNMIINDIFALNFFNQTLTQKGIDRYNTLLGGFTDQNNPKKKIKGLNEYINQYNQTLPKTGKIGKLKPLYKQILSDRESISFLPETLQTGQDVLTALRCYYESNLADVINEYGNDGKTLKEVFENLSNYDLSGVFIRNDASIADVSQKIFGNWNIIQQAFDLRYDQTYTGKKSKKPEKYEDERKKYFKNIQSFSIESINEALTYLNDKTKHKQIEKFFSGLGIRENKNNLITIINKAYEDLEKVLGIPYPTDKELSQDTRTVEKIKTFLDSVKALQWFTKLILGKGTEPNKDSLFYGDLLPLWNEIDKITPLYNSIRNYMTKKPYSTEKIKLNFQNATLLAGWDVNQERANTSLIFLKNGLYYLGIMDQEYNKSFIDLPVLPMTTADDVYQKMEYKQLPGPEKMLPKVFFSKARIDEFAPSERVLEIYKNGTFKKGDDFKLEDCHELIEFYKRAIAQHPAWNQFNHQFSKTSAYQNIGEFYNDVKQQGYKITYRDVPVEYMNQLINDGQLYLFQIYNKDFSPHSKGTPNMHTLYWKMIFDEQNLNDVVYKLDGGAEVFYRKASPGIKKTPTHPKNQAVANKNPLNPKKESIFDYDLIKNKRFTMDKFLLHVPIKMNFKANPMTNLNMSVRSYLKTQRKTNIIGIHRGERNLLYVAVINEKGEILEQQSLNTIMNKNNDISHTTDYHDLLDRKEKERDTARKNWQTIENIKELKEGYLSQVIHKITQLMVKYQAIVVVEDLDMGFMQGRQKVEKQVYQKFEKMLISKLQYLVDKKAPIKQPGGLLKALQLTKNETAGQGKNSYEKQNGFLFYVPAWNTSSIDPTTGFVNLFKSSDLRYESINKSKTFINLIDKMQYSTSAQHFEFNIDYDKFTEKAQGTRTDWMICTHGKRIRSFRNAETNNQWCTEEIDLTQAFRQLLDDNEIDYQSQTLKEDILQMNTRAFFVAFLDIFRLILQLRNRKENGDYLISPVKNSTGEFFDSRDKRNGLPENEDANGAYNIARKGAWIIDAIKDADDDKLNRVKMTMSNKDWLTYAQAHLI

SEQ ID NO: 1661 - protein, 1255 aa, unidentified
  REGION 1..1255: note = Description of Unknown:uncultivated organism sequence
  REGION 1..1255: note = Category: MG75 effectors
  REGION 1..1255: note = Description: MG75-147 effector
MTLIIKYKESKNKREVYMSNLYSNLHNLYQVQKTLRFELKPQGKTKENMEKVGILEADEHRAEIYSKVKKYCDEYHKLFIDKSLSNIELNGIDRYYELYSINNRDDKQKEELDQLETGLRKQISDAFKKSAEYKGLFQKDMITSYLVTMYKENQEKMQDIGEFNRFTTYFTGYNKNRENMYSEEDKSTAISYRLINENLPTFIDNIKIYKKIVSLMPEDIEKIYKDLEEYIQVDSIDEIFNISYYNDVLTQRGIECYNILISGRTKNDGDKIKGLNEYINEFNQTHNEKIPKLQELYKQILSDAESASFKIDVIKNDKELMNLIEVYYANILPILNKIEDLFTRISNYNLELILVNNDGTLSTLSNMVFNEWSYIKGAISEKYDEKYSGKEKYGTEKYAQKKQEYLKKQKIYSLKFLNDCIGNNAICEYLKNYIIQNKNIETIKEDYNEVQNIKVEDDTKELIKDEKSIEKIKKFLDDVKSLQEFVKLVIPKDRTVEKDAKFYSELTPYYEKIKEIIPLYNKVRNYVTQKPYSTEKIKLNFECPTLLNGWDANKEEANLGVILIKEGKYYLGIINPYCKKIFEIDEKDSNEQKNYKKMEYKLLPGPNKMLPKVFFSNSRIEEFNPSKELQEKYNKGYHKKGKDFDINFCHELIDFYKMSLNKHEDWKKFNFKFKDTSEYNDISEFYREVEKQGYKIEYTEYSEKYINELVDRGELYLFQIYNKDFSEYSKGKENLHTLYWKAVFDPDNIMNPVYKLNGNAEVFYRKKSLEMKVIHPANQPIANKNISTIEAGRSTSTFKYDLIKDKRYTMDKFQFHVPITVNFKSERLFNINQIVNKYLKYNDDIHVIGIDRGERNLLYVCVIDKNEKIVYQKSLNEIVSEYNNNRYTTDYHGLLDRKEKEREIAREDWKNIENIKELKEGYMSQVIHILVELMKKYNAIIVIEDLNKGFKNSRIKVEKQVYQKFEKMFIDKLNYLVFKDEDKMNEGGVLNAYQLTNKFESFTKLGKQSGILYYIPAWCTSKIDPTTGFINRFYLKYENFDKSKEFVNRIDDIRYNEKENLFEFDIDYSKFTDRLNDTKNKWTLCSYGERILTQKNANGEWFDRRIQLSIEFKKLFEKYGINLNNIKDSILKLDKDNLEFYKGNGESLGFIQLFKLMVQMRNSLTGKEEDNLISPVKNRHGKFFNTSEKIEGLPIDADANGAYNIARKGFMLVEQMKNVEDEKLNKIKYNITEKEWLNYVQNRGMWWKRQYLYHI

SEQ ID NO: 1662 - protein, 1236 aa, unidentified
  REGION 1..1236: note = Description of Unknown:uncultivated organism sequence
  REGION 1..1236: note = Category: MG75 effectors
  REGION 1..1236: note = Description: MG75-148 effector
MKQLSELTGLYSLSKTLRFELKPIGKTLEHIESKGLIAQDEQRAEEYKKVKDIIDRYHKKFITMCLSDFKFEQNSLETYVALAEDTNRDEKAFDEIKKTLRKQIVETFKKGGAYSDLFKKKLIQKHLPEFVSDEEEKKMIANFSKFTTYFNGFNENRKNMYSDEDKSTAIAYRLIHENLPMFVNNMKSFSRIADSDVHQHFTEIESSFSEYLGVEHLEEMFQLDYFSETLTQEQIAVYNHIIGGRALEDGTKLKGINEYVNLYNQQHKNSRLPLLKPLYKMILSDRVALPWFPSEEFASDEEMIRAINETYNTLKEVLSIDGDSSLRSLLLNISSYDIKHIYIANDLGLTDISQQMFGQYDVYTSAIKQELREKNAPTAKERRNPELYDERINKLFKSAKSFSIEHLNSLVDSEHTIQNYYKHLGAYDRNGEQRVNLFTQIEMAYVAAKEILSGKHGNISQSDAETAIIKGLLDAFKSLQRFIKPLLGNGEEADKDNEFDAKLREAWNTLDIVTPLYNKVRNWLTRKPYSTEKIKLNFENAQLLGGWDVNKEPDCTSILLRKNGLYYLAIMNKKYNHAFDIDNLPNDGKCYEKIDYKLLPGANKMLPKVFFSKSRIKEFAPSEIIVNAYKKGSHKKGANFSISDCRRLIDFFKASISKHEDWKNFPFSFSSTETYEDISGFYREVEQQGYMLGFRNVSESFIKQLVDEGKLYLFQIWNKDFSDFSKGTPNMHTLYWKMLFDEHNLANVVYKLNGQAEVFYRKSSLDVANTTIHKAHQPIMNKNQENKKRQSTFDYDIIKNRRYTVDKFQFHVPISINFKATGRDNVNDNVLDIIRNGGIKHIIGIDRGERHLLYLSLIDLKGNIVKQMTLNDIVNEYNGNTYATNYKNLLAEREGNRTEARKNWKKIENIKDIKKGYLSQVVHIISKMMVEYNAIVVLEDLNMGFMRGRQKIERSVYEQFEKMLIDKLNYYVDKQKNSDEAGGLLHALQLTSKFESFKKLGKQSGCLFYIPAWNTSKIDPVTGFVNLFDTRYTNADQARKFFSQFDSIRYNADKDWFEFAFDYNKFTAKAKGTRTKWTLCTYGTRIRTFRNSERLNQWDNEEVVLTDEFKKAFANADINIHGNLKEAICSLQDKKYLEPLMHLMKLLLQMRNSITNSEVDYLLSPVADENGTFYDSRICSASLPKDADANGAYNIARKGLWAIHQIQETPAGDRPNLAIKNKDWLNFAQQKPYMNE

SEQ ID NO: 1663 - protein, 1245 aa, unidentified
  REGION 1..1245: note = Description of Unknown:uncultivated organism sequence
  REGION 1..1245: note = Category: MG75 effectors
  REGION 1..1245: note = Description: MG75-149 effector
MTLIIKYKESKNKREVYMSNLYSNLHNLYQVQKTLRFELKPQGKTKENMEKVGILEADEHRAEIYSKVKKYCDEYHKLFIDKSLSNIELNGIDRYYELYSINNRDDKQKEELDQLEASLRKQISDAFKKSAEYKGLFQKDIITSYLVTMYKENQEKMQDIGEFNRFTTYFTGYNKNRENMYSEEDKSTAISYRLINENLPTFIDNIKIYKKIVSLMPEDIEKIYKDLEEYIQVDSIDEIFNISYYNDVLTQRGIECYNILISGRTKNDGDKIKGLNEYINEFNQTHNEKIPKLQELYKQILSDAESASFKIDVIKNDKELMNLIEVYYANILPILNKIEDLFTRISNYNLELILVNNDGTLSTLSNMVFNEWSYIKGAISEKYDEEYSGKEKYGTEKYAQKKQEYLKKQKIYSLKFLNDCIGNNAICEYLKNYIIQNKNIETIKEDYNEVQNIKVEDDTKELIKDEKSIEKIKKFLDDVKSLQEFVKLVIPKDRTVEKDAKFYSELTPYYEKIKEIIPLYNKVRNYVTQKPYSTEKIKLNFECPTLLNGWDANKEEANLGVILLKEGKYYLGIINPYCKKIFEVDEKDSNEQNNYKKMEYKLLPGPNKMLPKVFFSNSRIEEFNPSKELQEKYNKGYHKKGKDFDINFCHELIDFYKQSLNKHEDWKKFNFKFKDTSEYNDISEFYREVEKQGYKIEYTEYSEKYINELVDRGELYLFQIYNKDFSEYSKGKENLHTLYWKAVFDPDNIMNPVYKLNGNAEVFYRKKSLEMKVTHPANQPIANKNISTIEAGRSTSTFKYDLIKDKRYTMDKFQFHVPITMNFKSERLLNINQIVNKYLKYNDDIHVIGIDRGERNLLYVCVIDKNEKIVYQKSLNEIVSEYNNNRYTTDYHGLLDRKEKEREIAREDWKNIENIKELKEGYMSQVIHILVELMKKYNAIIVIEDLNKGFKNSRIKVEKQVYQKFEKMFIDKLNYLVFKDEDKMDEGGVLNAYQLTNKFESFTKLGKQSGILYYIPAWCTSKIDPTTGFINRFYLKYENFDKSKEFVNRIDDIRYNEKENLFEFDIDYSKFTDRLNDTKNKWTLCSYGERILTQKNANGEWFDRRIQLSIEFKKLFEKYGINLNNIKDSILKLDKDNLEFYKGNGESLGFIQLFKLMVQMRNSLTGKEEDNLISPVKNQHGKFFNTSEKIEGLPIDADANGAYNIARKGFMLVEQMKNVEDEKLNKIKYNITEKEWLNYVQNRGM

SEQ ID NO: 1664 - protein, 1245 aa, unidentified
  REGION 1..1245: note = Description of Unknown:uncultivated organism sequence
  REGION 1..1245: note = Category: MG75 effectors
  REGION 1..1245: note = Description: MG75-150 effector
MTLTIKYKESKNKREVYMSNLYSNLHNLYQVQKTLRFELKPQGKTKENMEKVGILEADEHRAEIYSKVKKYCDEYHKLFIDKSLGNIELNGIDRYYELYSINNRDDKQKEELDQLEASLRKQISDAFKKSAEYKGLFQKDIITSYLVTMYKENQEKMQDIGEFNRFTTYFTGYNKNRENMYSEEDKSTAISYRLINENLPTFIDNIKIYKKIVSLMPEDIEKIYKDLEEYIQVDSIDEIFNISYYNDVLTQRGIECYNILISGRTKNDGDKIKGLNEYINEFNQTHNEKIPKLQELSKQILSDAESASFKIDVIKNDKELMNLIEVYYANILPILNKIEDLFTRISNYNLELILVNNDGTLSTLSNMVFNEWSYIKGAISEKYDEKYSGKEKYGTEKYAQKKQEYLKKQKIYSLKFLNDCIGNNAICEYLKNYIIQNKNIETIKEDYNEVQNIKVEDDTKELIKDEKSIEKIKKFLDDVKSLQEFVKLVIPKDRTVEKDAKFYSELTPYYEKIKEIIPLYNKVRNYVTQKPYSTEKIKLNFECPTLLNGWDANKEEANLGVILIKEGKYYLGIINPYCKKIFEVDEKDSNEQNNYKKMEYKLLPGPNKMLPKVFFSNSRIEEFNPSKELQEKYNKGYHKKGKDFDINFCHELIDFYKQSLNKHEDWKKFNFKFKDTSEYNDISEFYREVEKQGYKIEYTEYSEKYINELVDRGELYLFQIYNKDFSEYSKGKENLHTLYWKAVFDPDNIMNPVYKLNGNAEVFYRKKSLEMKVIHPANQPIANKNISTIEAGRSTSTFKYDLIKDKRYTMDKFQFHVPITVNFKSERLFNINQIVNKYLKYNDDIHVIGIDRGERNLLYVCVIDKNEKIVYQKSLNEIVSEYNNNRYTTDYHGLLDRKEKEREIAREDWKNIENIKELKEGYMSQVIHILVELMKKYNAIIVIEDLNKGFKNSRIKVEKQVYQKFEKMFIDKLNYLVFKDEDKMNEGGVLNAYQLTNKFESFTKLGKQSGILYYIPAWCTSKIDPTTGFINRFYLKYENFDKSKEFVNRIDDIRYNEKENLFEFDIDYSKFTDRLNDTKNKWTLCSYGERILTQKNANGEWLDRRIQLSIEFKKLFEKYGINLNNIKDSILKLDKDNLEFYKGNGESLGFIQLFKLMVQMRNSLTGKEEDNLISPVKNRHGKFFNTSEKIEGLPIDADANGAYNIARKGFMLVEQMKNVEDEKLNKIKYNITEKEWLNYVQNRGM

SEQ ID NO: 1665 - protein, 1255 aa, unidentified
  REGION 1..1255: note = Description of Unknown:uncultivated organism sequence
  REGION 1..1255: note = Category: MG75 effectors
  REGION 1..1255: note = Description: MG75-151 effector
MTLTIKYKESKNKREVYMSNLYSNLHNLYQVQKTLRFELKPQGKTKENMEKVGILEADEHRAEIYSKVKKYCDEYHKLFIDKSLGNIELNGIDRYYELYSINNRDDKQKEELDQLEASLRKQISDAFKKSAEYKGLFQKDIITSYLVTMYKENQEKMQDIGEFNRFTTYFTGYNKNRENMYSEEDKSTAISYRLINENLPTFIDNIKIYKKIVSLMPEDIEKIYKDLEEYIQVDSIDEIFNISYYNDVLTQRGIECYNILISGRTKNDGDKIKGLNEYINEFNQTHNEKIPKLQELSKQILSDAESASFKIDVIKNDKELMNLIEVYYANILPILNKIEDLFTRISNYNLELILVNNDGTLSTLSNMVFNEWSYIKGAISEKYDEKYSGKEKYGTEKYAQKKQEYLKKQKIYSLKFLNDCIGNNAICEYLKNYIIQNKNIETIKEDYNEVQNIKVEDDTKELIKDEKSIEKIKKFLDDVKSLQEFVKLVIPKDRTVEKDAKFYSELTPYYEKIKEIIPLYNKVRNYVTQKPYSTEKIKLNFECPTLLNGWDANKEEANLGVILIKEGKYYLGIINPYCKKIFEVDEKDSNEQNNYKKMEYKLLPGPNKMLPKVFFSNSRIEEFNPSKELQEKYNKGYHKKGKDFDINFCHELIDFYKQSLNKHEDWKKFNFKFKDTSEYNDISEFYREVEKQGYKIEYTEYSEKYINELVDRGELYLFQIYNKDFSEYSKGKENLHTLYWKAVFDPDNIMNPVYKLNGNAEVFYRKKSLEMKVIHPANQPIANKNISTIEAGRSTSTFKYDLIKDKRYTMDKFQFHVPITVNFKSERLFNINQIVNKYLKYNDDIHVIGIDRGERNLLYVCVIDKNEKIVYQKSLNEIVSEYNNNRYTTDYHGLLDRKEKEREIAREDWKNIENIKELKEGYMSQVIHILVELMKKYNAIIVIEDLNKGFKNSRIKVEKQVYQKFEKMFIDKLNYLVFKDEDKMNEGGVLNAYQLTNKFESFTKLGKQSGILYYIPAWCTSKIDPTTGFINRFYLKYENFDKSKEFVNRIDDIRYNEKENLFEFDIDYSKFTDRLNDTKNKWTLCSYGERILTQKNANGEWLDRRIQLSIEFKKLFEKYGINLNNIKDSILKLDKDNLEFYKGNGESLGFIQLFKLMVQMRNSLTGKEEDNLISPVKNRHGKFFNTSEKIEGLPIDADANGAYNIARKGFMLVEQMKNVEDEKLNKIKYNITEKEWLNYVQNRGMWWKRQYLYHI

SEQ ID NO: 1666 - protein, 1236 aa, unidentified
  REGION 1..1236: note = Description of Unknown:uncultivated organism sequence
  REGION 1..1236: note = Category: MG75 effectors
  REGION 1..1236: note = Description: MG75-152 effector
MKQLSELTGLYSLSKTLRFELKPIGKTLEHIESKGLIAQDEQRAEEYKKVKDIIDRYHKKFITMCLSDFKFEQNSLETYVALAEDTNRDEKAFDEIKKTLRKQIVETFKKGGSYSDLFKKELIQKHLPEFVSDEEEKKMIANFSKFTTYFNGFNENRKNMYSDEDKSTAIAYRLIHENLPMFVNNMKSFSRIADSDVHQHFTEIESSFSEYLGVEHLEEMFQLDYFSETLTQEQIAVYNHIIGGMALEDGTILKGINEYVNLYNQQHKNSRLPLLKPLYKMILSDRVALPWFPSEEFASDEEMIRAINETYNTLKEVLSIDGDSSLRSLLLNISSYDIKHIYIANDLGLTDISQQMFGQYDVYTSAIKQELRKKNAPTAKERRNPELYDERINKLFKSAKSFSIEHLNSLVDSEHTIQNYYKHLGAYDRNGEQRVNLFTQIEMAYVAAKEILSGKHGNISQSDAETAIIKGLLDAFKSLQRFIKPLLGNGEEADKDNEFDAKLREAWNTLDIVTPLYNKVRNWLTRKPYSTEKIKLNFENAQLLGGWDVNKEPDCTSILLRKDGLYYLAIMNKKYNHAFDIDNLPNDGKCYEKIDYKLLPGANKMLPKVFFSKSRIKEFAPSEIIVNAYKKGSHKKGANFSISDCRRLIDFFKASISKHEDWKNFPFSFSSTETYEDISGFYREVEQQGYMLGFRNVSESFIKQLVDEGKLYLFQIWNKDFSDFSKGTPNMHTLYWKMLFDEHNLANVVYKLNGQAEVFYRKSSLDVANTTIHKAHQPIMNKNQENKKRQSTFDYDIIKNRRYTVDKFQFHVPISINFKATGRDNVNDNVLDIIRNGGIKHIIGIDRGERHLLYLSLIDLKGNIVKQMTLNDIVNEYNGNTYATNYKNLLAEREGNRTEARKNWKKIENIKDIKKGYLSQVVHIISKMMVEYNAIVVLEDLNMGFMRGRQKIERSVYEQFEKMLIDKLNYYVDKQKDSDEAGGLLHALQLTSKFESFKKLGKQSGCLFYIPAWNTSKIDPVTGFVNLFDTRYTNADQARKFFSQFDSIRYNADKDWFEFAFDYNKFTAKAKDTRTKWTLCTYGTRIRTFRNPERLNQWDNEEVVLTDEFKKAFANADVNIHGNLKEAICSLQDKKYLEPLMHLMKLLLQMRNSITNSEIDYLLSPVADENGTFYDSRVCSASLPKDADANGAYNIARKGLWAIHQIQESPAGDRLNLAIKNKDWLNFAQQKPYMNE

SEQ ID NO: 1667 - protein, 1267 aa, unidentified
  REGION 1..1267: note = Description of Unknown:uncultivated organism sequence
  REGION 1..1267: note = Category: MG75 effectors
  REGION 1..1267: note = Description: MG75-153 effector
MKNFIAKYSVSKTLRFELKPIGKTLENIQKNGLISKDEMLAENYKEMKKTIDEFHKEFIHKTLSNASLDKENLKEIAELYTAPAEKRKEDNYKNQLKAYQKALRKEIVDHFKNDELFKNLFAEKLIKNHLQGFAQQKGLRFYSEFNNFTTYFVGFHENRKNIYTDEDKRTSIAYRLIHENLPKFIHNIAVFEKIQEKKIPLTILENQFMSKLGNDTLADVFRLEYYNCLLTQNSIDFINQLIGGYVNENQEKIQGLNEYINLYNQQQKDKKDRLPKMKMLYKQILSDRESISFLPQSFKESQEVLDAIRDYYLSNLLEYRAEDKEEPENVLEKIQERLSHIADYDLSKIYIRNDKAITDISQTIFGHWGLIHSALEFDFRQKNVGKKTTQKQEEDVEKYLKSDYYSIAEIENALISYKESTQNEKLVEVFNKTSHPIADYFKTYFKAKEKSKEGKEYTLIANIQAKYTCVEGLLNTDYPKDKKLHTDKDNLRNLKAFLDAILELLHFVKPLIISKNDFLEKDENFYSSIEPYYKQLELLIPLYNKVRNFATQKPYSTEKIKLNFENSTLLNGWDKNKESDNTCVLFRKGEDFYLGIMNKKYNKIFENVPKPKSDTTFLKMEYKLLPGANKMLPKVFFSKKNIAYYAPDSEILRIRNHSTHTKDGEPQKGYEKQAFKLEDCHKMIDFFKSSIEKHPEWKNFNFTFSNTQSYQSIDEFYREVEEQGYSISFVEVDEEYINQCVNEGKLYLFQIYNKDFSKNKKSKGKPNLHTLYWKALFDPENLKDVIYKLNGEAEVFYRKKSISAENIIVHKAQKPIENKNPLNLTKYSIFQYDIIKDRHYTEDKFLFHVPITLNFKSKKGKENINQEVLDYLKENPDVNIIGIDRGERHLLYLTVINSKGQILHQESLNTLKNETYNIQTDYHALLHEKEKDRDKARKEWGVIENIKELKEGYLSAIIHNIAKLMVQYNAIVVMEDLNSGFKRGRIKVEKQVYQKFEKMLIEKLNYLVFKDVPNYEPGGLYNALQLTSKFESFEKLGKQSGFLFYIPAWNTSKIDPTTGFVNLFGGIKYESIHQAVNFFEKFQSIRYNTKEAYFEFAFDYNDFTTKAEGTKTQWTVCTHGERIINFRNTEKNSEWDSKTVQLTQQIKNLLNEYHIAYEQGQDIKPAITAQNDKKFFEELLKQFKNTLQMRNSVINSDVDYLISPVMNAKGEFFDTRKTDSTLPQNADANGAYHIAKKGLLHVQQIIDGVKKTDLTNKKWLKFVQNNL

SEQ ID NO: 1668 - protein, 1275 aa, unidentified
  REGION 1..1275: note = Description of Unknown:uncultivated organism sequence
  REGION 1..1275: note = Category: MG75 effectors
  REGION 1..1275: note = Description: MG75-154 effector
MRKFNEFVGLYPISKTLRFELKPIGKTLEHIQRNKLLEYDAVRADDYVKVKKIIDTYHKYLIDEALSGFTFETEADGRRNNSLSEYYWYYNLRKRNEQEQKTFKTIQNNLRKQIVDKLTQSEKYKRIDKKELITTDLPDFLTNESEKELVEKFKNFTTYFTEFHKNRKNMYSKEEKSTAIAFRLINENLPKFVDNIAAFEKVASSPLAEKINALYEDFKEYLNVEKISSVFRLEYYNELLTQKQIDLYNAIVGGRTEEDNRTQIKGLNQYINEYNQQQTDRSNRLPKLKPLYKQILSDRESVSWLPPKFDSDKELLTKIKECYDALSEKEKVFDKLESILKSLSTYDLSKIYISNDSQLSYISQKMFGRWDIIGKAIREDCAKRNPQKNRESLEKFAERIDKKLKAIDSISIGDVDECLAQLGEPYVKRVEDYFAAMGASEIGEEQIGQEFFKKNIEEAYESVKELLNNADNITDNNLMQDKGNVEKIKNLLDAIKDLQRFIKPLLGKGDEADKDGVFYGEFTSLWTKLDTVTPLYNMVRNYLTSKPYSTKKIKLNFENSHFLRGWAKDYNKKAGLIYEKAGLYYLAIVDKKISNDDKKLLHKNVDEDVASRIIFDFQKPDEKNTPRLFIYSKKNPITIAPAVDIYNLPIDSILDVWNKEKYKVEYRQQDQLGYEQALYSLIDYFKEGFSKHESYKHYDFKWKETNKYKDISEFYHDVEISCYEVKYDKVNWKTLLKFVDEGKLYLFQIYNKDFSDHSKGTPNMHTLYWKMLFDEENLKDVVYKLNGEAEVFFRKSSITVQSPTHPANSPIKNKNKDNKKKESKFEYDLIKDRRYTVDKFLLHVPITMNFKSVGGSNINQLVKRYIRSATDLHIIGIDRGERHLLYLTVIDSRGNIKEQFSLNEIVNEYNGNTYRTDYHELLDTREGELTEARRNWQTIQNIRELKEGYLSQVIHKISELAIKYNAVIVLEDLNFGFMRSRQKVEKQVYQKFEKMLIYKLNYLVDKKKPVTETGGLLKAYQLTGEFESFKTLGKQSGILFYVPAWNTSKIDPVTGFVNLFDTHYENIEKAKGFFDKFKSIRYNSDKDWSEFVVDDYTRFSPKAEGTRRDWTICTQGKRIQIYRNPQRNNEWEGREIDLTKAFEEHFEAYGIDISKDLREQINIQNKKEFFEELLRLLRLTLQMRNSMPSSDIDYLISPIADDTGRFFDSRKQAELKGNAVLPMNADANGAYNIARKGLLAIRKMKQEENDSAKISLAISNKEWLKFAQTKPYLED

SEQ ID NO: 1669 - protein, 1236 aa, unidentified
  REGION 1..1236: note = Description of Unknown:uncultivated organism sequence
  REGION 1..1236: note = Category: MG75 effectors
  REGION 1..1236: note = Description: MG75-155 effector
MKQLSELTGLYSLSKTLRFELKPIGKTLEHIESKGLIAQDEQRAEEYKKVKDIIDRYHKKFITMCLSDFKFEQNSLETYVALAEDTNRDEKAFDEIKKTLRKQIVETFKKGGSYSDLFKKELIQKHLPEFVSDEEEKKMIANFSKFTTYFNGFNENRKNMYSDEDKSTAIAYRLIHENLPMFVNNMKSFSRIADSDVHQHFTEIESSFSEYLGVEHLEEMFQLDYFSETLTQEQIAVYNHIIGGRALEDGTKLKGINEYVNLYNQQHKNSRLPLLKPLYKMILSDRVALPWFPSEEFASDEEMIRAINETYNTLKEVLSIDGDSSLRSLLLNISSYDIKHIYIANDLGLTDISQQMFGQYDVYTSAIKQELREKNAPTAKERRNPELYDERINKLFKSAKSFSIEHLNSLVDSEHTIQNYYKHLGAYDRNGEQRVNLFTQIEMAYVAAKEILSGKHGNISQSDAETAIIKGLLDAFKSLQRFIKPLLGNGEEADKDNEFDAKLREAWNTLDIVTPLYNKVRNWLTRKPYSTEKIKLNFENAQLLGGWDVNKEPDCTSILLRKNGLYYLAIMNKKYNHAFDIDNLPNDGKCYEKIDYKLLPGANKMLPKVFFSKSRIKEFAPSEIIVNAYKKGSHKKGANFSISDCRRLIDFFKASISKHEDWKNFPFSFSSTEKYEDISGFYREVEQQGYMLGFRNVSESFIKQLVDEGKLYLFQIWNKDFSDFSKGTPNMHTLYWKMLFDEHNLANVVYKLNGQAEVFYRKSSLDVANTTIHKAHQPIMNKNQENKKRQSTFDYDIIKNRRYTVDKFQFHVPISINFKATGRDNVNDNVLDIIRNGGIKHIIGIDRGERHLLYLSLIDLKGNIVKQMTLNDIVNEYNGNTYATNYKNLLAEREGNRTEARKNWKKIENIKDIKKGYLSQVVHIISKMMVEYNAIVVLEDLNMGFMRGRQKIERSVYEQFEKMLIDKLNYYVDKQKNSDEAGGLLHALQLTSKFESFKKLGKQSGCLFYIPAWNTSKIDPVTGFVNLFDTRYTNADQARKFFSQFDSIRYNADKDWFEFAFDYNKFTAKAKDTRTKWTLCTYGTRIRTFRNPARLNQWDNEEVVLTDEFKKAFANADINIHGNLKEAICSLQDKKYLEPLMHLMKLLLQMRNSITNSEVDYLLSPVADENGTFYDSRICSASLPKDADANGAYNIARKGLWAIHQIQESPAGDRLNLAIKNKDWLNFAQQKPYMNE

SEQ ID NO: 1670 - protein, 1236 aa, unidentified
  REGION 1..1236: note = Description of Unknown:uncultivated organism sequence
  REGION 1..1236: note = Category: MG75 effectors
  REGION 1..1236: note = Description: MG75-156 effector
MKQLSELTGLYSLSKTLRFELKPIGKTLEHIESKGLIAQDEQRAEEYKKVKDIIDRYHKKFITMCLSDFKFEQNSLETYVALAEDTNRDEKSFDEIKKTLRKQIVETFKKGGSYSDLFKKELIQKHLPEIVTDEEEKKMIANFSKFTTYFNGFNENRKNMYSDEDKSTAIAYRLIHENLPMFVDNMKSFSRIADSDVHQHFTEIESSFSEYLGVEHLEGMFQLDYFSETLTQEQIAVYNHIIGGRVLEDGTKLKGINEYVNLYNQQHKDSRLPLLKPLYKMILSDRVALPWFPSEEFASDEEMIGAINATYNTLKDVLSIDGDSSLRCLLLNISSYDIKHIYIANDLGLTDISQQMFGQYDVYTSAIKQELRTTNAPTAKERRTPELYDERINKLFKSAKSFSIEYLNSLVDSEHTIQNYYKHLGAYDRNGEQRVNLFTQIEMAYVAAKEILSGKHGNISQSDAETAIIKGLLDAFKSLQRFIKPLLGNGEEADKDNEFDAKLREAWNTLDIVTPLYNKVRNWLTRKPYSTEKIKLNFENAQLLGGWDVNKEPDCTSILLRKNGLYYLAIMNKKYNHAFDIDNLPNDGECYEKIDYKLLPGANKMLPKVFFSKSRIKEFAPSEIIVNAYKKGSHKKGANFSISDCRRLIDFFKASISKHEDWKNFPFSFSSTETYEDISGFYREVEQQGYMLGFRNVSESFIKQLVDEGKLYLFQIWNKDFSDFSKGTPNMHTLYWKMLFDEHNLANVVYKLNGQAEVFYRKRSLDVANTTIHKAHQPIMNKNQENKKRQSTFDYDIIKNRRYTVDKFQFHVPISINFKATGRDNVNDNVLDIIRNGGIKHIIGIDRGERHLLYLSLIDLKGNIVKQMTLNDIVNEYNGNTYATNYKNLLAEREGNRTEARKNWKKIENIKDIKKGYLSQVVHIISKMMVEYNAIVVLEDLNMGFMRGRQKIERSVYEQFEKMQIDKLNYYVDKQKNSDEAGGLLHALQLTSKFESFKKLGKQSGCLFYIPAWNTSKIDPVTGFVNLFDTRYTNADQARKFFFQFDSIRYNADKDWFEFAFDYNKFTAKAKDTRTKWTLCTYGTRIRTFRNPARLNQWDNEEVVLTDEFKKAFANADINIHGNLKEAICSLQDKKYLEPLMHLMKLLLQMRNSITNSEVDYLLSPVADENGTFYDSRVCSASLPKDADANGAYNIARKGLWAIHQIQESPAGDRPNLAIKNKDWLNFAQQKPYMNE

SEQ ID NO: 1671 - protein, 1236 aa, unidentified
  REGION 1..1236: note = Description of Unknown:uncultivated organism sequence
  REGION 1..1236: note = Category: MG75 effectors
  REGION 1..1236: note = Description: MG75-157 effector
MKQLSELTGLYSLSKTLRFELKPIGKTLEYIESKGLIAQDEQRAEEYKKVKDIIDRYHKKFITMCLSDFKFEQNSLETYVALAEDTNRDEKAFDEIKKTLRKQIVETFKKGGSYSDLFKKELIQKHLPEFVSDEEEKKMIANFSKFTTYFNGFNENRKNMYSDEDKSTAIAYRLIHENLPMFVNNMKSFSRIADSDVHQHFTEIESSFSEYLGVEHLEEMFQLDYFSETLTQEQIAVYNHIIGGRALEDGTKLKGINEYVNLYNQQHKNSRLPLLKPLYKMILSDRVALPWFPSEEFASDEEMIRAINETYNTLKEVLSIDGDSSLRSLLLNISSYDIKHIYIANDLGLTDISQQMFGQYDVYTSAIKQELREKNAPTAKERRNPELYDERINKLFKSAKSFSIEHLNSLVDSEHTIQNYYKHLGAYDRNGEQRVNLFTQIEMAYVAAKEILSGKHGNISQSDAETAIIKGLLDAFKSLQRFIKPLLGNGEEADKDNEFDAKLREAWNTLDIVTPLYNKVRNWLTRKPYSTEKIKLNFENAQLLGGWDVNKEPDCTSILLRKNGLYYLAIMNKKYNHAFDIDNLPNDGKCYEKIDYKLLPGANKMLPKVFFSKSRIKEFAPSEIIVNAYKKGSHKKGANFSISDCRRLIDFFKASISKHEDWKNFPFSFSSTETYEDISGFYREVEQQGYMLGFRNVSESFIKQLVDEGKLYLFQIWNKDFSDFSKGTPNMHTLYWKMLFDEHNLANVVYKLNGQAEVFYRKSSLDVANTTIHKAHQPIMNKNQENKKRQSTFDYDIIKNRRYTVDKFQFHVPISINFKATGRDNVNDNVLDIIRNGGIKHIIGIDRGERHLLYLSLIDLKGNIVKQMTLNDIVNEYNGNTYATNYKNLLAEREGNRTEARKNWKKIENIKDIKKGYLSQVVHIISKMMVEYNAIVVLEDLNMGFMRGRQKIERSVYEQFEKMLIDKLNYYVDKQKNSDEAGGLLHALQLTSKFESFKKLGKQSGCLFYIPAWNTSKIDPVTGFVNLFDTRYTNADQARKFFSQFDSIRYNADKDWFEFAFDYNKFTTKAKDTRTKWTLCTYGTRIRTFRNPARLNQWDNEEVVLTDEFKKAFANADINIHVNLKEAICSLQDKKYLEPLMHLMKLLLQMRNSITNSEVDYLLSPVADENGTFYDSRVCSASLPKDADANGAYNIARKGLWAIHQIQETPAGDRPNLAIKNKDWLNFAQQKPYMNE

SEQ ID NO: 1672 - protein, 1236 aa, unidentified
  REGION 1..1236: note = Description of Unknown:uncultivated organism sequence
  REGION 1..1236: note = Category: MG75 effectors
  REGION 1..1236: note = Description: MG75-158 effector
MKQLSELTGLYSLSKTLRFELKPIGKTLEHIESKGLIAQDEQRAEEYKKVKDIIDRYHKKFITMCLSDFKFEQNSLETYVALAEDTNRDEKAFDEIKKTLRKQIVETFKKGGSYSDLFKKELIQKHLPEFVSDEEEKKMIANFSKFTTYFNGFNENRKNMYSDEDKSTAIAYRLIHENLPMFVNNMKSFSRIADSDVHQYFTEIESSFSEYLGVEQLEEMFQLDYFSETLTQEQIAVYNHIIGGRALEDGTKLKGINEYVNLYNQQHKDSRLPLLKPLYKMILSDRVALPWFPSEEFASDEEMIRAINETYNTLKEVLSIDGDSSLRSLLLNISSYDIKHIYIANDLGLTDISQQMFGQYDVYTSAIKQELREKNAPTAKERRNPELYDERINKLFKSAKSFSIEHLNSLVDSEHTIQNYYKHLGAYDRNGEQRVNLFTQIKMAYVAAKEILSGKHGNISQSDAETAIIKGLLDAFKSMQRFIKPLLGNGEEADKDNEFDAKLREAWNTLDIVTPLYNKVRNWLTRKPYSTEKIKLNFENAQLLGGWDVNKEPDCTSILLRKNGLYYLAIMNKKYNHAFDIDNLPNDGKCYEKIDYKLLPGANKMLPKVFFSKSRIKEFAPSEIIVNAYKKGSHKKGANFSISDCRRLIDFFKASISKHEDWKNFPFSFSSTETYEDISGFYREVEQQGYMLGFRNVSESFIKQLVDEGKLYLFQIWNKDFSDFSKGTPNMHTLYWKMLFDEHNLANVVYKLNGQAEVFYRKSSLDVANTTIHKAHQPIMNKNQENKKRQSTFDYDIIKNRRYTVDKFQFHVPISINFKATGRDNVNDNVLDIIRNGGIKHIIGIDRGERHLLYISLIDLKGNIVKQMTLNDIVNEYNGNTYATNYKDLLAEREGNRTEARKNWKKIENIKDIKKGYLSQVVHIISKMMVEYNAIVVLEDLNMGFMRGRQKIERSVYEQFEKMLIDKLNYYVDKQKDSDEAGGLLHALQLTSKFESFKKLGKQSGCLFYIPAWNTSKIDPVTGFVNLFDTRYTNADQARKFFSQFDSIRYNADKDWFEFAFDYNKFTAKAKGTRTKWTLCTYGTRIRTFRNPERLNQWDNEEVVLTDEFKKAFANADINIHGNLKEAICSLQDKKYLEPLMHLMKLLLQMRNSITNSEIDYLLSPVADENGTFYDSRVCSASLPKDADANGAYNIARKGLWAIHQIQESPADDRLNLAIKNKDWLNFAQQKPYMNE

SEQ ID NO: 1673 - protein, 1284 aa, unidentified
  REGION 1..1284: note = Description of Unknown:uncultivated organism sequence
  REGION 1..1284: note = Category: MG75 effectors
  REGION 1..1284: note = Description: MG75-159 effector
MNTSNLSRFTNLYSISKTLRFELQPLGKTKDYIEKNGILMRDEKRAEDYKTVKGIIDEYHKKYIKGRLWDFKLPLASEGKHDSLEEYKALYEVSKRSEADEAAFKEVKDNLRSIIAKRLTSGKAYETIFKKELIREDLINSLEDEVEREIVSQFADFTTYFGGFHENRKNMYDAGEKSTAIAYRLIHQNLPKFMDNMKAFAKIAETSIAEHFADIYEGSKEMLNVGSIEEIFRLDYFSETLTQPHIEVYNSIIGKRVLEDGTEVKGINEYVNLYNQQQKDKRLPLLVPLYKQILSDREKLSWLAEEFDSDEKMLAAVNETYTHLHDLLMGNENESLRSLLLHLRDNDLEQINIANDLSLTDISQHLFGRYDVFTNGIKEELRVITPRKRKETDEQLEDRISKIFKTQKSFSIAFLNSLPQPAMEDGKARCIEDYFMALGAVNNETTQKENLFAQIENAYENAKSVLQMKETGDMLSQNKPAVSKIKALLDALKDLQHFIKPLLGSGEENEKDELFYGSFQMMWDELDAVTPLYNKVRNWLTRKPYSTEKIKLNFDNAQLLDGWDENKETTNASILLYKDGNYYLGIIKKEDRKILGSPMPTDGECYDKVVYKFFKDITTMVPKCTTQKKDVIAHFMHSDDDYILYDKKTFDAPVTITKEIYNLNNVLYNGIKKFQIEYLRSTGDKRGYEHAVFIWKSFCMHFLKAYKSTSIYNLALVEQQINSYYDLSSFYNAVNLLLYNLSYRKVSVNYIHSLVDEGKLYLFRIWNKDFSEYSKGTPNLHTLYWKMLFDERNLADVVYKLNGQAEVFYRKSSIQPEHRIVHPAGKPIANKNEHSKEPTSTFKYDIVKDRRYTVDKFQFHVPITINFKAAGQENINPVVLDAIRRGGFTHIIGIDRGERHLLYLSLIDLQGNIVEQMTLNEIINEYKGLKHKTNYHDLLAKREGERTEARRSWDTIENIKEMKEGYLSQVVHIISKMMVEYNAIVVLEDLNTGFMRSRQKIERQVYEKFEKMLIDKLNCYIDKQVGASDIAGLLHPLQLACEAKKWKRSHQCGCLFYIPAWNTSKIDPVTGFVNLFDTRYENAAKAKAFFGKFGSIRYNAEKDWFEFAFDYNDFTTKAEGTRTEWTLCTYRERIRTFRNPQKNHQWDDEEIVLTDAFKQLFDKYDIDMKGNLKEAICAQNDAQFFKDMMELMKLLLQMRNSITNSETDYLLSPVADEKGQFFDSRRGITTLPDNADANGAYNIARKGLWVIRKIQETAENEKPSLAITNKEWLQFAQTKPYLND

SEQ ID NO: 1674 - protein, 1274 aa, unidentified
  REGION 1..1274: note = Description of Unknown:uncultivated organism sequence
  REGION 1..1274: note = Category: MG75 effectors
  REGION 1..1274: note = Description: MG75-160 effector
MKKNLEKFIGLYHMDKTLRFELKPMGKTLENINNNGFIENDNHRADSYKKVKKLIDRYHKHYIESVLGDFKLNSIQLEAYYNLYTQQSKTEKEIKEFEAIQDKLRKSIADALKKDDRFKRIDKKELINEDLNVVLENDDERILVSEFQGFTSYFTGFHENRKNMYSDEAKSTAIAYRLIHENLPKFIDNIAIFKKVAETSVADKFSKLYKDFEEYLNVYNINEMFDLDYYSIVLTQKQIEVYNGIIGGKTLEDGTKVQGLNEYINLYNQQQNDKRASLPKLKPLFKQILSDREQLSWLQEEFKTGGDVLDAVKEYCEAYFMNVDEMIKVLLTSIANYDLSKIYIPNDLSLTDISQKMLGNWNVIPNAIEQDFRNRYIKKPEENEEKYSERISKLVKQEKSFSLAYINSCLSELDNADISTYFASLGAVNIPDKQTSSITTEISMYYNQLKPLFDIEYPKEKNLSQDKLTVMQLKNLLDAFKALQRFVKPLLGKGNEAEKDEKFYGELMQLWGIIDEITPLYNKVRNYATRKPYSTDKIKVNFENAQLLDGWDENKEENNAAIILLKDGLYYLGIVKKEHRNILKVDKPMPSNGECYDKVVYKFFKDITTMVPKCTTQMKAVKQHFENSSESYTLFDKKSFNAPVEITKEIFELNNVLYNGVKKFQIEYLRSTNDRAGYEHAVNLWKEFCMQFLKAYKSTAIYDLSSIEKDWAKYTDLSSFYGAVNLLLYNLSYKKVSVEYIDKLVEEDKMYLFQIYNKDFSEYSKGTPNMHTLYWKMLFDERNLKDVVYKLNGQAEIFFRKKSISMAKPTHPANKPIDNKNVLNKRKQSTFKYDLIKDKRYTLDKFQFHVPITINFKSGGDGKINIDVCKHIKDSNDMHFIGIDRGERHLLYLCVINSKGEIVEQYSLNEIVNEYKGNKYHTDYHHLLQERDKKRQEERTSWQTIEGIKELKQGYLSQVIHKISQLIVKYNALVILEDLNMGFKRSRQKVESSVYQQFEKALIDKLNYYVDKKTEPTEDGGLLRAYQLASKFDSFQKMGKQSGFIFYVPAWNTSKIDPVTGFVNLLDTRYESVAKSQKFFDDFDSIRYNGEKDWFELKFDYNKFTKKAEGTKTDWTLCTYGTRVETFRNSEKNANWDSREINLTDEWKALFDKYNIPLNCNLKDAIAQQTSKDFHNILLHLLKLTLQMRNSETGTDIDYMVSPIANEDGKFYDSRLCDKSLPENADANGAYNIARKGLWIAQQIKEAEDLKKVKLAITNKEWLQFAQQKPYLND

SEQ ID NO: 1675 - protein, 1284 aa, unidentified
  REGION 1..1284: note = Description of Unknown:uncultivated organism sequence
  REGION 1..1284: note = Category: MG75 effectors
  REGION 1..1284: note = Description: MG75-161 effector
MNTSNLSRFTNLYSISKTLRFELQPLGKTKDYIEKNGILMRDEKRAEDYKTVKGIIDEYHKKYIKGRLWDFKLPLASEGKHDSLEEYKALYEVSKRSEADEAAFKEVKDNLRSIIAKRLTSGKAYETIFKKELIREDLINSLEDEVEREIVSQFADFTTYFGGFHENRKNMYDAGEKSTAIAYRLIHQNLPKFMDNMKAFAKIAETSIAEHFADIYEGSKEMLNVGSIEEIFRLDYFSETLTQPHIEVYNSIIGKRVLEDGTEVKGINEYVNLYNQQQKDKRLPLLVPLYKQILSDREKLSWLAEEFDSDEKMLAAVNETYTHLHDLLMGNENESLRSLLLHLRDNDLEQINIANDLSLTDISQHLFGRYDVFTNGIKEELRVITPRKRKETDEQLEDRISKIFKTQKSFSIAFLNSLPQPAMEDGKARCIEDYFMALGAVNNETTQKENLFAQIENAYENAKSVLQMKETGDMLSQNKPAVSKIKALLDALKDLQHFIKPLLGSGEENEKDELFYGSFQMIWDELDAVTPLYNKVRNWLTRKPYSTEKIKLNFDNAQLLDGWDENKETTNASILLYKDGNYYLGIIKKEDRKILGSPMPTDGECYDKVVYKFFKDITTMVPKCTTQKKDVIAHFMHSDDDYILYDKKTFDAPVTITKEIYNLNNVLYNGVKKFQIEYLRSTGDKRGYEHAVFIWKSFCMHFLKAYKSTSIYNLALVEQQINSYYDLSSFYNAVNLLLYNLSYRKVSVNYIHSLVDEGKLYLFRIWNKDFSEYSKGTPNLHTLYWKMLFDERNLADVVYKLNGQAEVFYRKSSIQPEHRIVHPAGKPIANKNENSKEPTSTFKYDIVKDRRYTVEKFQFHVPITINFKAAGQENINPVVLDAIRRGGFTHIIGIDRGERHLLYLSLIDLQGNIVEQMTLNEIINEYKGLKHKTNYHDLLAKREGERTEARRSWDTIENIKEMKEGYLSQVVHIISKMMVEYNAIVVLEDLNTGFMRSRQKIERQVYEKFEKMLIDKLNCYIDKQVGASDIAGLLHPLQLACEAKKWKRSHQCGCLFYIPAWNTSKIDPVTGFVNLFDTRYENAAKAKAFFGKFGSIRYNAEKDWFEFAFDYNDFTTKAEGTRTEWTLCTYRERIRTFRNPQKNHQWDDEEIVLTDAFKQLFDKYDIDMKGNLKEAICAQNDAQFFKDMMELMKLLLQMRNSITNSETDYLLSPVADEKGQFFDSRRGITTLPDNADANGAYNIARKGLWVIRKIQETAENEKPSLAITNKEWLQFAQTKPYLND

SEQ ID NO: 1676 - protein, 1279 aa, unidentified
  REGION 1..1279: note = Description of Unknown:uncultivated organism sequence
  REGION 1..1279: note = Category: MG75 effectors
  REGION 1..1279: note = Description: MG75-162 effector
MSNFNEFTHLYQLSKTLRFELKPIGETLKHFNESGILDQDEHRAESYKKVKKLIDRYHKEFMEEALRDFVFQMDDEGKNNSLSEYFFLYSLGKRTEAQDNDFKDVKKNLREQIAKYFKASPKYKNLFKQELIKEDLCNNMQCNEEEQKLVEEFHNFTTYFTGFHENRKNMYSDEEKSTAIAFRLVHQNLPKFIDNIGVFDRVRNIDEIKAGIENLQKHFETEGLFKQGEKIEDFFTLDYYSRLAVQSRIEIYNAILGGKTTEKGEKIQGLNELINLYNQQHKETHLPKMKALFKQILSDRQAVSWIEESFKSDNEVLSSVNDFYENLKQNEIFERTKELLTSVGSYDLSKVYITNDQQLTSISQQLYGSWAVIENAILAEMQNETPRKKKEDAEKYNERLKKAYSNRSSFSIAYIDQCLEAVFGENRIPVEQHFANLGKAEIETEAECGKIKIPDVFTQIEQTYSAAKSLLCNPYPKDKHLSQSDEDIEKVKNLLDALKRFQHFIKPLTGSGDEAEKDEMFYGDLAELWTEIDQLNSLYNKVRNHLTGKPYSEEKLKLNFENATLLNGWDKNKEPDNTAIILRKDGLYYLAIMNKEHNRIFASDKLPNNGECYEKVIYKLLPGANKMLPKVFLSKKGIEVFKPSQEILAIYNNGTHKKGDTFNINDCHKLIDFFKESISKHNDWKNFDFHFSDTNSYEDLSGFYREVENQGYKITFQNISSDYIDNLVNEGKLYLFQIYNKDFSTKRDLSKHKEGTPNMHTLYWQMLFDERNLNDGVYQLNGHAEVFFRKKSLNYTKPTHPANQPIAKKNPHSKNETSQFTYDLIKDKRFTMDKFLFHVPITLNFKSGETDNINAKVRQWLQKADDVHIIGIDRGERHLLYLTVIDSKGNIKEQMSLNTIENKYNGNTYAFDYHNRLDEKEKERDKAKKSWKTVENIKELKEGYLSQAIHKITQLMLKYNAIIVLEDLNIGFMRGRQKVEKQVYQKFEKMLIDKLNYLADKKKDPSEVGGVLNAYQLTSKFESFTKLGRQSGFLFYIPAWNTSKIDPVTGFVNLFDTQYKSDGKAKMFFSKFKSISYNKDKNWFEFSFDYNDFTSKADGTKTEWTVCTNGERIENFRNGETSNQWGGRTINLSQKFKSLFDEYGIDFTKDLQNSICSQSKKGFFKQLLHLFKLTVQMRNSNTETEEEKGKKDFIISPVCVDDKYYNSDIEAEKGKDEEGNWKSELPVNADANGAYNIARKGLMILNHIKQSSDPSKKQEYDLTNKAWLNFVQKGSVEGK

SEQ ID NO: 1677 - protein, 1017 aa, unidentified
  REGION 1..1017: note = Description of Unknown:uncultivated organism sequence
  REGION 1..1017: note = Category: MG75 effectors
  REGION 1..1017: note = Description: MG75-163 effector
MFQLDYFSETLTQEQIAVYNHIIGGRALEDGTKLKGINEYVNLYNQQHKDSRLPLLKPLYKMILSDRVALPWFPSEEFASDEEMIRAINETYNTLKEVLSIDGDSSLRSLLLNISSYDIKHIYIANDLGLTDISQQMFGQYDVYTSAIKQELREKNAPTAKERRNPELYDERINKLFKSAKSFSIEHLNSLVDSELTIQNYYKHLGAYDRNGEQRVNLFTQIEMAYVAAKEILSGKHGNISQSDAETAIIKGLLDAFKSLQRFIKPLLGNGEEADKDNEFDAKLREAWNTLDIVTPLYNKVRNWLTRKPYSTEKIKLNFENAQLLGGWDVNKEPDCTSILLRKNGLYYLAIMNKKYNHAFDIDNLPNDGKCYEKIDYKLLPGANKMLPKVFFSKSRIKEFAPSEIIVNAYKKGSHKKGSNFSISDCRRLIDFFKASISKHEDWKNFPFSFSSTETYEDISGFYREVEQQGYMLGFRNVSESFIKQFVDEGKLYLFQIWNKDFSDFSKGTPNMHTLYWKMLFDEHNLANVVYKLNGQAEVFYRKSSLDVANTTIHKAHQPIMNKNQENKKRQSTFDYDIIKNRRYTVDKFQFHVPISINFKATGRDNVNDNVLDIIRNGGIKHIIGIDRGERHLLYLSLIDLKGNIVKQMTLNDIVNEYNGNTYATNYKDLLAEREGNRTEARKNWKKIENIKDIKKGYLSQVVHIISKMMVEYNAIVVLEDLNMGFMRGRQKIERSVYEQFEKMLIDKLNYYVDKQKNSDEAGGLLHALQLTSKFESFKKLGKQSGCLFYIPAWNTSKIDPVTGFVNLFDTRYTNADQARKFFSQFDSIRYNAYKDWFEFAFDYNKFTAKAKDTRTKWTLCTYGTRIRTFRNPARLNQWDNEEVVLTDEFKKAFANADINIHGNLKEAICSLQDKKYLEPLMHLMKLLLQMRNSITNSEVDYLLSPVADENGTFYDSRICSASLPKDADANGAYNIARKGLWAIHQIQETPAGDRPNLAIKNKDWLNFAQQKPYMNE

SEQ ID NO: 1678 - protein, 1286 aa, unidentified
  REGION 1..1286: note = Description of Unknown:uncultivated organism sequence
  REGION 1..1286: note = Category: MG75 effectors
  REGION 1..1286: note = Description: MG75-164 effector
MKQKKTQNPFNQFIGLYPLSKTLRFELRPYNEKTKNNIISAGILAEDNHRAESYKKVKKIIDEYHKAFIERVLKDLVLEEKPLQAFYECYKKSSKEEALQEIGNNLRTQISNAFEKDPKYSTLTSKDLINKELPSIVTTEEERTLLEEFHGFSTYFVGFHQNRENMYSDEEKATSIAYRLINENLPKFIDNIRSFQKIADSPIADKLESIYDEYAKEGYMNVNTLNEMFEISFYNRVLTQTQIDLYNAIIGGKTEKDGHKTQGINEYINLYNQRGEVQKKDRLPLLKPLFKQILSDREHISWFEEGFADDQAMLNAIKDFYLELTETGPTTTESILDRTKSLLRTIADYDLTKIYLGYNSLSKISQQIFGEWDRIQRALEAEYDQREKTKTYEEKEKHFKSLKSVSIGFIDDCLKAFETDKQLSLSIKEYIAQLGKKNDDPDLIDRITASYKAVKAILTTEWPKERNIAQEKDIVALIKDLLDRIKDLQSFIKPLLGSGKESDKDNLFYGELASIWETINTVTPLYDKVRNRMTRKPYSTQKFKVNFRNSQLLKGWDLNKEKDYMGIILRKKDLYFLAIMNKKNTKVFSSKVPSQGECFEKMIYKQFDATKQVPKCSTELKRVKEAIEIDDKPYYELFDKQKFSKPLTITREIWQLNNLVWDKKTNSFVRRKKDETRPKKFQQEYLDITEDREGYCEALRKWIDFVKDFLASYKSTSIYNIKYKDSSEYASIKEFYNFLDQELYHIEFSNVSVDYINELIEEGKIYLFQIYNKDFSPHSKGTPNMHTLYWKTLFDERNLANVAYKLNGEAEIFFRKASLERKVTHPAHDPIKTKNPKTSIKEKAFAYDLIKDKRYTEDKFQLHVPITMNFKSPMEKKGINSRVNNYIKTAEDLHFIGIDRGERNLLYVCVIDSQGNIKDQYSLNEIVNQYNRTDYKYLLEKREEERDKERKSWQTIENIKDLKQGYLSQVVHKIAQLMVQYHAIVVLEDLNSGFKRSRQKVEKSVYQQFEKSLIDKLNYLIDKRLPIDEEGGVLRAYQLTNKFESFKTMKMQNGFLFYIPAWNTSKMDPTTGFVNLFDTRYTNIDKSKEFFDKFEAIRYNEGKDWFELEFDYEHFTTKAEGTQTQWTLCTWGERINTFRNKSKNSSWDYKKINLTEEYKTLFEQFSINYRRNLKKEILEQNSKDFFERLLSLLHLTLQMRNSIPNTDTDYLISPVADANGHFYYSEQCGDNLPKNADANGAYNIARKGMWMAEQIRRSNEGEELKLAISNKEWLRFAQEKPYLEDK

SEQ ID NO: 1679 - protein, 1236 aa, unidentified
  REGION 1..1236: note = Description of Unknown:uncultivated organism sequence
  REGION 1..1236: note = Category: MG75 effectors
  REGION 1..1236: note = Description: MG75-165 effector
MKQLSELTGLYSLSKTLRFELKPIGKTLEHIESKGLIAQDEQRAEEYKKVKDIIDRYHKKFITMCLSDFKFEQNSLETYVALAENTNRDEKAFDEIKKTLRKQIVETFKKGGSYSDLFKKELIQKHLPEFVSDEEEKKMIANFSKFTTYFNGFNENRKNMYSDEDKSTAIAYRLIHENLPMFVNNMKSFSRIADSDVHQHFTEIESSFSEYLGVEHLEEMFQLDYFSETLTQEQIAVYNHIIGGRALEDGTKLKGINEYVNLYNQQHKNSRLPLLKPLYKMILSDRVALPWFPSEEFASDEEMIRAINETYNTLKEVLSIDGDSSLRSLLLNISSYDIKHIYIANDLGLTDISQQMFGQYDVYTSAIKQELREKNAPTAKERRNPELYDERINKLFKSAKSFSIEHLNSLVDSEHTIQNYYKHLGAYDRNGEQRVNLFTQIEMAYVAAKEILSGKHGNISQSDAETAIIKGLLDAFKSLQRFIKPLLGNGEEADKDNEFDAKLREAWNTLDIVTPLYNKVRNWLTRKPYSTEKIKLNFENAQLLGGWDVNKEPDCTSILLRKNGLYYLAIMNKKYNHAFDIDNLPNDGKCYEKIDYKLLPGANKMLPKVFFSKSRIKEFAPSEIIVNAYKKGSHKKGANFSISDCRRLIDFFKASISKHEDWKNFPFSFSSTETYEDISGFYREVEQQGYMLGFRNVSESFIKQLVDEGKLYLFQICNKDFSDFSKGTPNMHTLYWKMLFDEHNLANVVYKLNGQAEVFYRKSSLDVANTTIHKAHQPIMNKNQENKKRQSTFDYDIIKNRRYTVDKFQFHVPISINFKATGRDNVNDNVLDIIRNGGIKHIIGIDRGERHLLYLSLIDLKGNIVKQMTLNDIVNEYNGNTYATNYKNLLAEREGNRTEARKNWKKIENIKDIKKGYLSQVVHIISKMMVEYNAIVVLEDLNMGFMRGRQKIERSVYEQFEKMLIDKLNYYVDKQKNSDEAGGLLHALQLTSKFESFKKLGKQSGCLFYIPAWNTSKIDPVTGFVNLFDTRYTNADQARKFFSQFDSIRYNADKDWFEFAFDYNKFTAKAKGTRTKWTLCTYGTRIRTFRNSERLNQWDNEEVVLTDEFKKAFANADINIHGNLKEAICSLQDKKYLEPLMHLMKLLLQMRNSITNSEVDYLLSPVADENGTFYDSRICSASLPKDADANGAYNIARKGLWAIHQIQETPAGDRPNLAIKNKDWLNFAQQKPYMNE

SEQ ID NO: 1680 - protein, 956 aa, unidentified
  REGION 1..956: note = Description of Unknown:uncultivated organism sequence
  REGION 1..956: note = Category: MG75 effectors
  REGION 1..956: note = Description: MG75-166 effector
MILSDRVALPWFPSEEFASDEEMIRAINETYNTLKEVLSIDGDSSLRSLLLNISSYDIKHIYIANDLGLTDISQQMFGQYDVYTSAIKQELREKNAPTAKERRNPELYDERINKLFKSAKSFSIEHLNSLVDSEHTIQNYYKHLGAYDRNGEQRVNLFTQIEMAYVAAKEILSGKHGNISQSDAETAIIKGLLDAFKSLQRFIKPLLGNGEEADKDNEFDAKLREAWNTLDIVTPLYNKVRNWLTRKPYSTEKIKLNFENAQLLGGWDVNKEPDCTSILLRKNGLYYLAIMNKKYNHAFDIDNLPNDGKCYEKIDYKLLPGANKMLPKVFFSKSRIKEFAPSEIIVNAYKKGSHKKGANFSISDCRRLIDFFKASISKHEDWKNFPFSFSSTETYEDISGFYREVEQQGYMLGFRNVSESFIKQLVDEGKLYLFQIWNKDFSDFSKGTPNMHTLYWKMLFDEHNLANVVYKLNGQAEVFYRKSSLDVANTTIHKAHQPIMNKNQENKKRQSTFDYDIIKNRRYTVDKFQFHVPISINFKATGRDNVNDNVLDIIRNGGIKHIIGIDRGERHLLYLSLIDLKGNIVKQMTLNDIVNEYNGNTYATNYKNLLAEREGNRTEARKNWKKIENIKDIKKGYLSQVVHIISKMMVEYNAIVVLEDLNMGFMRGRQKIERSVYEQFEKMLIDKLNYYVDKQKNSDEAGGLLHALQLTSKFESFKKLGKQSGCLFYIPAWNTSKIDPVTGFVNLFDTRYTNADQARKFFSQFDSIRYNADKDWFEFAFDYNKFTAKAKDTRTKWTLCTYGTRIRTFRNSERLNQWDNEEVVLTDEFKKAFANADINIQGNLKEAICSLQDKKYLEPLMHLMKLLLQMRNSITNSEVDYLLSPVADENGTFYDSRVCSASLPKDADANGAYNIARKGLWAIHQIQETPAGDRPNLAIKNKDWLNFAQQKPYMNE

SEQ ID NO: 1681 - protein, 1236 aa, unidentified
  REGION 1..1236: note = Description of Unknown:uncultivated organism sequence
  REGION 1..1236: note = Category: MG75 effectors
  REGION 1..1236: note = Description: MG75-167 effector
MKQLSELTGLYSLSKTLRFELKPIGKTLEHIESKGLIAQDEQRAEEYKKVKDIIDRYHKKFITMCLSNFKFEQNSLETYVALAEDTNRDEKVFDEIKKTLRKQIVETFKKGGSYSDLFKKELIQKHLPEFVSDEEEKKMIANFSKFTTYFNGFNENRKNMYSDEDKSTAIAYRLIHENLPMFVNNMKSFSRIADSDVHQHFTEIESSFSEYLGVEHLEEMFQLDYFSETLTQEQIAVYNHIIGGRALEDGTKLKGINEYVNLYNQQYKDSRLPLLKPLYKMILSDRVALPWFPSEEFASDEEMIRAINETYNTLKEVLSIDGDSSLRSLLLNISSYDIKHIYIANDLGLTDISQQMFGQYDVYTSAIKQELREKNAPTAKERRNPELYDERINKLLKSAKSFSIEHLNSLVDSEHTIQNYYKHLGAYDRNGEQRVNLFTQIEMAYVAAKEILSGKHGNISQSDAETAIIKGLLDAFKSLQRFIKPLLGNGEEADKDNEFDAKLREAWNTLDIVTPLYNKVRNWLTRKPYSTEKIKLNFENAQLLGGWDVNKEPDCTSILLRKNGLYYLAIMNKKYNHAFDIDNLPNDGKCYEKIDYKLLPGANKMLPKVFFSKSRIKEFAPSEIIVNAYKNGSHKKGANFSISDCRRLIDFFKASISKHEDWKNFPFSFSSTETYEDISGFYREVEQQGYMLGFRNVSESFIKQLVDEGKLYLFQIWNKDFSDFSKGTPNMHTLYWKMLFDEHNLANVVYKLNGQAEVFYRKSSLDVANTTIHKAHQPIMNKNQENKKRQSTFDYDIIKNRRYTVDKFQFHVPISINFKATGRDNVNDNVLDIIRNGGIKHIIGIDRGERHLLYLSLIDLKGNIVKQMTLNDIVNEYNGNTYATNYKNLLAEREGNRTEARKNWKKIENIKDIKKGYLSQVVHIISKMMVEYNAIVVLEDLNMGFMRGRQKIERSVYEQFEKMLIDKLNYYVDKQKNSDEAGGLLHALQLTSKFESFKKLGKQSGCLFYIPAWNTSKIDPVTGFVNLFDTRYTNADQARKFFSQFDSIRYNADKDWFEFAFDYNKFTAKAKDTRTKWTLCTYGTRIRTFRNPAKLNQWDNEEVVLTDEFKKAFANADINIHGNLKEAICSLQDKKYLEPLMHLMKLLLQMRNSVTNSEVDYLLSPVADENGTFYDSRVCSAYLPKDADANGAYNIARKGLWAIHQIQESPAGNRPNLAIKNKDWLNFAQQKPYMNE

SEQ ID NO: 1682 - protein, 1271 aa, unidentified
  REGION 1..1271: note = Description of Unknown:uncultivated organism sequence
  REGION 1..1271: note = Category: MG75 effectors
  REGION 1..1271: note = Description: MG75-168 effector
MNNNLNKFTGLYQLSRTLRFELKPIRKTRDNIERNGFLANDEHRAESYKKVKKLIDRYHKAYIDSVLGRFCLNEDVLANYYDLYMRSSKTEKEAKEFEAIQDYLRKSISAALKKDDRFKRIDKKELIREDMIAYLTDDEEKALVEEFHDFTTYFTGFHENRQNMYSAEAKSTAIAYRLIHDNLPKFIDNIAVFRQIAETSVADNFLKIYMENEEYLNVNSIEEMFDISYYSMVLTQTQIEVYNSIIGGRTLEDGTKLQGINEYINLYNQNLTDKKKRLPKLKPLFKQILSDRAQLSWLQEEFNTGADVIDAVKEYCKDYYDNIEKSIKALLKSLNDYDISKIYVPNDLQLTDISQRMFGNWSIIPNAIEHDIMYNNPRKANETEEKYAERIAKLKKQQKSFSLAYINDCLRELKDADLSTYFASLGAQNTAEKQTTSITSEIDIYYKQLRPLFNVEYPREKNLSQDKLTVMQLKDLLDAFKTLQRFVKPLLGNGDEAEKDEKFYGELMQLWEIINNLTPLYNKVRNYVTRKPFSTEKIKVNFENAQLLDGWDENKEKDNASIILRKDGIYYLGVMKKEQRKLLAKPMPSSGECYEKVVYKFFKDITTMVPKCTTQTKPVKEHFENSTEDYILFDKKSFDAPVVITKEIFDLNNVLYNGVKKFQIEYLRSTNDKKGYEHAVNTWKAFCIQFLKSYKSTSIYNLSSIEEDIEKYKDLNSFYSAVNLLLYSLTFRKVSVDYIDQLVEEDKMYLFQIYNKDFSQYSKGTPNMHTMYWKMLFDEENLKDVVYKLNGQAEVFFRKKSINVSSPTHPANKPIDNKNALNKKKQSTFEYDLIKDRRYSVDKFQFHVPLTLNFKSRGTGNINIDVREYIKESNDIHFIGIDRGERHLLYLCVIDGKGNIVEQYSLNEIVNEYKGNKYSTDYHNLLQERDKKRLEERSSWQTIEGIKELKQGYLSQVVHKISQLVVKYNAIVILEDLNMGFKRGRQKVESSIYQQFEKALIDKLNYLVDKSKAPSEEGGLLRAYQLTSKFDSFQKMGKQSGFLFYIPAWNTSKIDPVTGFVNLFDTRYDNVAKSQAFFNKFDSIRYNEKKDWFEISFDYNNFTAKAEGTKTQWTLCTYGTRIETFRNVDKNSNWDSKEVNLTEKWKSLFDDYSIKYDSNLKDAIIQQSSKEFYVRLLHLLKLTLQMRNSITGTEVDYMISPVADANGKFFDSRKSDSSLPENADANGAYNIARKGLWIAQQIREAEDLKKVKLAITNKEWLQFAQTKPYLG

SEQ ID NO: 1683 - protein, 1236 aa, unidentified
  REGION 1..1236: note = Description of Unknown:uncultivated organism sequence
  REGION 1..1236: note = Category: MG75 effectors
  REGION 1..1236: note = Description: MG75-169 effector
MKQLSELTGLYSLSKTLRFELKPIGKTLEHIESKGLIAQDEQRAEEYKKVKDIIDRYHKKFITMCLSDFKFEQNSLETYVALAEDTNRDEKAFDEIKKTLRKQIVETFKKGGSYSDLFKKELILKHLPEFVSDEEEKKMIANFSKFTTYFNGFNENRKNMYSDEDKSTAIAYRLIHENLPMFVNNMKSFSRIADSDVHQHFTEIESSFSEYLGVEHLEEMFQLDYFSETLTQEQIAVYNHIIGGRALEDGTKLKGINEYVNLYNQQHKDSRLPLLKPLYKMILSDRVALPWFPSEEFASDEEMIRAINETYNTLKEVLSIDGDSSLRSLLLNISSYDIKHIYIANDLGLTDISQQMFGQYDVYTSAIKQELREKNAPTAKERRNPELYDERINKLFKSARSFSIEHLNSLVDSEHTIQNYYKHLGAYDRNGEQRVNLFTQIEMAYVAAKEILSGKHGNINQSDAETAIIKGLLDAFKSMQRFIKPLLGNGEEADKDNEFDAKLREAWNTLDIVTPLYNKVRNWLTRKPYSTEKIKLNFENAQLLGGWDVNKEPDCTSILLRKNGLYYLAIMNKKYNHAFDIDNLPNDGKCYEKIDYKLLPGANKMLPKVFFSKSRIKEFAPSEIIVNAYKKGSHKKGANFSISDCRRLIDFFKASISKHEDWKNFPFSFSSTETYEDISGFYREVEQQGYMLGFRNVSESFIKQLVDEGKLYLFQIWNKDFSDFSKGTPNMHTLYWKMLFDEHNLANVVYKLNGQAEVFYRKSSLDVANTTIHKAHQPIMNKNQENKKRQSTFDYDIIKNRRYTVDKFQFHVPISINFKATGRDNVNDNVLDIIRNGGIKHIIGIDRGERHLLYISLIDLKGNIVKQMTLNDIVNEYNGNTYATNYKNLLAEREGNRTEARKNWKKIENIKDIKKGYLSQVVHIISKMMVEYNAIVVLEDLNMGFMRGRQKIERSVYEQFEKMLIDKLNYYVDKQKNSDEAGGLLHALQLTSKFESFKKLGKQSGCLFYIPAWNTSKIDPVTGFVNLFDTRYTNADQARKFFSQFDSIRYNADKDWFEFAFDYNKFTAKAKDTRTKWTLCTYGTRIRTFRNPARLNQWDNEEVVLTDEFKKAFANADVNIHGNLKEAICSLQDKKYLEPLMHLMKLLLQMRNSITNSEVDYLLSPVADENGTFYDSRVCSASLPKDADANGAYNIARKGLWAIHQIQETPAGDRPNLAIKNKDWLNFAQQKPYMNE

SEQ ID NO: 1684 - protein, 1236 aa, unidentified
  REGION 1..1236: note = Description of Unknown:uncultivated organism sequence
  REGION 1..1236: note = Category: MG75 effectors
  REGION 1..1236: note = Description: MG75-170 effector
MKQLSELTGLYSLSKTLRFELKPIGKTLEHIESKGLIAQDEQRAEEYKKVKDIIDRYHKKFITMCLSDFKFEQNSLETYVALAEDTNRDEKVFDEIKKTLRKQIVETFKKGGSYSDLFKKELIQKHLPEFVSDEEEKKMIANFSKFTTYFNGFNENRKNMYSDEDKSTAIAYRLIHENLPMFVNNMKSFSRIADSDVHQHFTEIESSFSEYLGVEHLEEMFQLDYFSETLTQEQIAVYNHIIGGRALEDGTKLKGINEYVNLYNQQHKDSRLPLLKPLYKMILSDRVALPWFPSEEFASDEEMIRAINETYNTLKEVLSIDGDSSLRSLLLNISSYDIKHIYIANDLGLTDISQQMFGQYDVYTSAIKQELREKNAPTAKERRNPELYDERINKLFKSAKSFSIEHLNSLVDSEHTIQNYYKHLGAYDRNGEQRVNLFTQIEMAYVAAKEILSGKHGNISQSDAETAIIKGLLDAFKSLQRFIKPLLGNGEEADKDNEFDAKLREAWNTLDIVTPLYNKVRNWLTRKPYSTEKIKLNFENAQLLGGWDVNKEPDCTSILLKKNGLYYLAIMNKKYNHAFDIDNLPNDGKCYEKIDYKLLPGANKMLPKVFFSKSRIKEFAPSEIIVNAYKKGSHKKGANFSISDCRRLIDFFKASISKHEDWKNFPFSFSSTETYEDISGFYREVEQQGYMLGFRNVSESFIKQLVDEGKLYLFQIWNKDFSDFSKGTPNMHTLYWKMLFDEHNLANVVYKLNGQAEVFYRKSSLDAANTTIHKAHQPIMNKNQENKKRQSTFDYDIIKNRRYTVDKFQFHVPISINFKATGRDNVNDNVLDIIRNGGIKHIIGIDRGERHLLYLSLIDLKGNIVKQMTLNDIVNEYNGNTYATNYKDLLAEREGNRTEARKNWKKIENIKDIKKGYLSQVVHIISKMMVEYNAIVVLEDLNMGFMRGRQKIERSVYEQFEKMLIDKLNYYVDKQKDSDEAGGLLHALQLTSKFESFKKLGKQSGCLFYIPAWNTSKIDPVTGFVNLFDTRYTNADQARKFFSQFDSIRYNADKDWFEFAFDYNKFTAKAKDTRTKWTLCTYGTRIRTFRNSERLNQWDNEEVVLTDEFKKAFANADINIHGNLKEAICSLQDKKYLEPLMHLMKLLLQMRNSITNSEVDYLLSPVADENGTFYDSRVCSASLPKDADANGAYNIARKGLWAIHQIQESPAGDRLNLAIKNKDWLNFAQQKPYMNE

SEQ ID NO: 1685 - protein, 1235 aa, unidentified
  REGION 1..1235: note = Description of Unknown:uncultivated organism sequence
  REGION 1..1235: note = Category: MG75 effectors
  REGION 1..1235: note = Description: MG75-171 effector
MKQLNELTGLYSLSKTLRFELKPIGKTLEHIESKGLIAQDEQRAEEYKKVKDIIDRYHKAFITMCLRDFNFDQNSLETYVALAEDSNRDEKDFDEIKKALRKQIVEAFKKGGSYSDLFKKELIQKHLPEFVKDEEEKKMVENFSKFTTYFSGFNENRKNMYSDEDKSTAIAYRLIHENLPMFIDNMKSFGKIAVSDVSQHFSEIESSFSEYLNVEHLADMFQLDYFSETLTQEQIAVYNHIVGGRTLEDGTKLQGVNEYVNLYNQQHKDNRLPLLKPLYKMILSDRVALSWLPEEFASDEEMINAINETYNTLKDVLMGNGDNSLRNLLLNIDKYDVEHIYIGNDLGLTDISQQLFGQYDVYTSAIKQELRNSVSPTAKERREPELYAERINKLFKSAKSFSILYLNSLVDSEHTIQSYYKQLGAYDRGGEQRINLFSQIEMAYVAAKDILSGKHGNISQSDADTAIIKNLLDAYKSLQRFIKPLLGDGEEADKDNEFDAKLREAWDALDIVTPLYNKVRNWLTRKPYSTEKIKLNFENAQLLGGWDVNKEPDCTSVLLRKNGFYYLAIMNKKYNHAFDIDNLPHNGKCYEKIDYKLLPGANKMLPKVFFSNSRIKEFAPSDAIVSAYRKGTHKKGSNFNISDCRRLIDFFKASIMKHEDWKKFPFSFSPTETYEDISGFYREVEQQGYMLGFRNVSESFINQLIDEGKLYLFQIWNKDFSEFSKGTPNMHTLYWKMLFDERNLANVVYKLNGQAEVFYRKRSLDVANTTIHKAHQPIVNKNQENKKLQSTFEYDIIKNRRYTVDKFQFHVPISINFKAIGRDNVNDNVLDIIRNGGIKHIIGVDRGERHLLYLSLIDLNGNIVKQMTLNDIVNEYNGNTYATNYRDLLAEREGNRTEARKNWKEIENIKDIKQGYLSQVVHIISKMMVEYDAIVVLEDLNMGFMRGRQKIERSVYEQFEKMLIDKLNYYVDKQKSVNEAGGLLHALQMTSKFESFKKLGKQSGCLFYIPAWNTSKIDPVTGFVNLFDTRYTNADQARRFFSQFDVIRYNADKDWFEFAFDYNNFTAKAEGTRTKWILCTYGTRIRTFRNPAKLNQWDNEEVVLTDEFKKAFANADIDIHGNLKEAICSLQDKKYLEPLMHLMKLLLQMRNSITNSEVDYLLSPVADENGKFYDSRTCSDSLPKDADANGAYNIARKGLWAIRQIQETPAGERSNLAIKNKEWLNFAQQKPYENE

SEQ ID NO: 1686 - protein, 967 aa, unidentified
  REGION 1..967: note = Description of Unknown:uncultivated organism sequence
  REGION 1..967: note = Category: MG75 effectors
  REGION 1..967: note = Description: MG75-172 effector
MSDRESVSWLPPKFDSDKDLLIKIKECYYALSEREKVFDKLESILKSLSTYDLSKIYISNDSQLSYISQKMFGRWDIISKAIREDCAKRNPQKSRESLEKFAERIDKKLKTIDSISIGDVDECLAQLGETYVKRVEDYFVAMGELEIDDEQTDTTSFKKNIEGAYESVKELLNNADNITDNNLMQNKGNVEKIKTLLDAIKDLQRFIKPLLGKGDEADKDGVFYGEFTSLWTKLDTVTPLYNMVRNYLTSKPYSTKKIKLNFENSSLMKGWDLNKEPDNTTVIFRKDGLYYLGIMGKKYNRVFVDREDLPHDGECYDKMEYKLLPGANKMLPKVFFSETGIQRFRPSEELLGKYERGTHTKGAGFDLGYCRALIDFFKKSIERHDDWKKFDFKFSDTSTYQDISEFYREVEQQGYKMSFRKVSVDYIKSLVEEGKLYLFQIYNKDFSAHSKGTPNMHTLYWKMLFDEENLKDVVYKLNGEAEVFFRKSSITVQSPTHPANSPIKNKNKDNQKKESKFEYDLIKDRRYTVDKFLFHVPITMNFKSVGVSNINQLVKRHIRSATDLHIIGIDRGERHLLYLTVIDSRGNIKEQFSLNEIVNEYNGNTYRTDYHELLDTREGERTEARRNWQTIQNIRELKEGYLSQVIHKISELAIKYNAVIVLEDLNFGFMRSRQKVEKQVYQKFEKMLIDKLNYLVDKKKPVAETGGLLRAYQLTGEFESFKTLGKQSGILFYVPAWNTSKIDPVTGFVNLFDTHYENIEKAKGFFDKFKSIRYNSDKDWFEFVVDDYTRFSPKAEGTRRDWTICTQGKRIQIYRNPQRNNEWEGREIDLTKAFKEHFEAYGVDISKDLREQINTQNKKEFFEELLRLLRLTLQMRNSMPSSDIDYLISPVADDTGCFFDSRKQAELKENAVLPMNADANGAYNIARKGLLAIRKMKQEENDSAKISLAISNKEWLKFAQTKPYLED

SEQ ID NO: 1687 - protein, 1236 aa, unidentified
  REGION 1..1236: note = Description of Unknown:uncultivated organism sequence
  REGION 1..1236: note = Category: MG75 effectors
  REGION 1..1236: note = Description: MG75-173 effector
MKQLSELTGLYSLSKTLRFELKPIGKTLEHIESKGLIAQDEQRAEEYKKVKDIIDRYHKKFITMCLSDFKFEQNSLETYVALAEDTNRDEKSFDEIKKTLRKQIVETFKKGGSYSDLFKKELIQKHLPEIVTDEEEKKMIANFSKFTTYFNGFNENRKNMYSDEDKSTAIAYRLIHENLPMFVDNMKSFSRIADSDVHQHFTEIESSFSEYLGVEHLEGMFQLDYFSETLTQEQIAVYNHIIGGRVLEDGTKLKGINEYVNLYNQQHKDSRLPLLKPLYKMILSDRVALPWFPSEEFASDEEMIGAINETYNTLKDVLSIDGDSSLRCLLLNISSYDIKHIYIANDLGLTDISQQMFGQYDVYTSAIKQELRTTNAPTAKERRTPELYDERINKLFKSAKSFSIEYLNSLVDSEHTIQNYYKHLGAYDRNGEQRVNLFTQIEMAYVAAKEILSGKHGNISQSDAETAIIKGLLDAFKSLQRFIKPLLGNGEEADKDNEFDAKLREAWNTLDIVTPLYNKVRNWLTRKPYSTEKIKLNFENAQLLGGWDVNKEPDCTSILLRKNGLYYLAIMNKKYNHAFDIDNLPNDGECYEKIDYKLLPGANKMLPKVFFSKSRIKEFAPSEIIVNAYKKGSHKKGANFSISDCRRLIDFFKASISKHEDWKNFPFSFSSTETYEDISGFYREVEQQGYMLGFRNVSESFIKQLVDEGKLYLFQIWNKDFSDFSKGTPNMHTLYWKMLFDEHNLANVVYKLNGQAEVFYRKRSLDVANTTIHKAHQPIMNKNQENKKRQSTFDYDIIKNRRYTVDKFQFHVPISINFKATGRDNVNDNVLDIIRNGGIKHIIGIDRGERHLLYLSLIDLKGNIVKQMTLNDIVNEYNGNTYATNYKNLLAEREGNRTEARKNWKKIENIKDIKKGYLSQVVHIISKMMVEYNAIVVLEDLNMGFMRGRQKIERSVYEQFEKMLIDKLNYYVDKQKNSDEAGGLLHALQLTSKFESFKKLGKQSGCLFYIPAWNTSKIDPVTGFVNLFDTRYTNADQARKFFFQFDSIRYNADKDWFEFAFDYNKFTAKAKDTRTKWTLCTYGTRIRTFRNPARLNQWDNEEVVLTDEFKKAFANADINIHGNLKEAICSLQDKKYLEPLMHLMKLLLQMRNSITNSEVDYLLSPVADENGTFYDSRVCSASLPKDADANGAYNIARKGLWAIHQIQESPAGDRPNLAIKNKDWLNFAQQKPYMNE

SEQ ID NO: 1688 - protein, 1237 aa, unidentified
  REGION 1..1237: note = Description of Unknown:uncultivated organism sequence
  REGION 1..1237: note = Category: MG75 effectors
  REGION 1..1237: note = Description: MG75-174 effector
MHTMKKINELTALYPLSKTLRFELKPIGKTLDHIEQKGLIVQDEQRAEEYKQVKNIIDSYHKEFITMCLKGLKLNMIYLERYESLARDVHRDEAEFDKVKAALRKQIVEAFKQGGSYNDLFKKELIQKHLPEFVESEEEKKMVANFSKFTTYFTGFYENRKNMYSDEEKSTAIAYRLIHENLPLFLDNMRSFRKIAESEVGEHFANIEVCFEEYLNVEHLAEMFELDYFSDTLTQEQIAVYNSVIGGRTLDDGTKIQGINEYVNLYNQQHKEARLPLLKPLYKMILSDRVALSWLPENPFESDEEMVEAIKEMCQSLKEVLMGNDGLRNLLLNIDLYDIEHIYIANDLGLTDISQQMFGQYDVYASAIKQELRQGVKQSPKERREPELFEERINRLYKSAKSFSIAYLNSHTDANHTIESYFKQLGAYDREGEQRINLFTQIEMAQIEATDIFAGKHGNISQSDKEIAILKGLLDAYKSLQHFVKPLLGHGDEADKDNEFDAKLREAWNALDIVTPLYNKVRNWLTRKPYSVEKIKLNFENAQLLGGWDVNKEPDCTSVLLRKDGFYYLAIMDKKSNHAFDSDELPCDGKCYEKIDYKLLPGANKMLPKVFFSKSRIDEFAPSKEIVEAYKNGTHKKGKDFNLAHCRRLIDFFKRSITKHEDWKNFPFVFSPTESYEDISGFYREVEQQGYMLSFRKVSESFINQLVDEGKLYLFKIWNKDFSEYSKGMPNMHTLYWKMLFNEQNLADTVYKLNGQAEVFYRKRSLDVADTTVHRASQPLVNKNALNKKRHSTFDYDIVKDRRYTVDKFQFHVPMTMNFKAVGRDNINSEVLNIIRNDGIKHIIGIDRGERHLLYLSLIDLKGNIVKQMTLNDIVNEYNGNTYATNYRDLLAEREGNRTEARRNWKKIENIKEIKQGYLSQVVHIISKMMVEYDAIVVLEDLNMGFMRGRQKIERSVYEQFEKMLIDKLNYYVDKQKRIDEAGGLLHALQLTSKFESFKKLGKQSGCLFYIPAWNTSKIDPVTGFVNLFDTRYVNADKAREFFSKFDSIRYNDAKNWFEFAFDYNKFTEKAKGTRTRWTLCTWGTRIRTFRNPAKLNQWDNEEVVLTDVFKKAFDEAGIDIHSNLKEAICTLTEKKHLESLMHLMKLLLQMRNSITNSEIDYLLSPVADENGHFYDSRTCDDTLPKDADANGAYNIARKGLWAIRTIQENSETERPNLALKNQDWLRFAQQKPYLND

SEQ ID NO: 1689 - protein, 1142 aa, unidentified
  REGION 1..1142: note = Description of Unknown:uncultivated organism sequence
  REGION 1..1142: note = Category: MG75 effectors
  REGION 1..1142: note = Description: MG75-175 effector
MKKFLDNDDDKALLDEFYEFTTYFTGFHENRKNMYSDEAKSTAIAYRLIHDNLPKFIDNMAVFRKIASTSVAEKFSTIYKAFEEYLNVNSIDEMFSLDYYNIVLTQSQIEVYNSIIGGRTLEDGTKIQGINEYINLYNQQKTNKKERLPKLKPLFKQILSDRVQLSWLQEEFNTGTDVLNAVKEYCTSYFDNVEEAVKVLLTGIGDYDLSKIYITNDLAITDVSQRMFGEWCIIPNAIEQRLRNDNPQKAKETEEKYSDRISKLKKLPKSFSLGYINECISELKGVDIADYYAALGAINTESKQEPSIPTKIQVHYNALKQILDTDYPREKNLSQDKLTVMQLKDLLDDFKALQRFIKPLLGNGDEADKDEKFYGELMQLWEVIDSITPLYNKVRNYSTRKPFSTEKIKVNFENAQLLDGWDENKESTNASIILRKDGMYYLGIMKKEHRNILNQPMPSDGDCYDKVVYKFFKDITTMVPKCTTQMKSVKEHFTNSNDDYTLFDKDKFLAPVVITKEIFDLNNVLYDGVKKFQVGYLNNTGDSQGYNHAVAIWKSFCLQFLKTYKSTSIYNFSSIEKNFDRYTDLNSFYGAVNLLLYSLTYRKVSVDYIQQLVDDDKMYLFRIYNKDFSPYSKGTPNMHTLYWKMLFDDCNLSDVVYKLNGQAEVFFRKKSINYQRPTHPANKPIDNKNVNNPKKQSTFDYDLIKDRRYTLDKFMFHVPITLNFKGMGSGDINMQVREYIKATDDLHFIGIDRGERHLLYICVINCKGDIVEQYSLNEIVNNYKGIDYSTDYHALLSDRDKKRKEERSSWQTIEGIKELKAGYLSQVIHKITQLMVKYNAIVLLEDLNMGFKRGRQKVESSVYQQFEKALIEKLNYLVDKNKDVNEIGGLLHAYQLTNDTKLQNKNGKQDGFLFYVPAWNTSKIDPVTGFVNLLDTRYENVATAQAFFNKFDSIRYNKEFDRFEFKFDYANFTAKAEDTRTQWTLCTCGTRVETFRNAEKNSNWDSREIDLTSEWKSLFAKHNISLDTNLKEAILLQSNKTFYTDILHLMKLTLQMRNSVTGTDIDYMVSPVSNECGEFFDSRYAKDGLPVNADANGAYNIARKGLWLAQQIKNASNLSEVKLAITNKEWLRFAQSKPYLND

SEQ ID NO: 1690 - protein, 1227 aa, unidentified
  REGION 1..1227: note = Description of Unknown:uncultivated organism sequence
  REGION 1..1227: note = Category: MG75 effectors
  REGION 1..1227: note = Description: MG75-176 effector
MKNLYSDLHNLYGLSKTLRFELQPVGRTKENFENYILDSDEEKSEKFKKVKAYCDEVHKNFIKNCLEKIDLADIKPLLKRYYELFLINNRSEQEDKEFEKIQENLCKKISGNFKNNDLYKGLFEKDMIKKYLPEYFKNDKEKLKEISLFFDFTTYFTGYHKNRQNMYSEENKSTAISFRLIKQNLPTFIKNMQNFKKIQNVIPTIGKTLTSKLGINIEYLFSNVEVYAECLTQKAIDMYNCAIGGKTLDNGEKIQGINEFINLYNQQNPNKKLPKLKFLYKQILSDNTSVSFKIDKIEDDKELIDLINSYYEKLKPVIESIDKVSGETELVLAIKNLSNYDLSRIWINQDDLTNVSQQVYGDWSYITHLLEEEYNSQNPKGAKQSIEKYNEKRSKDLKKIKEYSFAHLNSLVAQNDDCAKNKLYTYFVENLLKIITDIKSSQLQCNEILTRNHEENNKTLLGDFSSISLIKDFLENMKKLQNLVKTFMPKTIGIETDDLFYNALNYEILSEIIPVYNKVRNYVTQKSYSVEKFPLTFHCPTLLDGWDLNKEESNLSILFEKDGFYYLGIMNKKDNKIFKNIQPTKENEEVYRKIEYKLLPGPNKMLPKVFFSESRITEFNPTNELLSKYKKGCHKKGIDFDINFCRDLIDFYKKSLSIHQDWSQFNFKFDDTNKYQDISKFYRQVEEQGYRISTTNISEKYIDSLVEDGKLFLFKIYNKDFSEYSKGTPNLHTLYWKALFDEDNLKNVVYKLNGGAEIFYRKKSIEYKITHPKNQLIKNKNELNDKKESIFDYDLIKNKRFTMDKFLFHVPITLNFKSKNLEYINELVNLKIKENNNINVIGIDRGERNLIYLTVVNSKGELLEQLSLNEIVNEYNDKTYRTNYHDLLNKKEQERNEARKSWGAIKNIKELKEGYMSQVIHKITDLMIKYNAIIVLEDLNSGFKNSRKKVEKQVYDKFETMVINKLSYFVDKKQGKFDEGGLLNAYQLVNKDSKGKQSGVLFYIPAWNTSKIDPVTGFVNLFCIKNMSIEKAKEFFNKFENIKYNKEENFFEFDFDYSKFSDKACGIRKDWTICTYGERIKTFRNPSKNNQWDNEEIKLTEKFKELFEKYSINLLNIKNGIQNQTEKKFFDSLIGLFKLTLQMRNSVTNTDIDYILSPIKDKNGNFYDSRKNIKTLPKDADANGAYNIARKGLMLIEQIKETENLSKLKLKSITNEQWLTYVQEKNR

SEQ ID NO: 1691 - protein, 1245 aa, unidentified
  REGION 1..1245: note = Description of Unknown:uncultivated organism sequence
  REGION 1..1245: note = Category: MG75 effectors
  REGION 1..1245: note = Description: MG75-177 effector
MAENRKIDNLQNLYPNTKTIVNKLIPQGATLRNFENNHLLENDTERKDNYQIVKKLIDEYHKFFIEQSLSNVTYIDGLDEYIDVYFNSSDDKNELDSLEDKLRKNIANLFTKSSKYSDMFKKEMITKLLPEFLEATNNLEYLDIVNSFAEFTTYFKGFFDNRKNMYTSEAQSTGIAYRCINDNLPKFLDNVKSFNRAKDKLSEKNLTDLNNDFEGLCGTTTENVFSADYYVFVLAQSGIDRYNEIIGGYTTSDGTKIKGVNEYINLYNQRCQNKSDRIPNMKPLFKQILSDRQTVSFIPDSFSDDNEVLKAVYSAYNDNDTELEYKSIKETVDKIKNLFIDFEEPQLNGIYIKNGLPVTDLSNGIFKNWSMIRNLWNDDYDSKHKPAKVKDIEKYEDKRSSQYRSNKSLSLGFLQELVNKSENDEIGSKSISEYYREKTLELTENIQRTYFKAESLLESKYDIKKKNLKSDEESIALIKDFLDSIKELEKLLKPLCGTGKEQDKNEVFYGEFIPLFNYLCNIDSLYNKVRNYVTQKPYSTEKIKLNFENPQFLKGWDRNKEKDYRSVLLIKDQEYYLGVMNKGDSKIFENLSFDGEKECYTKVVCKLLPGPNKMLPKVFFAKSNIDFFAPSDEIQTLYKAGTFTKGKSFNIDDCHKLIDFYKQSLYKHPDWSTFNFEFRETSLYNDISEFYNDIHNQGYKISFDSVPESYINELVNKGKLYLFKIYNKDFSKYSKGTPNLHTLYFKMLFDERNLKDVVYKLNGRAEMFYRPASIMENDIISHPANQPIKNKNPHSEKTHSTFEYDLIKDKRYTKAQFSLHIPITLNFKASGAGSINDKVNELLKNCDDNYVIGIDRGERHLLYLTVINGRGEVVEQYSLNTIINEYNNKTHKVDYHNLLSEKETKRKEARQNWTAIENIKELKEGYISQVVHKICELVVKYDAVICMEDLNAGFKQGRTKFEKQVYQKFEKMLIDKLNYFVDKKKAPEENGGLLKAYQLTNKFDSFKKMGRQNGIVFYVPAWLTSKIDPSTGFVDLLKPKYKSVEDSKNFFSRFDSIRYNSDEDWFEFEFDYDNFPRGSASFRKRWTVCTFGKRIRTYRNPEKNSEWDNEEIDITASFKELFNNYSIDYIRNNLKTEIQNQTQKDFFQKLIKLFALTVQMRNSITNTDIDYLISPVMDKNGNFYDSRNYDNDSKLPANADANGAYNIARKGLWAIEQIKNTDDGKRPKLAISNKEWLKLAQSADM

SEQ ID NO: 1692 - protein, 1274 aa, unidentified
  REGION 1..1274: note = Description of Unknown:uncultivated organism sequence
  REGION 1..1274: note = Category: MG75 effectors
  REGION 1..1274: note = Description: MG75-178 effector
MNNNLNKFTGLYQLSKTLRFELKPIGKTLDNIQNNGFIANDEHRAESYKLVKKLIDNYHKDYIESVLDNFELNKEVLYSLYELYTCTNKTEKETKQYEAAQDSLRKAISSALKKDERFKHIDKKELIREDMLNYLDNEQDKALVNEFHDFTTYFTGFNENRQNMYAAEAKSTAIAYRLIHENLPKFIDNIAIFKKIAETSVADNFPALYQHYEEYLNVNDIGEIFELDYYNIVLTQKQIEVYNNIIGGRTLSDDTKIKGINEYVNEYNQKQKDKKDRLPKLKPLFKQILSDRVQLSWLQEEFQTGADVLNAIKNYCDTYFADIHESIKALLTSLKEYDLSKIYIPNDLQLTDISQQMFGNWSIIPNAIEQDIKNNNPRKAKEDEEKYSQRIDKIKKQAKSYSLAYINACIKELNNADVATHFASLGAIDNNEKQKASITADIVVHYNQLKPLFGVEYPKEKNLSQDKLTVMQIKDLLDDFKSLQRFVKPLLGNGDEAEKDEKFYGELMQLWEVINNITHLYNKVRNYSTRKPYSTDKIKINFENAQLLDGWDENKEKTNASIILRKNGLYYLGIMKKEHRKLLDKPMPSSGECYEKVVYKFFKDITTMVPKCTTQTKAVATHFKDSGEDYILFDKKNFNEPIVITKEIYELNNVLYDGVKKFQIEYLRTTNDKKGYEHAVNIWKNFCMQFLKAYKSTSIYDLSSIEKNIGNYGDLNSFYSAVNLLLYSLTFRSVSVDYINMLVDEDKMYLFQIYNKDFSTFSKGTPNMHTLYWKMLFDPQNLANVVYKLNGQAEVFFRKKSITIAKPTHPANKPIDNKNPANGKKQSIFDYDLIKDRRYTVDKFQFHVPITINFKSNGSDNINMMVKEHIKTSDDMHYIGIDRGERHLLYLCVIDNKGNIVEQYSLNNIKNEHNGNNYDTDYRNLLQERDKKRQEERSSWQTIEGIKELKQGYLSQVIHKITQLMVKYNAIVVLEDLNMGFKRGRQKVESSVYQQFEKALIDKLNYLVDKKKAPTEPGGLLHAYQLTSKFDSFQKMGKQSGFLFYIPAWNTSKIDPVTGFANLFDSRDTRYENIAKAQAFFNKFDSIRYNEKKDWFELSFDYNNFTSKAEGTKSKWTICTQGTRIETFRNTEKNSNWDSKEIQLTDEWKKLFTEYSIPFKSNLKDAIAQQSNKDFYTKLLSLLKLTLQMRNSITGTDVDYMISPVANVKGEFFDSRNSNATLPENADANGAYNIARKGLWIAKQIKEAEDLSKVKLAMSNKDWLQFAQTKPYLV

SEQ ID NO: 1693 - protein, 1286 aa, unidentified
  REGION 1..1286: note = Description of Unknown:uncultivated organism sequence
  REGION 1..1286: note = Category: MG75 effectors
  REGION 1..1286: note = Description: MG75-179 effector
MNKSILSRFTNLYQVSKTLRFELQPVGKTKENIEENGILLRDEKRAADCKIVKEIIDEYHKQYIENRLKDFKLPLNSEGKHDSLEEYQALYEMSKRSEADEATFKEVKDNLRSIIAERLTNAPTYKCIFGKELIRKELVDFLEDENAKEIVSQFADFTTYFGGFHKNRENMYSGEEKSTAIAYRLIHQNLPRFMDNMKAFERIAATSVAEHFVDIFEGWEEYLNVGSIEEIFRLDYFSDALTQQHIEVYNYIIGKKVLEDGSEIKGINEYVNLYNQQQKDKKLRLPLLVPLYKQILSDREKLSWIAEEFDSDDKMLAAITETYSHLHDLLMGEENESLRSLLVHLKDFDLSRINITNDLSLTDISQHLFGRYDVFTSGIKDELRAITPRKRNETDEQLGDRISKIFKTQQSFSIAFLNTLSQPALEGGNPRKIEDYFMALGAVNTETTQKENLFAQIEYAYEDVRAVLQMKETDNMLSQNKQAVAKIKAFLDALKGLQHFVKPLLGSGEEEEKDELFYGSFQMMWDELDAITPLYNKVRNWLTRKPFSTEKIKLNFDNAQLLEGWDENKETTNASIILRKDGFYYLGIIRKDCRKLLGAPMPSDGECYDKVVYKFFKDITTMVPKCTTQKKDVVAHFAHSKEDYILFDKKTFNAPVTITKEVYDLNNVLYNGIKKFQIEYLRSTGDKVGYEHAVSTWKSFCMSFLKAYKSTSIYNLALVEQHINSYNDLSSFYNAVNLLLYSLTYRKVSVNFIHSLVDEGKLYLFRIWNKDFSEFSKGTPNLHTLYWKMLFDERNLADVVYKLNGQAEVFYRKSSIKPENRIIHLANKPIANKNELNRKHESTFKYDIIKDRRYTFDKFQFHVPITINFKANGREDINPAVQDCIRRGGFTHVIGIDRGERHLLYLSLIDMQGNIVKQMTLNEIINEYKGNTYKSNYHDLLAKREGERTEARRSWDTIENIKEMKEGYLSQVVHIISKMMVEYNAIVVLEDLNTGFMRSRQKIERQVYEKFEKMLIDKLNCYIDKRADMSDIAGLLHPLQLTCEAKKWKRSHQCGCLFYIPAWNTSKIDPVTGFVNLFDTRYDNMAKAKAFFGKFKSIRYNVSKDWFEFAFDYNNFTTMAEGTRTDWTVCTYGERILTFRNPDKNLQWDDKEVVLTGAFKQLFEKHDIDILDNLKEAICMQTDAQFFKDLLGLMKLLLQMRNSKTGSEVDYLLSPVADEQGNFFDSRKGNATLPDNADANGAYNIARKGLWAIHKIQETAENKKPSLAISNKEWLQFAQTKPYLAD

SEQ ID NO: 1694 - protein, 1236 aa, unidentified
  REGION 1..1236: note = Description of Unknown:uncultivated organism sequence
  REGION 1..1236: note = Category: MG75 effectors
  REGION 1..1236: note = Description: MG75-180 effector
MKQLSELTGLYSLSKTLRFELKPIGKTLEHIESKGLIAQDEQRAEEYKKVKDIIDRYHKKFITMCLSDFKFEQNSLETYVALAEDTNRDEKSFDEIKKTLRKQIVETFKKGGSYSDLFKKELIQKHLPEIVTDEEEKKMIANFSKFTTYFNGFNENRKNMYSDEDKSTAIAYRLIHENLPMFVDNMKSFSRIADSDVHQHFTEIESSFSEYLGVEHLEGMFQLDYFSETLTQEQIAVYNHIIGGRVLEDGTKLKGINEYVNLYNQQHKDSRLPLLKPLYKMILSDRVALPWFPSEEFASDEEMIGAINETYNTLKEVLSIDGDSSLRCLLLNISSYDIKHIYIANDLGLTDISQQMFGQYDVYTSAIKQELRTTNAPTAKERRTPELYDERINKLFKSAKSFSIEYLNSLVDSEHTIQNYYKHLGAYDRNGEQRVNLFTQIEMAYVAAKEILSGKHGNISQSDAETAIIKGLLDAFKSLQRFIKPLLGNGEEADKDNEFDAKLREAWNTLDIVTPLYNKVRNWLTRKPYSTEKIKLNFENAQLLGGWDVNKEPDCTSILLRKNGLYYLAIMNKKYNHAFDIDNLPNDGKCYEKIDYKLLPGANKMLPKVFFSKSRIKEFAPSEIIVNAYKKGSHKKGANFSISDCRRLIDFFKASISKHEDWKNFPFSFSSTETYEDISGFYREVEQQGYMLGFRNVSESFIKQLVDEGKLYLFQIWNKDFSDFSKGTPNMHTLYWKMLFDEHNLANVVYKLNGQAEVFYRKRSLDVANTTIHKAHQPIMNKNQENKKRQSTFDYDIIKNRRYTVDKFQFHVPISINFKATGRDNVNDNVLDIIRNGGIKHIIGIDRGERHLLYLSLIDLKGNIVKQMTLNDIVNEYNGNTYATNYKNLLAEREGNRTEARKNWKKIENIKDIKKGYLSQVVHIISKMMVEYNAIVVLEDLNMGFMRGRQKIERSVYEQFEKMLIDKLNYYVDKQKNSDEAGGLLHALQLTSKFESFKKLGKQSGCLFYIPAWNTSKIDPVTGFVNLFDTRYTNADQARKFFSQFDSIRYNADKDWFEFAFDYNKITAKAKDTRTKWTLCTYGTRIRTFRNPARLNQWDNEEVVLTDEFKKAFANADINIHGNLKEAICSLQDKKYLEPLMHLMKLLLQMRNSITNSEVDYLLSPVADENGTFYDSRVCSVSLPKDADANGAYNIARKGLWAIHQIQESPAGDRPNLAIKNKDWLNFAQQKPYMNE

SEQ ID NO: 1695 - protein, 1283 aa, unidentified
  REGION 1..1283: note = Description of Unknown:uncultivated organism sequence
  REGION 1..1283: note = Category: MG75 effectors
  REGION 1..1283: note = Description: MG75-181 effector
MKQFTNLYQVTKTPRFELQPIGRTKEHIERNGILQRDEQRAEDYKKVKQLIDDYHKQFIKDRLWNFQLPLANEGQRNSLEEYQELYELSKRDDAQEKIFTEIKDNLRSIIAKRLTERGSAYDRIFKKELIREDLIDFLEKEEDKDVVRQFADFTTYFTGFNENRMNMYSDEEKSTAIAYRLIHQNLPKFMDNMKSFAKILQTPVAEHFMDIYKGWEEYLNVENLEDVFKLSYFSETLTQPHIEVYNYIIGKKVLEDGTEIKGINEYVNLYNQQLKDKEQRLPLLVPLYKQILSDREKLSWMAEEFDSDEKMLAAINESYDHLHDLLVGDENESLRSLLIHLKDFDLTQINISNDLSITDISQHLFGQYDVFTKGIKEELKLITRRKKGETEEELDERVSKIFKTQKSFSIDLLNHLPQPVMDDGRPRKVEDYFMSLGAIDTETTQKENLFAQIENAYEAVRPILQLTGTSETLSQNKSAVAKIKTLLDAFKDLQHFIKPLLGSGEENEKDELFYGAFQMIWDELDTITPLYNKVRNWLTRKPYSIEKIKLNFDNAQLLDGWDENKETANAAIILRKDAMFYLGIMNKEDRKLLANPMPTDGDCYDKVVYKFFKDITTMVPKCTTQMKAVSEHFKQSSVDYILFDKKKYHEPVIITKEIYELNNVLYKGAKKFQIEYLRTTRDTAGYEHAVATWKKFCIQFLKAYISTSIYDLSSVEQNIDNYHDLNSFYGAVNLLLYNLSYKKVSVNYINKLVDEGKLFLFRIWNKDFSEYSKGTPNLHTLYWRMLFDKRNLADVVYKLNGQAEVFYRKSSIKDENRIVHPAHKAIDNKNALNKKQTSTFEYDIIKDRRYTVDKFQFHVPITINFKAMGRTNINPIVQETIRRGGFTHVIGIDRGERHLLYLSLIDLHGNIVKQMTLNEIINEYNGQEHKTNYHSLLVRREGERTAARRSWDTIESIKELKEGYLSQVIHIISKLMVEYNAIVVLEDLNMGFMRGRQKIERQVYEKFEKMLIDKLNCYIDKQADPQSIGGLLHPIQLANKFESFRKLGKQCGCLFYIPAWNTSKIDPVTGFVNLFDTRYETREKARLFFSRFQRIKFNKDKDWFEFTFDYNDFTTKAEGTCTLWTLCSYGTRIRNFRNPLLNNQWDDEEIVLTDEFKQLFDKYGLDLQGNLKESINAQTDAQFFKELMGLMKLLLQMRNSKTNSEVDYLLSPVADGNNHFFDSRDGKLNLPDNADANGAYNIARKGLWVIRRIQETPEGEKLSLAISNKEWLQFAQTKPYLRD

SEQ ID NO: 1696 - protein, 1239 aa, unidentified
  REGION 1..1239: note = Description of Unknown:uncultivated organism sequence
  REGION 1..1239: note = Category: MG75 effectors
  REGION 1..1239: note = Description: MG75-182 effector
MEEFNQFTGLYPLSKTLRFELKPVGKTLENIVKHGLLEEDKHRADSYEKVKKIIDEYHKVFIDNALTDFKLKNGESKKNETLDQYFALYNKREKDENDKKDFSEIQKSLRKQIVDSLTGNEKYKNIFKKELIKQDLLEFCNEDDRKYVEEFKDFTTYFNGFNENRANMYSAEEQSTAIAYRLIHDNLPKFVDNINTFSKVLAVPEINEKLPKLYKDFESYLNVESISEMFQLDYFNMVLTQKQIDVYNAIIGGKDDGNEKIQGLNEFINLYNQKHKDTRLPKLKVLYKQILSDRNAISWLPEEFKDDNEVLIAINSCYKDLYEHVLGEKNLKILLENISQYQLDGIFIKNDLQLPNISQKLLGNWSVIQNAIIEDSKSFIKKKGKESENEYESRLNEIYKKQNSFSVAYINECLKNAGKEIGVENYFSALGAVNTETEQRENLFARISNAYSIVSDLLNAQYPEGRNLSQDKQNVAKIKDLLDALKALQHFIKPLLGNGDESGKDEKFYGEFTALWDELNKITSLYNMVRNYMTRKPYSEEKIKLNFQNSTLMDGWDYNKERDNTAVILRKDGLYYLGIMNKKYNKIFEPENVKHDGECFEKMIYKLLPGANKMLPKVFFSKSRIDEFKPSKEIVENYKNDTHKKGEKFNIEDCHRLIDFFKSSIEKHSDWSKFNFKFSDTSKYADLSGFYREVEHQGYKVTFVNISKDYVNSLVDEGKLYLFQIYNKDFSPYSKGTPNMHTLYWKMLFDERNLENVVYKLNGQAEIFYRKKSINYDRPTHPAHQPINNKNIQNKKKESLFSYDLIKNRRYTVDKFFFHVPITINFKGVDSENINDQVRRYLQKAKDTHVIGIDRGERNLLYLVVVDNKGNIVEQYSLNNIVNEYKGNTYSTDYHALLDAKEKERELARESWQTIENIKELKEGYLSQVIHKITELMIKYHAIVVLEDLNMGFKRGRQKVEKQVYQKFEKQLIDKLNYVVDKHKAPEADGGLLHAYQLTSKFDSFQKLGKQSGFLFYIPAWNTSKIDPVTGFVNLFDTRYVNIEKAKAFFCKFDIIRYNQDKGWFEFDFDYKNFTSKADESRTKWTLCTFGTRVETFRNKEKNSQWDNRNVDLTKAFKELFSKYNIDLSSNIKEAICIQTEKDFFESLLHLLKLTLQMRNSVTGTEIDYIISPVANENGEFFDSRACSDKLPKDADANGAYNIARKGLMLIEQIKKAKDLQKLKFDISNKSWLQYVQNN

SEQ ID NO: 1697 - protein, 1274 aa, unidentified
  REGION 1..1274: note = Description of Unknown:uncultivated organism sequence
  REGION 1..1274: note = Category: MG75 effectors
  REGION 1..1274: note = Description: MG75-183 effector
MNNNLNKFTGLYQLSKTLRFELKPIGKTLDNIQNNGFIANDEHRAESYKQVKKLIDNYHKDYIESVLDNFELNKEVLYSLYELYTCTNKTEKETKQYEAAQDSLRKAISSALKKDERFKRIDKKELIREDMLNYLDNEQDKALVNEFHDFTTYFTGFNENRQNMYAAEAKSTAIAYRLIHENLPKFIDNIAIFKKIAETSVADNFPALYQHYEEYLNVNDIGEIFELDYYNIVLTQKQIEVYNNIIGGRTLSDDTKIKGINEYVNEYNQKQKDKKDRLPKLKPLFKQILSDRVQLSWLQEEFQTGADVLNAIKNYCDTYFADIHESIKALLTSLKEYDLSKIYIPNDLQLTDISQQMFGNWSIIPNAIEQDIKNNNPRKAKEDEEKYSQRIDKIKKQAKSYSLAYINACIKELNNADVATHFASLGAIDNNEKQKASITADIVVHYNQLKPLFGVEYPKEKNLSQDKLTIMQIKDLLDDFKSLQRFVKPLLGNGDEAEKDEKFYGELMQLWEVINNITHLYNKVRNYSTRKPYSTDKIKVNFENAQLLDGWDENKENTNASIILRKNGLYYLGIMKKEHRKLLDKPMPSSGECYEKVVYKFFKDITTMVPKCTTQTKAVATHFKDSGEDYILFDKKNFNEPIVITKEIYELNNVLYDGVKKFQIEYLRTTNDKKGYEHAVNIWKNFCMQFLKAYKSTSIYDLSSIEKNIGNYGDLNSFYSAVNLLLYSLTFRSVSVDYINMLVDEDKMYLFQIYNKDFSTFSKCTPNMHTLYWKMLFDPQNLANVVYKLNGQAEVFFRKKSITIAKPTHPANKPIDNKNPANGKKQSLFDYDLIKDRRYTVDKFQFHVPITINFKSNGSDNINMMVKEHIKTSDDMHYIGIDRGERHLLYLCVIDSKGNIVEQYSLNNIKNEHNGNNYDTDYRNLLQERDKKRKEERSSWQTIEGIKELKQGYLSQVIHKITQLMVKYNAIVVLEDLNMGFKRGRQKVESSVYQQFEKALIDKLNYLVDKKKAPTEPGGLLHAYQLTSKFDSFQKMGKQSGFLFYIPAWNTSKIDPVTGFANLFDSRDTRYENIAKAQAFFNKFDSIRYNEKKDWFELSFDYNNFTSKAEGTQTKWTICTQGTRIETFRNTEKNSNWDSKEVQLTDEWKKLFTEYSIPFKSNLKDAIAQQSNKDFYTKLLSLLKLTLQMRNSITGTDVDYMISPVANVKGEFFDSRNSNATLPENADANGAYNIARKGLWISKQIKEAEDLSKVKLAMSNKDWLQFAQTKPYLE

SEQ ID NO: 1698 - protein, 1274 aa, unidentified
  REGION 1..1274: note = Description of Unknown:uncultivated organism sequence
  REGION 1..1274: note = Category: MG75 effectors
  REGION 1..1274: note = Description: MG75-184 effector
MNNNLNKFTGLYQLSKTLRFELKPIGKTLDNIQNNGFIANDEHRAESYKQVKKLIDNYHKDYIESVLDNFELNKEVLYSLYELYTCTNKTEKETKQYEAAQDSLRKAISSALKKDERFKRIDKKELIREDMLNYLDNEQDKALVNEFHDFTTYFTGFNENRQNMYAAEAKSTAIAYRLIHENLPKFIDNIAIFKKIAETSVADNFPALYQHYEEYLNVNDIGEIFELDYYNIVLTQKQIEVYNNIIGGRTLSDDTKIKGINEYVNEYNQKQKDKKDRLPKLKPLFKQILSDRVQLSWLQEEFQTGADVLNAIKNYCDTYFADIHESIKALLTSLKEYDLSKIYIPNDLQLTDISQQMFGNWSIIPNAIEQDIKNNNPRKAKEDEEKYSQRIDKIKKQAKSYSLTYINACIKELNNADVATHFASLGAIDNSEKQKASITADIVVHYNQLKPLFSVDYPKEKNLSQDKLTVMQIKDLLDDFKSLQRFVKPLLGNGDEAEKDEKFYGELMQLWEVINNITHLYNKVRNYSTRKPYSTDKIKVNFENAQLLDGWDENKENTNASIILRKNGLYYLGIMKKEHRKLLDKPMPSSGECYEKVVYKFFKDITTMVPKCTTQTKAVATHFRDSDEDYILFDKKNFNEPIVITKEIYELNNVLYDGVKKFQIEYLRTTNDKKGYEHAVNIWKNFCMQFLKAYKSTSIYDLSSIEKNIGNYGDLNSFYSAVNLLLYSLTFRSVSVDYINMLVDEDKMYLFQIYNKDFSTFSKGTPNMHTLYWKMLFDPQNLANVVYKLNGQAEVFFRKKSITIAKPTHPANKPIDNKNPANGKKQSLFDYDLIKDRRYTVDKFQFHVPITINFKSNGSDNINMMVKEHIKTSDDMHYIGIDRGERHLLYLCVIDSKGNIVEQYSLNNIKNEHNGNNYDTDYRNLLQERDKKRQEERSSWQTIEGIKELKQGYLSQVIHKITQLMVKYNAIVVLEDLNMGFKRGRQKVESSVYQQFEKALIDKLNYLVDKKKAPTEPGGLLHAYQLTSKFDSFQKMGKQSGFLFYIPAWNTSKIDPVTGFANLFDSRDTRYENIAKAQAFFNKFDSIRYNEKKDWFELSFDFNNFTSKAEGTKTKWTICTQGTRIETFRNAEKNSNWDSKEVQLTDEWKKLFTEYSIPFKSNLKDAIAQQSNKDFYTKLLSLLKLTLQMRNSIIGTDVDYMISPVANAKGEFFDSRNSNATLPENADANGAYNIARKGLWIAKQIKESEDISKVKLAMSNKEWLQFAQTKSYLE

SEQ ID NO: 1699 - protein, 1298 aa, unidentified
  REGION 1..1298: note = Description of Unknown:uncultivated organism sequence
  REGION 1..1298: note = Category: MG75 effectors
  REGION 1..1298: note = Description: MG75-185 effector
MNKSILSRFTNLYQVSKTLRFELQPVGKTKENIEENGILLRDEKRAADCKIVKEIIDEYHKQYIENRLKDFKLPLNSEGKHDSLEEYQALYEMSKRSEADEAAFKEVKDNLRSIIAERLTNAPTYKCIFGKELIRKELVDFLENENTKEIVEFLENEKAKEIVSQFADFTTYFGGFHKNRENMYSGEEKSTAIAYRLIHQNLPRFMDNMKAFERIAATSVAEHFVDIFEGWEEYLNVGSIAEIFRLDYFSDALTQQHIEVYNYIIGKKVLEDGSEIKGINEYVNLYNQQQKDKKLRLPLLVPLYKQILSDREKLSWIAEEFDSDDKMLAAITETYSHLHDLLMGEENESLRSLLVHLKDFDLSRINITNDLSLTDISQHLFGRYDVFTSGIKDELRAITPRKRNETDEQLGDRISKIFKTQQSFSIAFLNTLSQPALEGGNPRKIEDYFMALGAVNTETTQKENLFAQIENAYEDVRAVLQMKETDNMLSQNKQAVAKIKAFLDALKELQHFVKPLLGSGEEDEKDELFYGSFQMMWDELDAITPLYNKVRNWLTRKPFSTEKIKLNFDNAQLLEGWDENKETTNASIILRKDGFYYLGIIRKDCRKLLGAPMPSDGECYDKVVYKFFKDITTMVPKCTTQKKDVVAHFAHSKEDYILFDKKTFNAPVTITKEVYDLNNVLYNGIKKFQIEYLRSTGDKVGYEHAVSTWKSFCMSFLKAYKSTSIYNLALVEQHINSYNDLSSFYNAVNLLLYSLTYRKVSVNFIHSLVDEGKLYLFRIWNKDFSEFSKGTPNLHTLYWKMLFDERNLADVVYKLNGQAEVFYRKSSIKPENRIIHLANKPIANKNELNRKHESTFKYDIIKDRRYTFDKFQFHVPITINFKANGREDINPAVQDCIRRGGFTHVIGIDRGERHLLYLSLIDMQGNIVKQMTLNEIINEYKGNTYKSNYHDLLAKREGERTEARRSWDTIENIKEMKEGYLSQVVHIISKMMVEYNAIVVLEDLNTGFMRSRQKIERQVYEKFEKMLIDKLNCYIDKRADMSDIAGLLHPLQLTCEAKKWKRSHQCGCLFYIPAWNTSKIDPVTGFVNLFDTRYDNMAKAKAFFGKFKSIRYNVSKDWFEFAFDYNNFTTMAEGTRTDWTVCTYGERILTFRNPDKNLQWDDKEVVLTGAFKQLFEKHDIDILDNLKEAICMQTDAQFFKDLLGLMKLLLQMRNSKTGSEVDYLLSPVADEQGNFFDSRKGNATLPDNADANGAYNIARKGLWAIHKIQETAENKKPSLAISNKEWLQFAQTKPYLAD

SEQ ID NO: 1700 - protein, 1064 aa, unidentified
  REGION 1..1064: note = Description of Unknown:uncultivated organism sequence
  REGION 1..1064: note = Category: MG75 effectors
  REGION 1..1064: note = Description: MG75-186 effector
MYSEEEKPTGIAYRLINENLPTFIENFKIYNKVIKFMPEIINKIHTDLMEYIQVEDIDEIFDINYYNEVLTQKGIECYNIIISGKSKSNGEKIKGLNEYINEFNQKHNEKIPKLQELYKQILSDTDTASFKFDTIESDEELLNNIESYYTKLLPVFNKINQLFAKFNKYNLDLIFINNDGTLNTISNEIYKDWSYIRNRIGERYDIEYTGKLKKDTEQYSKQKQEYMKKQKQYSLKFLNDSLRDNYLIEYISNYIEQSKIMERMKTDFTEVQKIESRGDTKQLIKDENSIVKIKNLLDDIKFLQEFVKILVLKDRTIEKDAEFYSELMPYYNELKDIIPLYNKTRNYLTQKPYSTEKIKLNFECPTLLNGWDLNKEEANLGVILLKNEKYYLGIINPYCKKIFKIQEKDSNSENNYKKMEYKLLPGPNKMLPKVFFSKSKIDEFMPSDELLEKYNKGCHKKGKDFDINFCHELIDFYKTSLNKHKDWKKFDFKFKSTSEYNDISEFYKDVEEQGYKIEYSEYSEKYINELVDRGELYLFQIYNKDFSEYSKGRPNLHTMYWKAVFDIENIKNPVYKLNGEAEIFYRKKSLERKITHSANEPVANKNENTIKSGKPTSLFKYDLIKDKRYTVDKFQFHVPITMNFKSEKMFNINQVVNKYLKYNDDINVIGIDRGERNLLYVCVIDKNEKIVYQKSLNEIVNEYKSIKYSTNYHALLNKKEKEREIAREDWKNIENIKELKEGYMSQVIHILVELMRKYNAIIVIEDLNKGFKNSRIKVEKQVYQKFEKMFIDKLNYLVFKDEPKESEGGVLNAYQLTNKFETFNKIGKQSGVLYYIPAWCTSKIDPTTGFINRFYIKYENLDKSKEFINKIDDIRYNSSENLFEFDIDYSKFTDRLNETRNKWTLYTNGERIYTYRNDKGEWIDKKIQLTNEFKKLFEKYSINLDNIKNEILEKANIEFFKGNNETLGFIQLFKLMVQMRNSLTGKEEDNLISPVKNSNGKFFNTNEQIEGLPKDADANGAYNIARKGLMLIEQVRNTEDDKLNKIKYNITEKEWLDYVQNRGM

SEQ ID NO: 1701 - protein, 1287 aa, unidentified
  REGION 1..1287: note = Description of Unknown:uncultivated organism sequence
  REGION 1..1287: note = Category: MG75 effectors
  REGION 1..1287: note = Description: MG75-187 effector
MEKGMKQFTGLYSLSKSLRFELQPIGKTQENIEKHGILERDSQRAEDYKVVKEFIDEYHKQFIKSRLWNYKLPLKNEGQLNSLEEYQEMYEISKRDAAQEASFAQIKYNLRSIIVKRLTESSSSYSRIFKKELIREDLINFLEKEEDQEIVRQFADFTTYFTGFHENRRNMYTAEEKSTAIAYRLIHQNLPKFMDNMKSFAKIAETSVAEHFADIYEGWKEYLNVDSIEEIFQLDYFSETMTQPHIEVYNYIIGKKILEDGTEIKGINEYVNLYNQQQKDKNKRLPFLVPLYKQILSDREKLSWLTEEFDSDEKMLSAINESYSHLHDLLMGEENESLRSLLSHIKNFNLCQINISNDLSLTDISQHLFNRYDVFTNGIKDKLRVITPRKKKESDEDFEDRISKIFKTQKSFSISFLDNLPQPVMDDGKPQSIEDYFMSLGAVNTETTQKENLFAQIENAYEDARTILQMKDTGDTLSQNKSAVVKIKALLDALKDLQHFIKPLLGSGEENEKDELFYGSFQIMWDELDTVTPLYNKVRNWLTRKPYSTEKIKLNFDNAQLLDGWDENKETTNASIILCKNGGYYLGIFNKDYRKLLGTPMPSDGDCYDKVVYKFFKDITTMVPKCTTQKKDVVAHFAQSTENYILFDPKTFKASVTITKEIFDLNNVLYNGVKKFQIEYLRSTGDQSGYEHAVTTWKSFCMQFLKAYKSTSIYNLALVEQQIDSYRDLNSFYNAVNLLLYNLSYKKVSVAYINQLVEEGKLYLFRIWNKDFSEYSKGTPNLHTLYWKMLFDERNLADVVYKLNGQAEVFYRKASIKPENRILHPAQCPIANKNELNEKRSSIFEYDIIKDKRYTVDKFQFHVPITINFKATGQTNINPIVQDTIRRGGFSHIIGIDRGERHLLYLSLIDLKGNIVKQMTLNDIVNEYKGTIHKTNYHDLLVKREGERTDARRSWDTIENIKELKEGYLSQVVHIISKMMVEYNAIIVLEDLNMGFMRGRQKIERQVYEKFEKLLIDKLNCYVDKQIDPSSAGGLLHPFQLTNKFESFRKLGKQSGCLFYIPAWNTSKIDPVTGFVNLFDTRYDTPKKARSFFSKFQRISFNDKKGWFEFSYDYDDFTSKAEGTRTQWTLCTFGDRIRTFRNPKKNHQWDNESVVLTEEFKQLFEKYGIDIHSNLKESISMQSDAQFFKDLLGLMKLLLQMRNSKTNSEEDYLLSPVADETGHFFDSRENIRTLPNNADANGAYNIARKGLWAIRKIKETTQDDKVSLAISNKEWLQFAQTRPYLND

SEQ ID NO: 1702 - protein, 1235 aa, unidentified
  REGION 1..1235: note = Description of Unknown:uncultivated organism sequence
  REGION 1..1235: note = Category: MG75 effectors
  REGION 1..1235: note = Description: MG75-188 effector
MKQLNELTGLYSLSKTLRFELKPIGKTLEHIESKGLIAQDEQRAEEYKKVKDIIDRYHKAFITMCLRDFNFDQNSLETYVALAEDSNRDEKDFDEIKKALRKQIVEAFKKGGSYSDLFKKELIQKHLPEFVKDEEEKKMVENFSKFTTYFSGFNENRKNMYSDEDKSTAIAYRLIHENLPMFIDNMKSFGKIAVSDVSQHFSEIESSFSEYLNVEHLADMFQLDYFSETLTQEQIAVYNHIVGGRTLEDGTKLQGVNEYVNLYNQQHKDNRLPLLKPLYKMILSDRVALSWLPEEFASDEEMINAINETYNTLKDVLMGNGDNSLRNLLLNIDKYDVEHIYIGNDLGLTDISQQLFGQYDVYTSAIKQELRNSVSPTAKERREPELYAERINKLFKSAKSFSILYLNSLVDSEHTIQSYYKQLGAYDRGGEQRINLFSQIEMAYVAAKDILSGKHGNISQSDADTAIIKNLLDAYKSLQRFIKPLLGDGEEADKDNEFDAKLREAWDALDIVTPLYNKVRNWLTRKPYSTEKIKLNFENAQLLGGWDVNKEPDCTSVLLRKNGFYYLAIMNKKYNHAFDIDNLPHNGKCYEKIDYKLLPGANKMLPKVFFSNSRIKEFAPSDAIVSAYRKGTHKKGSNFNISDCRRLIDFFKASIMKHEDWKKFPFSFSPTETYEDISGFYREVEQQGYMLGFRNVSESFINQLIDEGKLYLFQIWNKDFSEFSKGTPNMHTLYWKMLFDERNLANVVYKLNGQAEVFYRKRSLDVANTTIHKAHQPIVNKNQENKKLQSTFEYDIIKNRRYTVDKFQFHVPISINFKAIGRDNVNDNVLDIIRNGGIKHIIGVDRGERHLLYLSLIDLNGNIVKQMTLNDIVNEYNGNTYATNYRDLLAEREGNRTEARKNWKEIENIKDIKQGYLSQVVHIISKMMVEYDAIVVLEDLNMGFMRGRQKIERSVYEQFEKMLIDKLNYYVDKQKSVNEAGGLLHALQMTSKFESFKKLGKQSGCLFYIPAWNTSKIDPVTGFVNLFDTRYTNADQARRFFSQFDVIRYNADKDWFEFAFDYNNFTAKAEGTRTKWTLCSYGTRIRTFRNPAKLNQWDNEEVVLTDEFKKAFANAGIDIHGNLKEAISSLQDKKYLEPLMHLMKLLLQMRNSITNSEVDYLLSPVADENGKFYDSRTCSDSLPKDADANGAYNIARKGLWAIRQIQETPAGERPNLAIKNKEWLNFAQQKPYKDE

SEQ ID NO: 1703 - protein, 1245 aa, unidentified
  REGION 1..1245: note = Description of Unknown:uncultivated organism sequence
  REGION 1..1245: note = Category: MG75 effectors
  REGION 1..1245: note = Description: MG75-189 effector
MTLIIKYKESKNKREVYMSNLYSNLHNLYQVQKTLRFELKPQGKTKENMEKVGILEADEHRAEIYSKVKKYCDEYHKLFIDKSLSNIELNGIDRYYELYSINNRDDKQKEELDQLETGLRKQISDAFKKSAEYKGLFQKDMITSYLVTMYKENQEKMQDIGEFNRFTTYFTGYNKNRENMYSEEDKSTAISYRLINENLPTFIDNIKIYKKIVSLMPEDIEKIYKDLEEYIQVDSIDEIFNISYYNDVLTQRGIECYNILISGRTKNDGDKIKGLNEYINEFNQTHNEKIPKLQELYKQILSDAESASFKIDVIKNDKELMNLIEVYYANILPILNKIEDLFTRISNYNLELILVNNDGTLSTLSNMVFNEWSYIKGAISEKYDEKYSGKEKYGTEKYAQKKQEYLKKQKIYSLKFLNDCIGNNAICEYLKNYIIQNKNIETIKEDYNEVQNIKVEDDTKELIKDEKSIEKIKKFLDDVKSLQEFVKLVIPKDRTVEKDAKFYSELTPYYEKIKEIIPLYNKVRNYVTQKPYSTEKIKLNFECPTLLNGWDANKEEANLGVILIKEGKYYLGIINPYCKKIFEIDEKDSNEQKNYKKMEYKLLPGPNKMLPKVFFSNSRIEEFNPSKELQEKYNKGYHKKGKDFDINFCHELIDFYKMSLNKHEDWKKFNFKFKDTSEYNDISEFYREVEKQGYKIEYTEYSEKYINELVDRGELYLFQIYNKDFSEYSKGKENLHTLYWKAVFDPDNIMNPVYKLNGNAEVFYRKKSLEMKVIHPANQPIANKNISTIEAGRSTSTFKYDLIKDKRYTMDKFQFHVPITVNFKSERLFNINQIVNKYLKYNDDIHVIGIDRGERNLLYVCVIDKNEKIVYQKSLNEIVSEYNNNRYTTDYHGLLDRKEKEREIAREDWKNIENIKELKEGYMSQVIHILVELMKKYNAIIVIEDLNKGFKNSRIKVEKQVYQKFEKMFIDKLNYLVFKDEDKMNEGGVLNAYQLTNKFESFTKLGKQSGILYYIPAWCTSKIDPTTGFINRFYLKYENFDKSKEFVNRIDDIRYNEKENLFEFDIDYSKFTDRLNDTKNKWTLCSYGERILTQKNANGEWFDRRIQLSIEFKKLFERYGINLNNIKDSILKLDKDNLEFYKGNGESLGFIQLFKLMVQMRNSLTGKEEDNLISPVKNRHGKFFNTSEKIEGLPIDADANGAYNIARKGFMLVEQMKNVEDEKLNKIKYNITEKEWLNYVQNRGM

SEQ ID NO: 1704 - protein, 1239 aa, unidentified
  REGION 1..1239: note = Description of Unknown:uncultivated organism sequence
  REGION 1..1239: note = Category: MG75 effectors
  REGION 1..1239: note = Description: MG75-190 effector
MEEFNQFTGLYPLSKTLRFELKPVGKTLENIVKHGLLEEDKHRADSYEKVKKIIDEYHKVFIDNALSDFKLKNGESKKNETLDQYFALYNKREKDENDKKDFSEIQKSLRKQIVDRLTGNEKYKNIFKKELIKQDLLEFCNEDDRKYVEEFKDFTTYFNGFNENRANMYSAEEQSTAIAYRLIHDNLPKFVDNINSFNKVLAVPEINEKLPKLYKDFESYLNVESISEMFQLDYFNMVLTQKQIDVYNAIIGGKDDGNEKIQGLNEFINLYNQKHKDTRLPKLKVLYKQILSDRNAISWLPEEFKDDNEVLIAINSCYKDLSEHVLGEKNLKILLENISQYQLDGIFIKNDFQLPYISQKLLGNWSVIQNAIIEDSKSFIKKKGKESENEYESRLNEKYKKQNSFSVAYINECLKNAGKEIGVENYFSALGAVHTETEQRENLFARISNAYSIVSDLLNAQYPEGRNLSQDKQNVSKIKDLLDALKALQHFIKPLLGNGDESGKDEKFYGEFTALWDELNKITSLYNMVRNYVTRKPYSEEKIKLNFQNSTLMDGWDYNKERDNTAVILRKDGLYYLGIMNKKYNKIFEPENVKHDGECFEKMIYKLLPGANKMLPKVFFSKSRIDEFKPSKEIVENYKNDTHKKGEKFNIEDCHRLIDFFKSSIEKHSDWSKFDFKFSDTSKYADLSGFYREVEHQGYKVTFVNISKDYVNSLVDEGKLYLFQIYNKDFSPYSKGTPNMHTLYWKMLFDERNLENVVYKLNGQAEIFYRKKSINYDRPTHPAHQPINNKNIQNKKKESLFSYDLIKNRRYTVDKFFFHVPITINFKGVDSENINDQVRRYLQKAKDTHVIGIDRGERNLLYLVVVDNKGNIVEQYSLNNIVNEYKGNTYSTDYHALLDAKEKERELARESWQTIENIKELKEGYLSQVIHKITELMIKYHAIVVLEDLNMGFKRGRQKVEKQVYQKFEKQLIDKLNYVVDKHKAPEADGGLLHAYQLTSKFDSFQKLGKQSGFLFYIPAWNTSKIDPVTGFVNLFDTRYVNIEKAKAFFCKFDIIRYNQDKEWFEFGFDYKNFTSKADESRTKWTLCTFGTRVETFRNKEKNSQWDNRNVDLTKAFKELFSKYNIDLSSNIKEAICIQTEKDFFESLLHLLKLTLQMRNSVTGTEIDYIISPVANGNGEFFDSRTCSDKLPKDADANGAYNIARKGLMLIEQIKKSKDLKKLKFDISNKSWLQYVQNN

SEQ ID NO: 1705 - protein, 1150 aa, unidentified
  REGION 1..1150: note = Description of Unknown:uncultivated organism sequence
  REGION 1..1150: note = Category: MG75 effectors
  REGION 1..1150: note = Description: MG75-191 effector
MLNFLVKKEDRDIVQQFADFTTYFTGFHENRRNMYSSEEKSTAIAYRLIHQNLPKFMENMKAFATIAQTSIAEHFADIYAGWEEYLNVGSIEEMFNLDYFSHTLTQTGIEVYNYIIGKKILEDGTEIKGINEYVNLYNQQQKDKKQRLPLLIPLYKQILSDREKLSWISEEFDSDEKMLAAINGLYIHLHDLLMGKENESLRSLLIYLKDFNLEHIYITNDQSLTNISQHLFKQYDVYTQGILNHLRVNTPRKKKETDEDFEKRISQILKSKKSFSIAFLDHLPHPITEEGKPKSIEDYFQALGAVDSETIQKENIFAQIENAYENVYEVLQLKETGNSLSQDKSAVAKIKVLLDAFKELQHFIKPLLGSGEENEKDELFYGTFQMMWDELEAITPLYNKVRNWMTRKPYSTEKIKLNFDNAQLLDGWDENKETTNASIILRKGSYFFLGIMNKNYRQLLDKPMPSDGDCFDKVVYKFFKDITTMVPKCTTQMKSVAEHFKHSSEDYILFDKKKYNTPVVITKEIYELNNVTYNGTKKFQIEYLRSTGDSEGYQHALTVWKAFCLKFLKAYISTSVYDLTLIEQNINSYKNLSTFYNAVNLLLYNISYKRVSTEYINTLVDEGKLYLFRIWNKDFSEFSKGTPNLHTLYWRMLFDERNLADVVYKLNGQAEVFYRKASIKPENLIIHPANQAIANKNILNRKKTSTFEYDIIKNRRYTVDKFQFHVPITINFKAIGQKNINPIVQETIRNNGFTHVIGIDRGERHLLYLSLIDLKGNIIKQMTLNEIINEYNGQCFVTNYHNLLVAREGDRTKSRKSWDTIETIKELKEGYLSQVVHIISKMMIEYKAIVVLEDLNVGFMRGRQKIERQVYEKFEKMLIEKLNCYVDKQADPASEGGLLHPLQLVNESKSFQKHGKQCGCLFYVRAWNTSKIDPTTGFVNLFDTRYETREKARVFFSKFKRISFNKEKDWFEFSFDYNDFTTKADGTRTQWTLCTNGTRIRTFRNPLKNNQWDDEEIILTDQFKELFSKYQIEITGNLKDSINRQSEAAFYKDLMSLMKLLLQMRNSKTNSEVDYLFSPVADEQGVFYDSRNCGANLPNNADANGAYNIARKGLWVIRKIQSTSIDEKISLAITDKDWLNFVQNKSYLID

SEQ ID NO: 1706 - protein, 1239 aa, unidentified
  REGION 1..1239: note = Description of Unknown:uncultivated organism sequence
  REGION 1..1239: note = Category: MG75 effectors
  REGION 1..1239: note = Description: MG75-192 effector
MEEFNQFTGLYPLSKTLRFELKPVGKTLENIVKHGLLEEDKHRADSYDKVKRIIDEYHKAFIDNALSDFKLKNGESKKYETLDQYFALYNKREKDENDKKDFSEIQKSLRKQIVDRLTGSEKYKNIFKKELIKHDLLKFCNEDDRKYVEEFKDFTTYFNGFNENRANMYSAEEQSTAIAYRLIHDNLPKFVDNINSFNKVLAVPEINEKLPKLYKDFESYLNVESISEMFQLDYFNMVLTQKQIDVYNAIIGGKDDGNEKIQGLNEFINLYNQKHKDTRLPKLKVLYKQILSDRNAISWLPEEFKDDNEVLIAINSCYKDLSEHVLGEKNLKILLENISQYQLDGIFIKNDFQLPYISQKLLGNWSVIQNAIIEDSKSFIKKKGKESENEYESRLNEIYKKQNSFSVAYINECLKNAGKEIGVENYFSALGAVHTETEQRENLFARISNAYSIVSDLLNVQYPEGRNLSQDKQNVSKIKDLLDALKALQHFIKPLLGNGDESGKDEKFYGEFTALWDELNKITSLYNMVRNYMTRKPYSEEKIKLNFQNSTLMDGWDYNKERDNTAVILRKDGLYYLGIMNKKYNKIFEPENVKHDGECFEKMIYKLLPGANKMLPKVFFSKSRIDEFKPSKEIVENYKNDTHKKGEKFNIEDCHRLIDFFKSSIEKHSDWSKFNFKFSDTSKYADLSGFYREVEHQGYKVTFVNISKDYVNSLVDEGKLYLFQIYNKDFSPYSKGTPNMHTLYWKMLFDERNLENVVYKLNGQAEIFYRKKSINYDRPTHPAHQPINNKNIQNKKKESLFSYDLIKNRRYTVDKFFFHVPITINFKGVDSENINDQVRRYLQKAKDTHVIGIDRGERNLLYLVVVDNKGNIVEQYSLNNIVNEYKGNTYSTDYHALLDAKEKERELARESWQTIENIKELKEGYLSQVIHKITELMIKYHAIVVLEDLNMGFKRGRQKVEKQVYQKFEKQLIDKLNYVVDKHKAPESDGGLLHAYQLTSKFDSFQKLGKQSGFLFYIPAWNTSKIDPVTGFVNLFDTRYVNIEKAKAFFCKFDIIRYNQDKGWFEFGFDYKNFTSKADESRTKWTLCTFGTRVETFRNKEKNSQWDNRNVDLTRAFKELFSKYNIDLTSNIKEAICIQTEKDFFESLLHLLKLTLQMRNSVTGTEIDYIISPVANENGEFFDSRTCSEKLPKDADANGAYNIARKGLMLIEQIKKAKDLQKLKFDISNKSWLQYVQNN

SEQ ID NO: 1707 - protein, 1236 aa, unidentified
  REGION 1..1236: note = Description of Unknown:uncultivated organism sequence
  REGION 1..1236: note = Category: MG75 effectors
  REGION 1..1236: note = Description: MG75-193 effector
MKQLSELTGLYSLSKTLRFELKPIGKTLEHIESKGLIAQDEQRAEEYKKVKDIIDRYHKKFITMCLSDFKFEQNSLETYVALAEDTNRDEKAFDEIKKTLRKQIVETFKKGGSYSDLFKKELIQKHLPEFVSDEEEKKMIANFSKFTTYFNGFNENRKNMYSDEDKSTAIAYRLIHENLPMFVNNMKSFSRIADSDVHQHFTEIESSFSEYLGVEHLEEMFQLDYFSETLTQEQIAVYNHIIGGRALEDGTKLKGINEYVNLYNQQHKNSRLPLLKPLYKMILSDRVALPWFPSEEFASDEEMIRAINETYNTLKEVLSIDGDSSLRSLLLNISSYDIKHIYIANDLGLTDISQQMFGQYDVYTSAIKQELREKNAPTAKERRNPELYDERINKLFKSAKSFSIEHLNSLVDSEHTIQNYYKHLGAYDRNGEQRVNLFTQIEMAYVAAKEILSGKHGNISQSDAETAIIKGLLDAFKSLQRFIKPLLGNGEEADKDNEFDAKLREAWNTLDIVTPLYNKVRNWLTRKPYSTEKIKLNFENAQLLGGWDVNKEPDCTSILLRKNGLYYLAIMNKKYNHAFDIDNLPNDGKCYEKIDYKLLPGANKMLPKVFFSKSRIKEFAPSEIIVNAYKKGSHKKGANFSISDCRRLIDFFKASISKHEDWKNFPFSFSSTEKYEDISGFYREVEQQGYMLGFRNVSESFIKQLVDEGKLYLFQIWNKDFSDFSKGTPNMHTLYWKMLFDEHNLANVVYKLNGQAEVFYRKSSLDVANTTIHKAHQPIMNKNQEYKKRQSTFDYDIIKNRRYTVDKFQFHVPISINFKATGRDNVNDNVLDIIRNGGIKHIIGIDRGERHLLYLSLIDLKGNIVKQMTLNDIVNEYNGNTYATNYKNLLAEREGNRTEARKNWKKIENIKDIKKGYLSQVVHIISKMMVEYNAIVVLEDLNMGFMRGRQKIERSVYEQFEKMLIDKLNYYVDKQKNSDEAGGLLHALQLTSKFESFKKLGKQSGCLFYIPAWNTSKIDPVTGFVNLFDTRYTNADQARKFFSQFDSIRYNADKDWFEFAFDYNKFTAKAKDTRTKWTLCTYGTRIRTFRNPARLNQWDNEEVVLTDEFKKAFANADINIHGNLKEAICSLQDKKYLEPLMHLMKLLLQMRNSITNSEVDYLLSPVADENGTFYDSRICSASLPKDADANGAYNIARKGLWAIHQIQESPAGDRLNLAIKNKDWLNFAQQKPYMNE

SEQ ID NO: 1708 - protein, 700 aa, unidentified
  REGION 1..700: note = Description of Unknown:uncultivated organism sequence
  REGION 1..700: note = Category: MG75 effectors
  REGION 1..700: note = Description: MG75-194 effector
METFSGFTNLYPLSKTLRFRLIPVGETLKHFIGSGILEEDQHRAESYVKVKAIIDDYHRTYIENSLSGFELPLESTGKFNSLEEYYLYHNIRNKTEEIQNLSSKVRTNLRKQVVTQLTKNEIFKRIDKKELIQSDLIDFVKNEPDANEKIALISEFRNFTVYFKGFHENRRNMYSDEEKSTSIAFRLIHENLPKFIDNMEVFAKIQNTSISENFDAIQKELCPELVTLCEMFKLGYFNKTLSQKQIDAYNTVIGGKTTSEGKKIKGLNEYINLYNQQHKQEKLPKMKLLFKQILSDRESASWLLEKFENDSQVVGAMVNFWNTIHDTVLAEGGLKTIIASLGSYGLEGIFLKNDLQLTDISQKATGSWSKISSEIKQKIEAMNPQKKKESYESYQERIDKLFKSYKSFSLAFVNECLRGEYKIEDYFLKLGAVNSSLLQKENHFSHILNTYTDVKEVIGFYSESTDTKLIQDNDSIQKIKQFLDAVKDLQAYVKPLLGNSDETGKDERFYGDLIEYWSLLDLITPLYNMVRNYVTQKPYSVDKIKINFQNPTLLNGWDLNKEMDNTSVILRRDGKYYLAIMNNKSRKVFLKYPSGTDRNCYEKMEYKLLPGANKMLPKVFFSKSRINEFMPNERLLSNYEKGTHKKSGTCFSLDDCHTLIDFFKKSLNKHEDWKNFGFKFSDTSTYEDMKCTENSCQFED

SEQ ID NO: 1709 - protein, 1283 aa, unidentified
  REGION 1..1283: note = Description of Unknown:uncultivated organism sequence
  REGION 1..1283: note = Category: MG75 effectors
  REGION 1..1283: note = Description: MG75-195 effector
MKQFSNLYQVSKTLRFELQPIGKTKENIESGGILQKDEQRAVNYKIVKGFIDEYHKQHIKNCLWNFELPLFNEGKHDSLEEYKILYETPQRNAVQEAAFTEVKDNLRAIIVKQLTKKGTAFDRIDKKELIREDLLNFLVKKEDRDIVQQFADFTTYFTGFHENRRNMYSSEEKSTAIAYRLIHQNLPKFMENMKAFATIAQTSIAEHFADIYAGWEEYLNVGSIEEMFNLDYFSHTLTQTGIEVYNYIIGKKILEDGTEIKGINEYVNLYNQQQKDKKQRLPLLIPLYKQILSDREKLSWISEEFDSDEKMLAAINGLYIHLHDLLMGKENESLRSLLIYLKDFNLEHIYITNDQSLTNISQHLFKQYDVYTQGILNHLRVNTPRKKKETDEDFEKRISQILKSKKSFSIAFLDHLPHPITEEGKPKSIEDYFQALGAVDSETIQKENIFAQIENAYENVYEVLQLKETGNSLSQDKSAVAKIKVLLDAFKELQHFIKPLLGSGEENEKDELFYGTFQMMWDELEAITPLYNKVRNWMTRKPYSTEKIKLNFDNAQLLDGWDENKETTNASIILRKGSYFFLGIMNKNYRQLLDKPMPSDGDCFDKVVYKFFKDITTMVPKCTTQMKSVAEHFKHSSEDYILFDKKKYNTPVVITKEIYELNNVTYNGTKKFQIEYLRSTGDSEGYQHALTVWKAFCLKFLKAYISTSVYDLTLIEQNINSYKNLSTFYNAVNLLLYNISYKRVSTEYINTLVDEGKLYLFRIWNKDFSEFSKGTPNLHTLYWRMLFDERNLADVVYKLNGQAEVFYRKASIKPENLIIHPANQAIANKNILNRKKTSTFEYDIIKNRRYTVDKFQFHVPITINFKAIAQKNINPIVQETIRNNGFTHVIGIDRGERHLLYLSLIDLKGNIIKQMTLNEIINEYNGQCFVTNYHDLLVAREGDRTKSRKSWDTIETIKELKEGYLSQVVHIISKMMIEYKAIVVLEDLNVGFMRGRQKIERQVYEKFEKMLIEKLNCYVDKQADPASEGGLLHPLQLVNESKSFQKHGKQCGCLFYVRAWNTSKIDPTTGFVNLFDTRYETREKARVFFSKFKRISFNKEKDWFEFSFDYNDFTTKADGTRTQWTLCTNGTRIRTFRNPLKNNQWDDEEIILTDQFKELFSKYQIEITGNLKDSINRQSEAAFYKDLMSLMKLLLQMRNSKTNSEVDYLFSPVADEQGVFYDSRNCGANLPNNADANGAYNIARKGLWVIRKIQSTSIDEKISLAITDKDWLNFVQNKSYLID

SEQ ID NO: 1710 - protein, 663 aa, unidentified
  REGION 1..663: note = Description of Unknown:uncultivated organism sequence
  REGION 1..663: note = Category: MG75 effectors
  REGION 1..663: note = Description: MG75-196 effector
MIPKCSTQLNKVKEHFAKSSTDITVFDSKTFTSPITITKEIFDLNNVTYDGKKKFLKEYLEKTGDQKGFSDALSTWKHFCLQFLKAYKSTANYDFSEIERNIDSYSDLPLFYQELNNILYKITFERVSADFIHQLVNEGCLYLFQIYSKDFSPYSKGKPNLHTIYWRMLFDEENLSNVVYKLNGEAEIFFRPSSIKCTGPTHLANRPIENKSEYNKKNKPSSTFGYDLFKDRRYTKDQFEFHVPITLNFKQPKPSMFNDEVRTFLKENGVRHIIGIDRGERNLLYLVMVDLDGNIIKQYSLNRIASNANNSNFEQDFRDILHKREGDRQEARRNWSTIQNIKELKEGYMSLVVHEIVKLMLKEDAIVVLESLNRSFMQIRGGIEKSVYQKFEKMLIDKLGYIVDKDKAPTENGGALHAIQLADTFENYNKYQSGIVRQCGFIFYVPAWCTSKIDPTTGFVPMLKCKYENIDSSQTFFSKFDSIRFNEAEEYFEFKTNYANFYTSSKGGKQQWNICTFGERILTQRAKDGHFESKTIALAPAFKELFAQAGINIQGNIKAQIVKQNDASFFKELHHLLRLTLQMRNSNSTTGDDYIISPVKNKDGEFFDSRRSGEKLPQDADANGAYNIARKGLMLLQQLNATKADSKFKPEISNEKWLEFAQK

SEQ ID NO: 1711 - protein, 1376 aa, unidentified
  REGION 1..1376: note = Description of Unknown:uncultivated organism sequence
  REGION 1..1376: note = Category: MG77 effectors
  REGION 1..1376: note = Description: MG77-1 effector
MTVDNSAYYDSYTGRYPIRRTVQFSLIPQGETQKWIDQYGFVSADEKRDEDYKELKKIIDNYHRDFIARALDSFKKAIDWNNLIEALEQFQQSNETDKPKARKELEKVQANYQSEIAEAFRKQDDFNSLFKKDLITKILPDSINDEDKNELLARFRQFTSYFTGFNENRRNLYSDEAKATAISHRIVNENFPRFYANCKDWERLNKLYHGFGLQVQDSIEKLDQDIDIAQYFEPKNYSLVLTQEGIDVYNMILGGGFDSSRKKVSGLNNLANECWQKARSNERNGSQSEGIEEQRAPHKIILQQLHRQILSENVSSWSQLFEQYKNDGEVYDALKTLNKELLQPRNEEVSFLDQVVDLFRKLKEFDPAVIQVRSNRFFSFSRTCFGDGFYLENAIASCVDEKLAPVQGLSASVRNKWAKKEQRTLREIAQIVYAAEKSLKAKDADAIDLPNEQVWEILHVDNLIEDFYETRDEIVVREERLEEDLTGAKPDARKLMQKGELVQKIKAFLDSLLNYQRALQVFSLDANEERNPEFYAYYDSLRENWSIVPQIYDRVRNYVTQKPYSKEKFKLTFENPSFLNGWSLDKQDENYGALFLQDGKYYLGILNPNNKIKFESLHDAVEDKTEGVFQKVDYNLFPGATKMIPKCSIARNDVKNHFRKSKSDCSLDNEKFIKPLRIPYRIMELNYDMTADQPEKLKLKKYQVEYKRSTGDEAGFTEALADWIDFCLDFLESYRNTAGYDFSFCYGKEYKSLDQFYNDVDRITYSLSLRDVSKRQIDQLISDGKLFFFQLYNKDFAEKATGKKNLHTLYFEALFSKQNLNETVFKLDGEAEMFYRPASIDSPFTHNVGEYVVNRTYTEVIDGKEERKSLKDYVHRELYEFANGKKAKSKLSKDAIRAIELGHYTPKEVTHAITRDKRFSQPQYSLHIPLTINFGTKPIGGRDNNSDILKSIKRDKDIAIIGIDRGERNLLYYSVIDQAGKILDQGSLNAINGVDYHEKLDLRERERNEQRQSWKSIDKIKDLKKGYLSVAVHEIVSLMLKHNAVIVMEDLNAGFKRSRTKFEKQIYQNFEKQLIDKLNYCVIKPKTQGTSDEASNRGEHRDLDAPGGVLCGYQLANQFESFQKLGKQCGSIFYVPAWNTSRIDPTTGFVNLFRAAELRYKNLQQVQSFFQRFDGIRFNKDEDWFEFTFSYSNFNTSGTSLIDEWTVCARDVELPIVVKDDNEGRWNRQNTKNETINIKNKLEGLFAEYGIDYKSGEDLIEAITFINHSGFYKELLKYFKTLIALRHSTKAGTTPAVDCIVSPVMNEAGYFFDSREASPAFPQDADANGAYNIALKGLQIAKEFIDEATDAPWRVTYKNSNNEWLRFVQERAWKNQ

SEQ ID NO: 1712 - protein, 1234 aa, unidentified
  REGION 1..1234: note = Description of Unknown:uncultivated organism sequence
  REGION 1..1234: note = Category: MG77 effectors
  REGION 1..1234: note = Description: MG77-2 effector
MSNFYSTFINLRPVSKTLRFSLIPIGKTRENIRSAEIISQDEKKSQDYVILKDVFDTYHKAYIDQHLCRIQGDWSELAKALEERQSSQSAETLNRVQTAYRKEIAKLLISEKATKLGKNDHLFLADDGVTFLQKNDLAKLIKLTVDEKRAAERENRRPEYLIPELGEHIKAVEQFDRFAGYFLAYQQARNNIYTDEGSTSVAHRVVNENFPKFMANIHTYRRLPESLKQEFEHSLEDLLYGVPLETVFSTDYFNAVLAQTGIERYNTLLGGKTEEGGVKIQGLNELCNLAFQQGILPKKVVFVPLYKQILSDRDRASFLPEKFKSAVEMLTALGHFMTELNEMIAAEHESVADNIKSGICDSDRVYIGKSQLASLSMLCFDNWNKLRDAVRPKEVYSLSELQLVSEKDILGIVREQFLAKLGKITEASTSLPPVLKKETLREEDYSKIKTYLDAVIDAQHLLKIFDADDDADKDSVFYGTSDALNETLRKGIPLYDKVRNFATGKPYSEEKFMLTFDAPTLLNGWDKNKERDNCCMLFRRDGLYYLGILNAKDKPTLTEEAEIDGPSYEKMVYKYLPTPSKMLPKVFNKSGRWIAAHGLDDEIRDGYEKGLHKVGPDFDPVFMHKLVDYYKVCISQYEDWATFRFRFSDTETYRTMADFYGEISAQSYNVSFTKVSERQINDAVDAGQMYLFQIYNKDFSEFSHGAPNLHTIYWRELFSAENLKNPLVKLNGEAEIFYRHPSVKNPFRHQKGDVLINKVDAEGVTVPDARYRTAASDAASSMPLEILRASYPELIFKIADREIVKDNRYTKESFAFHVPLTLNYGCDAGIRLNQTVCEKLQSDEPYYIMGIDRGERNLIYISVIDRHGRIVEQRSLNVVGQNKVDYQAKLDTLERERQDARKNWRAITAIKELKEGYLSFAIHEITELMMRYPCILVMEDLNFGFKRGRFHVEKQVYQKFEKMLIDKLGFCMLKDRTPEEEGSVRHAYQLTEPFESFQKLGKQSGVIFYVPAAYTSKIDPLTGFVNLFTSAQLNYTSVEAARTFFGTMREIGYDAQRDCYRFAFRYGDYDLNKKDYTDAWTVYTAGEDRIAHSVKNGRHEYETVDVTKRMKALFARFGIDPYASDLRAAIAAVDKKEFFSELLRLFRTTVQLRYEDQTQDFILSPVEKDGRFFDSRTAERDLPQDGDANGAYHIALQGLRLVWERIENGKVKTDGKGEQSYNWFRFVQKKEYRK

SEQ ID NO: 1713 - protein, 1236 aa, unidentified
  REGION 1..1236: note = Description of Unknown:uncultivated organism sequence
  REGION 1..1236: note = Category: MG78 active effectors
  REGION 1..1236: note = Description: MG78-1 active effector
MQQFIGVYPDSKTLRFKLIPIGRTLEMMEKNAIIQNDTKKYEGYKRLKKIIDEYHKAFMDHSLKDLYLEGLEEYSELYNRSKRDVSQEKKYKELQANLRKQVINAIKKDPQFKRLFKKELITEDLYKFVGDNEEIIDLLQEFSEYTTYFTGFHQNRENMYTDEEKSTSIAYRLVNQNLPKYLDNIKIYELLMTSSVAEQVEGLEKELRSLYGVLSIKDYFTIDGFNLVLTQKGIDVYNTILGAYAKENGEKVQGLNEIINIYNQHVKEKAKRIPIMKELYKQILSDRDTVSFVNEKFESDEDVFEAIDLFSTELEQTIIMPQNDMAVKALLLNIADYDLKHIYINNDSFITTISKYLYGDWSCIHSAISDHYDALKGGKVKDRKYEEKKQKELKQVADYSISDLDNYVSKYKNESKKMEDYFTEQCASILAEIEKTKEKYLELSAHCKDKEDSAIRKDDKNIGIIKEYLDAIKKLQRLLKSLVLGQQEPDKDELFYGELIRIWDALNGITHLYNQVRNYVTQKPYSLEKIKINFEKSTLLAGWDKNKERDNLGVLLLKDGNYYLAIMDRKHNKSFLEVKAATSDVYQKMNYKLLPDPSKMLPKVFFSQKRIQEFAPGEEILQIRESGSFKKGDNFNLEDCHKLIDFYKASINKHEEWKNFGFSFSDTKDYADISGFYKEVSDQGYKITFEDVDADYIDRLVEEGKLYLFKIYCKDFSPYSTGKPNLHTMYWRALFDEENLKDIVYKLNGQAEVFYRKASIPLKITHPANEPIHNKDLNAKKQTSVFPYDLIKNRRYTCDQFQLHVPITMNFKASGENRFNKRVNQYIHDTKGMHVIGIDRGERNLLYICVIDENGKIVYQKSLNEIISCRTNEEANEGHCVDYHLLLDAREKQNKEARENWTTVNSIKELKEGYLSQVIHIITDLMIRYNAIVVLEDLNFGFMRGRQKFEKQVYQKFEKMLIDKLNYLVDKDKEWTEDGGVYRAYQLTDKFKSFQMLGKQSGFLFYIPAWMTSKIDPSTGFVNLFYTKYENMEAAKNFIHKFKRISYNEEKAYFEFEFDYKDFTYKADGTKTDWTVCSSGMRIKHFRDHEKNNNWSTKTIYLTDDFKELFDEYEVKLQADNMQDQLLGLSDVHFYKKFMELFSLMVQMRNSNEEGEDNITSPVLNQNGEFFCTHKNERGSDRIIPEDADANGAYNIAKKGVLIIEKIRKTDVNDLDKVKLAISNKEWLQYAQEHIL

SEQ ID NO: 1714 - protein, 1235 aa, unidentified
  REGION 1..1235: note = Description of Unknown:uncultivated organism sequence
  REGION 1..1235: note = Category: MG78 effectors
  REGION 1..1235: note = Description: MG78-2 effector
MNRILADDFIGMYPVSKTLCFELRPIGKTLEHIERDGIIDTDVIRSENYAKVKKIIDEYHKAFIQKVLAKVQLDGLEDYYRFYNTIRRTDREEKAFLNCQENMRKQLSKAFKDDDAFKTIDKKELIKNDLVSFFAEDREKLDLIREFSDFTTYFTGFHQNRQNMYSDEAKSTSIAYRIVHENLPKYFDNIKVYDQIMATSISEQVAELESNLCVVFENFGKIGDYFIIPGYNAVISQEGIDRYNTIIGGYSEEDGKKIQGLNEIVNLYNQKHKVHLPKFKLLFKQILSDRERISFIPDEFASDIEVFDAVQGLLQRLDEELFENGEDNITISELFSDLSIYDLNGIYVTNDSSITTISQELFDDWSVIRNAIDRKYEEMNPIRRMKQEKYDEKKTTELKKIKSYSIGNLNALMEENLKSEGIEKYFTEKITHALLEIRTASENYRKIDVDKYQVGRALKGNDRDISLIKGLLDSLKELQWIIKPLNAGFEEAEKDELFYGEYTRIWDTLEAITPLYNKVRNYVTGKPYSTEKVKLNFGRATLLNGWDKNKERDNLGIILLKDNNYYLGIMNRDNTQCIDEAPQAGSEKVYEKMNYKLLPGPNKMLPKVFFSKSRIDEFSPTPELMHNYKKGTHKKGDLFNLDDCHKLIDFFKASIEKHEDWSQFGFQFSETGSYAELNDFYKEVSQQGYKITFSNIDESYIDKLVDEGSLYLFQIYNKDFSPYSKGTPNLHTLYWKAVFSKENLDNVVYKLNGEAEVFFRKASIRQEDIIVHPAGKEVANKDPFNEKKTSLFSYDIVKDRRFTCDKFSFHVPITMNFKADKQRNINERVNLALRAAKDIHIIGIDRGERNLLYVSVIDMNGKIVEQMSLNELLSYDKNKNLHRRDYHQILTERERENKSARQNWTTINTIKELKEGYLSQVVHVITDLMIKYNAIVVLEDLNFGFKRSRQKFERQVYQKFEKMLIDKLNYYVDKQKNYDENGGLLKAYQLTAKFTSFQTLGKQSGFLYYVPAWNTSKIDPTTGFTNLFSLRYESVEKTKAFIRNMDRIWYDADTGAYALSFNYDRFTYKAEGTKTDWIIYTFGKRIEHFRNKEKNSEWDVKYIDLTESFSELLAEYGISRELEDIKGEMLNISDAEFYKRFMKILSLTLQMRNSDEVNGVDEIISPVKNRRGEFFISGTCKDLPVDADANGAYNIAKKGLWLVEKIKETPEEDIANVKLALSNKEWLKFAQDNTL

SEQ ID NO: 1715 - protein, 1235 aa, unidentified
  REGION 1..1235: note = Description of Unknown:uncultivated organism sequence
  REGION 1..1235: note = Category: MG78 effectors
  REGION 1..1235: note = Description: MG78-3 effector
MKKRIADEFINLYPVSKTLRFELKPIGRTLEYVERDGIIETDVARSQNYTEVKALIDEYHKAFIQKVLENTELSGLEGYMNLYSNAHRADREEKEFEACQSDLRKQISKSFKQDPAFATIDKKELIKNDLISFYEGDQEKQALIESFSEFTTYFKGFHENRQNMYVDEAKSTSIAYRVVNQNLPKYCDNIKVFQLISETTISVSVAELEEKLNAKYSDFGKIGDYFTIDGFNKVISQKGIDRYNVILGGYTTKDGEKIQGLNEFVNLYNQKYKEHLPKFKLLFKQILSDRDSASFIPDQFESDQQVFEDIEKIYQRIKEELLENEEEITISELFSDLSAYDLGGIYVKNDGSLTAISQELYGDWSVIKSAINSDYENNTPIKRTKREKYEETKKKELEKVKSYSILSLNSFMSNIHKEANVEKYFTNKVTDALDRVAKEYRIFNGIKTGKYENGKSLKSNDSDIAKIKGLLDSLKELQFSVKPLIAGTDEAGKDEVFYGEFLRIWECLDIITPLYSKVRNYVTSKPYSTEKVKLNFGKSTLLDGWDKNKEQDNLGVVFLKDGNYYLGIMNRRDTGCIDSAPIANSDHVYKKMNYKLLPGPNKMFPKVFFSKSRIDEFAPSEELLSNYRKGTYKKGDNFSLEDCHDLIDFFKQSILKHEDWSQFNFKFSDTKDYENISEFYKEVADQGYKINFNDIDESYINKLIDEGSLYLFQIYNKDFSKYSKGMPNLHTLYWKALFMPVNLKNVVFKLNGEAEVFFRKASIRQQDIISHAAGQKIKNKDPLNEKTESLFEYDIVKDRRFTCDKFMFHVPITINFKAAGERYMNLRVNNMIHNADEMHIIGIDRGERNLLYTCVIDLNGNIVEQMSLNEILSYDKNNNLHRRDYQRMLTEREKENISARQNWTTINTIKELKEGYLSQVIHVITNLMIKYNAIIVLEDLNFGFKRGRQKFERQVYQKFEKMLIDKLNLYVDKQKAVDENGGLLNAYQLTAKFESFQKLGKQSGFLYYVPAWNTSKIDPTTGFTNLFYTRYESVEKTKMFIQNMDRIWYDESTAAYAFSFDYNRFTYKAEGTKTEWTIYTNGRRIERFRNPEKNSEWDVKSVDLTAAFDELMTEYSISKDTEDLRNTILEIQEADFFKRFMKLISLTVQMRNSDEKNGVDEIISPVKNARGEFFVSSGTEKYLPVDADANGAYNIAKKGLWIIQKIKETPEDEMAKLKLTMSNKEWLKFAQENTL

SEQ ID NO: 1716 - protein, 1245 aa, unidentified
  REGION 1..1245: note = Description of Unknown:uncultivated organism sequence
  REGION 1..1245: note = Category: MG78 effectors
  REGION 1..1245: note = Description: MG78-4 effector
MNQEKGNLLSEFTNLYPVSKTLRFELKPVGRTQEHIEYDGILDADFQRAEDYKKVKKIIDRYHKEFIEISLRNVFLTKEDLNTYKELYETNAAARDEKWEKHFNKAKESLRKQIERCFKDAPAYKNLFKKELVQKDLIEFVKGSEEETKLVQGFKDFTTYFQGFYENRKNMYSAEDKSTAIAYRLIHQNLPKFIDNMHIFQKVEQSPIKDQLNTMFYELKAKIDIASISDYFALEGFSKVLTQSGIDVYNTILGGYAEGNVKVQGLNERINLYNQQLSKEEKKQLSIPKLKPLFKQILSDRESISFIPEQFADDQELLDAISEFYRNIQQTIFENEELITISQLFGQSDSYNWNRIYVKNDAFITTMSKQYLGDWSIVTRALEMDYDLAHASKKKGAKYEEKRGKELKRVKYYAVQKLNQIVMQYYGQECQIQQWMNQQIQETLQMIYENYDAASALLNTTYVTKKSLCNNQQAIGQIKLLLDSLKQLQNLIKPIANTQNETDKDELFYSELIRIWNELDPLTLLYNRVRNYVTKKPYSLEKVKLNFNKSTLLNGWDKNKERDNLGIILRKDGLYYLGIINPKCTNVIEKAPEATESTCYEKMEYKLLPGANKMLPKVFFAEKNIEEFNPSEEILAIREDESFKKGNNFSLENCHKLIDFYKQSISKHKDWSKFGFEFTSTSEYQDISGFYREVENQGYKISFRDIDVSYIDELVEQGQLYLFQIYNKDFSPYSKGTPNLHTLYWKALFSPENLSNVVYKLNGEAEVFYRKASIAETDKVVHKANEPVKNKDVHTEKETSVFEYDLVKDKRYTVDKYQFHVPITMNFQAQGENYMNRKVNQMIHDNKGIHVIGIDRGERNLLYLTLVDPEGRIIKQMSLNEIISYDKQNRKHVKNYHDLLDVREKENKSDRQNWKTVNTIKELKEGYLSQVIHVITKLMVEYNAIVVLEDLNSGFMRGRQKFEKQVYQKFEKMLIDKLNYCVDKTINPEQSGGLLHAYQLTKRFDSFKKLGKQSGFLFYIPAWNTSKMDPTTGFVNLFYVKYESVDKTKEFIKKFDSISYNSERSYFEFAFDYSKFTYKADGTRLHWTICTHGERIENFRNPEKNNEWDSRKITLTTAWKKLLEKFEIDYTQKNLIDQMLQCNDTEFFKTFMRYFRLILQMRNSDAKTGEDWICSPVMNEHGKFYFSGEESTLPLDADANGAYNIARKGLWVIEQIQSAQLDKLDKIKLAISNKEWLKYAQEHTL

SEQ ID NO: 1717 - protein, 1208 aa, unidentified
  REGION 1..1208: note = Description of Unknown:uncultivated organism sequence
  REGION 1..1208: note = Category: MG78 effectors
  REGION 1..1208: note = Description: MG78-5 effector
MKDEHRAESYKKVKKIIDRYHQQFIDNVLDNIALEGLNEYQEYYCIKNRNEQQEKQFENIKKKIRKQISDAFTGNPKFKCIFSKDMIENELLEYTKDNTDEQELIYEFDKFTTYFQGFYDNRKNMYSCDGKSTEVAYRIVDQNLPKYIDNISIYKTALSAGLDKQISDAINKIKTYYNIPLSEQLFDVNGFNNVLSQKGISIYNYIIGGFSDKERSKIQGINEIINIYNQHVDKKDGKKIPKCKQLFKQILSDREDAPFIIEQFESDEEVFSAIDNFYCEMNVSIFNNVDSINVQQLLSGINNYNLSGIFIKNGLAITDISKNLFSDWSIINHALEMNYDKNNNTKNKQTEAYIEKRKKVIKKQKAYSIEFLNNVVTEYTDKEVHIEKYYVDKFNNEDNLVNKIIEQKRHYDELLATSRKKPLRKNDVLIENIKQLLDLFNELQRLIQPLINYDESAKDPLFYSEIERIWNILDLLTPLYNKVRNYITKKPYSIEKSKINFNSPTLLKGWDKNKEETNLAIIFEKNGLFYLGVIDKNNNKVITKAPKAKSNNVYKKMIYKQIPNPSRDFPHVFLAKGNIDYYKPDNELLKKYEQKTHLKNNPNFCLEDCHKLIDFFKQSIKKNEDWAKFNFVFSDTKTYKDLSDFYREVDAQRYKITFENIDEDYINQLVSEGKLYLFQIYNKDFSEYSKGKPNLHTLYWKMLFAPENLENVVYKLNGEAEIFYRRASIKQDEIIKHPANEPINNKNELNKKAKSVFEYDLIKDKRYTIDKYQFHVPITMNFGAQGDNHFNLSVNKAIKYADDVNVIGIDRGERNLLYLVVINSKGEIIKQKSLNEIITVNNNKTEFHTDYHILLDKREKENVSARQNWKTINTIKELKEGYLSQVIHVITEWMLEYNAIVVLEDLNFGFKRGRQKFEKQVYQKFEKMLIDKLNYIVDKNKDIYESAGLLNALQLTNKFETFKTLGKQSGFLYYVPAWLTSKIDSTTGFANLFNNNDIRYSSVEASKEFFSKFISITYNPLGIHGSDYFEFSFDYNDFTYRAADTQTHWTVCSYGERIHHFRNQEKNNEWDTQYVDLTKSMKNLFDNYNINYQNVDIKEDILKISEKAFFKELLWLFSLILQMRNSDSDNNVDRLISPVLNDKNEFFDTGLKIEEYPIDADANGAYNIARKGLWVINQIKLCDDDKLNKLKLAMSNKEWLQFAQENRL

SEQ ID NO: 1718 - protein, 1299 aa, unidentified
  REGION 1..1299: note = Description of Unknown:uncultivated organism sequence
  REGION 1..1299: note = Category: MG79 effectors
  REGION 1..1299: note = Description: MG79-1 effector
MNNLSQFTNLYLVSKTLRFELKPIGKTLENIEKDGIISEDEKRAENYKKVKIIIDKYHKWFIEKSLSCVKLPEEKLNIYYNLYKATPDVKKEEKWNKEFEDIKKELRKEITNSFSSDEVKDLYKDLGKKELIRDILPEWKELDEEEKQLFGDFYQFTTYFVGFNENRKNMYSSEEKSTAISYRIINDNLPKFIDNIETFKIIKKTEFYSLFNNIYSELEPWLNISSIDEIFELTYLNEVLSQSQIEEYNFIIGGRSGEDRNDKIRGLNQYINEYNQKHEKKDRLPKFKMLYKQILSDREKISFLPESFENVNDLFVSVETYYKSNLLCVKNENNEEINIFDELSKLMSEISSYDLSKIYIKNDKNITDISQKLFGNYGVITSSINYYYESFINPNYKDDYARAKTESKRDRIEKDKEKYTKQKYLSLLEIQEAIKKYLEYTNEYSDSVVSYDKCLINYFSKIFDEKDKTNKIKDVYDKYTLLEPVLNVSYPETKKLSKNEKKLLKDFLDAILEIEHLVKPIYITSDEYSENDLTFYSQFNELYSHLDLLISLYNKVRSFVTKKPYSTEKIKLNFNSPTLLNGWDKNKEQDNLGIILIKNEKYYLGIISHKNRFIIDDFCTDASMENGYKKVVYRQIADASKDLPNLIEVNEKTIRKTGRKNDKGVNVILEEFKETYLPKKINQIRKSESYKISSKNFSKEDLTAYIDYYMQRIIAYKSDFTFIFKKPEEYNSYTEFIKDIDRQKYYLSYEYISYEDIKSLVDTGKLYLFQIYNKDFSASSKGKKNLHTMYWKALFDEKNLKDIVYKLNGQAEIFYRKASIPQESIVRHQKGDEMEFKNPLRNGNGERFKYEIVKDRRYTVDKFQFHVPITMNFKSPGDFKINSEVRKYIRNNPDVNILGVDRGERNLIYISLIDQKGNVIFDEDGKPIQYSLNTIESKYKKGDETVTFKTPYHTLLDEREKSRKQARQQWDDIEGIKELKDGYISQVVSLVTRLMVKYNAILVMEDLNFGFKKGRIRVEKQVYQKFEKMLIDKLNYLVFKDSKPGEVGELYNALQLTNKFTSFSSLGKQTGFIFYVPAWDTSKIDPVTGFVNLFPRCNTVKERQEFFNKFDFIKFDGENFVFSFDYDNFTSRATETKTKWTISTQGGERYFWNNRADNGKGATEKINVTEAMKKSLSEAGIQLEKDMDLKEKISSLDGKYIGKIYRLFNIVLAMRYSKDEEDFILSPVADENGKFFDSRNAANNLPKDADANGAYNIARKGLWYIMQLNDASGDLMKTNLAITNKEWLSFAQNKPYLDN

SEQ ID NO: 1719 - protein, 1230 aa, unidentified
  REGION 1..1230: note = Description of Unknown:uncultivated organism sequence
  REGION 1..1230: note = Category: MG79 effectors
  REGION 1..1230: note = Description: MG79-2 effector
MKDFNQFTNLYQQSKTLRFELKPVGDTLTHIQKNGILDRDYARAENYRKMKKTIDEYHKDFIDRALRGTNLDGLDAFAKLYAASVEEKRTEKWKKEYASCKQALRKEIAECFKRQAGFSDLDRKELIRNRLKAWIDQNQSDLFYTEEFYEFTTYFTGYNQNRMNMYSDEEKATAISHRLVDENLPKFLDNAAAFRKLKDSPVADHFSQLCADMEPWLNRSSLDDVFSVPHFNSVLTQAEIDAYNVLLGGRREEDRKLRGLNEYINLYNQKHPDAKLPRMKMLYKQILSDRESISWLPMEFRNAVELLEAVSGYSREAVDTVARAESALLELPNCDLTHVYVRGDALGAISSKLFGVYYVLSDALGLEDREDYYSMAELQTALDGYAKTVDRSVIPNADALVPDCLIAYFKNGLLQLAKDLHEALDKATPLLQIQQPEDYSLSQSDKSQLKSFLDAAMEILHFLKPLYLPADSELEKDDVFYGAFAPVYEDLQPITKLYDMVRNFATKKPYSTEKVKLNFDCSTLLDGWDTNKETQNLGVLFLRDGCYYLGIMDKRHNRVMEKAEGSQEEECYQKVQYKLLPGANKMFPKVFFSKSRINEFAPNEEIMRIYKSGSYKKGANFSLKDCHTLVDFYKASIQKHPEWKQFEFRFSPTESYQDINGFFQEVDKQGYRLTYTPVSAAYIDALVREGKLYLFQIYNKDFSPYSKGRPNLHTMYWKALFSEENLRDVVYKLNGKAEVFYRKRSISDANLVIHPAGQPIAKKNPMLSGQSSCFTYGITKDRRYTVDKFQFHVPITMNFKASGAVPINEVNKKVCAYIKNNPDVNIIGIDRGERHLLYISLIDRNGRVVKDENGCDIQYSLNTVTGSYRSSDGRPVGFETPYHDLLDQKEHERQAARQNWDTVENIKELKEGYLSQIVYHIAKMMVRYHAIVVLEDLNSGFKRGRIKVEKQVYQNFEKALIEKLNYLVFKDAEEGQPGDLYHALQLTEKFESFKKLTKQSGFLFYVPAWNTSKIDPVTGFADLLKPRYTNVNDAKAFFNKFKRISYDARNDWFCFSFDYRDFTQKAGESRAEWELCTFGAERYAFNRNLNGSRGGYEKWNLTERLKKLFEDYGIDFRRENLENAITMQTKAPFFSSLIKILQVLLAMRYSSAEDGRDFILSPVMGPDGSFFCSENLTPGLPADADANGAFNIARKGLWVLQQIDRAEKYTDWTTKVQNTQWLSFVQQLTP

SEQ ID NO: 1720 - protein, 1332 aa, unidentified
  REGION 1..1332: note = Description of Unknown:uncultivated organism sequence
  REGION 1..1332: note = Category: MG79 effectors
  REGION 1..1332: note = Description: MG79-3 effector
MREKNSGLEQFTNLYSLSKTLRFELIPVEGTAEAIQQNGILAEDKKLADSYQKIKPTLDAFHRAFIDRCLSEVKLENLDRYYDLYHVGDEEKRTKKYQDEFKSVKNALRKEVVSYFKKDKRYPKGLFGKELLKTHLPKWIEETGEDWYQDESFVNFTTYFSGYNENRENMYKDKEQSTSIAYRMIDENLPKFVYNMRLFNRLSDTDISGSFSVISEELAPFIFTSSLEEMFELSTFNKLMTQDHIDALNTIIGGYKEGEKVVKGLNGYINEYNQAHPKNRLPMMQMLYKQILSESNSASWLPDAFDSAAELFSGMNNFCDCGLRMNENPSLLEEMKKVLQEIKACDAAGIYIRNDSSINTISNAIFGHYGVIRNALETYYECQVFPEYRKRLISAKSAKSAEKIKKAKETYVTGTGYFSVREIQDALELYIDTAELGSNPEIKNRYFKDCISVYLAEGSATYVSRIKEAYNNVSGMIKASYASDYRLNEDDKDGLKHFLDAVLSLLHYCKPLYVKAEAGIKVDEVFYGQFNPLYEQLQTVTVIYDKVRNYATQKPYSEEKIKLNFGIKGNFLSGWVESKTDASDNGTQYGGYLFRKRNYIGEYDYYLGISSNSKLFRYFNSISAEEASKYERLNYYQPKEQSVYGSAYKGRHSYADDKALLMSTILDFMKKTKDTEFYEGFLAYSQTDLATPSGCLSRIKEFSTELYENLLRDEKFKDANEEVMQALKATIHSMGRLKGTEAVTERQYGVFTEMMNDINTLMSNNVYQYSAVSETELREALQDKKKPLYLFRITNKDLAYAERLEQGKDRKHRGRDNLHTMYFKALMSGEQNVYDIGSGTVFYRPASIARKVTHPAGIPINSKNPNLKDHKNIFEYDLIKDRRFTEDKFQFHLSIIQNYSASGIKSSDYNEKVCQYLRNNPNVNILGIDRGERNLLYISMIDRNGNIVRDENGQLIQYSLNNLTGEYTNASGEIVKFTTPYHTLLDRREKDNADNQRSWGTIGKIKDLKAGYMSQVISHITRLMVKYNAIIVMEDLNSRFINSRRKVDKQVYQNFERALIEKLNYLVFKDIPVEESGGLYNALQLADRFTSFRDLQKQSGFIFYIPAWNTSRIDPVTGFVNLLKPKSDNLKQARDFFGKYESICFNSKSDWFEFAFDYSNFLSGADYLKSRWTVCTHGDCRYIYDKKMNNNKGGYKKINVTKTIKELFNEYGIDYAEGDDLKEQIVSQNRTAFFSKLIECLKVTLAMRYSNGDGGRDFILSPVADENGHFFNSEEAAANRDDLPWDADANGAYNIARKGLLVLRNIDKSDSVKDWTTKISNREWLEFAQSFN

SEQ ID NO: 1721 - protein, 1227 aa, unidentified
  REGION 1..1227: note = Description of Unknown:uncultivated organism sequence
  REGION 1..1227: note = Category: MG79 effectors
  REGION 1..1227: note = Description: MG79-4 effector
MNDLSLFTNLYPKSKTLRFELKPVGETLENIQRSGIIERDTARAESYRKMKKTIDAFHKSFIDRALTKANLTKLDEFDALYRASADEKRTDEWKKAFDSCKQALRKEIVAYFIIQEDFSDLNKKELIRNRLKTWIDQNHSDLYFTEEFRDFTTYFTGYNENRMNMYSDQEKATAVSHRLIDENLPKFLDNIAVYNKVKASPVAERFAQVCTDMEPWLNVASLDDVFSVSYYNCTLTQLQIDAYNVLLGGWRNGDQKRQGLNEYINLYNQTHPDAKLPQMKMLYKQILSDRESISWLPAEFENASELLDVVQAFSESLKSPVENAGRILWELPGCDKSKVYVRGDALGKISAGLFGAYHVISDALGEEERVDYYALDTLQSALLAYAETTDHEMIPNGEAIKPDCISQYYVQGIQALSDALNASYSDVADLLNTAHTAEYRLSQTDKAKLKAYLDAAMEILHFLKPLYLPSDFELEKDEVFYGAFAPVYEELQPMTKLYDMVRNYATKKPFSTEKVKLNFDCSTLLDGWDVNRETQNLGVLFLRGGNYYLGIMDKRNNRILEQVEASSEEGCYQKVQYKLLPGPNKMLPKVFFSKSRIAEFAPSEEVLRIYKSGSFKKGSAFSREDCHTLIDFYKSSIQKHPEWSQFGFCFSPTETYEDISGFFREISEQGYKLSYLPVSSSYVDELVRDGKLYLFQIYNKDFSPYSKGRPNLHTMYWKALFSEENLRDVVYKLNGQAEVFYRKRSISDDDLVTHPANQPIAKKNPALAGQNSTFSYDIVKDRRYAVDKFQFHVPITMNFKAGGTARINEKVCAYLKNNPDVNIIGIDRGERHLLYVSMIDRNGRVVRDENGKYIQYSLNTITGCYRDSAGKQVAFETPYHDLLDQKERERQSARQNWDTVETIKELKEGYMSQVVHHIARLMVKYNAVVVMEDLNSGFKRSRIKVEKQVYQNFEKALIEKLNYLVFKDTPADHPGGLYHALQLTESFESFKKLTKQSGFLFYVPAWNTSKIDPVTGFVDLLKPKYTNAVAAKAFFSKFQGISFDPENDWFRFRFDYRDFTEKAGESRTEWELCTAGELRYAFNRKLNGNHGGYEQWNVTERLKTLFDRYGVDWRTGDLRKAITERTEAPFFAALVKNLQVLLAMRYSCAEDGKDFILSPVAGPDGAFFCSENGMPGLPQDADANGAYNIARKGLWVLRQIDRAESFNDWTTKVQNAQWLTFVQELTP

SEQ ID NO: 1722 - protein, 1233 aa, unidentified
  REGION 1..1233: note = Description of Unknown:uncultivated organism sequence
  REGION 1..1233: note = Category: MG79 effectors
  REGION 1..1233: note = Description: MG79-5 effector
MKDLSTFISQYDVSKTLRFELIPTPETEKHIREKGILDADEKLAVSYKRMKETMDEFHKDFIDRALSTAQLRHIDEYCALYWADAEEKNSKKYADRLKAASAELRKEIVQCFDADDAFKKIDKKEFIKDELETWINEKHPMLYYDPDFKKFTTYFEGYRKNRMNLYSDEEKVGSVAYRLIGENLPKFLDNIRIYEKVKASKVAGKFSKLCKDMEQYMNGRSLDEMFSARAYPSTLTQTQIDQYNTVIGGRNDGSSKLQGLNEYINLYNQQHPDAKLPIFKMLYKQLLSDRISASWLPEAFDSAQALFDGVEAFAQEVLTDTVLNDLQTVLNELPERDAALIYVRKSSVNDISSRLFGYYSVFNDALDAMGENEKTGYISLARLQSAVDGYIPTLDKDEYESIVSEYAPNCVTACFFDNLHEYIENISDAYEALRPCFGVEHDENYQLSEKERTWLKAYLDGVIALLHFIKPLYIDKDFALEKDEVFYSDFMPLYEKLSQVTKLYDKVRSFASKKPYSTKKIKLNFGCSTLLSGWDVNKETQNLGVLLIKDGNYYLGIMDKANNKLFSDAPECQSEDCYQKVVYKLLQEPYKMLPKVFFSKSRINEFAPSEEIISIRINETFKKGPKFIAADCHKLVDFYKTSISKHPDWRRFEFKFSPTGTYVDINDFYQEVAEQGYKLFFKPVSTAYIDSAVSEGKLYLFRIYNKDFSPSAKGKPNLHTMYWKALFDEKNLADVVYKLSGHGEVFYRSRSIDDEKRVIHPANKPIDKRNSGMSGETSVFDYDIIKDRRYTVDKFQFHVPISLNFKAHGVSNFNEKVCTYLKNNPDVNIIGIDRGERNLLYISMIDRSGRVVKDSRGNYIQYSLNTITGEYKNADGAPVKFSTPYHELLDKKEKNRREARENWGDIESIKELKAGYMSQVVYHISRLMVEYNAIVVMEDLNSGFKNGRKKVEKQVYQNFEKALIEKLNYLVFKDYPVDTCGGLYRALQLTDKFKSFGMLTKQTGFLFYVPAWNTSKIDPVTGFVDMLKPKYKSIPDARVFFSKFNYIRYNDQKDWFEFSFDYGNFTDRADGTKTDWTLCTYGSLRYAYNKSLNNGHGGYEKWNVTDKLKALFSANGIEYADGKDLKTKITAQNKADFYAILVKCLQVTLAMRYSSVEDGKDFILSPVADENGVFFCSEGRNDGLPQDADANGAYNIARKGLCVLEHIDVAEKYSDWSTKISNKEWLNFVQTRA

SEQ ID NO: 1723 - protein, 1316 aa, unidentified
  REGION 1..1316: note = Description of Unknown:uncultivated organism sequence
  REGION 1..1316: note = Category: MG80 effectors
  REGION 1..1316: note = Description: MG80-1 effector
MSRATGGGGAFESLMNMLKRRRIWGMGIFDKFVRQYSLSKTLRFELKPVGKTLENMRNHLGFDEKLQTFFADQEIKDAYMTLKPIFDSIHEKFITESLASSVAKKINFLEYFKKYKNRKELGEKEFQNIEKQLRTKFNDAYIEAAESLRKKAGKDEKGKYVLRDASYKVLTEQGILKYIAKNTVEFGNIESREKIDHALKAFEGFFTYFGGFNQNRENYYETGKEASTAVATRVVHENLPKFCDNVLFFEAHTDGYKQIHGYLKKKGRNLVNKKGVTLFPIAKDVFEISYFSKCLSQNEIETYNDAIGNANFLINLYNQALSEGKKSLPLPFFKTLFKQIGCGKRDALFFTITHDTKADANKARVKKAEAFSVEEVLELAAGAGEKYFSGTSDDGMINTVPEFLEHLRHRTDYRGIYWKRAAVNTVAGKYFAGWVDIKEHLLKEKVFHKNSGSGEIVVPEVVELNGLFKALSKVENWKNILFKPSIIKEKDQGKIIERSQYVSQAVLGLVERDIELRKSEFLAGSFAVLSSKRYKKPNEIEKIKSWMDGGLAVIQMLKYFDVRENKAKGDPIDSMLSEGLNNLVRAKDAPWFMWYDGLRNYLTRKPQEGTKDNKLKLNFENSTLGDGWDVNKEPDNYCVLLQDSNKHYFLAVITRQKDIKGYNKIFVKDEQNELFSTRGSNEWKKIEYKLLPGPNKMLPKCLLPGNNRTKYGATETVLDIYDKGGFKKNESSFSPSSLGKIIDFYKEALKKYEDWRCFNFSFKETASYKDISQFYLDVERQGYKLDMIDINKSVLDHWVDEGMIYLFAINNQDYNRGKRVGHKNNLQTTYWNAIFKILENRPKLNGGAEIFYRRALASDQLEKVSDKDSNLKHFRFSKEKFMFHVPITLNPTLKNPRMNNLINDTLKKQKDVNFLGIDRGEKHLAYYSLIDRNGNIKEQGTLNMPFLDKQGKQRIIKADKRTIGEDEKEQIKIVDCKDYNDLLDARAGDRDYARLNWQAIRTIKELKDGYISQVVRKICDLAIQHNALIILEDLNTGFKRGRQKIEKSVYQKLELALAKKLNFLVDKNAKIGELGSVTNALQLTPLISNFGDIENRKQVGIMLYVRANYTSQTDPITGWRRSIYLKNGSEKSIKEQILKYFTDFGFKDDDYYFTYKDENKNWTLFSGTKGKGLDRFRRRMGLKKDTWTIEKQDIVKILDEVFIGFDKERSFYSQIKAGKELHGWGNLRFAIEMIQQIRNTGTTDADDDFIVSPVRDATGNHFDSRRAKKNQPDSGDANGAYNIARKGIMMLDRIASDENPYIRDSEWDAWLSKNSR

SEQ ID NO: 1724 - protein, 741 aa, unidentified
  REGION 1..741: note = Description of Unknown:uncultivated organism sequence
  REGION 1..741: note = Category: MG81 effectors
  REGION 1..741: note = Description: MG81-1 effector
MPIISPGNQESNADGAIELRIAADIDETTGCTFSATGLPDGLEFERKKFEDDEEHTWQTGRIIGTPKRAGIYQVTVTAIDKAGTKTTASFVWTVCAMRAYRFALDLSDPQITAMQQHAGTARWAYNKALEAKVNAHRAYTERLKALLASGLTPQQAKAQMKKESAALKAQTAIWEHHRQCLTAMNLGRALPAKTPRGPQELIDDLAAIRAMVPDGVDPALLTLVGNWKGQPPTALCWARDRHEARQKWIKTHLVMARQTVTHLKQQLFDLGDTIPNMIENLANWRNTRDLPKEEGGSPWWQEVSSYVFSGGMGRADAAWSNWLKSLSGQRAGKAVGYPRFKKRGQCADSFPLFHDVTNPSIRIEGYRHLRLPNIGEVRVHNSGHRSGTRNRVTATNAKGVKRTVSGQSKGRLGSTKRLVRMIERGDAIVQSVTVVRGGHRWYANVLVKLTPEAMRQREMVARAHQKVSKKRAQGRGNVGVEWGVRTLATLSNGESFANPKPGKKNQRRLRVASQKVSRKPHKRGQPISANRAAAIRQLGRVHHEIAETRKGNHHQISAAISLGYRGVAVRGLDVKSMTKSAKGTVEKPGKHVKVKSTFNRAALDAAPGMLQNQISYKTTQYGAKFGVAPKDLPSSQTCSACGWRDPSIPLTQMTFRCGNVECGKKIDREVNAARNIRNSVFPVASDSGDTLNACVDGIGPPGSRGQPSPKQEDPEPHPPPEDGPAEGHSGEAIPRRSHTPG

SEQ ID NO: 1725 - protein, 607 aa, unidentified
  REGION 1..607: note = Description of Unknown:uncultivated organism sequence
  REGION 1..607: note = Category: MG81 effectors
  REGION 1..607: note = Description: MG81-3 effector
MPTEPRLIQKAYKFALDPTPTQARAFASHAGGARFAYNWGISTYAAALDARKAQTDAGQDPTVDVPNHFALCKAWTQYKDTYRLTGDPDGRPVHWVEDNFVGTYQAALRDAHGAWQKMWDSRNGQRKGRAVGRPRFKKKGRSPDSFQMHGDSLRLDSGRALRPADATARKPLNRAERAKLAPTPGMTPTERSAAQKRLRAGRKARAGHVHGPQVSQSGTIYVNLPKVGPVRVPGRVRIPQVTPSVAGWVDRNSRTARKLLRQLAKAATTGPVVCPTCAGTGTVTVTTKKGERRDTKCGKYHPTVRPEDKLPGCQGKGKVEPARIVRATISRGASGTWWCSITTEQVITVPVITTRRPAHPTRRQLADGSIGVDLGVKYLAVLSTGDTYMNSRFLDSALTDLKRMQKVLSRTAKDSHRRLKARRRVGTLHEQVALMRRDATNRVTTELARKYATISVEGWDAQRLAELGSKDLPKRLRRNRNRALADAAPGMLRWQLEYKTSWYGSTLFKGEPHWETGRICSVCGTARTKPVPLAEEQFRCPQGHVLPRRVNSARVMDRVARGLVAAPATPEPRGGDVRPATPRRGGPSPAKRVARSRKRGKTGTPDP

SEQ ID NO: 1726 - protein, 632 aa, unidentified
  REGION 1..632: note = Description of Unknown:uncultivated organism sequence
  REGION 1..632: note = Category: MG81 effectors
  REGION 1..632: note = Description: MG81-4 effector
MTTETVMQQLAFKVALDPTPRQARAMGSHAGGARFAYNWGIARIAEALKQREAERQAGGEPTTPVPDHFALCKLWTQWKDTAEWVDRATGEVTRGVPWVAENFVGTYQAALRDAARAWANYFDSRTGQRAGRAIGKPRFKSKRTARKSFQVHGSSLRLVSAVKVNLPKIGTVTVMSDDSRHPAMARSRRRVPGQRHMGNRRRSRQLWQRLRHGQALAERAAEILSAAYADGNPDRVLEHLTALADERARARAVAAAEERLQKAKAAAAKAKPEKREKAQQRVAQAEEALRRAQAITANRKDGWSARKLAEVCRTGLITPVQAADLAEVFGLGEQQRAALAEAALQPRLVKATVTLGADGLWWLSLSAEVPVRVRTSPSRRQRERGATGLDLGVRNVVTSSKRLGGDQNLPNPRYLEQALVELRAAQKHLSRCTPGSARHAKAKARVGLIHADVARLREQHHHRLSTRLVRTFAGIAVEGYDLQELARRGSEGLPGEVRRRRNRALADTGAGMLRQQLQYKTARYGSHLVVAEPDAPTGRTCATCGQAKAKPVPPYHEVFACEACGRTRPRRLNTALALEAVAASSGSPHGGSDQPRGEDVRPAASRRGGQSSMKRAARSRPPGRGQTGTPGP

SEQ ID NO: 1727 - protein, 545 aa, unidentified
  REGION 1..545: note = Description of Unknown:uncultivated organism sequence
  REGION 1..545: note = Category: MG81 effectors
  REGION 1..545: note = Description: MG81-5 effector
MATTDKKDKDREKLRAYKFRLDPNQAQTTALYQAVGAARYTYNMLTAYNSEVNRLRDDYWKKRHDEGISDADIKKELKALAKEDKRYKQLKYGAFSTQYLTPERDRHKDAALRIKNGEDPSVVWNQETERSANPWLHTVNRRVLVSGLQNASDAWDNFWDSRMGKRAGRLVGTPRFKKKGVSRDSFTVPAAKEKEKMGAYGAAYLRGEPAYKQGRRKITDYRHVRLSYLGTIRTFNSTKPLVKAVAAGAKIRSYTVSRNADRWYVSFLVKFSEPIRRSATKRARAAGSVGVDLGVKYLASLSDSEAPQRFPNLKFVEGLPSLENPRWSGTSSRRLRKLQRALARSQKGSNRRSRLVKQIARLHHMTALRRESNLHQLTKKLATGYTLVGFEDLNVSGMTASAKGTVENPGKNVAQKSGLNRVVLDAAFGVFRNQLEYKAVWYGSAFEKVNRYFASSQTCSECGRKAKTKLTLRDRVFDCVYCGNMMDRDFNAAVNICREAQRLFDEKLASEDGESLNGRGSRGALRGAKTVEASRPPASHRRGSP

SEQ ID NO: 1728 - protein, 512 aa, unidentified
  REGION 1..512: note = Description of Unknown:uncultivated organism sequence
  REGION 1..512: note = Category: MG81 effectors
  REGION 1..512: note = Description: MG81-6 effector
MPTKQKEDSNRCVLTLPLLTEPWQEHIIEKRFKIIEHLKNQLISIELRKLKKLQRTKAYKNLIKQIESVPKSERTALYKERNKMLKDAGFSQYTFMDDMAGKKSLMQKHFESHINVQIAHKAAIDVWSSFEKFLFGTGQIVHYQKRGTLSSVASKSPKTGMFYYSDENIFKWSGGGTKPKGGIILCLRVASVKTNYEKEMVANNEIKYYRVVRKWMKTKYKYYLQITFAGKPADKHREISTGRVGIDIGTQTIAIASDKSVKLLELADKVNKNHIKKCELQRKLDRSRRYTNPDNFNPDGTVKRGTKGHKLKWNKSKHYIEIAGKIRELERKNADIRKYQHTCLANDILAMGNQIYIEPMNYKGLQKRAKETQVDEKGRYKKKKRFGKSLANKAPAMFVTILKTKAEQHGGEVYEVDIMSYRASQCDHTTGEYTKHGLNDRWRILGNGDKVQRDLYSAFLIKNSNKTHDEIDLDKCSKTYDNFKKLHDTEIENIRNEVKLRERKNISSYGIA

SEQ ID NO: 1729 - protein, 512 aa, unidentified
  REGION 1..512: note = Description of Unknown:uncultivated organism sequence
  REGION 1..512: note = Category: MG81 effectors
  REGION 1..512: note = Description: MG81-7 effector
MPAKQKEGGNRCVLTLPLLTELWQEHIIEKRFKIIEHLKNQLISIELRKLKNLQRTKAYKNLIKQIESVPKSERTVLYKERNKMLKDAGFSQYTFMDDMAGKKSLMQKHFESHINVQIAHKAAIDVWSSFEKFLFGTGQIVHYQKRGTLSSVASKSPKTGMFYYSDENIFKWSGGGTKPKGGIILCLRVASVKTNYEKEMVANNEIKYYRVVRKWMKTKYKYYLQITFAGKPADKHREISTGRVGIDIGTQTIAIASDKSVKLLELADKVNKNHIKKCELQRKLDRSRRYTNPDNFNPDGTVKRGTKGHKLKWNKSKHYLEIAGKIRELERKNADIRKYQHTCLANDILAMGNQIYIEPMNYKGLQKRVKETQVDEKGRYKKKKRFGKSLANKAPAMFVTILKTKAEQHGGEVYEVDIMSYRASQCDHTTGEYTKHGLNDRWRILGNGDKVQRDLYSAFLIKNSNKTHDEIDLDKCSKTYDNFKKLHDKEIENIRNEVILRKRRNISSYGIA

SEQ ID NO: 1730 - protein, 512 aa, unidentified
  REGION 1..512: note = Description of Unknown:uncultivated organism sequence
  REGION 1..512: note = Category: MG81 effectors
  REGION 1..512: note = Description: MG81-8 effector
MPTKQKEDSNRCVLTLPLLTEPWQEHIIEKRFKIIEHLKNQLISIELRKLKKLQRTKAYKNLIKQIESVPKSERTALYKERNKMLKDAGFSQYTFMDDMAGKKSLMQKHFESHINVQIAHKAAIDVWSSFEKFLFGTGQMIHYQKRGTLSSVASKSPKTGMFYYSDENIFKWSGGGTKPKGGIILCLRVASVKTNYEKEMVANNEIKYYRVVRKWMKTKYKYYLQITFAGKPADKHREISTGRVGIDIGTQTIAIASDKSVKLLELADKINKNHIKKCELQRKLDRSRRYTNPDNFNPDGTVKRGTKGHKLKWNKSKHYIEIAGKIRELERKNADIRKYQHTCLANDILAMGNQIYIEPMNYKGLQKRAKETQVDEKGRYKKKKRFGKSLANKAPAMFVTILKTKAEQHGGEVYEVDIMSYRASQCDHTTGEYTKHGLNDRWRILGNGDKVQRDLYSAFLIKNSNKTHDEIDLDKCSKTYDSFKKLHDKEIENIRNEVKLRERKNISSYGIA

SEQ ID NO: 1731 - protein, 512 aa, unidentified
  REGION 1..512: note = Description of Unknown:uncultivated organism sequence
  REGION 1..512: note = Category: MG81 effectors
  REGION 1..512: note = Description: MG81-9 effector
MPTKQKEGGNRCVLTLPLLTEPWQEHIIEKRFKIIEHLKNQLISIELRKLKNLQRTKAYKNLIKQIESVPKSERTALYKERNKMLKDAGFSQYTFMDDMAGKKSLMQKHFESHINVQIAHKAAIDVWSSFEKFLFGSGQMIHYQKRGTLSSVASKSPKTGMFYYSDENIFKWSGGGTKPKGGIILCLRVASVKTNYEKEMVANNEIKYYRVVRKWMKTKYKYYLQITFAGKPADKHREISTGRVGIDIGTQTIAIASDKSVKLLELADKVNKNHIKKCELQRKLDRSRRYTNPDNFNPEGTVKRGTKGHKLKWNKSKHYIEIAGKIRELERKNADIRKYQHTCLANDILAMGNQIYIEPMNYKGLQKRAKETQVDEKGRYKKKKRFGKSLANKAPAMFVTILKTKVEQHGGEVYEVDIMSYRASQCDHTTGEYTKHGLNDRWRILGNGDKVQRDLYSAFLIKNSNKTHDEIDLDKCSKTYDNFKKLHDKEIENIRNEVKLRERKNISSYGIA

SEQ ID NO: 1732 - protein, 512 aa, unidentified
  REGION 1..512: note = Description of Unknown:uncultivated organism sequence
  REGION 1..512: note = Category: MG81 effectors
  REGION 1..512: note = Description: MG81-10 effector
MPTKQKEDSNRCVLTLPLLTEPWQEHIIEKRFKIIEHLKNQLISIELRKLKKLQRTKAYKNLIKQIESVPKSERTALYKERNKMLKDAGFSQYTFMDDMAGKKSLMQKHFESHINVQIAHKAAIDVWSSFEKFLFGTGQMIHYQKRGTLSSVASKSPKTGMFYYSDENIFKWSGGGTKPKGGIILCLRVASVKTNYEKEMVANNEIKYYRVVRKWMKTKYNYYLQITFAGKPADKHREISTGRVGIDIGTQTIAIASDKSVKLLELADKINKNHIKKCELQRKLDRSRRYTNPDNFNPDGTVKRGTKGHKLKWNKSKHYIEIAGKIRELERKNADIRKYQHTCLANDILAMGNQIYIEPMNYKGLQKRAKETQVDEKGRYKKKKRFGKSLANKAPAMFVTILKTKAEQHGGEVYEVDIMSYRASQCDHTTGEYTKHGLNDRWRILGNGDKVQRDLYSAFLIKNSNKTHDEIDLDKCSKTYDSFKKLHDKEIENIRNEVKLRERKNISSYGIA

SEQ ID NO: 1733 - protein, 512 aa, unidentified
  REGION 1..512: note = Description of Unknown:uncultivated organism sequence
  REGION 1..512: note = Category: MG81 effectors
  REGION 1..512: note = Description: MG81-11 effector
MPTKQKEDSNRCVLTLPLLTEPWQEHIIEKRFKIIEHLKNQLISIELRKLKNLPRTKAYKNLMKRIESVPKSERTALYKERNKMLKDAGFSQYTFMDDMAGKKSLMQKHFESHINVQIAHKAAIDVWSSFEKFLFGSGQMIHYQKRGTLSSVASKSPKTGMFYYPDENIFKWSGGGTKPKGGIILCLRVASVKTNYEKEMIANNEIKYYRVVRKWMKTKYKYYLQITFAGKPADKHREISTGRVGIDIGTQTIAIASDKSVKLLELADKVNKNHIKKCELQRKLDRSRRYTNPDNFNPDGTVKRGTKGHKLKWNKSKHYLEIAGKIRELERKNADIRKYQHTCLANDILAMGNQIYIEPMNYKGLQKRAKETQVDEKGRYKKKKRFGKSLANKAPAMFVTILKTKAEQHGGEVYEVDIMSYRASQCDHTTGEYTKHGLNDRWRILGNGDKVQRDLYSAFLIKNSNKTHDEIDLDKCSKTYDSFKKLHDKEIENIRNEVKLRERKNISSYGIA

SEQ ID NO: 1734 - protein, 512 aa, unidentified
  REGION 1..512: note = Description of Unknown:uncultivated organism sequence
  REGION 1..512: note = Category: MG81 effectors
  REGION 1..512: note = Description: MG81-12 effector
MPTKQKEDSNRCVLTLPLLTEPWQEHIIEKRFKIIEHLKNQLISIELRKLKNLQRTKAYKNLIKQIESVPKSERTVLYKERNKMLKDAGFSQYTFMDDMAGKKSLMQKHFESHINVQIAHKAAIDVWSSFEKFLFGTDQMIHYQKRGTLSSVASKSPKTGMFYYSDENIFKWSGGGTKPKGGIILCLRVASVKTNYEKEMVANNEIKYYRVVRKWMKTKYKYYLQITFAGKPADKHREISTGRVGIDIGTQTIAIASDKSVKLLELADKVNKNHIKKCELQRKLDRSRRYTNPDNFNPDGTVKRGTKGHKLKWNKSKHYLEIAGKIRELERKNADIRKYQHTCLANDILAMGNQIYIEPMNYKGLQKRAKETQVDEKGRYKKKKRFGKSLANKAPAMFVTILKTKVEQHGGEVYEVDIMSYRASQCDHTTGEYTKHGLNDRWRILGNGDKVQRDLYSAFLIKNSNKTHDEIDLDKCSKTYDSFKKLHDKEIENIRNEVKLRERRNISSYGIA

SEQ ID NO: 1735 - protein, 512 aa, unidentified
  REGION 1..512: note = Description of Unknown:uncultivated organism sequence
  REGION 1..512: note = Category: MG81 effectors
  REGION 1..512: note = Description: MG81-13 effector
MPTKQKEGGNRCVLTLPLLTEPWQEHIIEKRFKIIEHLKNQLISIELRKLKNLQRTKAYKNLIKQIESVPKSERTALYKERNKMLKDAGFSQYTFMDDMAGKKSLMQKHFESHINVQIAHKAAIDVWSSFEKFLFGSGQMIHYQKRGTLSSVASKSPKTGMFYYSDENIFKWSGGGTKPKGGIILCLRVASVKTNYEKEMVANNEIKYYRVVRKWMKTKYKYYLQITFAGKPADKHREISTGRVGIDIGTQTIAIASDKSVKLLELADKVNKNHIKKCELQRKLDRSRRYTNPDNFNPDGTVKRGTKGHKLKWNKSKHYLEVAGKIRELERKNADIRKYQHTCLANDILAMGNQIYIEPMNYKGLQKRAKETQVDEKGRYKKKKRFGRSLANKAPAMFVTILKTKAEQHGGEVYEVDIMSYRASQCDHTTGEYTKHGLNDRWRILGNGDKVQRDLYSAFLIKNSNKTHDEIDLDKCSKTYDSFKKLHDKEIENIRNEVKLRERKNISSYGIA

SEQ ID NO: 1736 - protein, 531 aa, unidentified
  REGION 1..531: note = Description of Unknown:uncultivated organism sequence
  REGION 1..531: note = Category: MG81 effectors
  REGION 1..531: note = Description: MG81-14 effector
MILLAKNNNNNNNTDTCVLTLPLRVEKWQEDCLLKRFEAARRIYNSLLNFELKKLRQLERTVEYRQIQSVISSAYRSNTKDSPECKDAFKRREKLISANGISEYGFKSDVKFFYKHFDGLIGSNVAVHCIAVQLWAAFDKYLRGSGKEIHFKRLGDISSLKGYSVKGKSGGCEIIFRGQYIEWTRKKKKLLLPLKIDPDNEYEREMLSRRVKYVRIIKKPGKNRLRWYAQLTLEGKPALKYSAETGKPIHSVGKGNVGIDIGPQTVAYASDKEVALLELADRVTNIEHQKKKLQRKLDRSRRATNPDNYKPDGTIKRGVKLTRNKSKRYLKLQSKLAYIQHRQAEIRKLQHTCLANHMLTLGDRFFVEKMNWPGLAHRAKETSISEKTGRYKRKKRFGKSLANKAPAMFISILKRKCETLGLPGVVEVDTYSLKASQYNHLSDTYEKKSLSERWNYMPISDGSDSSKTKRIQRDLYSAFLLQHTIPQPCSFDKKALRIDYPNFVTMHDAEIHRLESLPKTITSMGVRRSHS

SEQ ID NO: 1737 - protein, 512 aa, unidentified
  REGION 1..512: note = Description of Unknown:uncultivated organism sequence
  REGION 1..512: note = Category: MG81 effectors
  REGION 1..512: note = Description: MG81-15 effector
MPTKQKEDINRCVLTLPLLTEPWQEHIIEKRFKIIEHLKNQLISIELRKIKNLQRTKAYKNLIKQIESVPKSERTALYKERNKMLKDAGFSQYTFMDDMAGKKSLMQKHFESHINVQIAHKAAIDVWSSFEKFLFGTGQIVHYQKRGTLSSVASKSPKTGMFYYSDENIFKWSGGGTKPKGGIILCLRVASVKTNYEKEMVANNEIKYYRVVRKWMKTKYKYYLQITFAGKPADKHREISTGRVGIDIGTQTIAIASDKSVKLLELADKVNKNHIKKCELQRKLDRSRRYTNPDNFNPDGTVKRGTKGHKLKWNKSKHYIEIAGKIRELERKNADIRKYQHTCLANDILAMGNQIYIEPMNYKGLQKRVKETQVDEKGRYKKKKRFGKSLANKAPAMFVTILKTKAEQHGGEVYEVDIMSYRASQCDHTTGEYTKHGLNDRWRILGNGDKVQRDLYSAFLIKNSNKTHDEIDLDKCSKTYDSFKKLHDKEIENIRNEVKLRERRNISSYGIA

SEQ ID NO: 1738 - protein, 512 aa, unidentified
  REGION 1..512: note = Description of Unknown:uncultivated organism sequence
  REGION 1..512: note = Category: MG81 effectors
  REGION 1..512: note = Description: MG81-16 effector
MPTKQKEGGNRCVLTLPLLTEPWQEHIIEKRFKIIEHLKNQLISIELRKLKNLQRTKAYKNLMKRIESVPKSERTALYKERNKMLKDAGFSQYTFMDDMAGKKSLMQKHFESHINVQIAHKAAIDVWSSFEKFLFGSGQMIHYQKRGTLSSVASKSPKTGMFYYSDENIFKWSGGGTKPKGGIILCLRVASVKTNYEKEMVANNEIKYYRVVRKWMKTKYKYYLQITFAGKPADKHREISTGRVGIDIGTQTIAIASDKSVKLLELADKVNKNHIKKCELQRKLDRSRRYTNPDNFNPDGTVKRGTKGHKLKWNKSKHYIEIAGKIRELERKNADIRKYQHTCLANDILTMGNQIYIEPMNYKGLQKRAKETQVDEKGRYKKKKRFGKSLANKAPAMFVTILKTKAEQHGGEVYEVDIMSYRASQCDHTTGEYTKHGLNDRWRILGNGDKVQRDLYSAFLIKNSNKTHDEIDLDKCSKTYDSFKKLHDKEIENIRNEVILRERRNISSYGIA

SEQ ID NO: 1739 - protein, 512 aa, unidentified
  REGION 1..512: note = Description of Unknown:uncultivated organism sequence
  REGION 1..512: note = Category: MG81 effectors
  REGION 1..512: note = Description: MG81-17 effector
MPTKQKEGGNRCVLTLPLLTEPWQEHIIEKRFKIIEHLKNQLISIELRKLKKLQRTKAYKNLIKQIESVPKSERTVLYKERNKMLKDAGFSQYTFMDDMAGKKSLMQKHFESHINVQIAHKAAIDVWSSFEKFLFGTGQIVHYQKRGTLSSVASKSPKTGMFYYSDENIFKWSGGGTKPKGGIILCLRVASVKTNYEKEMVANNEIKYYRVVRKWMKTKYKYYLQITFAGKPADKHREISTGRVGIDIGTQTIAIASDKSVKLLELADKVNKNHIKKCELQRKLDRSRRYTNPDNFNPDGTVKRGTKGHKLKWNKSKHYLEVAGKIRELERKNADIRKYQHTCLANDILAMGNQIYIEPMNYKGLQKRAKETQVDEKGRYKKKKRFGKSLANKAPAMFVTILKTKAEQHGGEVYEVDIMSYRASQCDHTTGEYTKHGLNDRWRILGNGDKVQRDLYSAFLIKNSNKTHDEIDLDKCSKTYDSFKKLHDKEIENIRNEVILRKRRNISSYGIA

SEQ ID NO: 1740 - protein, 530 aa, unidentified
  REGION 1..530: note = Description of Unknown:uncultivated organism sequence
  REGION 1..530: note = Category: MG81 effectors
  REGION 1..530: note = Description: MG81-18 effector
MILLANNNNNNNTDTCVLTLPLRVEKWQEDCLLKRFEAARRIYNSLLNFELKKLRQLERTVEYRQIQSVISSAYRSNTKDSPECKDALKRREKLISANGLAEYGFKSDVKFFYKHFDGLIGSNVAVHCIAVQLWAAFNKYLSGSGKEIHFKRLGEISSLKGYSVKGKSGGREIIFRGQYIEWTRKKKKLLLPLKIDPDNEYEREMLSRRVKYVRIIKKPGKNRLRWYAQLTLEGKPALKYSAETGKPIHSVGKGNVGIDIGPQTIAYASDKEVALLELADRVTNIEHQKKKLQRKLDRSRRATNPDNYKPDGTIKRGVKLTRNKSKRYLKLQSKLAYIQHRQAEIRKLQHTCLANHMLTLGDRFFVEKMNWSGLAHRAKETSISEKTGRYKRKKRFGKSLANKAPAMFISILKRKCETLGLPGVVEVDTYSLKASQYNHLSDTCEKKSLSERWNYMPISDGSDSSKTKRIQRDLYSAFLLQHTIPQPCSFDKEALRIDYPKFVIMHDAEIHRLESLPKTVTSMGVRRSHS

SEQ ID NO: 1741 - protein, 512 aa, unidentified
  REGION 1..512: note = Description of Unknown:uncultivated organism sequence
  REGION 1..512: note = Category: MG81 effectors
  REGION 1..512: note = Description: MG81-19 effector
MPTKQKEGGNRCVLTLPLLTEPWQEHIIEKRFKIIEHLKNQLISIELRKLKKLQRTKAYKNLIKQIESVPKSERTVLYKERNKMLKDAGFSQYTFMDDMAGKKSLMQKHFESHINVQIAHKAAIDVWSSFEKFLFGTGQIVHYQKRGTLSSVASKSPKTGMFYYSDENIFKWSGGGTKPKGGIILCLRVASVKTNYEKEMVANNEIKYYRVVRKWMKTKYKYYLQITFAGKPADKHREISTGRVGIDIGTQTIAIASDKSVKLLELADKVNKNHIKKCELQRKLDRSRQYTNPDNFNPDGTVKRGTKGHKLKWNKSKHYLEVAGKIRELERKNADIRKYQHTCLANDILAMGNQIYIEPMNYKGLQKRAKETQVDEKGRYKKKKRFGKSLANKAPAMFVTILKTKAEQHGGEVYEVDIMSYRASQCDHTTGEYTKHGLNDRWRILGNGDKVQRDLYSAFLIKNSNKTHDEIDLDKCSKTYDSFKKLHDKEIENIRNEVILRKRRNISSYGIA

SEQ ID NO: 1742 - protein, 512 aa, unidentified
  REGION 1..512: note = Description of Unknown:uncultivated organism sequence
  REGION 1..512: note = Category: MG81 effectors
  REGION 1..512: note = Description: MG81-20 effector
MPTKQKEGGNRCVLTLPLLTEPWQEHIIEKRFKIIEHLKNQLISIELRKLKKLQRTKAYKNLIKQIESVPKSERTVLYKERNKMLKDAGFSQYTFMDDMAGKKSLMQKHFESHINVQIAHKAAIDVWSSFEKFLFGTGQIVHYQKRGTLSSVASKSPKTGMFYYSDENIFKWSCGGTKPKGGIILCLRVASVKTNYEKEMVANNEIKYYRVVRKWMKTKYKYYLQITFAGKPADKHREISTGRVGIDIGTQTIAIASDKSVKLLELADKVNKNHIKKCELQRKLDRSRRYTNPDNFNPDGTVKRGTKGHKLKWNKSKHYLEVAGKIRELERKNADIRKYQHTCLANDILAMGNQIYIEPMNYKGLQKRAKETQVDEKGRYKKKKRFGKSLANKAPAMFVTILKTKAEQHGGEVYEVDIMSYRASQCDHTTGEYTKHGLNDRWRILGNGDKVQRDLYSAFLIKNSNKTHDEIDLDKCSKTYDSFKKLHDKEIENIRNEVILRKRRNISSYGIA

SEQ ID NO: 1743 - protein, 512 aa, unidentified
  REGION 1..512: note = Description of Unknown:uncultivated organism sequence
  REGION 1..512: note = Category: MG81 effectors
  REGION 1..512: note = Description: MG81-21 effector
MPTKQKEDSNRCVLTLPLLTEPWQEHIIEKRFKIIEHLKNQLISIELRKLKKLQRTKAYKNLIKQIESVPKSERTALYKERNKMLKDAGFSQYTFMDDMAGKKSLMQKHFESHINVQIAHKAAIDVWSSFEKFLFGTGQIVHYQKRGTLSSVASKSPKTGMFYYSDENIFKWSGGGTKPKGGIILCLRGASVKTNYEKEMVANNEIKYYRVVRKWMKTKYKYYLQITFAGKPADKHREISTGRVGIDIGTQTIAIASDKSVKLLELADKVNKNHIKKCELQRKLDRSRRYTNPDNFNPDGTVKRGTKGHKLKWNKSKHYIEIAGKIRELERKNADIRKYQHTCLANDILAMGNQIYIEPMNYKGLQKRAKETQVDEKGRYKKKKRFGKSLANKAPAMFVTILKTKAEQHGGEVYEVDIMSYRASQCDHTTGEYTKHGLNDRWRILGNGDKVQRDLYSAFLIKNSNKTHDEIDLDKCSKTYDNFKKLHDTEIENIRNEVKLRERKNISSYGIA

SEQ ID NO: 1744 - protein, 512 aa, unidentified
  REGION 1..512: note = Description of Unknown:uncultivated organism sequence
  REGION 1..512: note = Category: MG81 effectors
  REGION 1..512: note = Description: MG81-22 effector
MPTKQKEDSNRCVLTLPLLTEPWQEHIIEKRFKIIEHLKNQLISIELRKLKKLQRTKAYKNLIKQIESVPKSERTVLYKKRNKMLKDAGFSQYTFMDDMAGKKSLMQKHFESHINVQIAHKAAIDVWSSFEKFLFGSGQMIHYQKRGTLSSVASKSPKTGMFYYSDENIFKWSGGGTKPKGGIILCLRVASVKTNYEKEMVANNEIKYYRVVRKWMKTKYKYYLQITFAGKPADKHHEVSTDRVGIDIGTQTIAIASDKSVKLLELADKVNKNHIKKCELQRKLDRSRRYTNPDNFNPDGTVKRGTKGHKLKWNKSKHYIEIAGKIRELERKNADIRKYQHTCLANDILAMGNQIYIEPMNYKGLQKRAKETQVDEKGRYKKKKRFGKSLANKAPAMFVTILKTKAEQHGGEVYEVDIMSYRASQCDHTTGEYTKHGLNDRWRILGNGDKVQRDLYSAFLIKNSNKTHDEIDLDKCSKTYDNFKKLHDKEIENIRNEVILRKRRNISSYGIA

SEQ ID NO: 1745 - protein, 528 aa, unidentified
  REGION 1..528: note = Description of Unknown:uncultivated organism sequence
  REGION 1..528: note = Category: MG81 effectors
  REGION 1..528: note = Description: MG81-23 effector
MILLTKNNNNTDTCVLTLPLRVEKWQEDCLLKRFEAARRIYNSLLNFELKKLRQLERTVEYRQIQSVISSAYRSNTKDSPECKDAFKRREKLISANGISEYGFKSDVKFFYKHFDGLIGSNVAVHCIAVQLWAAFDKYLRGSGKEIHFKRLGDISSLKGYSVKGKSGGCEIIFRGQYIEWTRKKKKLLLPLKIDPDNEYEREMLSRRVKYVRIIKKPGKNRLRWYAQLTLEGKPALKYSAETGKPIHSVGKGNVGIDIGPQTVAYASDKEVALLELADRVTNIEHQKKKLQRKLDRSRRATNPDNYKPDGTIKRGVKLTRNKSKRYLKLQSKLAYIQHRQAEIRKLQHTCLANHMLTLGDRFFVEKMNWPGLAHRAKETSISEKTGRYKRKKRFGKSLANKAPAMFISILKRKCETLGLPGVVEVDTYSLKASQYNHLSDTYEKKSLSERWNYMPISDGSDSSKTKRIQRDLYSAFLLQHTIPQPCSFDKKALRIDYPNFVTMHDAEIHRLESLPKTITSMGVRRSHS

SEQ ID NO: 1746 - protein, 512 aa, unidentified
  REGION 1..512: note = Description of Unknown:uncultivated organism sequence
  REGION 1..512: note = Category: MG81 effectors
  REGION 1..512: note = Description: MG81-24 effector
MPTKQKEDSNRCVLTLPLLTEPWQEHIIEKRFKIIEHLKNQLISIELRKLKNLQRTKAYKNLIKQIESVPKSERTVLYKERNKMLKDAGFSQYTFMDDMAGKKSLMQKHFESHINVQIAHKAAIDVWSSFEKFLFGTGQIVHYQKRGTLSSVASKSPKTGMFYYSDENIFKWSGGGTKPKGGIILCLRVASVKTNYEKEMVANNEIKYYRVVRKWMKTKYKYYLQITFAGKPADKHREISTGRIGIDIGTQTIAIASDKSVKLLELADKVNKNHIKKCELQRKLDRSRRYTNPDNFNPDGTVKRGTKGHKLKWNKSKHYIEIAGKIRELERKNADIRKYQHTCLANDILAMGNQIYIEPMNYKGLQKRVKETQVDEKGRYKKKKRFGKSLANKAPAMFVTILKTKAEQHGGEVYEVDIMSYRASQCDHTTGEYTKHGLNDRWRILGNGDKVQRDLYSAFLIKNSNKTHDEIDLDKCSKTYDSFKKLHDKEIENIRNEVKLRERKNISSYGIA

SEQ ID NO: 1747 - protein, 512 aa, unidentified
  REGION 1..512: note = Description of Unknown:uncultivated organism sequence
  REGION 1..512: note = Category: MG81 effectors
  REGION 1..512: note = Description: MG81-25 effector
MPTKQKEGGNRCVLTLPLLTEPWQEHIIEKRFKIIEHLKNQLISIELRKLKNLQRTKAYKNLIKQIESVPKSERTALYKERNKMLKDAGFSQYTFMDDMAGKKSLMQKHFESHINVQIAHKAAIDVWSSFEKFLFGTGQIVHYQKRGTLSSVASKSPKTGMFYYPDENIFKWSGGGTKPKGGIILCLRVASVKTNYEKEMVANNEIKYYRVVRKWMKTKYKYYLQITFAGKPADKHREISTGRVGIDIGTQTIAIASDKSVKLLELADKVNKNHIKKCELQRKLDRSRRYTNPDNFNPDGTVKRGTKGHKLKWNKSKHYIEIAGKIRELERKNADIRKYQHTCLANDILAMGNQIYIEPMNYKGLQKRAKETQVDEKGRYKKKKRFGKSLANKAPAMFVTILKTKAEQHGGEVYEVDIMSYRASQCDHTTGEYTKHGLNDRWRILGNGDKVQRDLYSAFLIKNSNKTHDAIDLDKCSKTYDSFKKLHDKEIENIRNEVKLRERKNISSYGIA

SEQ ID NO: 1748 - protein, 512 aa, unidentified
  REGION 1..512: note = Description of Unknown:uncultivated organism sequence
  REGION 1..512: note = Category: MG81 effectors
  REGION 1..512: note = Description: MG81-26 effector
MPTKQKEDSNRCVLTLPLLTEPWQEHIIEKRFKIIEHLKNQLISIELRKLKNLQRTKAYKNLMKRIESVPKSERTALYKERNKMLEGKGFSQYTFMDDMAGKKSLMQKHFESHINVQIAHKAAIDVWSSFEKFLFGSGQMIHYQKRGTLSSVASKSPKTGMFYYPDENIFKWSGGGTKPKGGIILCLRVASVKTNYEKEMVANNEIKYYRVVRKWMKTKYKYYLQITFAGKPADKHREISTGRVGIDIGTQTIAIASDKSVKLLELADKVNKNHIKKCELQRKLDRSRRYTNPDNFNPDGTVKRGTKGHKLKWNKSKHYLEIAGKIRELERKNADIRKYQHTCLANDILAMGNQIYIEPMNYKGLQKRAKETQVDEKGRYKKKKRFGKSLANKAPAMFVTILKTKAEQHGGEVYEVDIMSYRASQCDHTTGEYTKHGLNDRWRILGNGDKVQRDLYSAFLIKNSNKTHDEIDLDKCSKTYDSFKKLHDKEIENIRNEVKLRERKNISSYGIA

SEQ ID NO: 1749 - protein, 527 aa, unidentified
  REGION 1..527: note = Description of Unknown:uncultivated organism sequence
  REGION 1..527: note = Category: MG81 effectors
  REGION 1..527: note = Description: MG81-27 effector
MAKNNNNNNTDTCVLTLPLRVEKWQEDCLLKRFEAARRIYNSLLNFELKKLRQLERTVEYRQIQSVISSAYRSNTKDSPECKDAFKRREKLISANGISEYGFKSDVKFFYKHFDGLIGSSVAVHCIAVQLWAAFDKYLRGSGKEIHFKRLGEISSLKGYSVKGKSGGLEIIFRGQYIEWTRKKKKLLLPLKIDPDNEYEREMLSRRVKYVRIIKKPGKNRLRWYAQLTLEGKPALKYSAETGKPIHSVGKGNVGIDIGPQTVAYASDKEVALLELADRVTNIEHQKKKLQRKLDRSRRATNPDNYKPDGTIKRGVKLTRNKSKRYLKLQSKLAYIQHRQAEIRKLQHTCLANHMLTLGDRFFVEKMNWPGLAHRAKETSISEKTGRYKRKKRFGKSLANKAPAMFISILKRKCETLGLPGVVEVDTYNLKASQYNHLSDTYEKKSLSERWNYMPISDGSDSSKTKRIQRDLYSAFLLQHTIPQPCSFDKEALRIDYPNFVTMHDAEIHRLESLPKTVTSMGVRRSHS

SEQ ID NO: 1750 - protein, 512 aa, unidentified
  REGION 1..512: note = Description of Unknown:uncultivated organism sequence
  REGION 1..512: note = Category: MG81 effectors
  REGION 1..512: note = Description: MG81-28 effector
MPTKQKEDSNRCVLTLPLLTEPWQEHIIEKRFKIIEHLKNQLIFIELRKLKNLQRTKAYKNLIKQIESVPKSERTALYKERNKMLKDAGFSQYTFMDDMAGKKSLMQKHFESHINVQIAHKAAIDVWSSFEKFLFGTGQIVHYQKRGTLSSVASKSPKTGMFYYSDENIFKWSGGGTKPKGGIILCLRVASVKTNYEKEMVANNEIKYYRVVRKWMKTKYKYYLQITFAGKPADKHREISTGRVGIDIGTQTIAIASDKSVKLLELADKVNKNHIKKCELQRKLDRSRRYTNPDNFNPDGTVRRGTKGHKLKWNKSKHYIEIAGKIRELERKNADIRKYQHTCLANDILAMGNQIYIEPMNYKGLQKKAKETQVDEKGRYKKKKRFGKSLANKAPAMFVTILKTKAEQHGGEVYEVDIMSYRASQCDHTTGEYTKHGLNDRWRILGNGDKVQRDLYSAFLIKNSNKTHDEIDLDKCSKTYDNFKKLHDKEIENIRNEVKLRERKNISSYGIA

SEQ ID NO: 1751 - protein, 512 aa, unidentified
  REGION 1..512: note = Description of Unknown:uncultivated organism sequence
  REGION 1..512: note = Category: MG81 effectors
  REGION 1..512: note = Description: MG81-29 effector
MPTKQKEDSNRCVLTLPLLTEPWQEHIIEKRFKIIEHLKNQLISIELRKLKNLQRTKAYKNLIKQIESVPKSERTVLYKERNKMLKDAGFSQYTFMDDMAGKKSLMQKHFESHINVQIAHKAAIDVWSSFEKFLFGTDQMIHYQKRGTLSSVASKSPKTGMFYYSDENIFKWSGGGTKPKGGIILCLRVASVKTNYEKEMVANNEIKYYRVVRKWMKTKYKYYLQITFAGKPADKHREISTGRVGIDIGTQTIAIASDKSVKLLELADKVNKNHIKKCELQRKLDRSRRYTNPDNFNPDGTVKRGTKGHKLKWNKSKHYLEIAGKIRELERKNADIQKYQHTCLANDILAMGNQIYIEPMNYKGLQKRAKETQVDEKGRYKKKKRFGKSLANKAPAMFVTILKTKVEQHGGEVYEVDIMSYRASQCDHTTGEYTKHGLNDRWRILGNGDKVQRDLYSAFLIKNSNKTHDEIDLDKCSKTYDSFKKLHDKEIENIRNEVKLRERRNISSYGIA

SEQ ID NO: 1752 - protein, 512 aa, unidentified
  REGION 1..512: note = Description of Unknown:uncultivated organism sequence
  REGION 1..512: note = Category: MG81 effectors
  REGION 1..512: note = Description: MG81-30 effector
MPTKQKEDSNRCVLTLPLLTEPWQEHIIEKRFKIIEHLKNQLISIELRKLKNLQRTKAYKNLIKQIESVPKSERTALYKERNKMLKDAGFSQYTFMDDMAGKKSLMQKHFESHINVQIAHKAAIDVWSSFEKFLFGTGQIVHYQKRGTLSSVASKSPKTGMFYYSDENIFKWSGGGTKPKGGIILCLRVASVKTNYEKEMVANNEIKYYRVVRKWMKTKYKYYLQITFAGKPADKHREISTGRVGIDIGTQTIAIASDKSVKLLELADKVNKNHIKKCELQRKLDRSRRYTNPDNFNPDGTVKRGTKGHKLKWNKSKHYLEIAGKIRELERKNADIRKYQHTCLANDILAMGNQIYIEPMNYKGLQKRVKETQVDEKGRYKKKKRFGKSLANKAPSMFVTILKTKAEQHGGEVYEVDIMSYRASQCDHTTGEYTKHGLNDRWRILGNGDKVQRDLYSAFLIKNSNKTHDEIDLDKCSKTYDNFKKLHDKEIENIRNEVKLRERRNISSYGIA

SEQ ID NO: 1753 - protein, 531 aa, unidentified
  REGION 1..531: note = Description of Unknown:uncultivated organism sequence
  REGION 1..531: note = Category: MG81 effectors
  REGION 1..531: note = Description: MG81-31 effector
MILLANNNNNNNNTDTCVLTLPLRVEKWQEDCLLKRFEAARRIYNSLLNFELKKLRQLERTAEYRQIQSVISSAYRSNTKDSLECKDAFKRREKLISANGISENGFKSDVKFFYKHFDGLIGSSVAVHCIAVQLWAAFDKYLSGSGKEIHFKRLGDISSLKGYSVKGKSGGCEIIFRGQYVEWTRKKKKLLLPLKIDPDNEYEREMLSRRVKYVRIIKKPGKNRLRWYAQLTLEGKPALKYSAGTGKPIHSVGKGNVGIDIGPQTVAYASDKEVALLELADRVTNIEHQKKKLQRKLDRSRRATNPDNYKPDGTIKRGVKLTRNKSKRYLKLQSKLAYIQHRQAEIRKLQHTCLANHMLTLGDRFFVEKMNWPGLAHRAKETSISEKTGRYKRKKRFGKSLANKAPAMFISILKRKCETLGLPGVVEVDTYSLKASQYNHLSDTYEKKSLSERWNYMPISDGSDSSKTKRIQRDLYSAFLLQHTIPQPCSFDKEALRIDYPNFVTMHDAEIHRLESLPKTVTSMGVRRSHS

SEQ ID NO: 1754 - protein, 512 aa, unidentified
  REGION 1..512: note = Description of Unknown:uncultivated organism sequence
  REGION 1..512: note = Category: MG81 effectors
  REGION 1..512: note = Description: MG81-32 effector
MPTKQKEGGNRCVLTLPLLTEPWQEHIIEKRFKIIEHLKNQLISIELRKLKKLQRTKAYKNLIKQIESVPKSERTVLYKERNKMLKDAGFSQYTFMDDMAGKKSLMQKHFESHINVQIAHKAAIDVWSSFEKFLFGTGQIVHYQKRGTLSSVASKSPKTGMFYYSDENIFKWSGGGTKPKGGIILCLRVASVKTNYEKEMVANNEIKYYRVVRKWMKTKYKYYLQITFAGKPADKHREISTGRVGIDIGTQTIAIASDKSVKLLELADKVNKNHIKKCELQRKLDRSRRYTNPDNFNPDGTVKRGTKGHKLKWNKSKHYLEVAGKIRELERKNADIRKYQHTCLANDILAMGNQIYIEPMNYKDLQKRAKETQVDEKGRYKKKKRFGKSLANKAPAMFVTILKTKAEQHGGEVYEVDIMSYRASQCDHTTGEYTKHGLNDRWRILGNGDKVQRDLYSAFLIKNSNKTHDEIDLDKCSKTYDSFKKLHDKEIENIRNEVILRKRRNISSYGIA

SEQ ID NO: 1755 - protein, 534 aa, unidentified
  REGION 1..534: note = Description of Unknown:uncultivated organism sequence
  REGION 1..534: note = Category: MG81 effectors
  REGION 1..534: note = Description: MG81-33 effector
MILLANNNNNNNNNNNTDTCVLTLPLRVEKWQEDCLLKRFEAARRIYNSLLNFELKKLRQLERTVEYRQIQSVISSAYRSNTKDSLECKDAFKRREKLISANGISENGFKSDVKFFYKHFDGLIGSSVAVHCIAVQLWAAFDKYLSGSGKEIHFKRLGDISSLKGYSVKGKSGGLEIIFRGQYVEWTRKKKKLLLPLKIDPDNEYEREMLSRRVKYVRIIKKPGKNRLRWYAQLTLEGKPALKYSAGTGKPIHSVGKGNVGIDIGPQTVAYASDKEVALLELADRVTNIEHQKKKLQRKLDRSRRATNPDNYKPDGTIKCGVKLTRNKSKRYLKLQSKLAYIQHRQAEIRKLQHTCLANHMLTLGDRFFVEKMNWPGLAHRAKETSISEKTGRYKRKKRFGKSLANKAPAMFISILKRKCETLGLPGVVEVDTYSLKASQYNHLSDTYEKKSLSERWNYMPISDGSDSSKTKRIQRDLYSAFLLQHTIPHPCSFDKEALRIDYPNFVIMHDAEIHRLEFLPKTVTSMGVRRSHS

SEQ ID NO: 1756 - protein, 528 aa, unidentified
  REGION 1..528: note = Description of Unknown:uncultivated organism sequence
  REGION 1..528: note = Category: MG81 effectors
  REGION 1..528: note = Description: MG81-34 effector
MILLANNNNNTDTCVLTLPLRVEKWQEDCLLKRFEAARRIYNSLLNFELKKLRQLERTVEYRQIQSVISSAYRSNTKDSLECKDAFKRRKKLTDENGISEYGFKSDVKFFYKHFDGLIGSNVAVHCIAVQLWAAFDKYLSGSGKEIHFKRLGDISSLKGYSVKGKSGGCEIIFRGQYVEWTRKKKKLLLPLKIDPDNEYEREMLSRRVKYVRIIKKPGKNRLRWYAQLTLEGKPALKYSAETGKPIHSVGKGNVGIDIGPQTVAYASDKEVALLELADRVTNIEHQKKKLQRKLDRSRRATNPDNYKPDGTIKRGVKLTRNKSKRYLKLQSKLAYIQHRQAEIRKLQHTCLANHMLTLGDRFFVEKMNWPGLAHRAKETSISEKTGRYKRKKRFGKSLANKAPAMFISILKRKCETLGLPGVVEVDTYNLKASQYNHLSDTCEKKSLSERWNYMPISDGSDSSKTKRIQRDLYSAFLLQHTIPQPCSFDKEALRIDYPNFVIMHDAEIHRLESLPKTITSMGVRRSHS

SEQ ID NO: 1757 - protein, 536 aa, unidentified
  REGION 1..536: note = Description of Unknown:uncultivated organism sequence
  REGION 1..536: note = Category: MG81 effectors
  REGION 1..536: note = Description: MG81-35 effector
MANNNNNNNNNNNNNNNNTDTCVLTLPLRVEKWQEDCLLKRFEAARRIYNSLLNFELKKLRQLERTVEYRQIQSVISSAYRSNTKDSLECKDAFKRRKKLTDENGISEYGFKSDVKFFYKHFDGLIGSNVAVHCIAVQLWAAFDKYLRGSGKEIHFKRLGDISSLKGYSVKGKSGGREIIFRGQYVEWIRKKKKLLLPLKIDPDNEYEREMLSRRVKYVRIIKKPGKNRLRWYAQLTLEGKPALKYSAGTGKPIHSVGKGNVGIDIGPQTVAYASDKEVALLELADRVTNIEHQKKKLQRKLDRSRRATNPDNYKPDGTIKRGVKLTRNKSKRYLKLQSKLAYIQHRQAEIRKLQHTCLANHMLTLGDRFFVEKMNWPGLAHRAKETSFSEKTGRYKRKKRFGKSLANKAPAMFISILKRKCETLGLPGVVEVDTYNLKASQYNHLSDTYEKKSLSERWNYMPISDGSDSSKTKRIQRDLYSAFLLQHTIPQPCSFDKEALRIDYPNFVTMHDAEIHRLESLPKTVTSMGVRRSHS

SEQ ID NO: 1758 - protein, 512 aa, unidentified
  REGION 1..512: note = Description of Unknown:uncultivated organism sequence
  REGION 1..512: note = Category: MG81 effectors
  REGION 1..512: note = Description: MG81-36 effector
MPTKQKEGGNRCVLTLPLLTEPWQEHIIEKRFKIIEHLKNQLISIELRKLKNLQRTKAYKNLIKQIESVPKSERTALYKERNKMLKDAGFSQYTFMDDMAGKKSLMQKHFESHINVQIAHKAAIDVWSSFEKFLFGTGQIVHYQKRGTLSSVASKSPKTGMFYYSDENIFKWSGGGTKPKGGIILCLRVASVKTNYEKEMVANNEIKYYRVVRKWMKTKYKYYLQITFAGKPADKHREISTGRVGIDIGTQTIAIASDKSVKLLEFADKVNKNHIKKCELQRKLDRSRQYTNPDNFNPDGTVKRGTKGHKLKWNKSKHYLEVAGKIRELERKNADIRKYQHTCLANDILAMGNQIYIEPMNYKGLQKRVKETQVDEKGRYKKKKRFGKSLANKAPAMFVTILKTKAEQHGGEVYEVDIMSYRASQCDHTTGEYTKHGLNDRWRILGNGDKVQRDLYSAFLIKNSNKTHDEIDLDKCSKTYDNFKKLHDKEIENIRNEVILRERRNISSYGIA

SEQ ID NO: 1759 - protein, 528 aa, unidentified
  REGION 1..528: note = Description of Unknown:uncultivated organism sequence
  REGION 1..528: note = Category: MG81 effectors
  REGION 1..528: note = Description: MG81-37 effector
MILLTKNNNNTDTCVLTLPLRVEKWQEDCLLKRFEAARRIYNSLLNFELKKLRQLERTVEYRQIQSVISSAYRSNTKDSLECKDAFKHREKLISANGISKNGFKSDVKFFYKHFDGLIGSSVAVHCIAVQLWAAFDKYLSGSGKEIHFKRLGDISSLKGYSVKGKSGGCEIIFRGQYVEWTRKKKKLLLPLKIDPDNEYEREMLSRRVKYVRIIKKPGKNRLRWYAQLTLEGKPALKYSAETGKPIHSVGKGNVGIDIGPQTVAYASDKEVALLELADRVTNIEHQKKKLQRKLDRSRRATNPDNYKPDGTIKRGVKLTRNKSKRYLKLQSKLAYIQHRQAEIRKLQHTCLANHMLTLGDRFFVEKMNWPGLAHRAKETSISEKTGRYKRKKRFGKSLANKAPAMFISILKRKCETLGLPGVVEVDTYSLKASQYNHLSDTCEKKSLSERWNYMPISDGSDSSKTKRIQRDLYSAFLLQHTIPQPCSFDKEALRIDYPNFVIMHDAEIHRLESLPKTITSMGVRRSHS

SEQ ID NO: 1760 - protein, 526 aa, unidentified
  REGION 1..526: note = Description of Unknown:uncultivated organism sequence
  REGION 1..526: note = Category: MG81 effectors
  REGION 1..526: note = Description: MG81-38 effector
MAKKNSNDTDTCVLTLPLRVEKWQEDCLLKRFEAARRIYNSLLNFELKKLRQLERTVEYRQIQSVISSAYRSNTKDSPECKDAFKRREKLISANGISEYGFKSDVKFFYKHFDGLIGSSVAVHCIAVQLWAAFDKYLRGSGKEIHFKRLGEISSLKGYSVKGKSGGLEIIFRGQYIEWTRKKKKLLLPLKIDPDNEYEREMLSRRVKYVRIIKKPGKNRLRWYAQLTLEGKPALKYSAETGKPIHSVGKGNVGIDIGPQTVAYASDKEVALLELADRVTNIEHQKKKLQRKLDRSRRATNPDNYKPDGTIKRGVKLTRNKSKRYLKLQSKLAYIQHRQAEIRKLQHTCLANHMLTLGDRFFVEKMNWPGLAHRAKETSISEKTGRYKRKKRFGKSLANKAPAMFISILKRKCETLGLPGVVEVDTYSLKASQYNHLSDTYEKKSLSERWNYMPISDGSDSSKTKRIQRDLYSAFLLQHTIPQPCSFDKEALRIDYPNFVIMHDAEIHRLESLPKTITSMGVRRSHS

SEQ ID NO: 1761 - protein, 530 aa, unidentified
  REGION 1..530: note = Description of Unknown:uncultivated organism sequence
  REGION 1..530: note = Category: MG81 effectors
  REGION 1..530: note = Description: MG81-39 effector
MILLAKNNNNNNTDTCVLTLPLRVEKWQEDCLLKRFEAARRIYNSLLNFELKKLRQLERTVEYRQIQSVISSAYRSNTKDSPECKDAFKRREKLISANGISENGFKSDVKFFYKHFDGLIGSNVAVHCIAVQLWAAFDKYLSGSGKEIHFKRLGDISSLKGYSVKGKSGGCEIIFRGQYVEWTRKKKKLLLPLKIDPDNEYEREMLSRRVKYVRIIKKPGKNRLRWYAQLTLEGKPALKYSAETGKPIHSVGKGNVGIDIGPQTVAYASDKEVALLELADRVTNIEHQKKKLQRKLDRSRRATNPDNYKPDGTIKCGVKLTRNKSKRYLKLQSKLAYIQHRQAEIRKLQHTCLANHMLTLGDRFFVEKMNWPGLAHRAKETSISEKTGRYKRKKRFGKSLTNKAPAMFISILKRKCETLGLPGVVEVDTYSLKASQYNHLSDTYEKKSLSERWNYMPISDGSDSSKTKRIQRDLYSAFLLQHTIPHPCSFDKKALRIDYPNFVTMHDAEIHRLESLPKTITSMGVRRSHS

SEQ ID NO: 1762 - protein, 526 aa, unidentified
  REGION 1..526: note = Description of Unknown:uncultivated organism sequence
  REGION 1..526: note = Category: MG81 effectors
  REGION 1..526: note = Description: MG81-40 effector
MAKKNNNDTDTCVLTLPLRVEKWQEDCLLKRFEAARRIYNSLLNFELKKLRQLERTVEYRQIQSVISSAYRSNTKDSLECKDAFKRREKLISANGISENGFKSDVKFFYKHFDGLIGSSVAVHCIAVQLWAAFDKYLSGSGKEIHFKRLGDISSLKGYSVKGKSGGCEIIFRGQYVEWTRKKKKLLLPLKIDPDNEYEREMLSRRVKYVRIIKKPGKNRLRWYAQLTLEGKPALKYSAETGKPIHSVGKGNVGIDIGPQTVAYASDKEVALLELADRVTNIEHQKKKLQRKLDRSRRATNPDNYKPDGTIKRGVKLTRNKSKRYLKLQSKLAYIQHRQAEIRKLQHTCLANHMLTLGDRFFVEKMNWPGLAHRAKETSISEKTGRYKRKKRFGKSLANKAPAMFISILKRKCETLGLPGVVEVDTFRLRASQYNHLSDTYEKKSLSERWNYMPISDGSDSSKTKRIQRDLYSAFLLQHTIPQPCSFDKKALRIDYPNFVTMHDAEIHRLESLPKTITSMGVRRSHS

SEQ ID NO: 1763 - protein, 524 aa, unidentified
  REGION 1..524: note = Description of Unknown:uncultivated organism sequence
  REGION 1..524: note = Category: MG81 effectors
  REGION 1..524: note = Description: MG81-41 effector
MAKNNNTDTCVLTLPLRVEKWQEDCLLKRFEAARRIYNSLLNFELKKLRQLERTVEYRQIQSVISSAYRSNTKDSPECKDAFKRREKLISANGISEYGFKSDVKFFYKHFDGLIGSSVAVHCIAVQLWAAFDKYLRGSGKEIHFKRLGEISSLKGYSVKGKSGGLEIIFRGQYIEWTRKKKKLLLPLKIDPDNEYEREMLSRRVKYVRIIKKPGKNRLRWYAQLTLEGKPALKYSAETGKPIHSVGKGNVGIDIGPQTVAYASDKEVALLELADRVTNIEHQKKKLQRKLDRSRRATNPDNYKPDGTIKRGVKLTRNKSKRYLKLQSKLAYIQHRQAEIRKLQHTCLANHMLTLGDRFFVEKMNWPGLAHRAKETSISEKTGRYKRKKRFGKSLANKAPAMFISILKRKCETLGLPGVVEVDTYNLKASQYNHLSDTYEKKSLSERWNYMPISDGSDSSKTKRIQRDLYSAFLLQHTIPQPCSFDKEALRIDYPNFVTMHDAEIHRLESLPKTVTSMGVRRSHS

SEQ ID NO: 1764 - protein, 341 aa, unidentified
  REGION 1..341: note = Description of Unknown:uncultivated organism sequence
  REGION 1..341: note = Category: MG81 effectors
  REGION 1..341: note = Description: MG81-42 effector
MLPLKIDPDNEYEREMLSRRVKYVRIIKKPGKNRLRWYAQLTLEGKPALKYSAETGKPIHSVGKGNVGIDIGPQTVAYASDKEVALLELADRVTNIEHQKKKLQRKLDRSRRATNPDNYKPDGTIKRGVKLTRNKSKRYLKLQSKLAYIQHRQAEIRKLQHTCLANHMLTLGDRFFVEKMNWPGLAHRAKETSISEKTGRYKRKKRFGKSLANKAPAMFISILKRKCETLGLPGVVEVDTYNLKASQYNHLSDTYEKKSLSERWNYMPISDGSDSSKTKRIQRDLYSAFLLQHTIPQPCSFDKEALRIDYPNFVTMHDAEIHRLESLPKTVTSMGVRRSHS

SEQ ID NO: 1765 - protein, 534 aa, unidentified
  REGION 1..534: note = Description of Unknown:uncultivated organism sequence
  REGION 1..534: note = Category: MG81 effectors
  REGION 1..534: note = Description: MG81-43 effector
MILLANNNNNNNNNNNTDTCVLTLPLRVEKWQEDCLLKRFEAARRIYNSLLNFELKKLRQLERTVEYRQIQSVISSAYRSNTKDSPECKDAFKRREKLISANGISEYGFKSDVKFFYKHFDGLIGSNVAVHCIAVQLWAAFDKYLRGSGKEIHFKRLGDISSLKGYSVKGKSGGCEIIFRGQYIEWTRKKKKLLLPLKIDPDNEYEREMLSRRVKYVRIIKKPGKNRLRWYAQLTLEGKPALKYSAETGKPIHSVGKGNVGIDIGPQTVAYASDKEVALLELADRVTNIEHQKKKLQRKLDRSRRATNPDNYKPDGTIKRGVKLTRNKSKRYLKLQSKLAYIQHRQAEIRKLQHTCLANHMLTLGDRFFVEKMNWPGLAHRAKETSISEKTGRYKRKKRFGKSLANKAPAMFISILKRKCETLGLPGVVEVDTYSLKASQYNHLSDTYEKKSLSERWNYMPISDGSDSSKTKRIQRDLYSAFLLQHTIPQPCSFDKKALRIDYPNFVTMHDAEIHRLESLPKTITSMGVRRSHS

SEQ ID NO: 1766 - protein, 511 aa, unidentified
  REGION 1..511: note = Description of Unknown:uncultivated organism sequence
  REGION 1..511: note = Category: MG81 effectors
  REGION 1..511: note = Description: MG81-44 effector
MKKSNTDTCCLTLPLKLEKWQEDRLAKRFEIARQIYNTMVHAELKKLRNIENSQPYRQIQKQIEALNWKNQNDKARLKSLYNDRNKLLNTIGFSEYGFKADIKYYYKHFNDNIGSSVAVHGIAPQVWAAFEKMLFHKEGKKVHYKKKDDIHSLHGYSVTGKSGGVEIIFRKTYIEWKGLKLPLKRSPDNAYETEMLGRRVKYVRLLRKPGKRKDCWYAQLSLEGKPAIKRDPESGKRRHSIGRGAVGLDIGPQTLAYSACGAADLVELADQVQNIEQMKRRLQRKLDRSRRATNPDNYADNGTIRRGVKLTHNKSNRYRRTQRELRYLQHCQAEIRKRQHIELANHLLALGDCFYVEDMAWPSLTHRAKETAISEKTGRIKRKKRFGKSVANKAPATLIGILEQKCNSLGLPGVMKVPTSLRASQYNHQSGEYTSKPLSQRWNNMPDGERIQRDLYSAFLLQHYDPKAGNFDSALLQQDYPQFVQYHHRAIQRLSTVPKTLSSMGIQRSLR

SEQ ID NO: 1767 - protein, 512 aa, unidentified
  REGION 1..512: note = Description of Unknown:uncultivated organism sequence
  REGION 1..512: note = Category: MG81 effectors
  REGION 1..512: note = Description: MG81-45 effector
MPTKQKEDSNRCVLTLPLLTEPWQEHIIEKRFKIIEHLKNQLISIELRKFKNLQRTKAYKNLIKQIESVPKSERTVLYKERNKMLKDAGFSQYTFMDDMAGKKSLMQKHFESHINVQIAHKAAIDVWSSFEKFLFGSGQMIHYQKRGTLSSVASKSPKTGMFYYSDENIFKWSGGGTKPKGGIILCLRVASVKTNYEKEMVANNEIKYYRVVRKWMKTKYKYYLQITFAGKPADKHREISTGRVGIDIGTQTIAIASDKSVKLLELADKVNKNHIKKCELQRKLDRSRRYTNPDNFNPDGTVKRGTKGHKLKWNKSKHYLEIAGKIRELERKNADIRKYQHTCLANDILAMGNQIYIEPMNYKGLQKRAKETQVDEKGRYKKKKRFGKSLANKAPAMFVTILKTKVEQHGGEVYEVDIMLYRASQCDHTTGEYTKHGLNDRWRILGNGDKVQRDLYSAFLIKNSNKTHDEIDLDKCSKTYDNFKKLHDKEIENIRNEVKLRERKNISSYGIA

SEQ ID NO: 1768 - protein, 530 aa, unidentified
  REGION 1..530: note = Description of Unknown:uncultivated organism sequence
  REGION 1..530: note = Category: MG81 effectors
  REGION 1..530: note = Description: MG81-46 effector
MILLAKNNNNNNTDTCVLTLPLRVEKWQEDCLLKRFEAARRIYNSLLNFELKKLRQLERTVEYRQIQSVISSAYRSNTKDSPECKDAFKRREKLISANGISEYGFKSDVKFFYKHFDGLIGSSVAVHCIAVQLWAAFDKYLSGSGKEIHFKRLGDISSLKGYSVKGKSGGREIIFRGQYIEWTRKKKKLLLPLKIDPDNEYEREMLSRRVKYVRIIKKPGKNRLRWYAQLTLEGKPALKYSAGTGKPIHSVGKGNVGIDIGPQTVAYASDKEVALLELADRVTNIEHQKKKLQRKLDRSRRATNPDNYKPDGTIKRGVKLTRNKSKRYLKLQSKLAYIQHRQAEIRKLQHTCLANHMLTLGDRFFVEKMNWPGLAHRAKETSISEKTGRYKRKKRFGKSLANKAPAMFISILKRKCETLGLPGVVEVDTYSLKASQYNHLSDTYEKKSLSERWNYMPISDGSDSSKTKRIQRDLYSAFLLQHTIPQPCSFDKEALRIDYPNFVTMHDAEIHRLESLPKTVTSMGVRRSHS

SEQ ID NO: 1769 - protein, 1338 aa, unidentified
  REGION 1..1338: note = Description of Unknown:uncultivated organism sequence
  REGION 1..1338: note = Category: MG81 effectors
  REGION 1..1338: note = Description: MG81-47 effector
MKFSKYEHKSAAVVLKNSAAEKRVSDNVEGILFPLQKETLDNYVEKRIDKVQEKYAVLVNAKISKKDKEEKTKEEAIKYFNEFMDYLFVKWHDREQGVSAKTAKNKEQLKKLVEKLVKFLRNKGRDNLYIGKRKTKIKDINLELSDESVHELVRTKIRGSLRKNFCYKVSGKTAVCYLPDVIGKLMKIVCVESDFVSGMRRIPKEELEKTFLIIATEYNKKIKEDNVVKSIQNQNVRVQVFYEEGEARLELANARHRKKKCIFDLQRRFALGDQNERKKILCELAKLIILFTAGTDVYHKIKNRDIPLWNFNFLDDVLTEETKIFHQECVDIINNRDQIQDKLKKQDEESIEKEKNIRKVNNFNKEIRKGIYQKIRSRYQEYKKLKGNELPDESEFWIEEIERDIEGMFLKDKKRWIRQEELDVKRMCGRLWEKRIEYLRSKYVDIGKGVYHFAMPDLHNLIEKKEIKIGEVQPEFQKGITSFDYERIKAEENLERSFIIYITFAVNNFARAVYPPTFYKKNGNEDILQIKDPETIRESRHGDAGRRIMQFFGGVSQWKEVLGISENIPSDYTEKLIVDIQKAMNQIRNVSFHYASSFPKRVYEEDSPLIKIFNKEREGLSKLYCEKIFSNNVPKFYKINDITKLMDHLYEDTKVDLEAQIPSFKKVLSPGKFIEQINDFVDKEAYENLNEKDIFHHALYYTLKQIYYNCFIKSENLKEKFIEALNEMKKNPQDDTEKWALNSLCKRIDEYEKNISFGNLCQRIMTDYALQNSEMKVQIDKDNSKTDKKYEHFIMLLYKGIRKIFISYYNGEWEGSGEKFDYDFLKKPEFNAEDKEISKEEFCAQWEKELYSDLASEKEGWIISWFIVAHFMTPTHVNHLRGEIKGYFGYVNGIENRRYNIMKKSRPIDEEIKKRYEKVLKVLNLASEYCGLVSAKWEDYYSDENDFAEDIRKYVQYENQEPDKSQQEQLKQFCSKTAADSPSGYINIYEAGGVPIVNRNIIHAKMYGTEKLLSKCFTDDRITEEEIRDFYKKRKELEELFRKGICKEKEEEESKRKYQQKKNRIELQDIQKYSDILNDLMSQLISWCYLRERDKMYFQLGLHYIRLYHDKEKKIVEESSKLRVLKRYDEDHAAEIQIISDGALLYQLAAIYTYELPIFEIQNRGMAKIVSSTQNGSMISASERVFRKKYLGENKSKNSLLEVGMELFENKKKEKFIREYRNYLDHFKYYARNDMSMMELYNKMFFLFFSNDIKLRKSVTVVFRNILARHFVLSKLVFCKESSIEGGKRFVLKDNLKSKTTTHKPEKNIEFEVDYYDEHFLKRLQKILEYKTKIMDEK

SEQ ID NO: 1770 - protein, 538 aa, unidentified
  REGION 1..538: note = Description of Unknown:uncultivated organism sequence
  REGION 1..538: note = Category: MG81 effectors
  REGION 1..538: note = Description: MG81-48 effector
MGLEFKKYDVVMVDFPERKCGSIQSGLRPAIIIQNDIGNQYSPTLLVIPLTTKIKSLNQPTHTLIKKAIGNGLDQDSMLLAEQTTAICKEHAKKIGEIRNETVKKQILTCFLNEANKLLKDAGISQFDFIKDISSLQKHFAPHIAQKVGAAAARSHVWSAFDKVVFGKGQRIHFHKKGDLKSITSGYFGISMTVKNGYFIWSGGTKDEKDRKVNPITISVKIKQPETYYEKEMLQKQIKYVTIVRKWIKNRYKYYLQFMLVGNPVVKPRVIANGKRVGIDIGPSSAAIVSEKEVKLVELADKVQKNHDKKTQLQRSMDRSRRAMNPQNFNKNGTIKRGIKLIWNESNHYKEMRGQVRELERKNADIRKYQHTCLANYVMSLGTEVYVEQMNFKGLQKRAKETKYDENGRPKRKKRFGKSIANRAPAMFITILNNKLFGIAGEELHKVNTFTFKASQYDHTNDTYKKKLLKDRWAELSNGDKIQRDLYSAFLIMNSDAEMQQADLRKCEETYKRFKEQHDGLIVKMKESNHIRLSSFGF

SEQ ID NO: 1771 - protein, 533 aa, unidentified
  REGION 1..533: note = Description of Unknown:uncultivated organism sequence
  REGION 1..533: note = Category: MG81 effectors
  REGION 1..533: note = Description: MG81-49 effector
MANNNNNNNNNNNNNTDTCVLTLPLRVEKWQEDCLLKRFEAARRIYNSLLNFELKKLRQLERTVEYRQIQSVISSAYRSNTKDSLECKDAFKRRKKLTDENGISEYGFKSDVKFFYKHFDGLIGSNVAVHCIAVQLWAAFDKYLRGSGKEIHFKRLGDISSLKGYSVKGKSGGCEIIFRGQYVEWTRKKKKLLLPLKIDPDNEYEREMLSRRVKYVRIIKKPGKNRLRWYAQLTLEGKPALKYSAGTGKPIHSVGKGNVGIDIGPQTVAYASDKEVALLELADRVTNIEHQKKKLQRKLDRSRRATNPDNYKPDGTIKRGVKLTRNKSKRYLKLQSKLAYIQHRQAEIRKLQHTCLANHMLTLGDRFFVEKMNWPGLAHRAKETSISEKTGRYKRKKRFGKSLANKAPAMFISILKRKCETLGLPGVVEVDTYNLKASQYNHLSDTYEKKSLSERWNYMPISDGSDSSKTKRIQRDLYSAFLLQHTIPQPCSFDKEALRIDYPNFVTMHDAEIHRLESLPKTVTSMGVRRSHS

SEQ ID NO: 1772 - protein, 561 aa, unidentified
  REGION 1..561: note = Description of Unknown:uncultivated organism sequence
  REGION 1..561: note = Category: MG81 effectors
  REGION 1..561: note = Description: MG81-50 effector
MNISRSHRIRLFPTKEQERFLQDCAFVARTAWNFGLSFLIESNRRVIADWNALSDAERLARDPALKPKKESKRKKKKTEVSDDKKKKQSKPKVEWASYTDDDRLKRAPTGWDSAPASAAWTQVKKTSASGQLRGAVIANAVPAMVGFNAFIDLNKAWNKYFKECGSKPCSRRKDDKNCWCKDFPAWMGCGHPRFKNRSSGKSFLLPGSDKSGCNAIFGVDGKHFVFTGNKYHQRITMAEELRFQGRVASARVFEDNRHWYASIQVMDITVPDPAAHAGPSVGVDLGVASTATLSTGEKIDNLHAARKNEPRIAKLNQAISLKSIWLPCPACAGEPDKKKECKRCSGAGQVQDRRAVTCEVCKGTGKDLEDESKRCRRCRGCGRQKSQRMIDLEAKITKLQQHAANQRNDHMHKATTRIVQTYSFIGLEDINFNEMKTQNAEKMTGEGKRKRGFQRSLTDACPGEFRRQLEYKAPAYGGRSVRIDKWSASSKICSACGERVDDLPMSVRTWTCPVCGVSHDRDINAAVNILRKALDEAKTTGEQSAVVKKPRCAKKELHDAR

SEQ ID NO: 1773 - protein, 512 aa, unidentified
  REGION 1..512: note = Description of Unknown:uncultivated organism sequence
  REGION 1..512: note = Category: MG81 effectors
  REGION 1..512: note = Description: MG81-51 effector
MPTKQKEDSNRCVLTLPLLTEPWQEHIIEKRFKIIEHLKNQLISIELRKLKNLQRTKAYKNLMKRIESVPKSERTALYKERNKMLKDAGFSQYTFMDDMAGKKSLMQKHFESHINVQIAHKAAIDVWSSFEKFLFGTGQIVHYQKRGTLSSVASKSPKTGMFYYPDENIFKWSGGGTKPKGGIILCLRVASVKTNYEKEMIANNEIKYYRVVRKWMKTKYKYYLQITFAGKPADKHREISTGRVGIDIGTQTIAIASDKSVKLLELADKVNKNHIKKCELQRKLDRSRRYTNPDNFNPDGTVKRGTKGHKLKWNKSKHYLEVAGKIRELERKNADIRKYQHTCLANDILAMGNQIYIEPMNYKGLQKRAKETQVDEKGRYKKKKRFGKSLANKAPAMFVTILKTKAEQHGGEVYEVDIMSYRASQCDHTTGEYTKHGLNDRWRILGNGDKVQRDLYSAFLIKNSNKTHDEIDLDKCSKTYDSFKKLHDKEIENIRNEVILRKRRNISSYGIA

SEQ ID NO: 1774 - protein, 512 aa, unidentified
  REGION 1..512: note = Description of Unknown:uncultivated organism sequence
  REGION 1..512: note = Category: MG81 effectors
  REGION 1..512: note = Description: MG81-52 effector
MPTKQKEGGNRCVLTLPLLTEPWQEHIIEKRFKIIEHLKNQLISIELRKLKNLQRTKAYKNLIKQIESVPKSERTVLYKKRNKMLKDAGFSQYTFMDDMAGKKSLMQKHFESHINVQIAHKAAIDVWSSFEKFLFGSGQMIHYQKRGTLSSVASKSPKTGMFYYSDENIFKWSGGGTKPKGGIILCLRVAPVKTNYEKEMVANNEIKYYRVVRKWMKTKYKYYLQITFAGKPADKHHEVSTDRVGIDIGTQTIAIASDKSVKLLELADKVNKNHIKKCELQRKLDRSRRYTNPDNFNPDGTVKRGTKGHKLKWNKSKHYIEIAGKIRELERKNADIRKYQHTCLANDILAMGNQIYIEPMNYKGLQKRVKETQVDEKGRYKKKKRFGKSLANKAPAMFVTILKTKAEQHGGEVYEVDIMSYRASQCDHTTGEYTKHGLNDRWRILGNGDKVQRDLYSAFLIKNSNKTHDEIDLDKCSKTYDNFKKLHDKEIENIRNEVILRERRNISSYGIA

SEQ ID NO: 1775 - protein, 512 aa, unidentified
  REGION 1..512: note = Description of Unknown:uncultivated organism sequence
  REGION 1..512: note = Category: MG81 effectors
  REGION 1..512: note = Description: MG81-53 effector
MPTKQKEDSNRCVLTLPLLTEPWQEHIIEKRFKIIEHLKNQLISIELRKLKNLQRTKAYKNLMKRIESVPKSERTALYKERNKMLEGKGFSQYTFMDDMAGKKSLMQKHFESHINVQIAHKAAIDVWSSFEKFLFGSGQMIHYQKRGTLSSVASKSPKTGMFYYPDENIFKWSGGGTKPKGGIILCLRVASVKTNYEKEMVANNEIKYYRVVRKWMKTKYKYYLQITFAGKPADKHREISTGRVGIDIGTQTIAIASDKSVKLLELADKVNKNYIKKCELQRKLDRSRRYTNPDNFNPDGTVKRGTKGHKLKWNKSKHYLEIAGKIRELERKNADIRKYQHTCLANDILAMGNQIYIEPMNYKGLQKRAKETQVDEKGRYKKKKRFGKSLANKAPAMFVTILKTKAEQHGGEVYEVDIMSYRASQCDHTTGEYTKHGLNDRWRILGNGDKVQRDLYSAFLIKNSNKTHDEIDLDKCSKTYDSFKKLHDKEIENIRNEVKLRERKNISSYGIA

SEQ ID NO: 1776 - protein, 512 aa, unidentified
  REGION 1..512: note = Description of Unknown:uncultivated organism sequence
  REGION 1..512: note = Category: MG81 effectors
  REGION 1..512: note = Description: MG81-54 effector
MPTKQKEGGNRCVLTLPLLTEPWQEHIIEKRFKIIEHLKNQLISIELRKLKNLQRTKAYKNLIKQIESVPKSERTALYKERNKMLKDAGFSQYTFMDDMAGKKSLMQKHFESHINVQIAHKAAIDVWSSFEKFLFGTGQIVHYQKRGTLSSVASKSPKTGMFYYSDENIFKWSGGGTKPKGGIILCLRVASVKTNYEKEMVANNEIKYYRVVRKWMKTKYKYYLQITFAGKPADKHREISTGRVGIDIGTQTIAIASDKTVKLLELADKVNKNHIKKCELQRKLDRSRRYTNPDNFNPDGTVKRGTKGHKLKWNKSKHYIEIAGKIRELERKNADIRKYQHTCLANDILAMGNQIYIEPMNYKGLQKRAKETQVDEKGRYKKKKRFGKSLANKAPAMFVTILKTKAEQHGGEVYEVDIMSYRASQCDHTTGEYTKHGLNDRWRILGNGDKVQRDLYSAFLIKNSNKTHDEIDLDKCSKTYDSFKKLHDKEIENIRNEVKLRERRNISSYGIA

SEQ ID NO: 1777 - protein, 512 aa, unidentified
  REGION 1..512: note = Description of Unknown:uncultivated organism sequence
  REGION 1..512: note = Category: MG81 effectors
  REGION 1..512: note = Description: MG81-55 effector
MPTKQKEGGNRCVLTLPLLTEPWQEHIIEKRFKIIEHLKNQLISIELRKLKKLQRTKAYKNLIKQIESVPKSERTALYKERNKMLKDAGFSQYTFMDDMAGKKSLMQKHFESHINVQIAHKAAIDVWSSFEKFLFGTGQIVHYQKRGTLSSVASKSPKTGMFYYSDENIFKWSGGGTKPKGGIILCLRVASVKTNYEKEMVANNEIKYYRVVRKWMKTKYKYYLQITFAGKPADKHREISTGRVGIDIGTQTIAIASDKSVKLLELADKVNKNHIKKCELQRKLDRSRRYTNPDNFNPDGTVKRGTKGHKLKWNKSKHYIEIAGKIRELERKNADIRKYQHTCLANDILAMGNQIYIEPMNYKGLQKRAKETQVDEKGRYKKKKRFGKSLANKAPAMFVTILKTKAEQHGGEVYEVDIMSYRASQCDHTTGEYTKHGLNDRWRILGNGDKVQRDLYSAFLIKNSNKTHDEIDLDKCSKTYDNFKKLHDKEIENIRNEVILRERKNISSYGIA

SEQ ID NO: 1778 - protein, 512 aa, unidentified
  REGION 1..512: note = Description of Unknown:uncultivated organism sequence
  REGION 1..512: note = Category: MG81 effectors
  REGION 1..512: note = Description: MG81-56 effector
MKKSSTDTCCLTLPLKLEKWQEDRLAKRFEIARQLYNTLVHAELKRLVQIKRTAEYLENEQKIRALDRNNPADRAKLQELYKEQRKSLKTAGFTDYSFTTDMGKYYKHFRDNIGSSVAVHGIAPQVWAAFDKVLFKKGGKKVHYKRPGEVNSVQGYSRTGKSGGTEIMFRGPYIEWKGLKLPLKLSPDNAYETDMLQRRVKLVRLVRRPGKRRDRWYAQLVLEAKPAIKADPVTGKAVHPIGSGPVGLDIGPQTLAYSAAGAAGLVELADRVQNIEQEKRRLQRKMDRSRRAANPDNYAEDGTIRRGVKLTHNKSKRYRRSQQELKYLQHRQAEIRKLQHIQLANHLLSLGDHFYVEKMEWSSLTHRAKETVISEKTGKPRSKRRFGKSIANKAPAMLIEILRQKCKSLGLSDVVEINPADIKASQYNHLTGKYVKKSLSRRWNDMQDGEHLQRDLYSAFLLQHYDSCSKTLDLDSLARDYPAFVQYHHREIERLHALPKTPSSMGIRRSIA

SEQ ID NO: 1779 - protein, 512 aa, unidentified
  REGION 1..512: note = Description of Unknown:uncultivated organism sequence
  REGION 1..512: note = Category: MG81 effectors
  REGION 1..512: note = Description: MG81-57 effector
MPAKQKEGSNRCVLTLPLLTEPWQEHIIEKRFKIIEHLKNQLISIELRKLKNLQRTKAYKNLMKRIESVPKSERTALYKERNKMLKDAGFSQYTFMDDMAGKKSLMQKHFESHINVQIAHKAAIDVWSSFEKFLFGTGQIVHYQKRGTLSSVASKSPKTGMFYYSDENIFKWSGGGTKPKGGIILCLRVAPVKTNYEKEMVANNEIKYYRVVRKWMKTKYKYYLQITFAGKPADKHHEVSTGRVGIDIGTQTIAIASDKSVKLLELADKVNKNHIKKCELQRKLDRSRRYTNPDNFNPDGTVKRGTKGHKLKWNKSKHYIEIAGKIRELERKNADIRKYQHTCLANDILAMGNQIYIEPMNYKGLQKRAKETQVDEKGRYKKKKRFGKSLANKAPAMFVTILKTKAEQHGGEVYEVDIMSYRASQCDHTTGEYTKHGLNDRWRILGNGDKVQRDLYSAFLIKNSNKTHDEIDLDKCSKTYDNFKKLHDKEIENIRNEVKLRERRNISSYGIA

SEQ ID NO: 1780 - protein, 512 aa, unidentified
  REGION 1..512: note = Description of Unknown:uncultivated organism sequence
  REGION 1..512: note = Category: MG81 effectors
  REGION 1..512: note = Description: MG81-58 effector
MPTKQKEDSNRCVLTLPLLTEPWQEHIIEKRFKIIEHLKNQLISIELRKLKKLQRTKAYKNLIKQIESVPKSERTALYKERNKMLKDAGFSQYTFMDDMAGKKSLMQKHFESHINVQIAHKAAIDVWSSFEKFLFGTGQIVHYQKRGTLSSVASKSPKTGMFYYPDENIFKWSGGGTKPKGGIILCLRVASVKTNYEKEMVANNEIKYYRVVRKWMKTKYKYYLQITFAGKPADKHREISTGRVGIDIGTQTIAIASDKSVKLLELADKVNKNHIKKCELQRKLDRSRRYTNPDNFNPDGTVKRGTKGHKLKWNKSKHYLEIAGKIRELERKNADIRKYQHTCLANDILAMGNQIYIEPMNYKGLQKRAKETQVDEKGRYKKKKRFGKSLANKAPAMFVTILKTKAEQHGGEVYEVDIMSYRASQCDHTTGEYTKHGLNDRWRILGNGDKVQRDLYSAFLIKNSNKTHDEIDLDKCSKTYDSFKKLHDKEIENIRNEVILRKRRNISSYGIA

SEQ ID NO: 1781 - protein, 512 aa, unidentified
  REGION 1..512: note = Description of Unknown:uncultivated organism sequence
  REGION 1..512: note = Category: MG81 effectors
  REGION 1..512: note = Description: MG81-59 effector
MPTKQKEDSNRCVLTLPLLTEPWQEHIIEKRFKIIEHLKNQLISIELKKLKNLQRTKAYKNLIKQIESVPKSERTALYKERNKMLKDAGFSQYTFMDDMAGKKSLMQKHFESHINVQIAHKAAIDVWSSFEKFLFGTGQMIHYQKRGTLSSVASKSPKTGMFYYSDENIFKWSGGGTKPKGGIILCLRVASVKTNYEKEMVANNEIKYYRVVRKWMKTKYKYYLQITFAGKPADKHREISTGRVGIDIGTQTIAIASDKSVKLLELADEVNKNHIKKCELQRKLDRSRRYTNPDNFNPDGTVKRGTKGYKLKWNKSKHYIEIAGKIRELERKNADIRKYQHTCLANDILAMGNQIYIEPMNYKGLQKRAKETQVDEKGRYKKKKRFGKSLANKAPAMFVTILKTKAEQHGGEVYEVDIMSYRASQCDHTTGEYTKHGLNDRWRILGNGDKVQRDLYSAFLIKNSNKTHDEIDLDKCSKTYDNFKKLHDKEIENIRNEVILRKRRNISSYGIA

SEQ ID NO: 1782 - protein, 185 aa, unidentified
  REGION 1..185: note = Description of Unknown:uncultivated organism sequence
  REGION 1..185: note = Category: MG81 effectors
  REGION 1..185: note = Description: MG81-60 effector
MKNKYKRTGTTVSIQQHNELANRLLSFGSEHYIEEMRFRALAKQAKETKFNSKGRPVRKKRFGKSIFNKAPALFAKTIKRKVLNAGGSFQRVDTFSVKASQFNHLTETYTKKSLGKRWNTMPDGTKVQRDLYSAFLIQNVDDSLKQVDVERCNQSYDSFLALHDREIRRLSYLLTPNSMGAQHSA

SEQ ID NO: 1783 - protein, 512 aa, unidentified
  REGION 1..512: note = Description of Unknown:uncultivated organism sequence
  REGION 1..512: note = Category: MG81 effectors
  REGION 1..512: note = Description: MG81-61 effector
MPTKQKEDSNRCVLTLPLLTEPWQEHIIEKRFKIIEHLKNQLISIELRKLKNLQRTKAYKNLIKQIESVPKSERTVLYKERNKMLKDAGFSQYTFMDDMAGKKSLMQKHFESHINVQIAHKAAIDVWSSFEKFLFGTGQMIHYQKRGTLSSVASKSPKTGMFYYSDENIFKWSGGGTKPKGGIILCLRVASVKTNYEKEMVANNEIKYYRVVRKWMKTKYKYYLQITFAGKPADKHREISTGRVGIDIGTQTIAIASDKSVKLLELADKVNKNHIKKCELQRKLDRSRRYTNPDNFNPDGTVKRGTKGHKLKWNKSKHYLEIAGKIRELERKNADIRKYQHTCLANDILAMGNQIYIEPMNYKGLQKRAKETQVDEKGRYKKKKRFGKSLANKAPAMFVTILKTKVEQHGGEVYEVDIMSYRASQCDHTTGEYTKHGLNDRWRILGNGDKVQRDLYSAFLIKNSNKTHDEIDLDKCSKTYDSFKKLHDKEIENIRNEVKLRERRNISSYGIA

SEQ ID NO: 1784 - protein, 511 aa, unidentified
  REGION 1..511: note = Description of Unknown:uncultivated organism sequence
  REGION 1..511: note = Category: MG81 effectors
  REGION 1..511: note = Description: MG81-62 effector
MAKCSTDTCCLTLPLRLEKWQEDRLAKRFEIARRIYNTMVRAELKKLRAIEQSEPYKANQEKIQALDWKTQADKQALKALYKERDKLLRDGGFSERGFKSDIKNYYKHFNNNIGSNVAAHGIAPQVWAAFEKMLFKKEGKKVHFKKKGDIRSLRGYSVTGKSGGVEIIFRETYIEWKGLKLPLKLSPDNIYETQMLSYRVKYVRLLRKPGKRKDRWYAQLSLEGKPVIKYNPKTGEVRHPIGKGAVGLDIGPQTLAYSAATGADLVELANQVQNVEQEKRRLQRKLDRSRRATNPGNYADDGTIRRGIALTHNKSKRYLRTQQELKYLQHQQAEIRKRQHTELANHLLSLGDCFYVEKMVWTSLTHRAKETEISEKTGKIKRKKRFGKSVANKAPATLIGILQLKSAALGIPGVIEVPTSVKASQYNHQSGTYTPKPLSQRWNNMPDGERIQRDLYSAFLLQHYDPQTNTFDANSLHQDYPQFVQYHHDAVLRLYAMPKTPSSMGIKRSLR

SEQ ID NO: 1785 - protein, 511 aa, unidentified
  REGION 1..511: note = Description of Unknown:uncultivated organism sequence
  REGION 1..511: note = Category: MG81 effectors
  REGION 1..511: note = Description: MG81-63 effector
MGKSSTDTCCLTLPLKLEKWQEDRLAKRFEIARQIYNTMVRAELKRLRQVEQSPQYRSNKKAIQALDWKNTADKPKLKTLYRERDKLLKGGGFTEYGFKSDIKNFYKHFAENIGSSVAVHGIAPQVWAAFERVLFKKEGKKVHFKKTGDIRSLRGYSVTGKSGGVEIIFRGSYIEWKGLDLPLKLSPDNAYETEMLSYRVKYVRILRKPGKTRDRWYAQLSLEGKPAIKRNPASGNPVHPVGQGAVGLDIGPQTLAYAAEKEANLVELADRVQNIEREKHLLQRKMDRSRRAANPDNYAENGTIRRGVKLTHNKSKRYLRLQRELCYLQHCQAETRKRQHTELANHLLSLGSCFYVEDMAWPSLTHRAKKTEISDKTGRIKRKKRFGKSIANKAPAALINILRTKCVSLGIPGVVEVPTSLKASQYNHQSKEYTPKPLSQRWNDMPDGSRIQRDLYSAFLLQHYDPQSGNFDQASLEADYPQFVQLHNQSIQRLLTVPKTPSSMGIRRSVS

SEQ ID NO: 1786 - protein, 525 aa, unidentified
  REGION 1..525: note = Description of Unknown:uncultivated organism sequence
  REGION 1..525: note = Category: MG81 effectors
  REGION 1..525: note = Description: MG81-64 effector
MAKNNNDTDTCVLTLPLRVEKWQEDCLLKRFEAARRIYNSLLNFELKKLRQLERTVEYRQIQSVISSAYRSNTKDSPECKDAFKRREKLISANGISENGFKSDVKFFYKHFDGLIGSSVAVHCIAVQLWAAFDKYLSGSGKEIHFKRLGDISSLKGYSVKGKSGGREIIFRGQYIEWTRKKKKLLLPLKIDPDNEYEREMLSRRVKYVRIIKKPGKNRLRWYAQLTLEGKPALKYSAETGKPIHSVGKGNVGIDIGPQTVAYASDKEVALLELADRVTNIEHQKKKLQRKLDRSRRATNPDNYKPDGTIKRGVKLTRNKSKRYLKLQSKLAYIQHRQAEIRKLQHTCLANHMLTLGDRFFVEKMNWPGLAHRAKETSISEKTGRYKRKKRFGKSLANKAPAMFISILKRKCETLGLPGVVEVDTFRLRASQYNHLSDTYEKKSLSERWNYMPISDGSDSSKTKRIQRDLYSAFLLQHTIPQPCSFDKEALRIDYPNFVTMHDAEIHRLESLPKTVTSMDVRRSHS

SEQ ID NO: 1787 - protein, 512 aa, unidentified
  REGION 1..512: note = Description of Unknown:uncultivated organism sequence
  REGION 1..512: note = Category: MG81 effectors
  REGION 1..512: note = Description: MG81-65 effector
MPTKQKEGGNRCVLTLPLLTEPWQEHIIEKRFKIIEHLKNQLISIELRKLKNLQRTKAYKNLIKQIESVPKSERTALYKERNKMLKDAGFSQYTFMDDMAGKKSLMQKHFEGHINVQIAHKAAIDVWSSFEKFLFGTGQIVHYQKRGTLSSVASKSPKTGMFYYSDENIFKWSGGGTKPKGGIILCLRVASVKTNYEKEMVANNEIKYYRVVRKWMKTKYKYYLQITFAGKPADKHREISTGRVGIDIGTQTIAIASDKSVKLLELADKVNKNHIKKCELQRKLDRSRRYTNPDNFNPDGTVKRGTKGHKLKWNKSKHYIEIAGKIRELERKNADIRKYQHTCLANDILAMGNQIYIEPMNYKGLQKRAKETQVDEKGRYKKKKRFGKSLANKAPAMFVTILKTKAEQHGGEVYEVDIMSYRASQCDHTTGEYTKHGLNDRWRILGNGDKVQRDLYSAFLIKNSNKTHDEIDLDKCSKTYDNFKKLHDKEIENIRNEVKLRERKNISSYGIA

SEQ ID NO: 1788 - protein, 523 aa, unidentified
  REGION 1..523: note = Description of Unknown:uncultivated organism sequence
  REGION 1..523: note = Category: MG81 effectors
  REGION 1..523: note = Description: MG81-66 effector
MPTKQKEGGNRCVLTLPLLTEPWQEHIIEKRFKIIEHLKNQLISIELRKLKNLQRTKAYKNLIKQIESVPKSERTVLYKERNKMLKDAGFSQYTFMDDMAGKKSLMQKHFESHINVQIAHKAAIDVWSSFEKFLFGSGQMIHYQKRGTLKSIASKSPKNGMHYFPESNTFKWSGGKQKKIGQKGEQKKVSIKPISLCLRVSPLKTDYEKEMVANNEIKYYRVVRKWMKTKYKYYLQITFAGKPADKHREISTGRVGIDIGTQTIAIASDKSVKLLELADKVNKNHIKKCELQRKLDRSRRYTNPDNFNPDGTVRRGTKGHKLKWNKSKHYLEIAGKIRELERKNSDIRKYQHTCLANDILAMGNQIYIEPMNYKGLQKRAKETQVDEKGRYKKKKRFGKSLANKAPSMFVTILKTKAEQHGGEVYEVDIMSYRASQCDHTTGEYTKHGLNDRWRILGNGDKVQRDLYSAFLIKNSNKTHDEIDLDKCSKTYDNFKKLHDTEIENIRNEVKLRERKNISSYGIA

SEQ ID NO: 1789 - protein, 511 aa, unidentified
  REGION 1..511: note = Description of Unknown:uncultivated organism sequence
  REGION 1..511: note = Category: MG81 effectors
  REGION 1..511: note = Description: MG81-67 effector
MREDSQNTCCLTLPLKIEKWQADRLIKRFEIARQIYNTLVHAELKKLQKMEASAEYRQIQDRIRELNPSDVRAKKEWKILKDKQEKLWKAWKITEYGFKSDIKAYYKYFNENIGSAVATHDIAPRVWAAFEKKLNDRTGKVKIQYKKAGDIRSLKGFSVSGKSGGTEIIFHKTYIAWKGLTLPLKLSPDNAYEKEMLMRRIKYVRILRKPGKHKDRWYAQLSLEGNPVVKLDPVSGLPRHPIGKGAVGIDIGPQTLAYSAEGGADLVELADQVQCIEQEKSRLQRKMDRSRRASNPDNYAQDGTIKRGVKLTHNKSRRYCKLQKELAYMLYRQAETRKRQHRELINRLLTMGDCFYIEDMHWNSLAHRAKKTEISEKTGRYKRKKRFGKSIANKAPAMLVDMLEQKCKSLELDVVMVNTSLKASQYNHQTGKYEKKTLSQRWNYMPDGEQIQRDLYSAFLLQHVVPEKNAFDNEALCRDYPKFVQYHHEVIERLRSLPKTISSMGIRQSVS

SEQ ID NO: 1790 - protein, 511 aa, unidentified
  REGION 1..511: note = Description of Unknown:uncultivated organism sequence
  REGION 1..511: note = Category: MG81 effectors
  REGION 1..511: note = Description: MG81-68 effector
MAKCSTDTCCLTLPLRLEKWQEDRLAKRFEIARQIYNTMVRAELKKLRAMEQSEPYKANQEKIQALDWKTQTDKQALKALYKERDKLLRDGGFSEYGFKSDIKNYYKHFNNNIGSNVAFHGIAPQVWAAFEKMLFKKEGKKVHFKKKGDIHSLRGYSAAGKSGGVEIIFRETYIEWKGLKLPLKLSPDNIYETQMLSYRVKYVRLLRKPGKRKDRWYAQLSLEGKPVIKYNPKTGEVRHPIGKGAVGLDIGPQTLAYSAATGADLVELANQVQNVEQEKRRLQRKLDRSRRATNPGNYADDGTIRRGIALTHNKSKRYLRTQQELKYLQHQQAEIRKRQHTELANHLLSLGDCFYVEKMVWTSLTHRAKETEISEKTGKIKRKKRFGKSVANKAPATLIGILQRKSAALGIPGVIEVPTSVKASQYNHQSGTYTPKPLSQRWNNMPDGERIQRDLYSAFLLQHYDPQTNTFDANSLHQDYPQFVQYHHDAVLRLYAMPKTPSSMGIKRSLR

SEQ ID NO: 1791 - protein, 523 aa, unidentified
  REGION 1..523: note = Description of Unknown:uncultivated organism sequence
  REGION 1..523: note = Category: MG81 effectors
  REGION 1..523: note = Description: MG81-69 effector
MPTKQKEGGNRCVLTLPLLTEPWQEHIIEKRFKIIEHLKNQLISIELRKLKNLQRTKAYKNLIKQIESVPKSERTALYKERNKMLKDAGFSQYTFMDDMAGKKSLMQKHFESHINVQIAHKAAIDVWSSFEKFLFGSGQMIHYQKRGTLKSIASKSPKNGMHYFPESNTFKWSGGKQKKIGQKGEQKKVSIKPISLCLRVSPLKTDYEKEMVANNEIKYYRVVRKWMKTKYKYYLQITFAGKPADKHREISTGRVGIDIGTQTIAIASDKSVKLLELADKVNKNHIKKCELQRKLDRSRRYTNPDNFNPDGTVRRGTKGHKLKWNKSKHYLEIAGKIRELERKNSDIRKYQHTCLANDILAMGNQIYIEPMNYKGLQKRAKETQVDEKGRYKKKKRFGKSLANKAPSMFVTILKTKAEQHGGEVYEVDIMSYRASQCDHTTGEYTKHGLNDRWRILGNGDKVQRDLYSAFLIKNSNKTHDEIDLDKCSKTYDNFKKLHDKEIENIRNEVKLRERRNISSYGIA

SEQ ID NO: 1792 - protein, 529 aa, unidentified
  REGION 1..529: note = Description of Unknown:uncultivated organism sequence
  REGION 1..529: note = Category: MG81 effectors
  REGION 1..529: note = Description: MG81-70 effector
MILLAKKNNNDTDTCVLTLPLRVEKWQEDCLLKRFEAARRIYNSLLNFELKKLRQLERTVEYRQIQSVISSAYRSNTKDSPECKDAFKRREKLISANGISEYGFKSDVKFFYKHFDGLIGSSVAVHCIAVQLWAAFDKYLSGSGKEIHFKRLGDISSLKGYSVKGKSGGREIIFRGQYIEWTRKKKKLLLPLKIDPDNEYEREMLSRRVKYVRIIKKPGKNRLRWYAQLTLEGKPALKYSAGTGKPIHSVGKGDVGIDIGPQTVAYASDKEVALLELADRVTNIEHQKKKLQRKLDRSRRATNPDNYKPDGTIKRGVKLTHNKSKRYLKLQSKLAYIQHRQAEIRKLQHTCLANHMLTLGDRFFVEKMNWPGLAHRAKETSISEKTGRYKRKKRFGKSLANKAPAMFISILKRKCETLGLPGVVEVDTYSLKASQYNHLSDTYEKKSLSERWNYMPISDGSDSSKTKRIQRDLYSAFLLQHTIPQPCSFDKEALRIDYPNFVTMHDAEIHRLGSLPKTITSMGVRRSHS

SEQ ID NO: 1793 - protein, 512 aa, unidentified
  REGION 1..512: note = Description of Unknown:uncultivated organism sequence
  REGION 1..512: note = Category: MG81 effectors
  REGION 1..512: note = Description: MG81-71 effector
MKKSSTDTCCLTLPLKLEKWQEDRLAKRFEIARQLYNTLVHAELKRLAQVKQTAEYRENERKIRTLDWNDPGDQAKLKGLYKERRKSLKTAGFTDYSFTTDMGKYYKHFRDNIGSSVAVHGIAPQVWAAFDKLLFKKGGKKVHYKKPGEVNSVQGYSRTGKSGGTEIMFRGPYIEWKGLKLPLKLSPDNAYETDMLQRRVKLVRLVRRPGKRRDRWYAQLVLEGKPAIKADPVTGKAVHPIGSGPVGLDIGPQTLAYSAAGAAGLVELADRVQNIEQEKRCLQRKMGRSRRATNPDNYAEDGTIRRGVKLTHNKSKRYRRSQQELKYLQRRQAEIRKLQHIQLANHLLSLGDHFYVEKMEWSSLTHRAKKTVISEKTGKPRSKKRFGKSIANKAPAMLIEILRQKCKSLGLPNVVEINPADIKASQYNHLTGEYVKKSLSRRWNEMQDGEHLQRDLYSAFLLQHYDSMSKALDLDSLARDYPAFVQYHHREIERLHALPKTPASMGIRRSIA

SEQ ID NO: 1794 - protein, 1362 aa, unidentified
  REGION 1..1362: note = Description of Unknown:uncultivated organism sequence
  REGION 1..1362: note = Category: MG81 effectors
  REGION 1..1362: note = Description: MG81-72 effector
MKISKIKNSRPGISVTENKNEEQLSRQSLLYYAPVKDGKIRLESKDLEQHVTECNEKAQKLYNVITPEINFYRDENRQKMVENLARNFNAVINNALRSIRNPKEKKERRVEKEVAFILNLSKKSIKLKENVFVKSTDLIVKFPENNKYNKKNSKGTGSKEAYIQKMISDLVLRKLKNTLRKEVKLENGCRMQMTEITISLMSAICLYGNAESFDPAILKAFFEKVDSDYTKYKYVEQIVKSIESQSAKLKVVEKDGRHLLISANADHRKKKYVFEFMRMYAAADEKEKRELTEHIQDLIGLYLCGKAGYENAENRFSDMIESHNCICGKIEEILNELEEPENLSQQKKEKLKNTTVKVMALKYRAAVNYLADEVGKTVLGEIREKKVRSCADLYWIEYIDSTVEKLLLKSRNKDGYRYEIGFLSKHIWKEWTQYISGKYIEMGKGVYHFAIPDLSGALEGESVSICEVKPEYRNGVSGFDYERIRAEESLEREMEKYVLFAVNNFARAVTPEEEREKSGHEDVLLMKTLSEIEESQTKEERQKKHDNNVKNAITLYADADRRILQFFGGQSRFREKEDSLINLYSGEDLYKEIRKELYAIRNITFHYTTKAEKDQTQKHDLAEYLFEEEFSDITELFREKYYANNVWKYYDAEVINTIMENIYCGRKYRAAQVPAFKNIISRPELPQVMNGFVKGNSLRRLMNCPDRDVINKYWSALFFVLKELYYYDFLQEQKRPEDNVKERFFRAIKKLSGQEKGDKEQKAWESFENRIDQIGRDRSFGAICQGLMIEYMLQNSDISMVQTETDNGKANNKKQIYKHYRTLLYNCISEAFIEYLREKWKELRTPVLTAKEWSKEEFCRADGLKHLSLFDHLKETFNDAESGSSWYMAAHFINQKYLNHLLGSIRNYLQFTEDIEDRAISLGDCVDNKREEKNLRYRNTLEILEFVAQFCERTTNVMEDYFESNQEYAEYLSGFVDYNTTKKETDIEKALYSFCKQKFKVDGKEYMAGIYYDGENLIPNRNIIRANMYGTTSCLKPCMDRITLKEIRTMYADQNKLDLVLKEGVCHTEEEQKAYREYQNEKNRIELFDVCTYTQILNDMQARLIGWSYMRERDLMYYQLGYYYTKLFWTDSISEEDARRRLVGNLVNVEDGAILYQILAFNSYNLPIIANKNNTVTLLKDEGSIGGKAITAFFKNYENAEMIYEEALDLFENMDEHAAIINTRNYIEHFKYFIKSDRSMMDLYSEIYDRFFRHDHNRKKNVPDSLKNVLADNFMIVDIDMELGSKKVGEKKKGFREHKAARIEFTDSGIRSTDMTYTIKPDIKDNKKDNKKDKKVLVPARSEVFLKQFRKILEYRIQDKTQ

SEQ ID NO: 1795 - protein, 512 aa, unidentified
  REGION 1..512: note = Description of Unknown:uncultivated organism sequence
  REGION 1..512: note = Category: MG81 effectors
  REGION 1..512: note = Description: MG81-73 effector
MPTKQKEDSNRCVLTLPLLTELWQEHIIEKRFKIIEHLKNQLISKELRKLKNLQRTKAYKNLMKRIESVPKSERTALYKERNKMLKDAGFSQYAFMDDMAGKKSLMQKHFESHINVQIAHKAAIDVWSSFEKFLFGTGQIVHYQKRGTLSSIASKSPKTGMFYYSDENIFKWSGGGTKPKGGIILCLRVASVKTNYEKEMVANNEIKYYRVVRKWMKTKYKYYLQITFAGKPADKHREISTGRVGIDIGTQTIAIASDKSVKLLELADKVNKNHIKKCELQRKLDRSRRYTNPDNFNPDGTVKRGTKGHKLKWNKSKHYIEIAGKIRELERKNADIRKYQHTCLANDILAMGNQIYIEPMNYKGLQKRAKETQVDEKGRYKKKKRFGKSLANKAPAMFVTILKTKAEQHGGEVYEVDIMSYRASQCDHTTGEYTKHGLNDRWRILGNGDKVQRDLYSAFLIKNSNKTHDEIDLDKCSKTYDNFKKLHDKEIENIRNEVKLRERKNISSYGIA

SEQ ID NO: 1796 - protein, 530 aa, unidentified
  REGION 1..530: note = Description of Unknown:uncultivated organism sequence
  REGION 1..530: note = Category: MG81 effectors
  REGION 1..530: note = Description: MG81-74 effector
MILLAKNNNNNNTDTCVLTLPLRVEKWQEDCLLKRFEAARRIYNSLLNFELKKLRQLERTVEYRQIQSVISSAYRSNTKDSPECKDAFKRREKLISANGISKNGFKSDVKFFYKHFDGLIGSSVAVHCIAVQLWAAFDKYLSGSGKEIHFKRLGDISSLKGYSVKGKSGGCEIIFRGQYVEWTRKKKKLLLPLKIDPDNEYEREMLSRRVKYVRIIKKPGKNRLRWYAQLTLEGKPALKYSAETGKPIHSVGKGNVGIDIGPQTVAYASDKEVALLELADRVTNIEHQKKKLQRKLDRSRRATNPDNYKPDGTIKRGVKLTRNKSKRYLKLQSKLAYIQHRQAEIRKLQHTCLANHMLTLGDRFFVEKMNWPGLAHRAKETSISEKTGRYKRKKRFGKSLANKAPAMFISILKRKCETLGLPGVVEVDTYNLKASQYNHLSDTCEKKSLSERWNYMPISDGSDSSKTKRIQRDLYSAFLLQHTIPQPCSFDKEALRIDYPNFVIMHDAEIHRLESLPKTITSMGVRRSHS

SEQ ID NO: 1797 - protein, 528 aa, unidentified
  REGION 1..528: note = Description of Unknown:uncultivated organism sequence
  REGION 1..528: note = Category: MG81 effectors
  REGION 1..528: note = Description: MG81-75 effector
MILLTKNNNNTDTCVLTLPLRVEKWQEDCLLKRFEAARRIYNSLLNFELKKLRQLERTVEYRQIQSVISSAYRSNTKDSPECKDAFKRREKLISANGISEYGFKSDVKFFYKHFDGLIGSNVAVHCIAGQLWAAFDKYLRGSGKEIHFKRLGDISSLKGYSVKGKSGGCEIIFRGQYIEWTRKKKKLLLPLKIDPDNEYEREMLSRRVKYVRIIKKPGKNRLRWYAQLTLEGKPALKYSAETGKPIHSVGKGNVGIDIGPQTVAYASDKEVALLELADRVTNIEHQKKKLQRKLDRSRRATNPDNYKPDGTIKRGVKLTRNKSKRYLKLQSKLAYIQHRQAEIRKLQHTCLANHMLTLGDRFFVEKMNWPGLAHRAKETSISEKTGRYKRKKRFGKSLANKAPAMFISILKRKCETLGLPGVVEVDTYSLKASQYNHLSDTYEKKSLSERWNYMPISDGSDSSKTKRIQRDLYSAFLLQHTIPQPCSFDKKALRIDYPNFVTMHDAEIHRLESLPKTITSMGVRRSHS

SEQ ID NO: 1798 - protein, 512 aa, unidentified
  REGION 1..512: note = Description of Unknown:uncultivated organism sequence
  REGION 1..512: note = Category: MG81 effectors
  REGION 1..512: note = Description: MG81-76 effector
MPTKQKEGGNRCVLTLPLLTEPWQEHIIEKRFKIIEHLKNQLISIELRKLKNLQRTKAYKNLMKRIESVPKSERTALYKERNKMLKDAGFSQYTFMDDMAGKKSLMQKHFESHINVQIAHKAAIDVWSSFEKFLFGSGQMIHYQKRGTLSSVASKSPKTGMFYYSDENIFKWSGGGTKPKGGIILCLRVASVKTNYEKEMVANNEIKYYRVVRKWMKTKYKYYLQITFAGKPADKHREISTGRVGIDIGTQTIAIASDKSVKLLELADKVNKNHMKKCELQRKLDRSRRYTNPDNFNPDGTVKRGTKGHKLKWNKSKHYIEIAGKIRELERKNADIRKYQHTCLANDILTMGNQIYIEPMNYKGFQKRAKETQVDEKGRYKKKKRFGKSLANKAPAMFVTILKTKAEQHGGEVYEVDIMSYRASQCDHTTGEYTKHGLNDRWRILGNGDKVQRDLYSAFLIKNSNKTHDEIDLDKCSKTYDSFKKLHDKEIENIRNEVILRERRNISSYGIA

SEQ ID NO: 1799 - protein, 529 aa, unidentified
  REGION 1..529: note = Description of Unknown:uncultivated organism sequence
  REGION 1..529: note = Category: MG81 effectors
  REGION 1..529: note = Description: MG81-77 effector
MILLANNNNNNTDTCVLTLPLRVEKWQEDCLLKRFEAARRIYNSLLNFELKKLRQLERTVEYRQIQSVISSAYRSNTKDSPECKDAFKRREKLISANGISKNGFKSDVKFFYKHFDGLIGSSVAVHCIAVQLWAAFDKYLSGSGKEIHFKRLGDISSLKGYSVKGKSGGCEIIFRGQYVEWTRKKKKLLLPLKIDPDNEYEREMLSRRVKYVRIIKKPGKNRLRWYAQLTLEGKPALKYSAETGKPIHSVGKGNVGIDIGPQTVAYASDKEVALLELADRVTNIEHQKKKLQRKLDRSRRATNPDNYKPDGTIKRGVKLTRNKSKRYLKLQSKLAYIQHRQAEIRKLQHTCLANHMLTLGDRFFVEKMNWPGLAHRAKETSISEKTGRYKRKKRFGKSLANKAPAMFISILKRKCETLGLPGVVEVDTYNLKASQYNHLSDTCEKKSLSERWNYMPISDGSDSSKTKRIQRDLYSAFLLQHTIPQPCSFDKEALRIDYPNFVIMHDAEIHRLESLPKTITSMGVRRSHS

SEQ ID NO: 1800 - protein, 511 aa, unidentified
  REGION 1..511: note = Description of Unknown:uncultivated organism sequence
  REGION 1..511: note = Category: MG81 effectors
  REGION 1..511: note = Description: MG81-78 effector
MREDSQNTCCLTLPLKIEKWQADRLIKRFEIARQIYNTLVHAELKKLQKMEASAEYRQIQDRIRELNPSDARAKKEWKILKDKQEKLWKAWKITEYGFKSDIKAYYKYFNENIGSAVATHDIAPQVWAAFEKKLNDRTGKVKIQYKKAGDIRSLKGFSVSGKSGGTEIIFHKTYIAWKGLTLPLKLSPDNAYEKEMLMRRIKYVRILRKPGKHKDRWYAQLSLEGNPVVKLDPVSGLPRHPIGKGAVGIDIGPRTLAYSAEGGADLVELADQVQCIEQEKSRLQRKMDRSRRASNPDNYAQDGTIKRGVKLTHNKSRRYCKLQKELAYMLYRQAETRKRQHRELINRLLTMGDCFYIEDMHWNSLAHRAKKTEISEKTGGYKRKKRFGKSIANKAPAMLVDMLEQKCKSLELDVVMVNTSLKASQYNHQTGKYEKKTLSQRWNHMPDGEQIQRDLYSAFLLQHVVPEKNAFDNEALCRDYPKFVQYHHEVIERLRSLPKTISSMGIRRSVS

SEQ ID NO: 1801 - protein, 524 aa, unidentified
  REGION 1..524: note = Description of Unknown:uncultivated organism sequence
  REGION 1..524: note = Category: MG81 effectors
  REGION 1..524: note = Description: MG81-79 effector
MAKNNNTDTCVLTLPLRVEKWQEDCLLKRFEAARRIYNSLLNFELKKLRQLERTVEYRQIQSVISSAYRSNTKDSPECKDAFKRREKLISANGISEYGFKSDVKFFYKHFDGLIGSNVAVHCIAVQLWAAFDKYLRGSGKEIHFKRLGDISSLKGYSVKGKSDGREIIFRGQYIEWTRKKKKLLLPLKIDPDNEYEREMLSRRVKYVRIIKKPGKNRLRWYAQLTLEGKPALKYSAGTGKPIHSVGKGNVGIDIGPQTVAYASDKEVALLELADRVTNIEHQKKKLQRKLDRSRRATNPDNYKPDGTIKRGVKLTRNKSKRYLKLQSKLAYIQHRQAEIRKLQHTCLANHMLTLGDRFFVEKMNWPGLAHRAKETSISEKTGRYKRKKRFGKSLANKAPAMFISILKRKCETLGLPGVVEVDTYSLKASQYNHLSDTYEKKSLSERWNYMPISDGSDSSKTKRIQRDLYSAFLLQHTIPQPCSFDKEALRIDYPNFVTMHDAEIHRLESLPKTVTSMGVRRSHS

SEQ ID NO: 1802 - protein, 532 aa, unidentified
  REGION 1..532: note = Description of Unknown:uncultivated organism sequence
  REGION 1..532: note = Category: MG81 effectors
  REGION 1..532: note = Description: MG81-80 effector
MILLAKKNNNNNNNTDTCVLTLPLRVEKWQEDCLLKRFEAARRIYNSLLNFELKKLRQLERTVEYRQIQSVISSAYRSNTKDSPECKAALKRREKLIDENGLTKNGFKNDVKFFYKHFDGLIGSSVAVHCIAVQLWAAFNKYLCGNGKEIHFKRLGDISSLKGYSVKGKSGGCEIIFRGQYVEWTRKKKKLLLPLKIDPDNEYEREMLSRRVKYVRIIKKPGKNRLRWYAQLTLEGKPALKYSAETGKPIHSVGKGDVGIDIGPQTVAYASDKEVALLELADRVTNIEHQKKKLQRKLDRSRRATNPDNYKPDGTIKRGVKLTRNKSKRYLKLQSKLAYIQHRQAEIRKLQHTCLANHMLTLGDRFFVEKMNWPGLAHRAKETSISEKTGRYKRKKRFGKSLANKAPAMFISILKQKCETLGLPGVVEVDTFRLKASQYNHLSDTCEKKSLSERWNYMPISDGSDSSKTKRIQRDLYSAFLLQHTIPQSCSFDKEALRIDYPNFVTMHDAEIHRLESLPKTITSMGVRRSHS

SEQ ID NO: 1803 - protein, 512 aa, unidentified
  REGION 1..512: note = Description of Unknown:uncultivated organism sequence
  REGION 1..512: note = Category: MG81 effectors
  REGION 1..512: note = Description: MG81-81 effector
MKKSSTDTCCLTLPLKLEKWQEDRLAKRFEIARQLYNTLVHAELKRLVQIKRTAEYLENEQKIRALDRNNPADRAKLQELYKEQRKSLKTAGFTDYSFTTDMGKYYKHFRDNIGSSVAVHGIAPQVWAAFDKVLFKKGGKKVHYKKPGEVNSVQGYSRTGKSGGTEIMFRGPYIEWKGLKLPLKLSPDNAYETDMLQRRVKLVRLVRRPGKRRDRWYAQLVLEGKPAIKADPVTGKAVHPIGSGPVGLDIGPQTLAYSAAGVAGLVELADRVQNIEQEKRCLQRKMDRSRRAANPDNYAEDGTIRRGVKLTHNKSKRYRRSQQELKYLQHRQAEIRKLQHIQLANHLLSLGDHFYVEKMEWSSLTHRAKKTVISEKTGKPRSKKRFGKSIANKTPAMLIEILRQKCKSLGLLNVVEINPADIKASQYNHLTGEYVKKSLSRRWNEMQDGEHLQRDLYSAFLLQHYDSMSKALDLDSLARDYPAFVQYHHREIERLHALPKTPASMGIRRSIA

SEQ ID NO: 1804 - protein, 554 aa, unidentified
  REGION 1..554: note = Description of Unknown:uncultivated organism sequence
  REGION 1..554: note = Category: MG81 effectors
  REGION 1..554: note = Description: MG81-82 effector
MDNEEKKEDGATCCLTLPLKLEKWQSDHLEKRFEIARQLYNTLVHAELKRIHRIERMPEYREIERLIEATTDKKEKWALKNQKKQFLRKNGINRNTFTTDMKRLYKHFNDNIGSNVAQHGIVSQVLTAFEKVYIENQSGEVHFKKPGDLRSVQGYSQKESGGKEIMFRNGKIIWTQQENDDRKKSPKYQQRKKRQNYKGVKGIAREFPVVFSKNNPYEAEMLTKHVKFVRILRKDGKTKPHWYAQLVLEGKPAIKRDPASGAPKHPVGHGVVGIDIGTRTLAYSTDKEVNLLELADRVQNIEQEKRRLQRKMDRSRRAMNPENYNSDGTFKRGVKLTRNKSKRYRRIQHQLAMIQHHQADIRKQQHNELANYLLTLGDCFFVENMSYCDLVHRANKTEISEKTGRYKRKKRFGKSIANKAPAMLITMLKQKCQSRGLKGVKEVDTHVRASQYNHQTDTCIEKALENRWNVMPDGERIQRDLYSAFLLQHCKQGLPKYNRKELKKEFGEELYRVFDREALQRDYPQFVAYHHMTIQRLSELPHTIPSMGIRRIIS

SEQ ID NO: 1805 - protein, 512 aa, unidentified
  REGION 1..512: note = Description of Unknown:uncultivated organism sequence
  REGION 1..512: note = Category: MG81 effectors
  REGION 1..512: note = Description: MG81-83 effector
MPTKQKEDSNRCVLTLPLLTEPWQEHIIEKRFKIIEHLKNQLISIELRKLKNLQRTKAYKNLMKRIESVPKSERTALYKERNKMLKDAGFSQYTFMDDMAGKKSLMQKHFESHINVQIAHKAAIDVWSSFEKFLFGTGQIVHYQKRGTLSSVASKSPKTGMFYYSDENIFKWSGGGTKPKGGIILCLRVASVKTNYEKEMVANNEIKYYRVVRKWMKTKYKYYLQITFAGKPADKHREISTGRVGIDIGTQTIAIASDKSVKLLELVDKVNKNHIKKCELQRKLDRSRRYTNPDNFNPDGTVKRGTKGHKLKWNKSKHYLEIAGKIRELERKNTDIRKYQHTCLANDILAMGNQIYIEPMNYKGLQKRAKETQVDEKGRYKKKKRFGKSLANKAPAMFVTILKTKAEQHGGEVYEVDIMSYRASQCDHTTGEYTKHGLNDRWRILGNGDKVQRDLYSAFLIKNSNKTHDEIDLDKCSKTYDSFKKLHDKEIENIRNEVILRKRRNISSYGIA

SEQ ID NO: 1806 - protein, 512 aa, unidentified
  REGION 1..512: note = Description of Unknown:uncultivated organism sequence
  REGION 1..512: note = Category: MG81 effectors
  REGION 1..512: note = Description: MG81-84 effector
MPTKQKEGGNRCVLTLPLLTEPWQEHIIEKRFKIIEHLKNQLISIELRKLKNLQRTKAYKNLIKQIESVPKSERTALYKERNKMLKDAGFSQYTFMDDMAGKKSLMQKHFESHINVQIAHKAAIDVWSSFEKFLFGTGQIVHYQKRGTLSSVASKSPKTGMFYYSDENIFKWSGGGTKPKGGIILCLRVASVKTNYEKEMVANNEIKYYRVVRKWMKTKYKYYLQITFAGKPADKHREISTGRVGIDIGTQTIAIASDKSVKLLELADKVNKNHIKKCELQRKLDRSRQYTNPDNFNPDGTVGRGTKGHKLKWNKSKHYLEIAGKIRELERKNADIRKYQHSCLANDILAMGNQIYIEPMNYKGLQKRAKETQVDEKGRYKKKKRFGKSLANKAPAMFVTILKTKAEQHGGEVYEVDIMSYRASQCDHTTGEYTKHGLNDRWRILGNGDKVQRDLYSAFLIKNSNKTHDEIDLDKCSKTYDNFKKLHDKEIENIRNEVILRKRRNISSYGIA

SEQ ID NO: 1807 - protein, 505 aa, unidentified
  REGION 1..505: note = Description of Unknown:uncultivated organism sequence
  REGION 1..505: note = Category: MG81 effectors
  REGION 1..505: note = Description: MG81-85 effector
MGKEEDKEPRCVLTLPLYPEPWQVDIIEKRFHIMEHIENSLTAIELRKLKNVERAKKYKDVVAAIKEEKDDKKRSKLWKERNKLLKDAGINQFDFIKDVSLLQKHFASHIAQKVAAAAARTHVWSSFDRVVFGNGRKIHFHKKGDLKSITSGYFGVSMTVKNGYFIWSGGTKDEKDRKVNPITISIRIKQPETYYEKEMLQKQIKYVTIVRKWIKNKYKYYLQFMLVGNPVVKPRTIANGKRVGIDIGTSSAAIVSGKEIKLVELADHIQNNYDKEIQLQRSMDRSRRVMNPQNFNEDGTIKRGIKLIWIESKHYKEMKGQVRELERKNADIRKYQHTCLANYVLSLGTEVYIEQMSFKGLQRKVKETKYDKNGKPKRKKRFGKSIANRAPATFVMILKNKLSGIAGEELHKVNTFTFKASQYDHTNNTYQKKLLGHRWAKLSNGDKIQRDLYSAFLLMNSDTDMQYTDQNKCKRNYKKFKIQHDELIKAMQESSKRYPKSFGIN

SEQ ID NO: 1808 - protein, 538 aa, unidentified
  REGION 1..538: note = Description of Unknown:uncultivated organism sequence
  REGION 1..538: note = Category: MG81 effectors
  REGION 1..538: note = Description: MG81-86 effector
MNNEEKEKEGATCCLTLPLKLEKWQSDHLEKRFEIARQLYNTLVHAELKKKCQVERMPEYQEIMKMIDTASNQKEKWALEKKRKAFLEENGFSRNAFKADMEKYYKHFNDNIGANVALHGITAQVWIAFDKVFVDNYKQKGKVHFKKPGELCSVQGYSQKKSGGKEIMFREDRIIWNQQGNRDRKKVKREFLLKLSPNNPYEAEMLKRHVKFVRILRKDGKTKPHWYAQLVLEGKPAVKRDPISSAPKHPVGHGVVGIDIGTRTLAYSTDKEVNLLELADHVQNIEQEKRRLQRKMDRSRRATNPENYNPDGTFKRGVKLTRNKSKRYRRIQHQLAMIQHHQADIRKQQHNELANYLLTLGDCFFVENMSYCDLAHRANKTEISEKTGRYKRKKRFGKSIANKAPAMLITMLKQKCQSRGLEGVKEVDTHVCASQYNHQTDTCIKKALENRWNIMPDGERIQRDLYSAFLLQHCRRDLPEYNRKELQKEFGEELYRVFDREALQRDYPQFVAYHHMTIQRLSELPHTIPSMGIRRIIS

SEQ ID NO: 1809 - protein, 512 aa, unidentified
  REGION 1..512: note = Description of Unknown:uncultivated organism sequence
  REGION 1..512: note = Category: MG81 effectors
  REGION 1..512: note = Description: MG81-87 effector
MPTKQKEDSNRCVLTLPLLTEPWQEHIIEKRFKIIEHLKNQLISIELRKLKNLQRTKAYKNLIKQIESVPKSERTALYKERNKMLKDAGFSQYTFMDDMAGKKSLMQKHFESHINVQIAHKAAIDVWSSFEKFLFGSGQMIHYQKRGTLSSVASKSPKTGMFYYSDENIFKWSGGGTKPKGGIILCLRVASVKTNYEKEMVANNEIKYYRVVRKWMKTKYKYYLQITFAGKPADKHREISTGRVGIDIGTQTIAIASDKSVKLLELADKVNKNHIKKCELQRKLDRSRRYTNPDNFNPDGTVKRGTKGHKLKWNKSKHYIEIAGKIRELERKNADIRKYQHTCLANDILAMGNQIYIEPMNYKGLQKRAKETQVDEKGRYKKKKRFGKSLANKAPAMFVTILKTKAEQHGGEVYEVDIMSYRASQCDHTTGEYTKHGLNDRWRILGNGDKVQRDLYSAFLIKNSNKTHDEIDLDKCSKTYDNFKKLHDKEIENIRNEVILRKRRNISSYGIA

SEQ ID NO: 1810 - protein, 530 aa, unidentified
  REGION 1..530: note = Description of Unknown:uncultivated organism sequence
  REGION 1..530: note = Category: MG81 effectors
  REGION 1..530: note = Description: MG81-88 effector
MILLANNNNNNNTDTCVLTLPLRVEKWQEDCLLKRFEAARRIYNSLLNFELKKLRQLERTVEYRQIQSVISSAYRSNTKDSPECKAALKRREKLIDENGLTKNGFKNDVKFFYKHFDGLIGSSVAVHCIAVQLWAAFNKYLRGNGKEIHFKRLGDISSLKGYSVKGKSGGCEIIFRGQYVEWTRKKKKLLLPLKIDPDNEYEREMLSRRVKYVRIIKKPGKNRLRWYAQLTLEGKPALKYSAETGKPIHSVGKGDVGIDIGPQTVAYASDKEVALLELADRVTNIEHQKKKLQRKLDRSRRATNPDNYKPDGTIKRGVKLTRNKSKRYLKLQSKLAYIQHRQAEIRKLQHTCLANHMLTLGDRFFVEKMNWPGLAHRAKETSISEKTGRYKRKKRFGKSLANKAPAMFISILKQKCETLGLPGVVEVDTFRLKASQYNHLSDTCEKKSLSERWNYMPISDGSDSSKTKRIQRDLYSAFLLQHTIPQSCSFDKEALRIDYPNFVTMHDAEIHRLESLPKTITSMGVRRSHS

SEQ ID NO: 1811 - protein, 528 aa, unidentified
  REGION 1..528: note = Description of Unknown:uncultivated organism sequence
  REGION 1..528: note = Category: MG81 effectors
  REGION 1..528: note = Description: MG81-89 effector
MILLANNNNNTDTCVLTLPLRVEKWQEDCLLKRFEAARRIYNSLLNFELKKLRQLERTVEYRQIQSVISSAYRSNTKDSLECKDAFKRRKKLTDENGISEYGFKSDVKFFYKHFDGLIGSNVAVHCIAVQLWAAFDKYLRGSGKEIHFKRLGDISSLKGYSVKGKSGGCEIIFRGQYVEWTRKKKKLLLPLKIDPDNEYEREMLSKRVKYVRIIKKPGKNRLRWYAQLTLEGKPALKYSAETGKPIHSVGKGNVGIDIGPQTVAYASDKEVALLELADRVTNIEHQKKKLQRKLDRSRRATNPDNYKPDGTIKRGVKLTRNKSKRYLKLQSKLAYIQHRQAEIRKLQHTCLANHMLTLGDRFFVEKMNWPGLAHRAKETSISEKTGRYKRKKRFGKSLANKAPAMFISILKRKCETLGLPGVVEVDTYSLKASQYNHLSDTYEKKSLSERWNYMPISDGSDSSKTKRIQRDLYSAFLLQHTIPHPCSFDKEALRIDYPNFVIMHDAEIHRLEFLPKTVTSMGVRRSHS

SEQ ID NO: 1812 - protein, 505 aa, unidentified
  REGION 1..505: note = Description of Unknown:uncultivated organism sequence
  REGION 1..505: note = Category: MG81 effectors
  REGION 1..505: note = Description: MG81-90 effector
MGKEEDKEPRCVLTLPLYPEPWQVDIIEKRFHIMERIENSLTAIELRKLKNVERAKKYKDVVAGIKEEKDDKKRSKLWKERNKLLKDAGINQFDFIKDVSLLQKHFASHIAQKVAAAAARTHVWSSFDRVVFGNGRKIHFHKKGDLKSITSGYFGVSMTVKNGYFIWSGGTKDEKDRKVNPITISIRIKQPETYYEKEMLQKQIKYVTIVRKRIKNRYKYYLQFMLVGNPVAKPRTIANGKRVGIDIGTSSAAIVSGKEIKLVELADHIQNNYDKEIQLQRSMDRSRRAMNPQNFNEDGTIKRGIKLIWIESKHYKEMKGQVRELERKNADIRKYQHTCLANYVLSLGTEVYIEQMSFKGLQRKVKETKYDKNGKPKRKKRFGKSIANRAPATFVMILKNKLSGIAGEELHKVNTFTFKASQYDHTNNTYQKKLLGHRWAKLSNGDKIQRDLYSAFLLMNSDTDMQYTDQNKCKRNYKKFKIQHDELIKAMQESSKRYPKSFGIN

SEQ ID NO: 1813 - protein, 512 aa, unidentified
  REGION 1..512: note = Description of Unknown:uncultivated organism sequence
  REGION 1..512: note = Category: MG81 effectors
  REGION 1..512: note = Description: MG81-91 effector
MPTKQKEGGNRCVLTLPLLTEPWQEHIIEKRFKIIEHLKNQLISIELRKLKKLQRTKAYKNLIKQIESVPKSERTVLYKERNKMLKDAGFSQYTFMDDMAGKKSLMQKHFESHINVQIAHKAAIDVWSSFEKFLFGTGQIVHYQKRGTLSSVASKSPKTGMFYYSDENIFKWSGGGTKPKGGIILCLRVASLKTNYEKEMVANNEIKYYRVVRKWMKTKYKYYLQITFAGKPADKHREISTGRVGIDIGTQTIAIASDKSVKLLELADKVNKNHIKKCELQRKLDRSRRYTNPDNFNPDGTVKRGTKGHKLKWNKSKHYLEVAGKIRELERKNADIRKYQHTCLANDILAMGNQIYIEPMNYKGLQKRAKETQVDEKGRYKKKKRFGKSLANKAPAMFVTILKTKAEQHGGEVYEVDIMSYRASQCDHTTGEYTKHGLNDRWRILGNGDKVQRDLYSAFLIKNSNKTHDEIDLDKCSKTYDSFKKLHDKEIENIRNEVILRKRRNISSYGIA

SEQ ID NO: 1814 - protein, 512 aa, unidentified
  REGION 1..512: note = Description of Unknown:uncultivated organism sequence
  REGION 1..512: note = Category: MG81 effectors
  REGION 1..512: note = Description: MG81-92 effector
MPTKQKEDSNRCVLTLPLLTEPWQEHIIEKRFKIIEHLKNQLISIELRKLKKLQRTKAYKNLIKQIESVPKSERTVLYKERNKMLKDAGFSQYTFMDDMAGKKSLMQKHFESHINVQIAHKAAIDVWSSFEKFLFGSGQMIHYQKRGTLSSVASKSPKTGMFYYPDENIFKWSGGGTKPKGGIILCLRVASVKTNYEKEMVANNEIKYYRVVRKWMKTKYKYYLQITFAGKPADKHREISTGRVGIDIGTQTIAIASDKSVKLLELADKVNKNHIKKCELQRKLDRSRRYTNPDNFNPDGTVKRGTKGHKLKWNKSKHYIEIAGKIRELERKNADIRKYQHTCLANDILAMGNQIYIEPMNYKGLQKRAKETQVDEKGRYKKKKRFGKSLANKAPAMFVTILKTKAEQHGGEVYEVDIMSYRASQCDHTTGEYTKHGLNDRWRILGNGDKVQRDLYSAFLIKNSNKTHDEIDLDKCSKTYDNFKKLHDKEIENIRNEVILRKRRNISSYGIA

SEQ ID NO: 1815 - protein, 511 aa, unidentified
  REGION 1..511: note = Description of Unknown:uncultivated organism sequence
  REGION 1..511: note = Category: MG81 effectors
  REGION 1..511: note = Description: MG81-93 effector
MAKCSTDTCCLTLPLRLEKWQEDRLAKRFEIARQIYNTMVRAELKKLRAMEQSEPYKANQEKIQALDRKTQTDKQALKALYKERDKLLRDGGFSEYGFKSDIKNYYKHFNNNIGSNVAFHGIAPQVWAAFEKMLFKKEGKKVHFKKKGDIHSLRGYSATGKSGGVEIIFRETYIEWKGLKLPLKLSPDNIYETQMLSYRVKYVRLLRKPGKRKDRWYAQLSLEGKPVIKYNPKTGEVRHPIGKGAVGLDIGPQTLAYSAATGADLVELANQVQNVEQEKRRLQRKLDRSRRATNPGNYADDGTIRRGIALTHNKSKRYLRTQQELKYLQHQQAEIRKRQHTELANHLLSLGDCFYVEKMVWTSLTHRAKETEISEKTGKIKRKKRFGKSVANKAPATLIGILQRKSAALGIPGVIEVPTSVKASQYNHQSGTYTPKPLSQRWNNMPDGERIQRDLYSAFLLQHYDPQTNTFDANSLHQDYPQFVQYHHDAVLRLYAMPKTPSSMGIKRSLR

SEQ ID NO: 1816 - protein, 512 aa, unidentified
  REGION 1..512: note = Description of Unknown:uncultivated organism sequence
  REGION 1..512: note = Category: MG81 effectors
  REGION 1..512: note = Description: MG81-94 effector
MKKSSTDTCCLTLPLKLEKWQEDRLAKRFEIARQLYNTLVHAELKRLAQVKQTAEYRENERKIRALDWNDPGDQAKLKGLYKERRKSLKTAGFTDYSFTTDMGKYYKHFRDNIGSSVAVHGIAPQVWAAFDKLLFKKGGKKVHYKKPGEVNSVQGYSRTGKSGGTEIMFRGPYIEWKGLKLPLKLSPDNAYETDMLQRRVKLVRLVRRPGKRRDRWYAQLVLEAKPAIKADPVTGKAVHPIGSGPVGLDIGPQTLAYSAAGAAGLVELADRVQNIEQEKRCLQRKMDRSRRATNPDNYAEDGTIRCGVKLTHNKSKRYRRSQQELKYLQHRQAEIRKLQHIQLANHLLSLGDHFYVEKMEWSSLTHRAKKTVISEKTGKPRSKKRFGKSIANKAPAMLIEILRQKCKSLGLPNVVEINPADIKASQYNHLTGEYVKKSLSRRWNEMQDGEHLQRDLYSAFLLQHYDSMSKALDLDSLARDYPAFVQYHHREIERLHALPKTPSSMGIRRSIA

SEQ ID NO: 1817 - protein, 542 aa, unidentified
  REGION 1..542: note = Description of Unknown:uncultivated organism sequence
  REGION 1..542: note = Category: MG81 effectors
  REGION 1..542: note = Description: MG81-95 effector
MATTDKKDKDKEKLRAYKFRLDPNQAQTIALYQAAGAARYTYNMLTAYNLEVNRLRDDYWKKRHDEGISDADIKKELNALTKEDKRYKQLKYGVFGTQYLTPEKKRHEQAEHRIENGEDPSVVWNQETERSANPWLHTANQRVLVSGLQNASDAWDNFWASRTGKRAGRLVGTPRFKKKGISRDSFTVPAAETMGAYGTAYLRGEAAYQQGKRTITDYRHVRLSYLGVIRTYDSTKPLVKAVAAGAEIRSYTVSRNADRWYVSFLVKFSEPIRRSATKRARAAGAVGVDLGVKYLASLSDSEAPQRFPNLKFAEGLPSLENPRWSEASSRRLHKLQRALARSQKGSNRRSRLVKQIARLHHMTALRRESNLHQLTKKLSTGYTMVGLEDLNVSGMTASAKGTVENPGKNVAQKSGLNRVVLDAAFGVFRYQLEYKTAWYGSTLEKIDRYFASSQTCSECGRKAKTKLTLRDRVFDCAYCGNMMDRDFNAAVNICREAQRLFNKKLASENGESLNGRGSRGALRGAETVEASRPPASHRRGSP

SEQ ID NO: 1818 - protein, 512 aa, unidentified
  REGION 1..512: note = Description of Unknown:uncultivated organism sequence
  REGION 1..512: note = Category: MG81 effectors
  REGION 1..512: note = Description: MG81-96 effector
MKKSNTDTCCLTLPLKLEKWQEDRLAKRFEIARQLYNTLVHAELKRLAQVKQTAEYRENERKIRALDWNDPGDQAKLKGLYKERRKSLKTAGFTDYSFTTDMGKYYKHFRDNIGSSVAVHGIAPQVWAAFDKLLFKKGGKKVHYKKPGEVNSVQGYSRTGKSGGTEIMFRGPYIEWKGLKLPLKLSPDNAYETDMLQRRVKLVRLVRRPGKRRDRWYAQLVLEAKPAIKADPVTGKAVHPIGSGPVGLDIGPQTLAYSAAGAAGLVELADRVQNIEQEKRFLQRKMDRSRRAANPDNYAEDGTIRRGVKLTHNKSKRYRRSQQELKYLQRRQAEIRKLQHIQLANHLLSLGDHFYVEKMEWSSLTHRTKKTVISEKTGKPRSKKRFGKSIANKAPAMLIEILRQKCKSLGLPNVVEINPADIKASQYNHLTGEYVKKSLSRRWNDMQDGEHLQRDLYSAFLLQHYDSCSKTLDHDSIVRDYPAFVQYHHQEIERLHALPKTPASMGIRRSIA

SEQ ID NO: 1819 - protein, 534 aa, unidentified
  REGION 1..534: note = Description of Unknown:uncultivated organism sequence
  REGION 1..534: note = Category: MG81 effectors
  REGION 1..534: note = Description: MG81-97 effector
MGWKSKGRGGKRVKRSSTDTCCLTLPLKLEKWQSDRLEKRFEIGRQIYNTIVHAELKKLRKLERTQQYQEIEQKLENAKQEETKELWKKKRQLLDQNGLSENHFKADMKHYYPHFKDNIASSVAVHGIASQAWTAFEKVLLSKDGKMVHFKKKGELSSLRGYSQAGKSGGIEIIFRGSYVEWKGLKLPLKLSPDNDYETEMLSKRVKYVRILRKDGKTKTHWYAQLALEGKPAVKRDSISGAPKHPVGHGVVGIDIGTRTLAYSTDKEVNLLELADRVQNIEQEKRRLQRKMDRSRRAMNPGNYKPDGSIKQGVKLTWNNSKRYKRIQHQYAMIQHHQADIRKQQHNELANYLLTLGDCFFVENMSYCDLAHRANKTEISEKTGRYKRKKRFGKSIANKAPAMLITMLKQKCQSRGLEGVKEVDTHVCASQYNHQTDTCIKKALENRWNIMPDGERIQRDLYSAFLLQHCRRDLPEYNRKELQKEFGEELYRVFDREALQRDYPQFVAYHHMTIQRLSELPHTIPSMGIRRIIS

SEQ ID NO: 1820 - protein, 538 aa, unidentified
  REGION 1..538: note = Description of Unknown:uncultivated organism sequence
  REGION 1..538: note = Category: MG81 effectors
  REGION 1..538: note = Description: MG81-98 effector
MNNEEKEKEGATCCLTLPLKLEKWQSDHLEKRFEIARQLYNTLVHAELKKKCQVERMPEYQEIMKMIDAASNQKEKWALEKKRKAFLEENGFSRNAFKADMEKYYKHFNDNIGANVALHGITAQVWIAFDKVFVDNYKQKGKVHFKKPGELCSVQGYSQKKSGGKEIMFREDRIIWNQQGNRDRKKVKREFLLKLSPDNPYEAEMLKRHVKFVRILRKDGKTKPHWYAQLVLEGKPAVKRDPASGAPKHPVGHGVVGIDIGTRTLAYSTDKEVNLLELADRVQNIEQEKRRLQRKMDRSRRATNPENYNPDGTFKRGVKLTRNKSKRYRRIQHQLAMIQHHQADIRKQQHNELANYLLTLGDCFFVENMSYCDLVHRANKTEISEKTGRYKRKKRFGKSIANKAPAMLITMLKQKCQSRGLEGVKEVDTHVRASQYNHQTDTCIEKALENRWNVMPDGERIQRDLYSAFLLQHCKQGLPEYNRKELKKEFGEELYRVFDREALQRDYPQFVAYHHMTIQRLSELPHTIPSMGIRRIIS

SEQ ID NO: 1821 - protein, 550 aa, unidentified
  REGION 1..550: note = Description of Unknown:uncultivated organism sequence
  REGION 1..550: note = Category: MG81 effectors
  REGION 1..550: note = Description: MG81-99 effector
MGWKSKGRGGTLVDNEEKKEDGATCCLTLPLKLEKWQSDHLEKRFEIARQLYNTLVHAELKKKCQVERMPEYQEIMKMIDTASNQKEKWALEKKRKAFLEENGFSRNAFKADMEKYYKHFNDNIGANVALHGITAQVWIAFDKVFVDNYKQKGKVHFKKPGELCSVQGYSQKKSGGKEIMFREDRIIWNQQGNRDRKKVKREFLLKLSPDNPYEAEMLKRHVKFVRILRKDGKTKPHWYAQLVLEGKPAVKRDPASGAPKHPIGHGVVGIDIGTRTLAYSTDKEVNLLELADRVQNIEQEKRRLQRKMDRSRRATNPENYNPDGTFKRGVKLTRNKSKRYRRIQHQLAMIQHHQADIRKQQHNELANYLLTLGDCFFVENMSYCDLVHRANKTEISEKTGRYKRKKRFGKSIANKAPAMLITMLKQKCQSRGLKGVKEVDTHVRASQYNHQTDTCIEKALENRWNVMPDGERIQRDLYSAFLLQHCKQGLPEYNRKELKKEFGEELYRVFDREALQRDYPQFVAYHHMTIQRLSELPHTIPSMGIRRIIS

SEQ ID NO: 1822 - protein, 357 aa, unidentified
  REGION 1..357: note = Description of Unknown:uncultivated organism sequence
  REGION 1..357: note = Category: MG81 effectors
  REGION 1..357: note = Description: MG81-100 effector
MNNEEKEKEGATCCLTLPLKLEKWQSDHLEKRFEIARQLYNTLVHAELKKKCQVERMPEYQEIMKMIDTASNQKEKWALEKKRKAFLEENGFSRNAFKADMEKYYKHFNDNIGANVALHGITAQVWIAFDKVFVDNYKQKGKVHFKKPGELCSVQGYSQKKSGGKEIMFREDRIIWNQQGNRDRKKVKREFLLKLSPNNPYEAEMLKRHVKFVRILRKDGKTKPHWYAQLVLEGKPAVKRDPISSAPKHPVGHGVVGIDIGTRTLAYSTDKEVNLLELADRVQNIEQEKRRLQRKMDRSRRAMNPENYNSDGTFKRGVKLTRNKSKRYRRIQHQLAMIQHHQADIRKQQHNELANFC

SEQ ID NO: 1823 - protein, 522 aa, unidentified
  REGION 1..522: note = Description of Unknown:uncultivated organism sequence
  REGION 1..522: note = Category: MG81 effectors
  REGION 1..522: note = Description: MG81-101 effector
MKKSSTDTCCLTLPLKLEKWQSDRLEKRFEIGRQIYNTVVRAELKKLHQLERTPQYREIEQKLKEAKQEEAKELWKKRTQLLSQSGFSEYGFKSDMKYYYQHFKENIGSSVAVHGIASQVWTAFEKVLFSKDGKMVHFKKKGELSSLRGYSQAGKSGGKEIIFRGNYIEWKELKLPLKLTPNNDYETEMLSKRVKYVRLLRQDGKTKPHWYAQLVLEGKPAIKRDPVSGAPKHHVGHGVVGLDIGTRTLAYSADDKVDLLELADRVQNIEQEKMLLQRKLDRSRRATNPENYKPDGTIKKGVKLTRNKSKRYRKIQHQLAMLQHRQADIRKRQHNELANYLLTLGDCFFVEDMDYRALTRKAKKTEISEKTGRYKRKKRFGKSIANKAPSMLIALLDQKCKSLNLEGVKKVDTAVKASQYNHQTDECKAKELKERWNIMPDGERIQRDLYSAFLLQHCKRGLPEYNRKELKKEFGEELYRVFDREALQRDYPQFVVYHHMTIQRLSALPKTIASMGIRRSIS

SEQ ID NO: 1824 - protein, 548 aa, unidentified
  REGION 1..548: note = Description of Unknown:uncultivated organism sequence
  REGION 1..548: note = Category: MG81 effectors
  REGION 1..548: note = Description: MG81-102 effector
MEWKSTGRGGTLVDNEEKKEDGATCCLTLPLKLEKWQSDHLEKRFEIARQLYNTLVHAELKRIHRIERMPEYREIERQIEATTDKKEKWALKNQKKQFLRKNGINRNTFTTDMKRLYKHFNDNIGSNVAQHGIVSQVLTAFEKVYIENQSGEVHFKKPGDLRSVQGYSQKKSGGVEIMFREGKIIWNQQGNNDRKGVAREFPLKLSPDNSYEAEMLKKHVKFVRILRNEGKTKPHWYAQLVLEGKPAIKRDPASGAPKHPVGHGVVGIDIGTRTLAYSTDSKVDLIELADRVQNTEQEKMLLQRKLDRSRRATNPENYKPDGTIKKGVKLTRNKSKRYRKIQHQLAMLQHRQADIRKRQHNELANYLLTLGDCFFVEDMDYRALTRKAKKTEISEKTGRYKRKKRFGKSIANKAPSMLIALLDQKCKSLNLEGVKKVDTAVKASQYNHQTDECKAKKLKERWNIMPDGERIQRDLYSAFLLQHCRRDLPEYNRKKLQEAFGNELYRVFDREALQRDYPKFVEYHRETIQRLSALPKTIASMGIRRIIS

SEQ ID NO: 1825 - protein, 511 aa, unidentified
  REGION 1..511: note = Description of Unknown:uncultivated organism sequence
  REGION 1..511: note = Category: MG81 effectors
  REGION 1..511: note = Description: MG81-103 effector
MAKCSTDTCCLTLPLRLEKWHEDRLAKRFEIARQIYNTMVRAELKKLRAMEQSEPYKANQEKIQALDWKTQADKQALKALYKERDKLLRDGGFSEYGFKSDIKNYYKHFNNNIGSSVAVHGIAPQVWAAFEKMLFKKEGKKVHFKKKGDIRSLRGYSVTRKSGGVEIIFRETYIEWKGLKLPLKLSPDNIYETQMLSYRVKYVHLLRKPGKRKDRWYAQLSLEGKPVIKYNPKTGEVRHPIGKGAVGLDIGPQTLAYSAATGADLVELANQVQNVEQEKRRLQRKLDRSRRATNPGNYADDGTIRRGIALTHNKSKRYLRTQQELKYLQHQQAEIRKRQHTELANHLLSLGDCFYVEKMVWTSLTHRAKETEISEKTGKIKRKKRFGKSVANKAPATLIGILQRKSAALGIPGVIEVPTSVKASQYNHQSGTYTPKPLSQRWNNMPDGERIQRDLYSAFLLQHYDPQTNTFDANSLHQDYPQFVQYHHDAVLRLYAMPKTPSSMGIKRSLR

SEQ ID NO: 1826 - protein, 512 aa, unidentified
  REGION 1..512: note = Description of Unknown:uncultivated organism sequence
  REGION 1..512: note = Category: MG81 effectors
  REGION 1..512: note = Description: MG81-104 effector
MKKSSTDTCCLTLPLKLEKWQEDRLAKRFEIARQLYNTLVHAELKRLVQIKRTAEYLENEQKIRALDRNNPADRAKLQELYKEQRKSLKTAGFTDYSFTTDMGKYYKHFRDNIGSSVAVHGIAPQVWAAFDKVLFKKGGKKVHYKRPGEVNSVQGYSRTGKSGGREIMFRGAYIEWKGLKLPLKLSPDNAYETDMLQRRVKLVRLVRRPGKRRDRWYAQLVLEGKPAIKADPVTGKAVHPIGSGPIGLDIGPQTLAYSAAGAAGLVELADRVQNIEQEKRRLQRKMDRSRRAANPDNYAEDGTIRRGVKLTHNKSKRYRRSQQELKYLQHRQAEIRKLQHIQFANHLLSLGDHFYVEKMEWSSLTHRAKETVISEKTGKPRSKRRFGKSIANKAPAMLIEILRQKCKSLGLSDVVEINPADIKASQYNHLTGEYVKKSLSRRWNDMQDGEHLQRDLYSAFLLQHYDSCSKTLDHDSIVRDYPAFVQYHHREIERLHALPKTPSSMGIRRSIA

SEQ ID NO: 1827 - protein, 311 aa, unidentified
  REGION 1..311: note = Description of Unknown:uncultivated organism sequence
  REGION 1..311: note = Category: MG81 effectors
  REGION 1..311: note = Description: MG81-105 effector
MILLAKNNNNTDTCVLTLPLRVEKWQEDCLLKRFEAARRIYNSLLNFELKKLRQLERTVEYRQIQSVISSAYRSNTKDSPECKDAFKRREKLISANGISEYGFKSDVKFFYKHFDGLIGSNVAVHCIAVQLWAAFDKYLRGSGKEIHFKRLGDISSLKGYSVKGKSGGCEIIFRGQYIEWTRKKKKLLLPLKIDPDNEYEREMLSRRVKYVRIIKKPGKNRLRWYAQLTLEGKPALKYSAETGKPIHSVGKGNVGIDIGPRPLHTLPIKKLLCLNLLTESPISSIKKRSFSASWIAAAAQRIRTTTNRTAQ

SEQ ID NO: 1828 - protein, 511 aa, unidentified
  REGION 1..511: note = Description of Unknown:uncultivated organism sequence
  REGION 1..511: note = Category: MG81 effectors
  REGION 1..511: note = Description: MG81-106 effector
MAKCSTDTCCLTLPLRLEKWQEDRLAKRFEIARQIYNTMVRAELKKLRAMEQSEPYKANQEKIQALDRKTQTDKQALKALYKERDKLLRDGGFSEYGFKSDIKNYYKHFNNNIGSNVAFHGIAPQVWAAFEKMLFKKEGKKVHFKKKGDIHSLRGYSATGKSGGVEIIFRETYIEWKGLKLPLKLSPDNIYETQMLSYRVKYVRLLRKPGKRKDRWYAQLSLEGKPVIKYNPKTGEVRHPIGKGAVGLDIGPQTLAYSAATGADLVELANQVQNVEQEKRRLQRKLDRSRRATNPGNYADDGTIRRGIALTHNKSKRYLRTQQELKYLQHQQAEIRKRQHTELANHLLSLGDCFYVEKMVWTSLTHRAKETEISEKTGKIKRKKRFGKSVANKAPATLIGILQRKSAALGIPGVIEVPTSVKASQYNHQSGTYTHKPLSQRWNNMPDGERIQRDLYSAFLLQHYDPQTNTFDANSLHQDYPQFVQYHHDAVLRLYAMPKAPSSMGIKRSLR

SEQ ID NO: 1829 - protein, 527 aa, unidentified
  REGION 1..527: note = Description of Unknown:uncultivated organism sequence
  REGION 1..527: note = Category: MG81 effectors
  REGION 1..527: note = Description: MG81-107 effector
MAKNNNNNDTDTCVLTLPLRVEKWQEDCLLKRFEAARRIYNSLLNFELKKLRQLERTVEYRQIQSVISSAYRSNTKDSPECKDAFKRREKLISANGISENGFKSDVKFFYKHFDGLIGSSVAVHCIAVQLWAAFDKYLSGSGKEIHFKRLGDISSLKGYSVKGKSGGCEIIFRGQYVEWTRKKKKLLLPLKIDPDNEYEREMLSRRVKYVRIIKKPGKNRLRWYAQLTLEGKPALKYSAETGKPIHSVGKGNVGIDIGPQTVAYASDKEVALLELADRVTNIEHQKKKLQRKLDRSRRATNPDNYKPDGTIKRGVKLTRNKSKRYLKLQSKLAYIQHRQAEIRKLQHTCLANHMLTLGDCFFVEKMNWPGLAHRAKETSISEKTGRYKRKKRFGKSLANKAPAMFISILKRKCETLGLPGVVEVDTFRLRASQYNHLSDTYEKKSLSERWNYMPISDGSDSSKTKRIQRDLYSAFLLQHTIPQPCSFDKEALRIDYPNFVIMHDAEIHRLESLPKTITSMGVRRSHS

SEQ ID NO: 1830 - protein, 536 aa, unidentified
  REGION 1..536: note = Description of Unknown:uncultivated organism sequence
  REGION 1..536: note = Category: MG81 effectors
  REGION 1..536: note = Description: MG81-108 effector
MDADEYKKLLKKFHKLSDRHILVAEADMSYPDVQKVVNLSDRIRKAGNELVSLMKKNYEQLMRTKKYRKLLQLYGSTEDKKKRKTYAGQLNEMQEQYNVTWDFCRASMIPIGKKYGIDAIFALTKAEDVWRGVEKCLYGNGRMLHFSKYGDFPCIRAKQINRGIPMSVKNDELKFKLGKLVFGIQVKDRFQTDEVNAVLDYLAQPEVIDNKAVKTLQDEACCISTYRPCYATLVPKFIRGKYRVYLHLVIEGKAKPKYDSSGNPRHKYGRGVVGADIGTQTVAYTSDTETGLKNLSERGNSIQKSERLERLYYRAMDRSRRATNPKNYNADGTIKKGKKKWTYSRHYKKLKAKHAELCCINATNRQLAINEDVNHLRCLGDTFVTEPKNAARLMKRAKETTVNNKGKINRKKRFGKSVKNRCPGGFQAAVENKFKTSGGTYIEVPNNYRASQYDHTADDYIKKKLSDRMYKLADGTLVQRDWYSSFLLYCYNYRTNDIDKKKCAAEFKKCYSMEKDLIEWIKENKIKVLNSGIKIA

SEQ ID NO: 1831 - protein, 334 aa, unidentified
  REGION 1..334: note = Description of Unknown:uncultivated organism sequence
  REGION 1..334: note = Category: MG81 effectors
  REGION 1..334: note = Description: MG81-109 effector
MLKRHVKFVRILRKDGKTKPHWYAQLVLEGKPAVKRDPASGAPKHPIGHGVVGIDIGTRTLAYSTDKEVNLLELADRVQNIEQEKRRLQRKMDRSRRATNPENYNPDGTFKRGVKLTRNKSKRYRRIQHQLAMIQHHQADIRKQQHNELANYLLTLGDCFFVENMSYCDLVHRANKTEISEKTGRYKRKKRFGKSIANKAPAMLITMLKQKCQSRGLKGVKEVDTHVRASQYNHQTDTCIEKALENRWNVMPDGERIQRDLYSAFLLQHCKQGLPEYNRKELKKEFGEELYRVFDREALQRDYPQFVAYHHMTIQRLSELPHTIPSMGIRRIIS

SEQ ID NO: 1832 - protein, 511 aa, unidentified
  REGION 1..511: note = Description of Unknown:uncultivated organism sequence
  REGION 1..511: note = Category: MG81 effectors
  REGION 1..511: note = Description: MG81-110 effector
MAKCSTDTCCLTLPLRLEKWQEDRLAKRFEIARQIYNTMVRAELKKLRAMEQSEPYKANQEKIQALDWKTQTDKQALKALYKERDKLLRDGGFSEYGFKSDIKNYYKHFNNNIGSNVAFHGIAPQVWAAFEKMLFKKEGKKVHFKKKGDIHSLRGYSAAGKSGGVEIIFRETYIEWKGLKLPLKLSPDNIYETQMLSYRVKYVRLLRKPGKRKDRWYAQLSLEGKPVIKYNPKTGEVRHPIGKGAVGLDIGPQTLAYSAATGADLVELANQVQNVEQEKRRLQRKLDRSRRATNPGNYADDGTIRRGIALTHNKSKRYLRTQQELKYLQHQQAEIRKRQHTELANHLLSLGDCFYVEKMVWTSLTHRAKETEISEKTGKIKRKKRFGKSVANKAPATLIGILQRKSAALGIPGVIEVPTSVKASQYNHQSGTYTPKPLSQRWNNMPDGERIQRDLYSAFLLQHYDPQTNTFDANSLHQDYPQFVQYHHDAVLRLYAMPKAPSSMGIKRSLR

SEQ ID NO: 1833 - protein, 566 aa, unidentified
  REGION 1..566: note = Description of Unknown:uncultivated organism sequence
  REGION 1..566: note = Category: MG81 effectors
  REGION 1..566: note = Description: MG81-111 effector
MGWKSKGRGGTLVDNEEKKEDGATCCLTLPLKLEKWQSDHLEKRFEIARQLYNTLVHAELKRIHRIERMPEYREIERLIEATTDKKEKWALKNQKKQFLRKNGINRNTFTTDMKRLYKHFNDNIGSNVAQHGIVSQVLTAFEKVYIENQSGEVHFKKPGDLRSVQGYSQKESGGKEIMFRNGKIIWTQQENDDRKKSPKYQQRKKRQNYKGVKGIAREFPVVFSKNNPYEAEMLTKHVKFVRILRKDGKTKPHWYAQLVLEGKPAIKRDPASGAPKHPVGHGVVGIDIGTRTLAYSADSKVDLIELADRVQNIEQEKLLLQRKLDRSRRATNPENYKPDGTIKKGVKLTRNKSKRYRKIQHQLAMLQHRQADIRKRQHNELANYLLTLGDCFFVEDMDYRALTRKAKKTEISEKTGRYKRKKRFGKSIANKAPSMLIALLDQKCKSLNLEGVKKVDTAVKASQYNHQTDECKAKELKERWNIMPDGERIQRDLYSAFLLQHCKRGLPEYNRKKLQETFGNELYRVFDREALQRDYPKFVEYHRKTIQRLSALPKTIASMGIRRIIS

SEQ ID NO: 1834 - protein, 538 aa, unidentified
  REGION 1..538: note = Description of Unknown:uncultivated organism sequence
  REGION 1..538: note = Category: MG81 effectors
  REGION 1..538: note = Description: MG81-112 effector
MNNEEKEKEGATCCLTLPLKLEKWQSDHLEKRFEIARQLYNTLVHAELKKKCQVERMPEYQEIMKMIDTASNQKEKWALEKKRKAFLEENGFSRNAFKADMEKYYKHFNDNIGANVALHGITAQVWIAFDKVFVDNYKQKGKVHFKKPGELCSVQGYSQKKSGGKEIMFREDRIIWNQQGNRDRKKVKREFLLKLSPNNPYEAEMLKRHVKFVRILRKDGKTKPHWYAQLVLEGKPAVKRDPISSAPKHPVGHGVVGIDIGTRTLAYSTDKEVNLLELADHVQNIEQEKRRLQRKMDRSRRATNPENYNPDGTFKRGVKLTRNKSKRYRRIQHQLAMIQHHQADIRKQQHNELANYLLTLGDCFFVENMSYCDLVHRANKTEISEKTGRYKRKKRFGKSIANKAPAMLITMLKQKCQSRGLKGVKEVDTHVRASQYNHQTDTCIEKALENRWNVMPDGERIQRDLYSAFLLQHCKQGLPEYNRKELKKEFGEELYRVFDREALQRDYPQFVAYHHMTIQRLSELPHTIPSMGIRRIIS

SEQ ID NO: 1835 - protein, 534 aa, unidentified
  REGION 1..534: note = Description of Unknown:uncultivated organism sequence
  REGION 1..534: note = Category: MG81 effectors
  REGION 1..534: note = Description: MG81-113 effector
MGWKSKGRGGKRVKRSSTDTCCLTLPLKLEKWQSDRLEKRFEIGRQIYNTIVHAELKKLRKLERTQQYQEIEQKLENAKQEETKELWKKKRQLLDQNGLSENHFKADMKHYYPHFKDNIASSVAVHGIASQAWTAFEKVLLSKDGKMVHFKKKGELSSLRGYSQTGKSGGIEIIFRGSYVEWKGLKLPLKLSPDNDYETEMLSKRVKYVRILRQDGKTKPHWYAQLVLEGKPAVKRDPISGAPKHPIGRGVVGIDIGTRTLAYSADSKVDLIELADRVQNIEQEKLLLQRKLDRSRRATNPENYKPDGTIKKGVKLTRNKSKRYRRIQHQLAMIQHHQADIRKQQHNELANYLLTLGDCFFVENMSYCDLAHRANKTEISEKTGRYKRKKRFGKSIANKAPAMLITMLKQKCQSRGLKGVKEVDTHVRASQYNHQTDTCIEKALENRWNVMPDGERIQRDLYSAFLLQHCKQGLPEYNRKELKKEFGEELYRVFDREALQRDYPQFVAYHHMTIQRLSELPHTIPSMGIRRIIS

SEQ ID NO: 1836 - protein, 534 aa, unidentified
  REGION 1..534: note = Description of Unknown:uncultivated organism sequence
  REGION 1..534: note = Category: MG81 effectors
  REGION 1..534: note = Description: MG81-114 effector
MGWKSKGRGGTLVKKSSTDTCCLTLPLKLEKWQSDRLEKRFEIGRQIYNTVVRAELKKLQQVERTPQYREIEQKLKEAKQEEAKELWKTRTQLLSKSGFSEYGFKSDMKYYYQHFKENIGSSVAVHGIASQVWTAFEKVLFSKDGKMVHFKKKGELSSLRGYSQAGKSGGIEIIFRGSYVEWKGLKLPLKLSPDNDYETEMLSKRVKYVRILRKEGKTKPHWYAQLVLEGKPAIKRDPASGAPKHPVGHGVVGIDIGTRTLAYSADSKVDLIELADRVQNIEQEKMLLQRKLDRSRRATNPENYKPDGTIKKGVKLTRNKSKRYRKIQHQLAMLQHRQADIRKRQHNELANYLLTLGDCFFVEDMDYRALTRKAKKTEISEKTGRYKRKKRFGKSIANKAPSMLIALLDQKCKSLNLEGVKKVDTAVKASQYNHQTDECKAKELKERWNIMPDGERIQRDLYSAFLLQHCRRDLPEYNRKKLQETFGNELYRVFDREALQRDYPQFVAYHHMTIQRLSALPKTIASMGIRRSIS

SEQ ID NO: 1837 - protein, 213 aa, unidentified
  REGION 1..213: note = Description of Unknown:uncultivated organism sequence
  REGION 1..213: note = Category: MG81 effectors
  REGION 1..213: note = Description: MG81-115 effector
MKLTRNKSKRYLKLQSKLAYIQHRQAEIRKLQHTCLANHMLTLGDRFFVEKMNWPGLAHRAKETSISEKTGRYKRKKRFGKSLANKAPAMFISILKRKCETLGLPGVVEVDTYSLKASQYNHLSDTYEKKSLSERWNYMPISDGSDSSKTKRIQRDLYSAFLLQHTIPQPCSFDKKALRIDYPNFVTMHDAEIHRLESLPKTITSMGVRRSHS

SEQ ID NO: 1838 - protein, 522 aa, unidentified
  REGION 1..522: note = Description of Unknown:uncultivated organism sequence
  REGION 1..522: note = Category: MG81 effectors
  REGION 1..522: note = Description: MG81-116 effector
MKRSSTDTCCLTLPLKLEKWQSDRLEKRFEIGRQIYNTIVHAELKKLRKLERTQQYQEIEQKLENAKQEETKELWKKKRQLLDQNGLSEDHFKADMKYYYPHFKDNIASNVAVHGIASQAWTAFEKVLFSKDGKMVHFKKKGELSSLRGYSRAGKSGGVEIIFRGSYVEWKGLKLPLKLSPDNDYETEMLSKRVKYVRILRKDGKTKTHWYAQLVLEGKPAVKRDPASGAPKHPIGHGVVGIDIGTRTLAYSTDKEVNLLELADHVQNIEQEKRRLQRKMDRSRRATNPENYNPDGTFKRGVKLTRNKSKRYRRIQHQLAMIQHHQADIRKQQHNELANYLLTLGDCFFVENMSYCDLVHRANKTEISEKTGRYKRKKRFGKSIANKAPAMLITMLKQKCQSRGLEGVKEVDTHVRASQYNHQTDTCIEKALENRWNVMPDGERIQRDLYSAFLLQHCKQGLPEYNRKELKKEFGEELYRVFDREALQRDYPQFVAYHHMTIQRLSELPHTIPSMGIRRIIS

SEQ ID NO: 1839 - protein, 538 aa, unidentified
  REGION 1..538: note = Description of Unknown:uncultivated organism sequence
  REGION 1..538: note = Category: MG81 effectors
  REGION 1..538: note = Description: MG81-117 effector
MNNEEKEKEGATCCLTLPLKLEKWQSDHLEKRFEIARQLYNTLVHAELKKKCQVERMPEYQEIMKMIDTASNQKEKWALEKKRKAFLEENGFSRNAFKADMEKYYKHFNDNIGANVALHGITAQVWIAFDKVFVDNYKQKGKVHFKKPGELCSVQGYSQKKSGGKEIMFREDRIIWNQQGNRDRKKVKGEFLLKLSPNNPYEAEMLKRHVKFVRILRKDGKTKPHWYAQLVLEGKPAVKRDPISSAPKHPVGHGVVGIDIGTRTLAYSTDKEVNLLELADHVQNIEQEKRRLQRKMDRSRRATNPENYNPDGTFKRGVKLTRNKSKRYRRIQHQLAMIQHHQADIRKQQHNELANYLLTLGDCFFVENMSYCDLVHRANKTEISEKTGRYKRKKRFGKSIANKAPAMLITMLKQKCQSRGLKGVKEVDTHVRASQYNHQTDTCIEKALENRWNVMPDGERIQRDLYSAFLLQHCKQGLPEYNRKELKKEFGEELYRVFDREALQRDYPQFVAYHHMTIQRLSELPHTIPSMGIRRIIS

SEQ ID NO: 1840 - protein, 388 aa, unidentified
  REGION 1..388: note = Description of Unknown:uncultivated organism sequence
  REGION 1..388: note = Category: MG81 effectors
  REGION 1..388: note = Description: MG81-118 effector
MVHFKKKGELSSLRGYSQTGKSGGIEIIFRGSYVEWKGLKLPLKLSPDNDYETEMLSKRVKYVRILRQDGKTKPHWYAQLVLEGKPAVKRDPISGAPKHPIGHGVVGIDIGTRTLAYSADSKVDLIELADRVQNIEQEKLLLQRKLDRSRRATNPGNYNPDGTIKKGVKLTRNKSKRYRKIQHQLAMLQHRQADIRKRQHNELANYLLTLGDCFFVEDMDYRALTRKAKKTEISEKTGRYKRKKRFGKSIANKAPSMLIALLDQKCESLNLEGVKKVDTAVKASQYNHQTDECKAKELKERWNIMPDGERIQRDLYSAFLLQHCRRDLPEYNRKELQKEFGEELYRVFDREALQRDYPQFVAYHHMTIQRLSELPHTIPSMGIRRIIS

SEQ ID NO: 1841 - protein, 538 aa, unidentified
  REGION 1..538: note = Description of Unknown:uncultivated organism sequence
  REGION 1..538: note = Category: MG81 effectors
  REGION 1..538: note = Description: MG81-119 effector
MDNEEKEKDGATCCLTLPLKLEKWQSDHLEKRFEIARQLYNTLVHAELKKKCQVERMPEYQEIMKMIDAASNQKEKWALEKKRKAFLEENGFNRNAFKADMEKYYKHFNDNIGANVALHGITAQVWIAFDKVFVDNYKQKGKVHFKKPGELCSVQGYSQKKSGGKEIMFREDRIIWNQQGNRDRKKVKREFLLKLSPDNPYEAEMLKRHVKFVRILRKDGKTKPHWYAQLVLEGKPAVKRDPASGAPKHPIGHGVVGIDIGTRTLAYSTDKEVNLLELADHVQNIEQEKRRLQRKMDRSRRATNPENYNPDGTFKRGVKLTRNKSKRYRRIQHQLAMIQHHQADIRKQQHNELANYLLTLGDCFFVENMSYCDLVHRANKTEISEKTGRYKRKKRFGKSIANKAPAMLITMLKQKCQSRGLKGVKEVDTHVRASQYNHQTDTCIEKALENRWNVMPDGERIQRDLYSAFLLQHCKQGLPEYNRKELKKEFGEELYRVFDREALQRDYPQFVAYHHMTIQRLSELPHTIPSMGIRRIIS

SEQ ID NO: 1842 - protein, 567 aa, unidentified
  REGION 1..567: note = Description of Unknown:uncultivated organism sequence
  REGION 1..567: note = Category: MG81 effectors
  REGION 1..567: note = Description: MG81-120 effector
MSNLLFLLENEEKMRYNGVEKQRKGEGTRVNNEEKEKDGATCCLTLPLKLEKWQSDHLEKRFEIARQLYNTLVHAELKKKCQVERMPEYQEIMKMIDAASNQKEKWALEKKRKAFLEENGFSRNAFKADMEKYYKHFNDNIGANVALHGITAQVWIAFDKVFVDNYKQKGKVHFKKPGELCSVQGYSQKKSGGKEIMFREDRIIWNQQGNRDRKKVKREFLLKLSPDNPYEAEMLKRHVKFVRILRKDGKTKPHWYAQLVLEGKPAVKRDPASGAPKHPIGHGVVGIDIGTRTLAYSTDKEVNLLELADHVQNIEQEKRRLQRKMDRSRRATNPENYNPDGTFKRGVKLTRNKSKRYRRIQHQLAMIQHHQADIRKQQHNELANYLLTLGDCFFVENMSYCDLVHRANKTEISEKTGRYKRKKRFGKSIANKAPAMLITMLKQKCQSRGLEGVKEVDTHVRASQYNHQTDTCIEKALENRWNVMPDGERIQRDLYSAFLLQHCKQGLPEYNRKELKKEFGEELYRVFDREALQRDYPQFVAYHHMTIQRLSELPHTIPSMGIRRIIS

SEQ ID NO: 1843 - protein, 538 aa, unidentified
  REGION 1..538: note = Description of Unknown:uncultivated organism sequence
  REGION 1..538: note = Category: MG81 effectors
  REGION 1..538: note = Description: MG81-121 effector
MNNEEKEKEGATCCLTLPLKLEKWQSDHLEKRFEIARQLYNTLVHAELKKKCQVERMPEYQEIMKMIDTASNQKEKWALEKKRKAFLEENGFSRNAFKADMEKYYKHFNDNIGANVALHGITAQVWIAFDKVFVDNYKQKGKVHFKKPGELCSVQGYSQKKSGGKEIMFREDRIIWNQQGNRDRKKVKREFLLKLSPDNPYEAEMLKRHVKFVRILRKDGKTKPHWYAQLVLEGKPAVKRDPASGAPKHPIGHGVVGIDIGTRTLAYSTDKEVNLLELADRVQNIEQEKRRLQRKMDRSRRATNPENYNPDGTFKRGVKLTRNKSKRYRRIQHQLAMIQHHQADIRKQQHNELANYLLTLGDCFFVENMSYCDLVHRANKTEISEKTGRYKRKKRFGKSIANKAPAMLITMLKQKCQSRGLKGVKEVDTHVRASQYNHQTDTCIEKALENRWNVMPDGERIQRDLYSAFLLQHCKQGLPEYNRKELKKEFGEELYRVFDREALQRDYPQFVAYHHMTIQRLSELPHTIPSMGIRRIIS

SEQ ID NO: 1844 - protein, 550 aa, unidentified
  REGION 1..550: note = Description of Unknown:uncultivated organism sequence
  REGION 1..550: note = Category: MG81 effectors
  REGION 1..550: note = Description: MG81-122 effector
MGRKSTGRGGKRVNNEEKEKDGATCCLTLPLKLEKWQSDHLEKRFEIARQLYNTLVHAELKKKCQVVRMPEYQEIMKMIDAASNQKEKWALEKKRKAFLEENGFSRNAFKADMEKYYKHFNDNIGANVALHGITAQVWIAFDKVFVDNYKQKGKVHFKKPGELCSVQGYSQKKSGGKEIMFREDRIIWNQQGNRDRKKVKREFLLKLSPDNPYEAEMLKRHVKFVRILRKDGKTKPHWYAQLVLEGKPAVKRDPISSAPKHPVGHGVVGIDIGTRTLAYSTDKEVNLLELADRVQNIEQEKRRLQRKMDRSRRAMNPENYNSDGTFKRGVKLTRNKSKRYRRIQHQLAMIQHHQADIRKQQHNELANYLLTLGDCFFVENMSYCDLVHRANKTEISEKTGRYKRKKRFGKSIANKAPAMLITMLKQKCQSRGLEGVKEVDTHVRASQYNHQTDTCIEKALENRWNVMPDGERIQRDLYSAFLLQHCKQGLPEYNRKELKKEFGEELYRVFDREALQRDYPQFVAYHHMTIQRLSELPHTIPSMGIRRIIS

SEQ ID NO: 1845 - protein, 538 aa, unidentified
  REGION 1..538: note = Description of Unknown:uncultivated organism sequence
  REGION 1..538: note = Category: MG81 effectors
  REGION 1..538: note = Description: MG81-123 effector
MDNEEKEKDGATCCLTLPLKLEKWQSDHLEKRFEIARQLYNTLVHAELKKKCQVERMPEYQEIMKMIDAASNQKEKWALEKKRKAFLEENGFSRNAFKADMEKYYKHFNDNIGANVALHGITAQVWIAFDKVFVDNYKQKGKVHFKKPGELCSVQGYSQKKSGGKEIMFREDRIIWNQQGNRDRKKVKREFLLKLSPDNPYEAEMLKRHVKFVRILRKDGKTKPHWYAQLVLEGKPAVKRDPASGAPKHPIGHGVVGIDIGTRTLAYSTDSEVNLLELADRVQNIEQEKRRLQRKMDRSRRAMNPGNYKPDGSIKQGVKLTWNNSKRYKRIQHQYAMIQHHQADIRKQQHNELANYLLTLGDCFFVENMSYCDLAHRANKTEISEKTGRYKRKKRFGKSIANKAPAMLITMLKQKCQSRGLEGVKEVDTHVCASQYNHQTDTCIKKALENRWNIMPDGERIQRDLYSAFLLQHCRRDLPEYNRKELQKEFGEELYRVFDREALQRDYPQFVAYHHMTIQRLSELPHTIPSMGIRRIIS

SEQ ID NO: 1846 - protein, 427 aa, unidentified
  REGION 1..427: note = Description of Unknown:uncultivated organism sequence
  REGION 1..427: note = Category: MG81 effectors
  REGION 1..427: note = Description: MG81-124 effector
MKYYYQHFKENIGSSVAVHGIASQVWTAFEKVLFSKDGKMVHFKKKGELSSLRGYSQAGKSGGVEIIFRGSYVEWKGLKLPLKLSPDNDYETEMLSKRVKYVRILRQDGKTKPHWYAQLVLEGKPAIKRDPASGTPKHPIGHGVVGIDIGTRTLAYSADSKVDLIELADRVQNIEQEKMLLQRKLDRSRRATNPENYKPDGTIKKGVKLTRNKSKRYRKIQHQLAMLQHRQADIRKRQHNELANYLLTLGDCFFVEDMDYRALTRKAKKTEISEKTGRYKRKKRFGKSIANKAPSMLIALLDQKCKSLNLEGVKKVDTAVKASQYNHQTDECKAKELKERWNIMPDGERIQRDLYSAFLLQHCRRDLPEYNRKKLQETFGNELYRVFDREALQRDYPKFVEYHRETIQRLSALPKTIASMGIRRSIS

SEQ ID NO: 1847 - protein, 550 aa, unidentified
  REGION 1..550: note = Description of Unknown:uncultivated organism sequence
  REGION 1..550: note = Category: MG81 effectors
  REGION 1..550: note = Description: MG81-125 effector
MGWKSKGRGGTLVDNEEKKEDGATCCLTLPLKLEKWQSDHLEKRFEIARQLYNTLVHAELKKKCQVERMPEYQEIMKMIDTASNQKEKWALEKKRKAFLEENGFSRNAFKADMEKYYKHFNDNIGANVALHGITAQVWIAFDKVFVDNYKQKGKVHFKKPGELCSVQGYSQKKSGGKEIMFREDRIIWNQQGNRDRKKVKREFLLKLSPNNPYEAEMLKRHVKFVRILRKDGKTKPHWYAQLVLEGKPAVKRDPISSAPKHPVGHGVVGIDIGTRTLAYSTDKEVNLLELADRVQNIEQEKRRLQRKMDRSRRAMNPENYNPDGTFKRGVKLTRNKSKRYRRIQHQLAMIQHHQADIRKQQHNELANYLLTLGDCFFVENMSYCDLVHRANKTEISEKTGRYKRKKRFGKSIANKAPAMLITMLKQKCQSRGLEGVKEVDTHVRASQYNHQTDTCIEKALENRWNVMPDGERIQRDLYSAFLLQHCKQGLPEYNRKELKKEFGEELYRVFDREALQRDYPQFVAYHHMTIQRLSELPHTIPSMGIRRIIS

SEQ ID NO: 1848 - protein, 550 aa, unidentified
  REGION 1..550: note = Description of Unknown:uncultivated organism sequence
  REGION 1..550: note = Category: MG81 effectors
  REGION 1..550: note = Description: MG81-126 effector
MGWKSKGGGGTRVDNEEKEKDGATCCLTLPLKLEKWQSDHLEKRFEIARQLYNTLVHAELKKKCQVERMPEYQEIMKMIDTASNQKEKWALEKKRKAFLEENGFSRNAFKADMEKYYKHFNDNIGANVALHGITAQVWIAFDKVFVDNYKQKGKVHFKKPGELCSVQGYSQKKSGGKEIMFREDRIIWNQQGNRDRKKVKREFLLKLSPNNPYEAEMLKRHVKFVRILRKDGKTKPHWYAQLVLEGKPAVKRDPISSAPKHPVGHGVVGIDIGTRTLAYSTDKEVNLLELADRVQNIEQEKRRLQRKMDRSRRAMNPENYNSDGTFKRGVKLTRNKSKRYRRIQHQLAMIQHHQADIRKQQHNELANYLLTLGDCFFVENMSYCDLVHRANKTEISEKTGWYKRKKRFGKSIANKAPAMLITMLKQKCQSRGLEGVKEVDTHVRASQYNHQTDTCIEKALENRWNVMPDGERIQRDLYSAFLLQHCKQGLPEYNRKELKKEFGEELYRVFDREALQRDYPQFVAYHHMTIQRLSELPHTIPSMGIRRIIS

SEQ ID NO: 1849 - protein, 534 aa, unidentified
  REGION 1..534: note = Description of Unknown:uncultivated organism sequence
  REGION 1..534: note = Category: MG81 effectors
  REGION 1..534: note = Description: MG81-127 effector
MGWKSKGRGGKRVKRSSTDTCCLTLPLKLEKWQSDRLEKRFEIGRQIYNTIVHAELKKLRKLERTQQYQEIEQKLENAKQEETKELWKKKRQLLDQNGLSENHFKADMKHYYPHFKDNIASSVAVHGIASQAWTAFEKVLLSKDGKMVHFKKKGELSSLRGYSQTGKSGGIEIIFRGSYVEWKGLKLPLKLSPDNDYETEMLSKRVKYVRILRQDGKTKPHWYAQLVLEGKPAVKRDPISGAPKHPIGRGVVGIDIGTRTLAYSADSKVDLIELADRVQNIEQEKLLLQRKLDRSRRATNPENYKPDGTIKKGVKLTRNKSKRYRRIQHQLAMIQHHQADIRKQQHNELANYLLTLGDCFFVEDMDYRALTRKAKKTEISEKTGRYKRKKRFGKSIANKAPAMLITMLKQKCQSRGLKGVKEVDTHVRASQYNHQTDTCIEKALENRWNVMPDGERIQRDLYSAFLLQHCKQGLPEYNRKELKKEFGEELYRVFDREALQRDYPQFVAYHHMTIQRLSELPHTIPSMGIRRIIS

SEQ ID NO: 1850 - protein, 566 aa, unidentified
  REGION 1..566: note = Description of Unknown:uncultivated organism sequence
  REGION 1..566: note = Category: MG81 effectors
  REGION 1..566: note = Description: MG81-128 effector
MGWKSKGRGGTRVNNEEKEKDGATCCLTLPLKLEKWQSDHLEKRFEIARQLYNTLVHAELKRIHRIERMPEYREIERQIEATTDKKEKWALKNQKKQFLRKNGINRNTFTTDMKRLYKHFNDNIGSNVAQHGIVSQVLTAFEKVYIENQSGEVHFKKPGDLRSVQGYSQKESGGKEIMFRNGKIIWTQQENDDRKKSPKYQQRKKRQNYKGVKGIAREFPVVFSKNNPYEAEMLTKHVKFVRILRKDGKTKPHWYAQLVLEGTPVAKYDPISGAPKHPVGHGVVGIDIGTRTLAYSTDKEVNLLELADRVQNIEQEKRRLQRKMDRSRRAMNPENYNSDGTFKRGVKLTRNKSKRYRRIQHQLAMIQHHQADIRKQQHNELANYLLTLGDCFFVENMSYCDLVHRANKTEISEKTGRYKRKKRFGKSIANKAPAMLITMLKQKCQSRGLKGVKEVDTHVRASQYNHQTDTCIEKALENRWNVMPDGERIQRDLYSAFLLQHCKQGLPEYNRKELKKEFGEELYRVFDREALQRDYPQFVAYHHMTIQRLSELPHTIPSMGIRRIIS

SEQ ID NO: 1851 - protein, 534 aa, unidentified
  REGION 1..534: note = Description of Unknown:uncultivated organism sequence
  REGION 1..534: note = Category: MG81 effectors
  REGION 1..534: note = Description: MG81-129 effector
MGWKSTGRGGKRVKRSSTDTCCLTLPLKLEKWQSDRLEKRFEIGRQIYNTIVHAELKKLRKLERTQQYQEIEQKLENAKQEETKELWKKKRQLLDQNGLSENHFKADMKHYYPHFKDNIASSVAVHGIASQAWTAFEKVLLSKDGKMVHFKKKGELSSLRGYSQAGKSGGIEIIFRGSYVEWKGLKLPLQLSPNNEYETEMLSKRVKYVRILRKDGKTKTHWYAQLALEGKPAVKRDSISGAPKHPVGHGVVGIDIGTRTLAYSTDSEVNLLELADRVQNIEQEKRRLQRKMDRSRRAMNPGNYKPDGSIKQGVKLTWNNSKRYKRIQHQYAMIQHHQADIRKQQHNELANYLLTLGDCFFVEDMDYRALTRKAKKTEISEKTGRYKRKKRFGKSIANKAPSMLIALLDQKCKSLNLEGVKMVDTAVKASQYNHQTDECKAKELKERWNIMPDGERIQRDLYSAFLLQHCRRDLPEYNRKKLQEAFGNELYRVFDREALQRDYPKFVEYHRKTIQRLSALPKTIASMGIRRIIS

SEQ ID NO: 1852 - protein, 550 aa, unidentified
  REGION 1..550: note = Description of Unknown:uncultivated organism sequence
  REGION 1..550: note = Category: MG81 effectors
  REGION 1..550: note = Description: MG81-130 effector
MGWKSKGRGGTRVDNEEKEKDGATCCLTLPLKLEKWQSDHLEKRFEIARQLYNTLVHAELKKKCQVVRMPEYQEIMKMIDAASNQKEKWALEKKRKAFLEENGFSRNAFKADMEKYYKHFNDNIGANVALHGITAQVWIAFDKVFVDNYKQKGKVHFKKPGELCSVQGYSQKKSGGKEIMFREDRIIWNQQGNRDRKKVKREFLLKLSPDNPYEAEMLKRHVKFVRILRKDGKTKPHWYAQLVLEGKPAVKRDPASGAPKHPIGHGVVGIDIGTRTLAYSTDSEVNLLELADRVQNIEQEKRRLQRKMDRSRRAMNPGNYKPDGSIKQGVKLTWNNSKRYKRIQHQYAMIQHHQADIRKQQHNELANYLLTLGDCFFVENMSYCDLAHRANKTEISEKTGRYKRKKRFGKSIANKAPAMLITMLKQKCQSRGLEGVKEVDTHVCASQYNHQTDTCIKKALENRWNIMPDGERIQRDLYSAFLLQHCRRDLPEYNRKELQKEFGEELYRVFDREALQRDYPQFVAYHHMTIQRLSELPHTIPSMGIRRIIS

SEQ ID NO: 1853 - protein, 536 aa, unidentified
  REGION 1..536: note = Description of Unknown:uncultivated organism sequence
  REGION 1..536: note = Category: MG81 effectors
  REGION 1..536: note = Description: MG81-131 effector
MNNEEKEKDGATCCLTLPLKLEKWQSDHLEKRFEIARQLYNTLVHAELKRIHRIERMPEYREIERLIEATTDKKEKWALKNQKKQFLRKNGINRNTFTTDMKRLYKHFNDNIGSNVAQHGIVSQVLTAFEKVYIENQSGEVHFKKPGDLRSVQGYSQKKSGGVEIMFREGKIIWNQQGNNDRKGVAREFPLKLSPDNSYEAEMLKKHVKYVRILRNEGKTKPHWYAQLVLEGTPVAKYDPISGAPKHPVGHGVVGIDIGTRTLAYSTDKEVNLLELADHVQNIEQEKRRLQRKMDRSRRATNPENYNPDGTFKRGVKLTRNKSKRYRRIQHQLAMIQHHQADIRKQQHNELANYLLTLGDCFFVENMSYCDLVHRANKTEISEKTGRYKRKKRFGKSIANKAPAMLITMLKQKCQSRGLKGVKEVDTHVRASQYNHQTDTCIEKALENRWNVMPDGERIQRDLYSAFLLQHCKQGLPEYNRKELKKEFGEELYRVFDREALQRDYPQFVAYHHMTIQRLSELPHTIPSMGIRRIIS

SEQ ID NO: 1854 - protein, 534 aa, unidentified
  REGION 1..534: note = Description of Unknown:uncultivated organism sequence
  REGION 1..534: note = Category: MG81 effectors
  REGION 1..534: note = Description: MG81-132 effector
MGWKSKGRGGKRVKKSSTDTCCLTLPLKLEKWQSDRLEKRFEIGRQIYNTVVRAELKKLHQVERTPQYREIEQKLKEAKQEEAKELWKKRTQLLSKSGFSEYGFKSDMKYYYQHFKENIGSSVAVHGIASQVWTAFEKVLFSKDGKMVHFKKKGELSSLRGYSQAGKSGGIEIIFRGSYVEWKGLKLPLKLSSNNDYETEMLSKRVKYVRILRKEGKTKPHWYAQLVLEGKPAIKRDPASGAPKHPVGHGVVGIDIGTRTLAYSADSKVDLIELADRVQNIELEKMLLQRKLDRSRRATNPENYKPDGTIKKGVKLTRNKSKRYRKIQHQLAMLQHRQADIRKRQHNELANYLLTLGDCFFVEDMDYRALTRKAKKTEISEKTGRYKRKKRFGKSIANKAPSMLIALLDQKCKSLNLEGVKKVDTAVKASQYNHQTDECKAKELKERWNIMPDGERIQRDLYSAFLLQHCKRGLPEYNRKKLQEAFGNELYRVFDREALQRDYPKFVEYHRETIQRLSALPKTIASMGIRRIIS

SEQ ID NO: 1855 - protein, 334 aa, unidentified
  REGION 1..334: note = Description of Unknown:uncultivated organism sequence
  REGION 1..334: note = Category: MG81 effectors
  REGION 1..334: note = Description: MG81-133 effector
MLKKHVKFVRILRNEGKTKPHWYAQLVLEGKPAIKRDPASGTPKHPVGHGVVGIDIGTRTLAYSTDSEVNLLELADRVQNIEQEKRRLQRKMDRSRRAMNPGNYKPDGSIKQGVKLTWNNSKRYKQIQHQYAMIQHHQADIRKQQHNELANYLLTLGDCFFVEDMDYRALTRKAKKTEISEKTGRYKRKKRFGKSIANKAPSMLIALLDQKCKSLNLEGVKKVDTAVKASQYNHQTDECKAKELKERWNIMPDGERIQRDLYSAFLLQHCKRGLPEYNRKKLQETFGNELYRVFDREALQRDYPKFVEYHRETIQRLSALPKTIASMGIRRSIS

SEQ ID NO: 1856 - protein, 538 aa, unidentified
  REGION 1..538: note = Description of Unknown:uncultivated organism sequence
  REGION 1..538: note = Category: MG81 effectors
  REGION 1..538: note = Description: MG81-134 effector
MNNEEKEKDGATCCLTLPLKLEKWQSDHLEKRFEIARQLYNTLVHAELKKKCQVERMPEYQEIMKMIDAASNQKEKWALEKKRKAFLEENGFSRNAFKADMEKYYKHFNDNIGANVALHGITAQVWIAFDKVFVDNYKQKGKVHFKKPGELCSVQGYSQKKSGGKEIMFREDRIIWNQQGNRDRKKVKREFLLKLSPDNPYEAEMLKRHVKFVRILRKDGKTKPHWYAQLVLEGKPAVKRDSASGAPKHPIGHGVVGIDIGTRTLAYSTDKEVNLLELADHVQNIEQEKRRLQRKMDRSRRATNPENYNPDGTFKRGVKLTRNKSKRYRRIQHQLAMIQHHQADIRKQQHNELANYLLTLGDCFFVENMSYCDLVHRANKTEISEKTGRYKRKKRFGKSIANKAPAMLITMLKQKCQSRGLEGVKEVDTHVRASQYNHQTDTCIEKALENRWNVMPDGERIQRDLYSAFLLQHCKQGLPEYNRKELKKEFGEELYRVFDREALQRDYPQFVAYHHMTIQRLSELPHTIASMGIRRSIS

SEQ ID NO: 1857 - protein, 554 aa, unidentified
  REGION 1..554: note = Description of Unknown:uncultivated organism sequence
  REGION 1..554: note = Category: MG81 effectors
  REGION 1..554: note = Description: MG81-135 effector
MNNEEKEKDGATCCLTLPLKLEKWQSDHLEKRFEIARQLYNTLVHAELKRIHRIERMPEYREIERQIEATTDKKEKWALKNQKKQFLRKNGINRNTFTTDMKRLYKHFNDNIGSNVAQHGIVSQVLTAFEKVYIENQSGEVHFKKPGDLRSVQGYSQKESGGVEIMFRNGKIIWTQQENDDRKKSPKYQQRKKRQNYKGVKGIAREFPVVFSKNNPYEAEMLKKHVKFVRILRKDGKTKPHWYAQLVLEGTPVAKYDPISGAPKHPVGHGVVGIDIGTRTLAYSADSKVDLIELADRVQNIEQEKLLLQRKLDRSRRATNPENYKPDGTIKKGVKLTRNKSKRYRKIQHQLAMLQHRQADIRKRQHNELANYLLTLGDCFFVEDMDYRALTRKAKKTEISEKTGRYKRKKRFGKSIANKAPSMLIALLDQKCKSLNLEGVKKVDTAVKASRYNHQTDECKAKELKERWNIMPDGERIQRDLYSAFLLQHCRRDLPEYNRKKLQETFGNELYRVFDREALQRDYPKFVEYHRKTIQRLSALPKTIASMGIRRIIS

SEQ ID NO: 1858 - protein, 538 aa, unidentified
  REGION 1..538: note = Description of Unknown:uncultivated organism sequence
  REGION 1..538: note = Category: MG81 effectors
  REGION 1..538: note = Description: MG81-136 effector
MNNEEKEKDGATCCLTLPLKLEKWQSDHLEKRFEIARQLYNTLVHAELKKKCQVERMPEYQEIMKMIDAASNQKEKWALEKKRKAFLEENGFSRNAFKADMEKYYKHFNDNIGANVALHGITAQVWIAFDKVFVDNYKQKGKVHFKKPGELCSVQGYSQKKSGGKEIMFREDRIIWNQQGNRDRKKVKREFLLKLSPDNPYEAEMLKRHVKFVRILRKDGKTKPHWYAQLVLEGKPAVKRDPASGAPKHPIGHGVVGIDIGTRTLAYSTDKEVNLLELADHVQNIEQEKRRLQRKMDRSRRATNPENYNPDGTFKRGVKLTRNKSKRYRRIQHQLAMIQHHQADIRKQQHNELANYLLTLGDCFFVENMSYCDLVHRANKTEISEKTGRYKRKKRFGKSIANKAPAMLITMLKQKCQSRGLEGVKEVDTHVRASQYNHQTDTCIEKALENRWNVMPDGERIQRDLYSAFLLQHCKQGLPEYNRKELKKEFGEELYRVFDREALQRDYPQFVAYHHMTIQRLSELPHTIPSMGIRRIIS

SEQ ID NO: 1859 - protein, 522 aa, unidentified
  REGION 1..522: note = Description of Unknown:uncultivated organism sequence
  REGION 1..522: note = Category: MG81 effectors
  REGION 1..522: note = Description: MG81-137 effector
MKRSSTDTCCLTLPLKLEKWQSDRLEKRFEIGRQIYNTIVHAELKKLRKLERTQQYQEIEQKLENAKQEETKELWKKKRQLLDQNGLSENHFKADMKYYYPHFKDNIASSVAVHGIASQAWTAFEKVLLSKDGKMVHFKKKGELSSLRGYSQAGKSGGIEIIFRGSYVEWKGLKLPLQLSPNNEYETEMLSKRVKYVRILRKDGKTKTHWYAQLVLEGKPAIKRDPASGTPKHPVGHGVVGIDIGTRTLAYSTDKEVNLLELADHVQNIEQEKRRLQRKMDRSRRATNPENYNPDGTFKRGVKLTRNKSKRYRRIQHQLAMIQHHQADIRKQQHNELANYLLTLGDCFFVENMSYCDLVHRANKTEISEKTGRYKRKKRFGKSIANKAPAMLITMLKQKCQSRGLEGVKEVDTHVRASQYNHQTDTCIEKALENRWNVMPDGERIQRDLYSAFLLQHCKQGLPEYNRKELKKEFGEELYRVFDREALQRDYPQFVAYHHMTIQRLSELPHTIPSMGIRRIIS

SEQ ID NO: 1860 - protein, 538 aa, unidentified
  REGION 1..538: note = Description of Unknown:uncultivated organism sequence
  REGION 1..538: note = Category: MG81 effectors
  REGION 1..538: note = Description: MG81-138 effector
MDNEEKEKDGATCCLTLPLKLEKWQSDHLEKRFEIARQLYNTLVHAELKKKCQVERMPEYQEIMKMIDAASNQKEKWALEKKRKAFLEENGFNRNAFKADMEKYYKHFNDNIGANVALHGITAQVWIAFDKVFVDNYKQKGKVHFKKPGELCSVQGYSQKKSGGKEIMFREDRIIWNQQGNRDRKKVKREFLLKLSPDNPYEAEMLKRHVKFVRILRKDGKTKPHWYAQLVLEGKPAVKRDPASGAPKHPIGHGVVGIDIGTRTLAYSTDKEVNLLELADHVQNIEQEKRRLQRKMDRSRRATNPENYNPDGTFKRGVKLTRNKSKRYRRIQHQLAMIQHHQADIRKQQHNELANYLLTLGDCFFVENMSYCDLVHRANKTEISEKTGRYKRKKRFGKSIANKAPAMLITMLKQKCQSRGLEGVKEVDTHVRASQYNHQTDTCIEKALENRWNVMPDGERIQRDLYSAFLLQHCKQGLPEYNRKELKKEFGEELYRVFDREALQRDYPQFVAYHHMTIQRLSELPHTIPSMGIRRIIS

SEQ ID NO: 1861 - protein, 534 aa, unidentified
  REGION 1..534: note = Description of Unknown:uncultivated organism sequence
  REGION 1..534: note = Category: MG81 effectors
  REGION 1..534: note = Description: MG81-139 effector
MGWKSTGRGGKRVKRSSTDTCCLTLPLKLEKWQSDRLEKRFEIGRQIYNTIVHAELKKLRKLERTQQYQEIEQKLENAKQEETKELWKKKRQLLDQNGLSENHFKADMKHYYPHFKDNIASSVAVHGIASQAWTAFEKVLLSKDGKMVHFKKKGELSSLRGYSQAGKSGGIEIIFRGSYVEWKGLKLPLQLSPNNEYETEMLSKRVKYVRILRKDGKTKTHWYAQLALEGKPAVKRDSISGAPKHPVGHGVVGIDIGTRTLAYSTDSEVNLLELADRVQNIEQEKRRLQRKMDRSRRAMNPGNYKPDGSIKQGVKLTWNNSKRYKRIQHQYAMIQHHQADIRKQQHNELANYLLTLGDCFFVEDMDYRALTRKAKKTEISEKTGRYKRKKRFGKSIANKAPSMLIALLDQKCKSLNLEGVKKVDTAVKASQYNHQTDECKAKELKERWNIMPDGERIQRDLYSAFLLQHCRRDLPEYNRKKLQEAFGNELYRVFDREALQRDYPKFVEYHRKTIQRLSALPKTIASMGIRRIIS

SEQ ID NO: 1862 - protein, 512 aa, unidentified
  REGION 1..512: note = Description of Unknown:uncultivated organism sequence
  REGION 1..512: note = Category: MG81 effectors
  REGION 1..512: note = Description: MG81-140 effector
MPTKQKEDSNRCVLTLPLLTEPWQEHIIEKRFKIIEHLKNQLISIELRKLKNLQRTKAYKNLIKQIESVPKSERTVLYKERNKMLKDAGFSQYTFMDDMAGKKSLMQKHFESHINVQIAHKAAIDVWSSFEKFLFGTGQMIHYQKRGTLSSVASKSPKTGMFYYSDENIFKWSGGGTKPKGGIILCLRVASVKTNYEKEMVANNEIKYYRVVRKWMKTKYKYYLQITFAGKPADKHREISTGRVGIDIGTQTIAIASDKSVKLLELADKVNKNHIKKCELQRKLDRSRRYTNPDNFNPDGTVKRGTKGHKLKWNKSKHYLEIVGKIRELERKNADIRKYQHTCLANDILAMGNQIYIEPMNYKGLQKRAKETQVDEKGRYKKKKRFGKSLANKAPAMFVTILKTKVEQHGGEVYEVDIMSYRASQCDHTTGEYTKHGLNDRWRILGNGDKVQRDLYSAFLIKNSNKTHDEIDLDKCSKTYDSFKKLHDKEIENIRNEVKLRERRNISSYGIA

SEQ ID NO: 1863 - protein, 534 aa, unidentified
  REGION 1..534: note = Description of Unknown:uncultivated organism sequence
  REGION 1..534: note = Category: MG81 effectors
  REGION 1..534: note = Description: MG81-141 effector
MGWKSKGRGGKRVKRSSTDTCCLTLPLKLEKWQSDRLEKRFEIGRQIYNTIVHAELKKLRKLERTQQYQEIEQKLENAKQEETKELWKKKRQLLDQNGLSENHFKADMKHYYPHFKDNIASSVAVHGIASQAWTAFEKVLLSKDGKMVHFKKKGELSSLRGYSQAGKSGGIEIIFRGSYVEWKGLKLPLKLSPDNDYETEMLSKRVKYVRILRKDGKTKTHWYAQLALEGKPAVKRDSISGAPKHPVGHGVVGIDIGTRTLAYSADSKVDLIELADRVQNIEQEKMLLQRKLDRSRRATNPENYKPDGSIKQGVKLTWNNSKRYKRIQHQYAMIQHHQADIRKQQHNELANYLLTLGDCFFVEDMDYRALTRKAKKTEISEKTGRYKRKKRFGKSIANKAPSMLIALLDQKCKSLNLEGVKKVDTAVKASQYNHQTDECKAKELKERWNIMPDGERIQRDLYSAFLLQHCRRDLPEYNRKKLQEAFGNELYRVFDREALQRDYPKFVEYHRKTIQRLSALPKTIASMGIRRIIS

(The sequence listing continues in the following parts.)

What is claimed is:

1. A method of modifying a target polynucleotide, the method comprising contacting the target polynucleotide with an engineered nuclease system comprising:
   (a) a class 2, type V Cas endonuclease configured to be selective for a protospacer adjacent motif (PAM) sequence comprising 5'-YYn-3' (SEQ ID NO:3871), wherein the endonuclease comprises a WED II domain and a PAM-interacting domain having at least 80% sequence identity to a WED II domain and a PAM-interacting domain, respectively, of the amino acid sequence of SEQ ID NO: 215; and
   (b) an engineered guide ribonucleic acid, wherein the engineered guide ribonucleic acid is configured to form a complex with the endonuclease and the engineered guide ribonucleic acid comprises a spacer sequence configured to hybridize to a region of the target polynucleotide;
   thereby modifying the target polynucleotide.

2. The method of claim 1, wherein the endonuclease comprises WED II and PAM-interacting domains having at least 90% sequence identity to the WED II and PAM-interacting domains, respectively, of the amino acid sequence of SEQ ID NO: 215.

3. The method of claim 1, wherein the WED II domain and the PAM-interacting domain of the endonuclease comprise an amino acid sequence having at least 90% sequence identity to amino acid residues 561-730 of the amino acid sequence of SEQ ID NO: 215.

4. The method of claim 1, wherein the WED II domain of the endonuclease comprises a sequence having at least 90% sequence identity to residues 561-632 of the amino acid sequence of SEQ ID NO: 215.

5. The method of claim 1, wherein the endonuclease comprises a RuvC domain comprising an amino acid sequence having at least 80% sequence identity to RuvCI, RuvCII, and RuvCIII domains of the amino acid sequence of SEQ ID NO: 215, and wherein the endonuclease comprises catalytic residues G578-W579, K583, K641, D886, E976, or D1229.

6. The method of claim 1, wherein the endonuclease comprises catalytic residues G578-W579, K583, K641, D886, E976, or D1229.

7. The method of claim 1, wherein the endonuclease comprises at least one of the following mutations: S168R, E172R, or N577R when an amino acid sequence of the endonuclease is aligned to the amino acid sequence of SEQ ID NO: 215.

8. The method of claim 1, wherein the endonuclease comprises mutations S168R and E172R when an amino acid sequence of the endonuclease is aligned to the amino acid sequence of SEQ ID NO: 215.

9. The method of claim 1, wherein the endonuclease comprises mutations N577R when an amino acid sequence of the endonuclease is aligned to the amino acid sequence of SEQ ID NO: 215.

10. The method of claim 1, wherein the endonuclease comprises mutation S168R when an amino acid sequence of the endonuclease is aligned to the amino acid sequence of SEQ ID NO: 215.

11. The method of claim 10, wherein the endonuclease does not comprise a mutation of an amino acid residue corresponding to E172 or N577 when an amino acid sequence of the endonuclease is aligned to the amino acid sequence of SEQ ID NO: 215.

12. The method of claim 1, wherein the endonuclease comprises an amino acid sequence having at least 80% sequence identity to the amino acid sequence of SEQ ID NO: 215.

13. The method of claim 12, wherein the endonuclease comprises an amino acid sequence having at least 90% sequence identity to the amino acid sequence of SEQ ID NO: 215.

14. The method of claim 13, wherein the endonuclease comprises the amino acid sequence of SEQ ID NO: 215.

15. The method of claim 1, wherein the engineered guide ribonucleic acid comprises a nucleotide sequence having at least 80% sequence identity to nucleotides 1-20 of the nucleotide sequence of SEQ ID NO: 3609.

16. The method of claim 15, wherein the engineered guide ribonucleic acid comprises a nucleotide sequence having at least 90% sequence identity to nucleotides 1-20 of the nucleotide sequence of SEQ ID NO: 3609.

17. The method of claim 16, wherein the engineered guide ribonucleic acid comprises a nucleotide sequence of the nucleotide sequence of SEQ ID NO: 3609.

18. The method of claim 1, further comprising contacting the said target polynucleotide with a single- or double-stranded deoxyribonucleic acid repair template comprising from 5' to 3': a first homology arm comprising a sequence of at least 20 nucleotides 5' to a portion of the said target polynucleotide, a synthetic deoxyribonucleic acid sequence of at least 10 nucleotides, and a second homology arm comprising a sequence of at least 20 nucleotides 3' to the portion of the target polynucleotide.

19. The method of claim 18, wherein the single- or double-stranded deoxyribonucleic acid repair template comprises a transgene donor.

20. The method of claim 1, further comprising contacting the target polynucleotide with a deoxyribonucleic acid repair template comprising a double-stranded deoxyribonucleic acid segment flanked by one or two single-stranded deoxyribonucleic acid segments.

21. The method of claim 20, wherein the single-stranded deoxyribonucleic acid segments are conjugated to 5' ends or 3' ends of the double-stranded deoxyribonucleic acid segment.

22. The method of claim 20, wherein the double-stranded deoxyribonucleic acid segment comprises a barcode, an open reading frame, an enhancer, a promoter, a protein-coding sequence, a micro ribonucleic acid coding sequence, a ribonucleic acid coding sequence, or a transgene.

23. The method of claim 1, wherein the target polynucleotide is located within a cell.

24. The method of claim 23, wherein the cell is a mammalian cell.

25. The method of claim 24, wherein the cell is in vitro or in vivo.

26. The method of claim 1, wherein the sequence identity is determined by a BLASTP, CLUSTALW, MUSCLE, MAFFT algorithm or a CLUSTALW algorithm with the Smith-Waterman homology search algorithm parameters.

27. The method of claim 26, wherein the sequence identity is determined by the BLASTP homology search algorithm using parameters of a wordlength (W) of 3, an expectation (E) of 10, and a BLOSUM62 scoring matrix setting gap costs at existence of 11, extension of 1 and using a conditional compositional score matrix adjustment.

28. The method of claim 1, wherein the PAM-interacting domain of the endonuclease comprises an amino acid sequence having at least 90% sequence identity to amino acid residues 633-730 of the amino acid sequence of SEQ ID NO: 215.

* * * * *